United States Patent 7,868,149 (PLANT GENOME SEQUENCE AND USES THEREOF) - sequence listing, part 62

SEQ ID NO: 33371 - DNA, 808 bp, Oryza sativa
gtccgttagtgtgaaccgccgcccgtgcgcccggtccaccaaaccttagccgctgacgcaataatccttttttccttttcaaaaataattcattattgcgtcataattcaatttaaaccgatataagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgccgaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggccctttcgtacttgattaccttattccttgataccttgggttattacaatttgactagttgagctttatttatattggttcagctagatattagatataattgcttagccctgcttagaaacattagcacacattcgggataactaatgattcactattatttcatgatggtttaatgatagttcacgatggtcaatcgtgattagttaattaattaatgtgccaactaaaacctggtaatggtgggttgtgagcacatggttttgttggtcgtgctcatgacaattaaggaccggttcacgagtttcggttgt

SEQ ID NO: 33372 - DNA, 1343 bp, Oryza sativa
atgcctgcaggtcgactctagaggatcccttaaatccacgcgaatcaatgcccttctttccaaattgattaggggaaattaaaccccattgaatcctcttcaattccccccaatttccctcttgaatggcgcccccaatcgtcgggaacggccgcgcttttcccggccaccaaccatggccgccggccgccattcccgtcgccgttccgccctcccccgtggccggctccctcttttctcatataaaatgggatcctcatcccccgttctctcgttttagccccctcccgagcctccccgtggtccctagccatctccccgccgccctcctctctctcccacgccgccggccgcctccagccgcctgtgccgcctcgcccgcgcaccggccggccgtgccgtcgcctcctccagcgtcgcagccgcctcctcttccccggcgccacctccgatttgtggggaaatcgccggaacggtgcccccgccggcaaccagtggcattggtgccactgtactccctccagccggctcctgtacgtcgccggtgcgccgatcgacgccgccgtctcctccttcgacaccgcggcatcgcctccttccccggcatcacctcctcctcgcccgaagctcgccggagtggcctcgtcgtcggcgtccagtacctcccggtctccggtcggctcctgtacgtcgccggtacgccgatcgacgtcgccatctcctccgtcgacgtcgcagcgttgtcctcacctccagctgctcctcggtttcgccggaacaccgccgtgtcgccaccaacccctccacccgcctcgccggagtcctccggccgcccgttcctcctcgcttgtttaccggtcagccgcggcaccaccacctccggcatcgcagcggcaaggtcgccctcggcctcgcctccccttcgaccgaacccctccgcggtccatcgtcgttgtctccgttcgttctcgtcgtcgacgtcccgtcggtcgcccggctcgtcgtctcgcggtgccgcctccgtcatcgtcatcgcagcggcgtgttccacgtcgtccccgtctccgtgcagccactgctggctgtccctcatcgccccctcgccggccccggtcgtcgtcgtcctcgtcctctcgtcgttcccgatcgtcgtggcgttcgtccctccgtcgagccgttctcgtccgtcgtccgcgttcgtcaagcgagccgctgcagccccgtcctcgtcttcgtcctcggctccgcgtcgtcaagccttgtgccggccgcgtctcgccttcgtccaaggatcgccgccgaagccgtcccctggccgttcgtctccgttgtgcccgtctgtc

SEQ ID NO: 33373 - DNA, 765 bp, Oryza sativa
acacacccacaagtgcagcatcattgcaaaggagtacaatggagttataatataggggttaggttttgcaataaacagcatttaaaagacccttagttgctcaaagctaaatttaaaacacgatcctagaactatttaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggtttgaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacaggcggaagacgtgacatagttcccaacccatcctagccatagacaagagtaccgacccaatcccacctacggccggaacccccgggacaggcaggcaggactgagccccctagcagcaggacaccggccctgtgccatgacatctcgactaccgggccgcagctcgtgtagccttcatttgccctggagatgtccatcgaacccccgacttcgtccatctccatccgtgtacttttgtttataaccagactgagccacaaactaagccttacccactagacatgtggaagtacggtagtgctttgcaacagaggc

SEQ ID NO: 33374 - DNA, 395 bp, Oryza sativa
cccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatgagccagccatccagcc

SEQ ID NO: 33375 - DNA, 655 bp, Oryza sativa
ctcatcaattgcatctgttgctattccataacataacatgcgtgatactgtggttaccttttgtaaacatgacagtccaaggataccagtcgcatttctcttctgcacaaaatattcattatgtgcttcaatagcattcattatgcgtaaaaagagaggttgtctcattctaaacctgcacagtaattaacaataataattctcgtctatatcaattttgcaaacaaagattgacaaacaaaaggcacggctacaaacctgcgtctaaactgaacatcaaggtatgtaggttccttggaaaaataatcattatacaatctccaatgaccagtcaaattttcctgattaattactgtatgacctaaaacatatccaccaccttttgaacttcaccattgttgaactcaccgtgcactatatcaaccgccgaagaaataaattcttcgccgccatccgataaagactcctcatccaatagcatttggattggtgattcggaataagatcctctaacccaactacaacctgcccttacatggtggacattggcatgtcggtacattccacatatttccacgtactccctccgtttcaaaaaaaagaatttgggacgggatgtaacacattatagtacaataaattattacaatgaatc

SEQ ID NO: 33376 - DNA, 13335 bp, Oryza sativa
  unsure (1)..(13335): unsure at all n locations
nnnnnnnnnnnnnnnnnnnnnnnnnnnnnnnnnnnnnnnnnnnnnnnnnnnnnnnnncattatgcgtaaaaagagaggttgtctcattctaaacctgcacagtaattaacaataataattctcgtctatatcaattttgcaaacaaagattgacaaaacaaaaggcacggctacaaacctgcgtctaaactgaacatcaaggtatgtaggttccttggaaaaataatcattatacaatctccaatgaccagtcaaattttcctgattaattactgtatgacctaaaacatatccaccaccttttgaacttcaccattgttgaactcaccgtgcactatatcaaccgccgaagaaataaattcttcgccgccatccgataaagactcctcatccaatagcatttggattggtgattcggaataagatcctctaacccaactacaacctggcccttacatggtggacattggcatgtcggtacattccacatatttccacgtactccctccgtttcaaaaaaaagaatttgggacgggatgtaacacattatagtacaataaattattacaatgaatctgaacatatgtgtatccagatttttataggatggagatagtatgagcgaccatgtcactctaattttaggtcagataattagttccatgttgattttacagcaatgatggtttctaccaagaatcatcatctaccaggggagatccttggtagtgtttacttttagccgtaacaattagtctggttttctgtactaatttaaattgctttgctatccatgaacaaatatgaataaaaggagtttagtatctatttgaaaagattctgcacagatacaatttatttaaactcatattctatcatagtaatgaaatataattgctttgcttatgacttgtacttcattatggaatttctatccccaacggagtactctagatgatcaatggtgaaatgataaatgaaatgataaagagaataatcgactcttctccaacaaatgaactatcaacctcccaaaaaaattaattaatatattagattagctatctatttttccataacaaaataactatatattaactgaataaaatattgcaatgaaaaaattatttagtaattatagaattctttagtagttaggggatctttttcttctattggtgtctattagtttgtgtttgcttagcttcgtttctgctattgtgaacttttctgtgtgacttatgtaataattgtgtgtaactctttgagtaaacgctaggatgtttcattgaaaaaagtaattataacccgcaaaaaaagaaaaaagtaattatagaattcttgtatttcttcttcgacttgaataccaaattaaataaagaaaaaaatgaagtaaagaatgcattttcaaattaattctacatatgtttttatggtaagactatatattaccgtttagtacgctgtcattttattagtctccgtaaacaaccagtatttattctccaataaccaatggagggtgtggtcatagtgcacatctgggttaaggaggaccacaaaataatgtaggtactgttttcgtatatatgctatagctcagctataaattcacagctagtccttgcttcacctaggaccagtgtgatcacgcgattactcttgtagtaagctgatcatttttataaagttttatgtcaaaaaaaagttgatcatttatattgtgtagtaagacggatgattaatcatcacaccgttatatcttctggaagtgtactataatgtttaatatatctaacttgggatatatactatgcacataaacctgtgcatgtacacacgttatacatccactaaaaatatcatcgaaaattataaatctttttggtacatgtacctttagtattgcatctatgtgtaatgtatcatcttgaatttcttcacgcttagaccttgttcggttaatccccttgagggagggattaattggaagggatttagggggtgtttggatgggggtaaaaaattttagtccctatcacatcggatgtttgtacactaattagaagtattaaatgtagactaataaaaaaaactcattacataaccctggacgacgaatctattgagtttaattaatccatgattagcatatgtgatgttacattaaacattctctaattatggattaattaggcttaaaaaatatctcgtgaattagctctcatttatataattagttttgtaagtagtctatatttaaagctctaaattagtgtccaaatatcctatatgacaaggactaaagttttgtcactgatccaaacaccaccttattccacacctattttggtgtgaaattattccctctcaatccctttcaaatcaaacaagctattagggaaaaaaagcttggtttagttcctaactttttcttcaaactttcaacttttccatcacatcaaaactttcctacacacaaacttctaatttttttattcaaacttccaatttcggcatggaactaaacacagccaaagacaattatgatagaattatactattaaagctaaaaaaacccctatatattcgtagatcgagacattactctattaaattactgtatcatattacaaacataatggagtagtgatcgaagataaaaacgatagaacaaactctcccattaaataggacacattgtacaaagtactgatcatgcaacaatagtagtactctgttgcgtgttgattacccatggaccagagtagccatcatcatcacccatgctgccaatctgccatatgcgatgtcatatgcttgcgcttgcatatgtagagagatttctctccacacggcaaagctagccatccaccacctttgcttgcattcactcgccattactgacggacctaccaactgtagggcgtaggcgcaagcaccactccactgttgcagttctcaaatgcttgcacttggcttccgctcatgctcataaaaaagaaccgctgctaacgttgcgaatgccctgatatagcaagctgttcggccgccggcgcgaagaacatggagtccgtggtggtggccggagatctggccgctgcaccggcgccggcgacgccgatgtggttcgtggcgctggtcgccgtcggcctgcacgcggcggtcgtgtgggcggggacgttcctcgcgtggctccgccgcgcgttcctccggcccgggaagggcctgtgccggcggtacggcgagtgggcggtggtcaccggcgccaccgacggcatcggacgcgcggtggcgctggagctggctcgccgcgggctccacctcgtgctcgtggggcggaaccccgggaagctgtcgggcgtctgcaaggaggtccgcgcagcggcgccggcgtgcaaggtgaggaccgtggtgttcgacctcgccgccccaggggacgacgacgtcgggggcggcgagctgtcccgcggcgtggcgagggtggcggcggccgtggaggggctcgacgtggggctgctcgtgaacaacgccggcgcgacgtacccgtgcgcggcgtacttccacgaggtgcccgacgcggtctgggaggcggtgctgcgggtgaacgtggtggcggcgacgaggatcgcgcgcgccctcgtgccggccatggcggcgaaggggaggggtgccgtcgtcaacgtcggctccggctcctccgtcgtcgtgccggcgttcccgctctacgccgtgtacgcagcgaccaaagcgtaagtcaatccatccttccaatcttcaaagctatcgtgtcatgctcataagtatttttttctagtttaatcctaaatttatttctaaagctgaccaaaattagcgcaacttaacaactaaccttcttaaaacaagtcttagaaaattactgatcgtttcacgtttgttctaagtcaaacattttaaatctttaacccatctactcctataaacaaatataatttaatgtaataagatttatgaaaatactttaaatatataattcaattattggtaaactacatggcctggatttgaaaaaagtgatagtgaaagatatatgtcttacttacaacaaacgacgagtaattaaaagaaggaaaagtgttacaaaactttcgcacgtttctttgctccaagaactttcatatttgtaactattggattgcctcgagatttatatatgcatgaaggaaaaaagtagctacaaatttcttttcacacgtcacgtgtaagatcatggtgctagccaactaaatataagttatatcatagttatatatagcttgattaaaaaaagttacagtgtagttacaattataatatagttacctttcaaagtttttcgacttttcagtcaaaaaaaaacttgtagcagttttttaagatactcccaacgtaatttgactttgttgatccatgcagaaacttgactctaattaaatgtttttctatcatcggaacaaattgtgcaatttgacatctagaaacaaccatctactggcatgtatggagtacagttctacattaatagcccatcaattggcaggatggcatgacaccaccttaagtcaacacaagtgtatcatctagtggtggcaggcgccaaaaggcacgttgcagtgctatcactattcatgcaatatgtggagtacttccttcgtctaaaataataaccaaaataataacctaatacgatatgtgatggttcgtattactataaatatatataagagcactagaatatatcatactttgtactagagatatttaattatgtgccactcttacaagtggcaattaaatatgtcactgaacctacgtgtcataaactgccaatgataaattcttaattgtcacattttaaaagtagcaaatagttaaatgcacacctatcctaggtttaattattttgaaagagagagagagtatacatcccaaacttcactgcatgcaataaaaggttaaattgatttacttttttctttatcagttgttttcaaaaaagtaaatttcagatgattgcaactatatttttattaaaaattaccaatttacaataattttatatatacattttacaaatatttggagaaatacaacaataatgtacggttatatctgaaagctataaattttatttgtttgacaacttttgggcctacttatcttacacacacgcaatatttatgttggtgtatgcaagacccatatatcatatagatcaagagggctaaaggtacgtagctgtggctctgtgataaaattgctttgctattctcttagttctgtgagataccgatgcaaaattgtagcaaatttatacttttgaaaagccaagtgattgattctcagaaaattaaatgttaatgccaatttgatttaattttttatgtgagaagaatcaatgcttaaaaagactgcatcatatgggtgcatgcatataagcaattaattaataggaagtttcgatcttaaacaacaaaaaaagtgaattatatttgcatgatcttttattgttgtagttttactttggactggttatagttgaatttgggttgttgcacttcactactagaaaaaaggttttttcaggcggcccaaaacatgtgtcgcaggtggggggagaggaccgccgctaccctatcgcctgcgaaaatagaccattttcgcaggcgggcccgtggcccgccaacaaaaatcatcttaaaaaaatttttttaaaaaaaccaccaacctaaccactggcgccgccaccggcctcaccttccggccacggctctcctccgtccgccattgcctccacataggagagggaggagccgagccgccgtgtctcctccgtccgccggcctccacaggcgacgtcatcatcatcgtcgcatcaacaccgtcagtgtcgtcatcgcgtcaacgaggaggggagccagcggccggatgcgagccgtcatcatcacccgtcgtgatcggtggcggagccggcgaggagggaagccaccggtggaggaggcgagccgtcgtcgtcgttcgtcgtggccggcagcgaagggggcgaggagcgaaaccggccggcggaggcggcgaggagggaagccggcagcggaggaggagagccgttgtcgtcgctcctagtggccggcagcggagggggcgaggagggaagcggccagcggaggtggtgaggagacgagcctacgccgccgctcgtcgcgcacacaccgctccttctcggagccgccaccgctcgttggtgtcgacggcgacgccaacgccgacgccgacgctgctgctgacgccctgccgcggccttgctgagttgagttgaagataatatgcgagatggagaggagagggtgagtggtggggcggggttgagttgaagataagattgagtacttgagtctgtgacttagatatttttcggtggaggtatgattttctcaggcggaccacgtaaggttccgcttgtgaaaatcgatttttccaagcgggccacttaagcattccgcctgtaaaattaaaggtattttcgcagccggatcgcttaagtggtccgcctggataaatcgattttcgtaggcggatgacgaaaattcacctcagtttatatttttctaggcggatatttgggtccgatggtcatacccgcttggaaaaataaaaggccaatgttgctaaaaatcgtttttctagtagtgcttcagacctcccgaatcttttcttagttatgtccatcctatactcagacaaataacatgatatgttctgttcataggtgaaggatttcgctagcgtactagaaccgaagtggtttaggcggtacaaagtaaaaccatcataaatttagctagtggaaagtagaaagattgaactagggatggtctaacatgaaactaagtgcaattcactcttaaaaaaaggcaaaatctacagtgagaagatttgttgagcggtttggtgcaacattttgatgcagttgtttgtttaggtgtcacatgtatgtcgtcgtatatagttttttaagccacaaattctactggctattctcatgctatttctgttttaaattaactttattttttaatctatgttacaattaccaatataagatttagaagattaaaatatcttttactttattaattttcagtacttttgtctttaactttatcaagtccaagcccaccacgtttatcgccaactttaacaagtcctaatattttgattatttaaaaataaagtctttatgagttaaattggtgaaggaagagatgaagttattttgagataaaaaagtacctcgtattatttagtctcgtcatgtctaagatatggccgtggtatggcatatttcaacgttgaaccaaacttcccattataagtgcaagccaacgattgatcaccgtccaaatgcacatggcatatgaatgctcgttaatgtccgttcgtatatgacggaaaagttcatgctttgttcccccggcgaataacatggaggaccggccaataattatatattgagaaacgacataaataataaattaatatagcaatcatgcatatatccagatggtatattctcattgatatttcagagaaaacaataatcatttgaatataatgctgaaaacaaacaattgaagaaaagcacatctcaaagtaacttaaatatcatattgggtaaagtgtattgtcggcctttaaacttgtttgtctatatatatcatcaatgactaaccatatagtcgcgctttgcacaaattttgatcatgtttaagaacttttatatatgctttattagtttatcttagcttctagaaggttttaacataagttaatttatttacaaaatattcattggcctaactaattatagatttagctaagttatactatatgttcacatgaggaatcactagaaagtcttctggattttttttttcttcgttgtcttttgccccctctctctatttgtatcatgtgtccaagatgaatcaccagaaacatccataaattcccatatgcttagtcagtttgtgtttttttattaattcccatatgctctatttgtattaatgcatgcttagccaatatgttttgatgttgtgccacatcattgtgcaagaaagctgattcacttctttcactatatatatgagataagatttgtctaagtatatcatccagatctatgaacttttaaaatatatttttaaaattgtcatgacgcctcgagatcctacatgatgctcatttggaacaccgatatgatgctcatttggaacatcggtgttgagtcattctattttatctttttttcttctaattttcttctcttcttcccttctgttcgtgtggaaaaaacaaagaaaaaaatttgggaccgaaatatccgtgtggtatgccactttaatgtgcatgtcacataccaaatgagcgtcacataagagggaccgtaacaatttgggaatgttactcaatacataggggcaaacaagataatataagtttaggtacgtactaatctctaggtaattaatatgactgctctaacttaaatttcttatgagagcaagtttaatagtatagtccactactagctccaattcatctgtagccgatttaatagctaatttatacaatattgcttactatactattaatatatggtcccacatgtcatacacacattgcgtcttggagtccgtactatagctgactacagatctgtagcccgctgctcttctctctcatcttttatctcattaaaatatgtttgtagctagctaatagtctgttattgtacctgctctgataccatttttctaataccctttttttaggtatgttgaccaattgtctcgaagtctacatgttgaatacaagcatcacggagtggatgtgcaatgccaggtaacatttgttatctttttacaatgtttattgcctgaacatttatttcagcttcaaagtttaataaaacacccctttattttctttttggacgggctaaaagaagctatgtatttcgaaggtgccttgtaaagaactatgtgcgaaaattcattctcataggcagatctggaagaggcctgcatgcaaaataaaaggtttatttttatagacaggactgttaaacggcctacgtatgaattttctcacatgccggctccctctcctatattctcctccttgcgctaagtccttttctgtcatgtctactcctctccttagtgctctcgtccctcttctgttctcccctcctccctctatctgctctccttgatgaccgacaaaaggagcagccagcaggccctaacagaaggggcggtttgccacaagaggtctgcagaggagtgcggggtcggtggacagcggtgggagccactgcaacaacgggtggatccgctatcgcctggcaccttgatgggcagatccggccccaacgaccttgtgtcggctagacctagtggcggcagcaaaagggtagggaggggtggggccaaaggcattacatctggcgaggtgagaaggggcggatttggcaccaccagtcggatccggtagcttggagcagtgtggggctgttagcggcggatacacgatcccgacgacggtcgtggccatgggtgatgtggatctatcactactgtcactttcccctcctcttagctctctacctcccggcacgtgtggtggtgtaggcggcggtggatccatcggtagcggcctcggacgggtggatttgccgtctgcggctactgagagtggaggtggaggagccaagtagacgaagaccatagccttaacggcatgacgacgaccttgacatcaactgcgtgatgatgacagtggtgcccggtagtggcggtgacagcggccctaactggggtgtctagattcgttttgttttcttttagttgaacgtcctaatttggtcgcttaaaaataattttttacaggcggcctatgaaaatgggttctaacgtgcggttgtgtcgcacggttgaaaagatactgattttttttcatacaatagtgggaggcctttgcaaaaatgggttttcgacatttataaagatcatttctagagcgaggtgaaaataaaaggcagttatgagcacattatttaggctttgaaaatattgcatagctcatttttaacatattgtaaaataaaatactaaaattgctacaatattataaaaagtataaaattaacctaccgatattcttaatttcttttaacttctagaaaacttatatcttgtttccaaacatatattacataatggattgagtgttttactcttcttcagaagacatcgaaatgcactacaaattaacaccagaaaatatgtgcctctcattaccccatcacgtaaaataaaaaatccactacccatatgtacatcacatatttctccattgtcatctcaagtggtgccctaaccaattttttgtgcagataccattatatgtcgccacaaagatgtcacctgtccagggtaactcgccgtttataccatcacccgaggagtacgccaaggctgctgtccgctgcatcggttatgagccaagatgtgtcccctactggcgccactcgatccagtggttctttgcatctctactgccagattctgttctgaatctatggcgtctccaggttggaatccggaagagaaatcagatgaaggttctgcttggtgagagcgatcatggattcagttaaactgccataaatgttggttttgtgaagtgtgtgttaatctattcgaacaaaatagtatatacatcaatctgggatttgggtagtagtatatacttcgatgagttatgtgctgaatataatggaatggcatttagtgtttgttttgaactttgggtagtggttttgtttgcacctctagcactattttttattggtttgtgcgagttggaattattagtacttttccattcagtgtaatcgagaaataaacaatgtaaaatatgatgatgaatcttagtattccctccatcccacacgccctagtgtggatttggtcatctgcgtcaggtggaaatccacatcagtgtcggtgagtggcttggtcatagatcattggttagtgatgtgaaaactcatttgtgtcgggctggcagccgtcaccgataacagtcatctttgtcgggtgtaaataaaagaccatcatggataactctcatccgtaatgggtggtagttacgacctgtcgtggatgagagttattcgtgacagttcataattacaaaccttcacggataagaatttatgttttttgaattttaaatgcatagaaacccctaaaaatatcattaggatattccaaccatggtcacacatcactagataaaaattcatgatttttcaaatgatatgcatgcatgtcttaagtgggattcaaacccaagacctcttaacgaatgaaaatcaatcgtgccatctcacctatagaccacatgttgatcagggatcgatgctattttttttaactattcttatccaaatctgaaacaaaaatttgaaaccctagatgagttcaaacgagaacgctttcaactctttaatgtaggatatgtctccatccaaggttgtttggaaaattcaaaaaatattttggaaatagatcacatcacttataaacatattcggggatgaaaacaatcttaaatgaaaatattgtcaattatatttcatcaaaccctttgactttgatataggaaacgtctccatccgagatcaaggtaaaaattcaaaattatgtcttttaaaaatatatcttgccacttataatgcattcttgggcatataaactatctcatattaaaatattgtccgctttaaagttatagatctcatcgagatctataacttttatatatggtatgtctctatctaaggttatttgaaaatttcaaaaatttaaatttttcttcatccatgatggttagtaactaccatcctttacaaataatgttatccgtgaaggatggtaattaagacccatcacggatgagtgctctcatctttaatgggtcatcccattacactcgtcacggatgacattttatccgtgatgggatataattgagacccgttataagtcatatatgacgtgttagaactacaagccaataaagatgaccttatatcggtgaggggtcatccccgatagtcatatcttaaacgggatactttttgaactgttaggaatgactcatccgagtgaaggcattaggtaaagcactaaagtaaacgagtcgcactagcccgacactggtggctcatcaaggatgcccggatctatactagtgacaactgcacttattttggataggaggagtatgaagctactcatagcaactgccatagacaaattagtcacacaacatctaaaaataggagaaactgacatgagaaactggcaggtctatctcatttgcaagaacaagcaatagcttttgatgccagagtgaagataatactcccttcgttctaaaatataagggattttggttacctgtctagattcgtagtgttacgatatatcccatccagccaaaatgggttatgtttcagaacggagggagtataccataactgcatgagcaagcgaagcactaacagaagtggccatagccttttattagtagaggtgtgttcacttgacaaagatgaagagggcgatgatataaaccattggctagtggtgtaatctggggggatagagattactctagagtaatttggacgagtggtgttgaagacagcccgggaataacccgtgaaatggagcagtgcttggcttcaactctgaccttggaatcttcatctcatccagaatcttcatctcatccagtgtttttgcaaacaaaatataaagcgcactgcctccaccaatgaggaccctctgaatttgattttcttgataaccgggtcaaggactaagggataccgccccgggcgagccacttggtcagaatgatccgagtggtcaaacatgattgcgaacatcgaccctcgtatgtattggggtacattcggctgaaccatattaatttcacagtcggttagcttttgcttccccttctactcatgccaaggggcctccaaaaatatggtttagctcgactcggtgatcctggaatccactcgggtccatgtggtccggtttgtccttggacttatccttgccggagctaccctcaccggctggcgcctggagttgtttggcatgatcttcagcgaatttattgtagagcccatttagatcatatcataattgttgtgaggagggtgct

SEQ ID NO: 33377 - DNA, 31443 bp, Oryza sativa
  unsure (1)..(31443): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnncatttagatcatatcataattgttgtgaggagggtgctgcggctggtagttcccaatagtcgctgccaattattctggcctacgcttccgatctctctccgattaaattctctgttatctcttctctcctttgggcatggagcatccggtggcttatcgtcgtgagcatcattggttgcatctgctgacttggcatatggattgtatgtctcaaatagcttcgtcacggtggtcagaaacttgccaataaggttctcatcatggagtcgcttttgaaaggtagcgataataatgtcatccatgaccattgggtctttttttttgtttcagggaaccgcgtgatgtaatcttttagggattaatttttcttctaatggatgtgctatagatcgaactgagtaccaggcctctcgtaagtacccttgaaatttgcaatgaattgctcctgaagctcgcaccaggaatcattagatccccatggaatccccaaagccagttcctctatgagtcggtgaatgttgccggtaagtagtttaccatggccttgctatctcctccagctgctctgattgctaaagtgtatactgtcaacaaggattctggcttggtcttaccatcatatttctcgatacttgtaggcttgaatccggttgccaatccactcggtgaaggttaggagtgaacgcaggaatcccttcatcggcatcatatcctgtgatccctcatagtgagtggggaattatgatagccatggtggtcatgattttcacgctcccagtgccatcagttgagctcatctctgaggtcctcattgttcctatgatcgcgtatttcttcacaatggcgtccatcgtcgtggtggttaccaatgcgatatcctccatcctgacgattaaaagcctgtccgctactgaaggagctggtcgacggtttccattttgacgtcaccttagggatgaagcggtatgtcctttgttgcctgccaccgagtggtttttcgcagagggacgcccagacagctcttggttagggtgattgccagctagagttttaggtaactcagcgacggattggaatgtaattggcttggacggcgaaaattgcaacttgatcctcctacttgctaggaagacgtcgtggtcatcatggctttgtctttgttgagggtcggagtcacctggtggtcgggtatggcttcaagtacaaggtccaacagcatgactatcgcaacaacattgtgccgtggggcgacgaacattgtggtcgtcgtggcccatttggatgatattgtcgtgagccgtgcatcctcaggttgttagatcacaatgccaatcatgacgcagacgatcttctacctccttacgaaggtattcctcttccgcttctctctagattcgagcttgttcatccttggctcctttcaaagccatgaacacctcacggagtggggtagagtcgtcggagctatagatagtattgttatcggagaaatcagagccatccaatgagtgaatcagaacctgcacctccctaggcccatgttcagacatggtagagctatgcccaagctgaacccaagggtacatagtagactcagatccaaaagttgtgacgagaagtggaggaacctgtgtagcgattggtgacaacgatgtgtagggtggtcggactagagcaactccaatcggtcagatcgatggcagtcaggtgatcagaccggcgcatctacaccagtaagacctatctccaactggtttgagggtaacttttaattttgttagaagttttcagatttttgtgttcctaccattcacccctctctggtaggcctagttcttgtttcaatcctacaacacatataactctccaacggattgattattaaaacgtctacttaattcaaaatggaaagccaatgtcggtgacttattattcatggctattttttttctcttcctcttacttgagtccaatagaaggcactaaatatctcccatataagagcacgtgacaacacacaactctatattttccacgctattactatatggttttcccatcccgacgtctgcgtccatggatgttgggacagcggttcggaaccccctccccccacctccctgatcttgcaccgagaagataaggcgagtcaagtttttagaaaatacattgtgcgactgttggctgttgttcgtgaacgactacattcactaatcactatttcctcttcatcatggttggcagcgagaatgggaacaacaacggcaacggcaatgacaacgatggaaacggttctctttccattaccatcgcaatcattgaaaactactcccgcaaagggaagaaatggacaagctgcagtgtttgccttgccgagaaatattcgtttggaaactagaggaaacccgtgcgttgctgcaggacatactcaatattatgcaattggataggatgtgcatccatcctcaagttagaaaattaaagagataaataaatggactttttgatcaacatttgagccaaaacttcaaaaggatactacatacttaggtcatgagttaacatacaattcattagtgtattattcatcaaatgctgtcacgatgtagcttacatatagaaggttgcaatgtatccagtgacaatttatattgttctatcaaaggtagccaattcatttcatcgtcttctcatccaactatccacatgttatatatatatagctcttgtgatgggtgtttgactgatctaagtataaccacgaacacaataaatattatttagaaattcgcagaaaagaataatcaggtaatacaggatcagaatatatgcaaccttcagtaatagataagacgatgtgccaaacaactaatggtgatgatgtgctacagtgcttaatcagaattataaatttgatcttgtgtcaggatttctggaacaccttgaaacgtagtgataatctgctactacttgatgtcttgactgttccaactctctgcgtttaattcagacctaaaaggctgagacaaaagattgataagataagtcacaatggtaagaacaaaatgaaaaatccctacagtttacgatttcagaatgtcggtaaactcgtaaacaaccaaaaatagattttatgcaaccaatatttacatgtaaaagaaagaactgaagtaagagttaagtggacgcaaagcagataaattttgacattcgcatcaattgctggaacacctaaacacaaaccctctattactcttttggaatcacaaatatgtcatccaatgaactgtgcaggataagagaatggaaactgggggtgatggctgtatccatgaatccctacaaagcagatcaaacaaattcacttagccagtgcaaagttaatttctgcacacagtgataacaaaacatcctaacaatgtgaaagaaacttcgagcgattagacgaaattaaagcatgcttcaaaaaaaaaaggattggccgaagtattagttagagtctcagagataagacaaaagcagtgcttcatgcattagggatctactccatgaagtataactgatgaaggaacatgggccagcgagcaaaccgtagcgtgcatatctgtccatggatcgtacagctcaaacacctccgcaaacgtagcgcagcacgagtcaatcacaacctgcatcgaatgcaaaatcctcaaaactccgtaggacgacaatctgaactcctcagcttaaacaacaaatcaatcatgcacgcaccttggttccaaatttgaagaggaatgatgggtccgctaacattcagttgcggagcatcaagaatgcccggatcatcgcggctagaggccatggtgctgcctaagagatgaaaaggggactgaaaataccttctcacaaacatttttttttaccttgtcacaaacaattcttctgcaattcggattacctgcagatcgaagtggtggagcaacatgacttcccggatgctagcatccttggccgcccccatcatgtcggccgggagcgagacaccgcatgccgcggtgaggcgcagcacctcatcgaacccgagcaggggcccgaactcggcctcctcatagtcgttgtcgccgccatcgccgtcgccgccgccacccttgccgttgtttcctccggagccgctcccgcggtcccccacggccgatccttcgcctgtggtggcacgtggggcttgtgacccagagcaggagagggaatggtgtttggggggggcagtggggagaatagcctggaggagagctggtggaggggtctttgctcgtgagaggggttttgatggggaggaggaggagatcacggcggcggcagctgcaagggaggagaggggaggggaggcacccaaggccattgtaggggcggttgaggccagcatggcgctagggcatcgccacggggccccgcatatcttcatggtgagatacctgcagccgacgctacagacgcgcggctccgcggcgtggctggtgcgtgcnggatgaggaaggcagtgcgacgcggggaggagaagcgagcacatgcgcaggggagaaggagaagcgagtgcgccggctagcgggcccgctgcgcagctggcacgcacgcatgcgggcgggggaggggaagcgaccgcgtccggcggcggcagcggctgtgagcgatgcggatggggagaaaccaggaaagaaatgtgggctgggcttcacgcttgtgcgaacgttcagattagatctaacggctgacaattaaactgtcacgtggcttaaccacagggtatcgagaggtcatgttcaaatatatactacctctgtttttcaatgaatgatgttgttgactttttattactagtttaatcatttgcctttctcaaaaaaaactatttaattatagtttattttattataacttgttttattactcaaaatactttaagcatgatttatatcttatacatttacatattttttttaaaaaaaagacgaatgatcaagcatgtgtttaaaagttaatggtgtcatctattaaaaaaacgaagagagtatcactgagagatctcaggattatttgtatcctttcatattcactttagtaatcatctaaagcttgttctggtcctctgtggcatgttctaccataatgcgcctcacctgagctacctccttgcccaatgaactggccaagggatgtatcattcattagataataatcaaagcagctctcatcataactgatatacacaatcgtcaaagtgatttctctgaaatccatctcccaaacattgcaagacacctctccggctggtactctggtgcagtgtgtccaccaccctgggttaaatagcgttacagccgagttatttgcaattgtatacgtaatgcataatcatctattcttgtgcgttatgtcacattagtacgtttgtccagtaattaacaaggacactataattaagacaattcagtcttatcagaaagtcccagagagcagtaaattgacaaattttccctgccagctcaactaaagttcctctgtttttttaaaaaaagttatttgttgtgaagtttcaacgcctcatactggaaataacactagagcagtagagcccaccttaaaagcatcaaatacccaacatgcattttcttttcttgcatgtagttagggatgagggtatttgtttcttgttgaaaaaaaattgcatgtttctctttcttagttttgagagagagggagaagtaacttgtagttatgttgttacctttaccgtagcgaaggtcaagtcatttgcatatgtgattgtgaatctgcaaatcaataatactttaaaatgaaagtgtaattgtggaaaaaagtttgcatactcagataattatttcctatgccttttgttacagtaacaaactatatatctgcaagttataaattctcaccctgcagactgcccatcgatatgccaggctctccagtcatccacaattgggtagttgagtgatcttacccaggcttgtgtacccaaaaatggaaccacggaatcatggtcgccactatatgaaagacaaaaataagaagttgacaacacatagaaaaaaagaaaagaaaacaaccaatagtataaattcgaatggttatacgttagagggtctataacgttataagccgagaaatgagctgagaaatccttcccaacagttggaccttttaatctactactattggtgcttctgtctgtattagcggaagcaccaataataagagatcggttcttaattattaattgttgttaagagacatgcacataatctctaggcgtttcataatcataaaacttttgagatgtgaacatacaagaacttggttacctgtataccaagacacgatagcctctagatgtaagattttgatggtacttaatactgctctctatgtcctgagaataaggtagtccatcgtcatggcacctcacccactcatccacagttccctatatatgttatgaacatcaggagaaacaagaaaagtgtgatgtaaactgcaaaagtgaaacactaccagtcgatatggaaaaataatattaatttaaataccttttttattccaagattttcccgtgtgttgttgctgttagcccagaaatatgacaaatagttgggataggtctgttgatagaagaagtaatgtattgattcaggcaaaagttttgatggcgtagcaagatcttatatatgccacatcatccttcactaataattattacatttaaacatcatgcaagcatgctatattatctataattttataattattgaattttagttctttaaaatgcaagaatgttaaatcatcatcccgcataattcttatcttactataaagctataacccactaaattctaaaactctacatgcaatgatgacacatcatctttcactaataattattacatataaacatcgtacaagcatgctatattatctataattttattttataattattgaactttagagctttaaaatgaacgaatgttaaatcatcatcccatacacctatatagttcatcctcacttagttaatattatttctctcctctcatttagctatatcatatcaattgtttttgcccttagatgattaatctatggtccaaattatctctctccttttcttctctcacgaagccacatcatcttttacatttgaatcatcattctatatatactatttaaatttaaattaccatagactacatcaacttatgtaagcttatgttatctagctatcttacacattacttacttattgttattatactaaacttccacagcaacgtacggagtttcacctagtatagtatatactacgttctatttttggtactgggggttatccacaaataaggtatatatatataatgtaaacaatatctttttgaatgtaaggtatctcgttaactaaccaataatgctctctatatgtttgtcacctatcttcatttaacataaatattaggagccttctctctaaaggaaaaaatagagcaagatggcagtttgaatcaaagcattccaaagtatttggatggattatatataatttggaaagcaagagtatatttttaattaattaaattggtataactaaattggttctttctgaatttaaataataataatttgactccgtaaaaaaaactttgaattaatagtccctaacaaatgccagttaattaaacttattttaaataaatattagctagagaattatctttaacattaccaaccgatgcaaatgaatgaatgtttgatagcatggattatagcaccttgagtggaaaaaggtaattatatcacaggaaaattgtgtgctgttcattaagatcaacttacactacaatccattggaggacgtggtggccgatggtttcccactacaatctcctccagaatctttcttccaatagtaccatcatctggtttgggagatacatagatgcattttttatacaaaatatgtgcctctgaaacttctcccatgagctgcagcgaagcatcaattctagtcactttattaaagcataatcattttctaagaaaaaataaagcataactataccaggtcccatagtcatttaagaaaactacaaaggtaacccgcgcatctgtgcaagcactttatttgaagtgtcataaatctgttaccatcaaaatttaaatatttaattttcgttgacttttaattaaaatatcatttaattatatttgatatatctaactgtgtactatagggtgtgaaatttataaaggctgagcatgtatttatgtaatttgtagtataggttttaagattacatgtgctttaaaatagtatatgtgagttgtaaaattttctttcttaattgctatacgatttttgttcatatgcttatatattttgtgccttcatcaattatccaaaggttataaatgattcaattgcatggtatggattttgggggagaagagatataattcgcacccttgatgaatcatctaaaggctaaaaacaatttagataatgtggttttatgatatgatagagaattagtattaacatttttttagtggggatgaactttacagacatttaggtttttcataggctttcacaatttaggagctcataggacaggaagtgacttgagtggtgtccgagcggaaaaggccaatataagggcctgtttagttcccaaaaagttttttccaaaaacattaaatcgaatctttgaacacatgcatgaaccattaaatattgattttttaaaaaaaaactaattgcacagttaggggtgaaatcgcgagacaaatcttttgagcctaattagtccatgattagccataagtgctacagtaacccacatgtgctaatgacggattaattaggctcaaaagattcttctcgcggtttccaaacgagttatgaaattagtttttttattcgtgtccgaaaaccccttccgacatctggtcaaacgtccgatatgacacccaaaaattttcttttcgcgaactaaacaagccgaagtggcggcagtgtcagagatctggagtcctcgtatttagaattgtgcatatgacatgaaattgcggggaggcggcttgctgccggttggtgctgcggtacggccatatttgaagcacacgtgacctggtatctcagattagttaattatttttgggggaaaatgtgttttgtaattttttgagccataggataaggattgaagccatcatctgttttgcaagaaatgaagtgcatctttttgaaagtttcactttgggctaccttttgttagcgatgtttcactttgaaccaccctttagataatatttcactatgaactgagtaattttacctctattccactttggacaaccctgactctcttcttaagcatatgaatgattacaagttgcatcggcttctactctttaatggactcccatagctatatttagactattgctttcgcatatgacaagttaatgtagacagataaaaaagtcgagggtggtccaaagtgccataaaggtaaatttaacaggttttaagttaaaacatttattaaaaggtgatccaaaatgaaacaactctcaatcaagatttagatttcataaacttatttaccgtaaaaatttgaaattttaattttaggtgattctttatgaaatattgtttaattatattttatatattgaattgtctgctataatgggtttggaattgaagggttgaacatgtagtctataatatatggaggtcccacatgctatattatttttagcactgtaacatgggaacaccgatgtgattgctcatgttgttgatgctatagatgattctttctgtgtttttatgcatatgtgttgtggaaatctttagttctcctagttagttcggcactcttcatttagccttgttttagttttgatggcactttttaattacacatccactatacgcgtccacgaacaaattatttacattacattgactgcaaatctattgtagagctgatcaactgagcatagtatcatcgatatcccaccctagcagtgaacctccacatccttcccagcgcaatcttccctgaccagacgtgcaacatctatagatatttaagatttaccgagtgctggttggggcttaatattgtggtttgtttaaatcaatctaatctaatccaacggtttagaatattggactcacaaattaaatgtgaaaattaaaagaaggaagttttccattttttttcctcagatttttaagattttctctaaattattagacttgtggtttaacagcatttgtagtagtctcacatgatggtttgagagcgtttgtaagaggtttaataaacttttagtatataatagacagctttcttatttacctaaacataactataccaagttttgccttacattctcctaaattttcgtttaagcccctttgtgttgattccattagttggataaactatattaccccttgtttttatagaaatgctagcttaattaaagcatatttcacataacgaaaacaatgtagctctaaaacatcaaaagggacatcattatttaacccaaatttgaaaaccaaaatttatattttgaaacaacctttaattaagtttgacaaaatttaaaattgtaatttcacctctccctccctccctccctccctctctctctcgcgagatttcttcgaaattgtttgaagttgatttgaaatgaaagacaaaatggtgacttgtgtaatttctacatctgaaatttcatcaaatttaattacaattcagtgggaaatttaaatttcagttttcaaaatttggttcaagcaactttgttgtcttcattttttataaccgatgaagataataacaagttagtactcatactccagggagggataatatagtcatttcataaaaagctaacaaacaacttaaacgtaatgttagttaatggagtgagtatagtagggactaacatttaagggataacacaaaacttaagcacatgtaagggtttgagtgaaaatactcaaggtacgcaaggaattttcttccttcctttaaacaaagaccggctggtgctgtgggatgtagctactccctttttgactttaaacggttgaattaagtattttatctcgttttcaagatgttcgtttcttcttcttttttcacaatactcataccattatacttcatgttctctgtttagatattcttgttctttttgaattttagtgcacaaactgcaaactgaggaaaatgtgcagcgacacccgggaaaaacaaatctttacacaagagaattagagaatggtgcgttaggggcactagaatttatttcatggtaaataaagaatatctgacaaaactcctgaataactgcagagtattcctcaaaaacagagcataagttcaagcctgcttacctcactgaacctgttcaaagcttgagcgcaggttgcattcttgggattggcataatcctctcttccgcaatgctccagtatagtcttaatatcgattaagtgcatgccaatggagacacaaagaattaagcccgttctattggcattccacatctagttaactgctagttgctactgtttgtaaataaattgaagtagtacctcatatagttgatctgaaatgattccaactccgtgagcataaggcactttcgactcgtaatcgatgctttcgccggtacccgggttgccaaccagatagccctgaactttttcattagcagagccaatctcttgaacactgatcctttataggtacatggtgcaaatgatttaccttgagattaagcacaggcttgactccagcctcaacatctggtttaaatacagagcatcaattcataagctataaaatgcacatctgatgaatcatagccatacaagcaggggctagaacactattaccttctgagattttctgcaggagaaatgggacaagctttccagcgtaggattctccaccaacgtacaacggattcgagaggaattcgcgatgttgagagaaccacttgatttgacaagcagaaagaacagtacagttatttaattagagcggacacacacacacttggtgtaaattaactaggagatgatctgttgttagtgtttgtgatcgagcaccttgttgacaaatttggtgagctgcagcgtggaggagacgtcgccgacgtcgtaccccctggggtcccgggagaaggagaagccggcgccgaccggcgagtcgacaaagaggacgctggcgaccttggtccacgtgtaggggttgtaccgcagccgcggcacgccgccgtcgtacggctctatcgccagcttcaccggacctgcagcacagaggcgggtgagcggtggcgcgccggccggtgagcggtggtggttgaggttctcaccgatctcgaagaagagcgcgctgaggacggagcagcggttgccgccgttgatccagaggaggacggggtcggcgccggggtcgccctccgactcgatgaagtagtagaacagctcgccgccgttctcctcgtcgacggtcacgtacctgatcgatcgatcgagcacaatcctctctcagtctcagcttcggctgatgcagagcaggacaagaaaagaatcgaagcttagatttggtcgattttttttacccggtttcgaagcgggaagggagcgcgccatcgaggccagggaggctggcgacgttcgtgcgttcggcggcggagacgacgaggagggggaggaggcggcgggacgacggatgagcggcggcgaggaggaggcagtagcagaagaggagacggaaggcgagacgcagtcgcagggacatgatagacgtcgcctttgtctctgtctgcactctgcaggtgcgctaccgcacaagaagctcctcgtcggtcctctgctttttatgggcccgctccgtgtttaatttctactccctccatttcattataagttgtttaacttttttttctagctgaatttgatcaagtttatataaaaatatattagtattttgaacataaaacaaacatattatcaatatatattcaatgttagattttattttagatattggtaaattttactataaatttagttaaacttaaaaaaaatcaaacgacttataatgtaaaacgaaatagagttataataatataatcctgaggtatctctgctttttgatttattctgcactgagtagagttataatataatccttttggatagacacgtaacataacatctcaggcatgaaacttttggattaggtgaacaagtacggttggtacatatttaactaatctagatgtcacatgttttgattgtttaaggaaccttttaaaatatttcaaattagaactaaattttatagatttctaagtctattgcttggtatgttcatattatgattttgcatacgcaagacttttatttggtgaagaactaaaaaagcagcactctccagttttggtgtcacctactccctccgtcccaaaataactcaattcctgagtttctgtgtccaacgtttgactgtccgtcttatttaaaaaaaattatgaaaaaatttaaaatgataagtcacgcataaagtattattcatgttttattatctaacaacaatgaaaatagtaatcataaaaaaattttatatgagacagacggtgaaacgttggacacggaaacgcaggaattgagttattttgggacggagggagtaaagcttagggaacgcacagggcctcatcattatgttattccacgatgcagttttcttaaagaagtttgttattctattgtggtggttgggtgagtcagatgagtttcaagtttcagtggtctgctactacattttttttttttgtaattgtcactctgatatgcgtttagtgttgaaagatatattctacggtgtatcgggcagaaggatctcttggttacattttactaggactcgggccataatcaccattttttttaaatcctttcaaattgcttacccagattttaattcatgtgccatccaaatttccaaatttatgatggttgcttaggacttgatcttggaagggaggcgaaagaacgcagcaaagccatcaattaccatcttcaatgacttgggcaaaacaaggtcttattttcaattataagaattcatccgtttattattttggttgccttgtctttatacccacataacattatttttcttcggtaactttgatgaaatgtagtacgatgtcaatgacgaaattttgtaatgatctttacatgcattttgacacaatatcgatatgattttcctactaccaatttggttgatttctttacctgctatgtcacatgaattactgcttatcaatttctggttttgatagcgttttgatagctagccattcaagcgttgtcgtagcgttagctattaaatatgaaaaaaaaattactccatcattttcatattataagttgctttttttctagttaaacttttttaagtttagttaaatttatcaaaaataattgtatcatttacaacaataaattagtttcataatgtaacatttaacatattcgattatacatttgttttaaattgaaaatattgctattttttataaatttagttaaattcactataaaacaagttaagtttaaccttatatatatatgtgaagggatatatctattaatttattttattattttaaaatattcttatttagatgatattccctcagtttttcataatatttcttatagaaaatttaataacatctaaaatattaaattagtttcattaaatctaatattcgatatattttgataatatgtttgttttatgttgaaaataatattatgtttttctataaatttgatcaaacctaaagaaatttgatgaggataaaagtcaaacgatttttaatatgaaacggataaagtatataaaatttattatttaaaaaaattcttatttagatgatatataaaaaagtggtgacgtccaatcgacgatgaaaatacatgtccgtcatttattcgttgcgctaccactaccaaactaggcgtgcgtttgcactgtgtgcacatgaacgatgctcatcttttcagaagctatcttctttggcccggttttgttacagggttgaaaagtttcggtatgttcttctttaaacagaatatcttcttttaatataaatcatcggcaacagtctgactgttaaaaaaaaaagttttagcgtgtaacatcggactacagacacatatttgaagtattaaacgtagtctaataaccaaaaaaattgcatattccgactgtaaacagcgagatgaatttattaaacctaattaatccatcattagtaaatatttactgtaacaccacattgtcaaatcatggagcaattagacttaaaagattcgtctcgtaatttacacgtaatctgtgtaattagttttttttctatatttaatactctatgtatgtgtccaaataattcgatgtgatatgatgaaaagtttttgcgtgagaactgaaaatggcctttgtttgctttttatttttcatgatattttcagaagctagcagcctagcacagcgccgaacaacgcgaggccccagaacttggattggagtcaccccaggacttggattcgagagtcaagggggatatatgctgtgcatgcgtgccaccgcgccgcggcgtactctatgcaatgcatgcatatatgcggccaccgcttgggcacttgggtggtgggtgtggacgagagggatgcgtggctgcgacggctttagcaactgtgcatggacaaagacatggcaggagcgatggacggacgtactcgacgttggcacgctcacatcaggcattgttacaaggcgatggggttgtgtcgttgtgatatcgtcgaagcctgacggcgatcgacaaggacaaggccagggcggcgcgcggtggcgagatgaccatacacagggggtggaggtagaggatattagagggtaaaaaaattttagctatattttatttattttcatcatatatatatatatttttcaatacaaacttagatactcgcatcagcttaaacttgattaaagtagagtaaattaatcaagtggcaccaccctccatttcgttttagctccgcccctgaccatacatctgagagttggtgagaaggtggcgtaatagttgaagataaaacccgactgatgaagattttatagtatggtagaacaccagctctcaaatcctaattttaaattttaacatcggttatagctcttatatatatatatatatatatatatatatatatatatataaaagagcatttccagcatgaaccctaaaccaagcccccaaacaattttataagggttgaggccaaaaatctagattcagcagagatctcatttaagacctcaaaataggaaggacctcaaatccctctccatagagtcccagtcctagaggctctacccacaacatccatctacatttttttggtgcgcgcgggaggaaaattctcttcgtgcgttgccttccatcctaccgtgggcgttgtgccgccgcttctctccccgaacacacccacacagcaaatccagtgagaaccaggtaggcattgccatgttgtcggttgtcctatgacatgttccgcttcggcttatttttttggtgcgcgggggaggaaaattctctttgtgcgttgccttccatccctacggtgggcgctgatgcgccgccactgctctccccgaacacacccatgcagtatatccagtgagaacccaggcgggcattgccatgccatcggttgtctatgacatgttccactttggctaacccaacctgacgtcccccaagcacctccgctgagtcaagcttgggcatcgccaagccgctagccgtcctctggcaagtttcactctgttcgcaccctcccaacccgtgcgctacaccatcagccatggtagcctcgctcacgcaatcatgcacaaatactagcttgtattaagatcttcaccaaccacatgagtaggagaggaagtaagtttttgcagttctttactttctgcgtggcgatgtccacaaaggggctggccggtgtgggtggaggtcgaagagggtggcggcgtggaggtagttggcgttgttgctactgattcaacgacacgaagacaacgacatagaatgcttagaatgctcggagattgatctctctaggacaacaacgacaacggcagagaaaaaaaaggatcaccgccccaggagatcagaaccctcctagggatgatggcagtggaagtgtgagagaggcgctagatcgcccactctaataccaagttgaatagtacaagaaaggagatattctgaatattagacacgttgtattaaggctcaggggccggtatatatagaataatactttggtagagataaagaaagatcaaagataaggaaggagttcacacaaatcaatcgtatcctaatacatttctaactatcatatatgttagattaatgggctaggcccaattaaatcctaataaattccattggcccacattaaatgctatgggtaataataccaccttggaaatctatgtgaagaggcctcaacttaaatacggagctagtggagagtctctgttgatcgattgagatggtgcgcggacagcaggcagggcgaggcgaggcaggtagctgctctctctctctctctctctctcattttgtaacggaccgtaataaacacggagaattgatttcgtattaatgagtgcgtcggttacggaattaaacgccgtgaattgattccatattaacgagcgcgtcggttacaaaattaaacaccgcggttgatgtaacggaccgtaataaacacggagaattgatttcgtattaatgagcgcgtcggttacataattaaacgccgtgaattgattccgtattaacgagcgcatcggttacaaaattaaacaccacggttgatgtaacggaccgtaataaacatggagaattgatttcgtattaatgagcgcgtcggttacggaattaaacgccgtgaattgattccgtattaacgagcgcgtcggttacaaaattaaacaccgcggttgatgactccgaatgttactctcgcgatcacatatatatactcggcagcgaccagaaggatatggagaagttcttcccgacgtctcttgtgcttcgagttcctcctcctctgttcttgcgctgcagaatccttccctggttctgttcacctgcgcgcacaggtgtacgggatgagcaggtgcctccggaattccgtccgcttgagaacctgtacgggtaggcgggcgatcaagtttttgggtagcacttcaagcgcgactgctccggttcttcgacgacaacgttgcatcttcctctgcttctgcttcaccatagcttctactggagagaacaaaggagacaacatcaacagaggcaatacgaattcctcaacatcttctgcaccgttctctgggtataagattgtaactttatttgattttcttcttattatttacatgttcacaatgttatccataggatttcaatcctatgtgaatatcaacgatgtctatacttattttaccttaaacatctcatcaccagatcgtttctcattgtgtatgccatatttattgtcataatattttggattaaaatataccgaattatgaccaaattttcaacaatatactctaacaaaaacacctctagcagttctggtttctcatttgaaggcccaactctacctactacccttcagcagggcccatatccaagccaacaaacccactaacttttttaaacttttaattttaaaaatcgatcatctcaatacttatttttatttttagatctaaacattttttttctatttcactccgcctgatgtgtggcgaacaacattgtcacgtcattagtaattcatgtcacggttttatcgtgccagttttatcttgtcacactagtacaaatgacatggtaagacaatactaccacgtcagccaaaatgacatggtaaaataacactgccacgccttcctcctcctgcgcgtggttcaaccactcgagctgcgacatgacagcgccagggatcttcaccttatcagcctcacaccgtcagtccgcggatccaagaattttcttaagcgtgaacaagcttaatagtagataattactaataactactagcccctctagttctcagcccaggtttccagtgctccaaacaactccacccaaatcactccaaaggacgacgcgccgccctcgctctcgtgtttcatagcctccgcactccttgtcgcacatccccgcgggcatgcccgttgctgcgggcgcagctcaatttaagggtattcaggtgaatatctaagatttttgaaaaaaaaatatatttgtatgagatatatgtctcatatgaatatgaaaaatatagaaaagaggcctattaatcgaaagaaaagcccaataagaaagcctggcctcctctcctcattatgcaggcccagtagccaagaaggccccaaaattaagtcaccctagaccacctcctggtcccaacttcgccccgctgaaacaccgcggccgcgccgccaatcgccatcgcggggaggtgttgttttttttttttttatcccttcccattttgaatacccaacctaaaaattctaagcgcgcccctagcggcgacgagcaccgcagggcacagccgcgcagggtataaggattcaggactcaatcaggagctctcaggttgcagacttgcagaatctcctggttctctaatggcagctttggctgcgcccgcgctgcgccgtctccgctcgccgcggctctgccttgccgccacggtcaattgcatcagcaacaatgccgccccggccgcatccgctggggtcaaccatgtgcaggactcgaactggcgcgtcgcggagctggccgcggccgggcgagtctcggacgcccgcaggctgttcgacggaatgcccgaccgggacgtggtgtcgtggacggcgatggtcgccgcgtacgcgcgccggggcatgctccaggaggcgcgggtgctgttcgaccgccctgatgcgcgccggaacgtggtcacctggacggcgctgctctccggctacgcgcgcgcacgccgcgttgacgaggccgaggccctcttcgagggcatggcggagaggaacgtcgtctcttggaacacgatgctggaggcgtataccgcagttggccgcgtcgaggatgcgtctgcccttttcaatcgcatgccggtgagggatgctggctcttggaacattcttctgtgtggacttgtgcggtcagggagtttggagagggctcgtaagatgtttgagagaatgccagtgagggatgtcatgtcatggaccacaatgatttctggccttgcacggaatggaagcgttgacgacgcttgggttctgtttgatgccatgccagagaggaatgttgtttcttggaatgccatgatctctgggtatgcacgaaaccacaggattgaggaagcacttgatttgttcacgaagatgcctattagggatgttgcttcttggaacattatgatcactggctttatccagaacaaagacttgaagagtgcacggcaactttttgatgagatgcctaaaaggaatgtgatcacttggaccaccatgatgaatggttacttacaatgcatgcagagtgaaatggcactaaaattatttaactgtatgcttgttcaaggaatccaaccaaatcaagtgacatttctaggttctcttgatgcgtgcagcaaccttgctgcactctgtgaagggcagcaggttcatcagatgatatgcaaaacaccatctcagtttgatacttttgtggaatccactctaatgaacttatatgccaagtgtggtgaaattaggctggcaagaaatgtgtttgatttctcaatggagaaggacttaatctcatggaatgggataatcgcagcatatgcacatcatgggtttggcatagaagcaatgcatttgtacaaaaatatgcaagaaaatggttataagcctaatgatgctacctatgtgggattgctctcagcatgtagccacgccggtttagtggatgaagggcttaagatctttgaatccatggtaaaggataactccattgtagtgcgtgatgaacattacacttgcttggttgatctttgtagccgagctggacggcttgaggatgctaaaagattaattagctggttcaagattaaacctacatcaagtaccgtttggagtgcccttctaggtggatgcaattcacatggaaatgaaagtattggtgatttagcggctaaacatctcttggaagcagaacctgataatgctggaacttatactctcttgtgtaacatttatgcttcagctggtaaatggaaagaagcagcagaaattaggtcagagatgaatgttcgagggctaaagaaacagccagggtgtagttggatcgaggtggcaaataaggttcatgtatttgtttcccgtgataaatcccacagtgaatctgacttgatcaatgatctgctgcaggatattcatcgcattatgagaatggctggtactgttcccagggaccatatgcttattgatgtggagctagtggggatttaaaagtaaataaaatgatgaatgtccgattaattttccagcacaagaattagcatagcttttagaggagtttggacctgtgcggacagtggtaccttgacacctcccctagcacagcccaatcctttatttgcattcttagcagcatgcgcatgtgctctgttctggttattcatcaatctgggtgatatatgtgaggtaggtctttgcagaagccttaaccttaccaatttgttatgtgtaccttacctctgggacaaggaataatgcactcacaaacggaatatagtggtctatattccggcgtgacataattcttggattctactttgctgattcagtggtagctgttttttgttgtctgacagcacctgctttcccaagtatgttatttaccagaataccaattgaaagtttactcctgtaatatcatctattctgtttctttgtttagataattatttcataagtctaagttttgtctatcctgctcctttcccattactgcttggacgaatggttcaatcgcagaattaacttcttttttttaaggatccttcatatttaaaactgtaactgcaactagattctttaaattggccactgaactaatataaatggcaatcaatcattttcattgtgtgaatcaaaacaagattaaggcaatgtattgtttatagatatcaagtgagaaattgtcaaaaataacatttctgatggagaaattctacgatacatggataatcaatatgtatcagatagagtaaattccctatgtacccatgaaaactcacttaatccctttcatacccctgaaatttacccgatccattctatgcccctgaaattttagcttgatctcttccatgcccctgctgttacattttccttcttttcattgttatgtttggttgcaaatgtctgttgtgcccttgatgattaatttagatttgaatataagcttgaaaaacgattaaagtttttgtttgagtgcacagtatgtgaattttatgaaactaatgagactatattattagagcaaaaaattttgaaaataaaacaaatgtaataaattaaaaattgtgtttgaaattttaataggataatggattttttttgatcgggagtattcataaaaacaatatcgtgagcattggtagtcatatctctgtatgaatgctcctcattttttatgttttttttaaaaataaataaataaatattttttatttcattatctaaaaataaattgtcataaataatgtatcgcacagtaaactcataactatagtaatctcatgtggcaaacatttacatttttaataatgtaattcgtaaacttttatgttcatccaaatggtaaaatgaacatttttatagaaattagacggttaactgacaggagggacatggtagggatcaaaaatcaaattttagggtatacaagaaagtaagcaaaatttagaggcatagaagggattagctaaaatttcggaggtatacaagggattttctctatcaggtattatggtacatggatcatctacatgtatctgtatttataagcatgattatccttgacttgttaataggtcatgaatttgtttattgctcttaaggagtcatcaattatttctgtatggtagatttcgaatgcatgactgcttttgtatgctgatttattaaaattttgtctttcatgggcaacgtgcatgtgcaggaaagtcggatcattttagttttacgactttggaagccatgtgctccaggactccgccaccattgaaaatctgcacagcagcaggtgttgtgctctttgaattaaaatatgttattctcaacgcggcaatgagctgtgccatggagggaaacctaaggctggatcatggtgagacccaacatgaaagaggagtgcaatggtgactagtgcatttatccagatctcaaatggcttagttgattcctttatattcttggcattccagttcgggggtggtatgcgaatggaggacattagaaagtagaaactgatgatttttgccatagggtaatttcgaagtgtttctgggggctaaactcagtataccaattggacatctcaactcaaggttagcttttttctctttctttactgatcattattctgttaagaaatatattttgccatcttattggaggatctgagattcaggtgatttcatttctttgcatggatttagaatatggacgtaggaaaaaataattattttttgggcttatacaagttgcataagattaaggttatggtttatgttatcagttttccttgatctgttcatgaagaatcaaatgggcttacacaagttgtacaagattaagctgcatgttttctgtggtcgctttccctttatctgttcctggagaatcaagacgatttttctagcagtagttaaaaatatatgagtcctctacctcctattaactcctaagtgattgtatttcattttgttggatgttaattttatatactatagtgtggttcctaacctatatggttgtccctatgctactatacagaccaaaatggtggataataagtccaaagacatgtcacacttgtatatgaaaaaaaatgcaaaaaaatgtaagacgaaacaagtatagctatgatttttttgttaagattttcaagttaaatgtgcttaattctgtccatattgacatgtccaaagtatgcagctgttatttttcacggaaaggccggaatcataataatcctgaaatcttgtaagtattcctttttcagtttgttctctggaacgggtaatgagtaatgaccacaaggaaatggcgccggtaatgctgtactcaccagatatttttttccttggtgtcaaggaaattactcccaaaaacaatggcacctgttgggacccaaggtcatgaataaaatagggatatgcgagaaaatgttttcccctgctactcgataaagtgtttgtcacagttactgtttcagtaaaaatataatacgtgttgctacagaatcaggctgggttttatcgccacagtatattcatgcaaaattacattaattgtaattttgcaaaattatatccttgaagaattggaaacgttagtcagacagtacaatcagatggctccataaatcactagtgcatgtaagagcggttggaatggtcttccagcatcttctatgagagtattcttaccggtaacatagccgctaagtttcgccttcatccttcacgtaccatccactcttccgttccgtacagtggcagttataccgcccagccagcgcgggcaactgcccgactccatgtacgctacccatggatcgagtgattgctttgcgttaaaatccatcattttccatcatttttctgacttccttatcagctagtcatgcagctcttttgcatgatgcaattaggccatagccaccagttgctcactgactctttcacgattcatgtgtttttcctgtggactaatcaaacgatcattcttgtgtttttcaattatctgttttacacttcaattcctatcagaatcctgtatttttcctattcctccgttttttcaaccctgcaattcaaaggggcccttagattacaaggaaagtcaacacttgagttgatgtctcttaagtcttttaggctgtgttcgcaggaggcaatctctaacccaaacaccgtgcacggaaaacggagcgatccattagcacgtgattaattaagtatttgctaaaaaatttcaaaaatggattaatttgatttttttaagcaactttcgtatagaaacttttttaaaaaatataccgtttaacggtttgaaaagcgtgcgcacggaaaacgaataggaggggttgggaaagggggcatccgaacacagctatacacaggagtggttggagatccaccttaaaaagatgtctaaagtagtcatcgtggctgtatggtcttcaaacatgacaccatcttgacatgtacccccaaccccccccccccctcctctcgccttcaatttattgctccttttgtaacctcctagcctgaggctattgtacagttttccccctacttaacacaaatacaccatgttgggtttcgtaaaaaaaaatatgacaccatctgcttccaaatgtgccagggatgaatataacaccttgtctacaaagttggtggtaatataagcctgtttagctgagaaaagcatgtttatctaacaactaaccaacacatgctacccctccatttcatttcatattataataatgagacgttttgatttatttttaagtgaaatttatttaattttaatcaaatttatagaaaacatagcaatattttaaaaaaaatatatagtataatatactcggttagatataatgaaactagtttgtgttatagatattgctacgtattcctataaatatgatcaagaaaaagtcaaaatatcttataatataaaataaaatatagagattacatagtaattcatggcaacccacgttatttgccattatggtttttcggactctttgcttcttacccatcgcatccatagctatataagatactacggtaaataccatcggttgctatagaagatacggtgaaaaacagtagttttgagagaggttgcgtcatccatctatcatgaggttgtataagtaagcttgaaacttatacaaagctgggcctatcttttcaacttattcatcggattattaaaatagataattccacactttgaaaaacttttttcttaaagattatttcttataattttaaatttatcactataattgagtgatttgtggtaataacttgctcaacaataaattatcaaaatcaaactagcccgttacttaccaggacttgtttaaaatatatatgattgaattaagataaaaaaaagtgaatattaggaaaggacctaatatcaaataattagaaggggcgagatttcgaacctaggtcgtctagcccaccaccttatggagctagccggaaaacccctgggcatttctctatgattgaattaagattaacgcgcgtcctccgcaaattaagatagcgtggtacaagggaaaagtagctttagttataatcaactagttgggtggcccgcgtaattgcgcagctagcacccaaacaaaatcatatatttttcagtataattttacttaaaatttattaaatagatatattgttgtcctaagactttgaaaggccaaatcttatcatcctcatatttctaattaaatagtttttaaaagtcacatcagttactaccccttacttatgtcatatcttacttctgtcatatccttctttatttgctttgctcgatctactactattattcattctccttagaacctttaaaaattagatcttatagttttagagtttattgtctcgttgggttttgtttttataatttctagaagttatgtcaaacgctgccattatacttctctacggcccgtccactgtcgtttctctttattgtcattgggattttaaaaatcgaacataattatcgttcgggttcttttttactttctagaagtcccgccaaaccgtcagcggctttaccattgtactcctttatggcatgcccgctgcctcccttctttattgtcattaagattttaaaatcaaatatgattatcatcggtttttttttttactttttagaagtttcgaacctttaaaaattggaccttttagtttttagagtttattgtcttggttgggtttctttttttataatttttagaagtcccgtcaaacaataccactatactcctctacggcccatctgccacctactctttattgtcattgggattctaaaaatcnaactgaagtattgnnggaattcaatnntttattttctagacgtcccgccaaccgtcggcagctctgcaactatacttctatacaccccgcctgctgcttctcctttttattgtcattgagattttaaaaatcgaatattattatcgatgttttttttactttctagaagtctcggcaaccgccttgcctgtttgcttcatggcctgcctgtcttccctctttttaatagtcattaggattctatttggtgttttattaacagtttttatacgtcgtatcaaccatcaccactctactcctttacaggcatgttacttaatttttcattatgatattttctatttataaattattttcttacttgaactcctataattatttttctgtttttctaaatttattttatttgtttttcaaaatttattttattttcggaattattttgttgctgtctagggtaggcagtaacaggccgcatgtacgttccaactttgatgcccttttatcaatcatcaatcaactaaattaataatatatattctcagtccaccatatatatatttatccataaacgtgtatgcatatgaggccttgtgttactattgtatccatggtgtccgtatacgtgtattatatatattattaaggaaaacgtatgctatagaaagaaatacatggagtagtagtgagaccttgtctgattgggtggttggacataattccaacatgatttttgttttgttgtgtagagtagcaattgttttttacctagtctagtaggattaatttctctagatagtttcctttactatagatatctaatcaatctcgaccgttataatacaggctcatcatgatttaacggttcagatttttctatttttcttcgattaatgtgggaatttctagtccccacagcgaatatggtgtctcctttcaaagctgttttaatatacatactaagcttaatcatcattagtgatgaggacacaactagctcggatataaccatgactaccttatgtattaatcaaccaaaggtgcatatgttctacattagatttacttgttatatatttgaacaaacattgctacacaatgagtttcatgtgtttttgtttgcagaggtacttgcttgggcgaaagaaaagagaccgagcgtaaggaatgcatagatgattgaagaagttgattgggaaccaaaccaagaccttcttcaagtcttatttcatctcaccacgtcacttttggtccatagaagacaagagataaagttatacacgttttgaatttagattcgggtctcctgacagcatcaacttcaaatagatctagccgctgttctagaaggaatttcggggcccatgagtacttgttggaaagcttatggagtctactttcagatggatttggtcccacatcaaaattcctaccaagctgccgggaaactgcaaaacaagccacgtatctcatccagtccgaatctgatttgcgttttgggccttgtaactgtgtcgtgggcttagcccaagggggtgtgcgccctagggcaaccctaggacgtccttaatcatatttattcattagccgtcatcgtttagagtcgggttttgcttaaattattttatcaagaacagtttcgccgctagatcgatttgtgaaaccccaaatccgagtgcttaatcattcatatgtaatttggttgcaatctatcttgttctttcttgtgttcttcgattcgcatgcagggattagccttctcggcgaggtcaaccgggtttcggcacggttgataaccagaggagacgtggtgctgcgattgcggggctcagtagcgtgttcgttcagaagccggatcgagttgtatcgcaactccgcccaaattaactgtttatcaatacctatcggaagatcgggacctaactccctcatcagttagtgggtaccagttataaagcatacaaccttttgcttatgttataaaccaaaattttaatttcaaattcgaatttttattttttttcatactagtttaatgtacagtatttttattttaaaaccaatataagcacacattatatttttctttcgctaataaaccgatctttacgaatattggattgacgaaacatcactctctcccgggcgccgccccatcccatcccccatccatgttccactgccagcccgggcccaccgcgtcggtgttctcctcattcctctctgccactgccgtccgagccacggaaaggcgagcggcgcgacgcggcgacgccctatggcgacccaccacgcccgccgcctccccgccgccgccgccgtcctcctgctcgtcctcctcgccggcggctccgcggccgacgacgcctccagcgacgacgacgcgggcgtcccgccgtcgcccggctgctccaacaagttccagctggtaacgcgcgccccacaccccccccccccgccgcccccaatccgttcccgtttttctcttcctgattttggtcagggtttggtggttggtggtggtagggtgcttagcctgctggttggcttatgggggtgacctagtggggaagggatggggatctctctttggttgtggagggggggatttgtggatctgctgcctccgtgagtgctggttagtaatggcagaggaccttgagaatttggttgagttgttcccagatggattgtgatgctgggtaaggagaggaggaatttccgagctgcacgctttagttgtgtactggaattatggatccagttggactgtgatttcgtttcattatggagttccatttagttcatttctgatagcttgaactaaaaatgatagttgatcatgtgccctgtagagatagcattgatttcttgccactttttggttgacttagctgattatctctagaaatagccactttagaccgaattggtctatttcttttttttcattttatatttttggaaaagcaccaaacgatgtacctgttttgcgcctgctgtccatgacgtatcatgtacttggtccggcttgaaccatcgaacagctgaacccgttcccctcctgcaggaaccattgaacaactttctcaaatgatgagaaaaaaacgaatagattttacaagaagcaaggaagatagtaacagaacatgttaccaggcggacagtggcatgacccatggcaacaacggttatggtggcgaaggatacaaggaggcagtacagaaataacaagcgttgggctgggctgcagtggtgtgtacttgtcctcgctctggtcctccaggcggtcctgcttcgttgacatggtgctgccactgaatcgccttgtagattagagagatgagatgggctcagctgcttgatggtttgagccggacaagcatatgatgcattgtgtctagcaagactgcaagaggataacggatgcaccacctggtgcttagcttagcaaagaaaagggggcaaaatgatgtatttcggattttcggtgaaaagtggcaatgtgttaaaccaactaagaagtggtaagaaaacaattggcctccagagaatggcaaatcctagagtgcaatctctgaacagtggcatatgatcgattatcccaactaaaatgtatttttcagttgcatggtcacttctcacttcagctgccattggtacagagtaatgcagtggcattgtctggaggcaacacagtgacta

SEQ ID NO: 33378 - DNA, 5034 bp, Oryza sativa
tcccctagcaaagaaaagggggcaaaatgatgtatttcggattttcggtgaaaagtggcaatgtgttaaaccaactaagaagtggtaagaaaacaattggcctccagagaatggcaaatcctagagtgcaatctctgaacagtggcatatgatcgattatcccaactaaaatgtatttttcagttgcatggtcacttctcacttcaggtggcattggtacagagtaatgcagtggcattgtctggaggcaacacagtgactacatgtggtacacagaagcaggggcaactgctgcatatagacatcttcacatgactagtcgtgaaccatgaaccaagaagataaaacaagatattttcttgaacaatttttgtcaccatagtagttatcttgtcccggtggattgaactgtgtagggcttaccctttaacctttcacccttttcatttaaatgttccacagcgtacttgtgaaatttcaccatgggtcaagctctcagttctattcctggtgtttgcaaacaaagacccaagtaaaatattgaatttaaaaactaacaatatagttcttatttactgttgatgccgttctgtcatataaggctaccaagtgcacatgccaatctctttctagtaatggaattttgataggcttggatagttcaagggtgccatttaggccatctcattgttttgggggtttaagtagacagacaaccaacaatgttgagggagttaaacaatctttttccttctagtgatgtctatggtagtcattttgcatgagactcatatacttgcatgtaccctgttggtgcgcaataaaagttacaaagaaaattacctatacttttagggccccttttatttgaacggaaaatgtaggaattttagaggactccaatcctatgggaaaaaaaaatcctatgaaagcctttgaagtaaaggattgaatcctatcctatcctttaaattttttatggaatgggtagtcctatagagattttggaggaaagttagcaagaggtccaacctcttggaaaaaaaatcctttgagtctaactctctcatctgattcctacgtttttcttgtggttcaatcaaacggtcattcatgtgttttttctattcctctgtttttccattcctgtgattcaaaggggtccttaagtttttccacaagggttctcatccttgagattttatccaggttaaggtgaagaattgggtaaatggaactgaaggtacaattgttgttgggttgagtgcaagatttggagcctccgtgcctcgagatattcatgaagctcagaaaacatttgctgtccttgcaaatccacttgattgttgttccaattcgacatcaaaggtttgattttaacatcaactataataaacttattagcaagtttggttctttgaatgactgctgtaaatattttctaaactaattctcgcttttgcagctaacaaattatattgctatagcacaacgtggagaatgcgctttcactgctaaagcaaagattgcacagactggaggtgcagttggtttactagttatcaatgataatgaaggtatgaaaaggttaatatgaaatatattattatatatatcctgttaatatagtcgtatttatctgttaaacttcattctttcagaactttacaagatggtttgcagtgacaacgatacttccattaatgttacaatacctgttgtaatgataccacagtcagctggaaaaaagatgaagggcctcttggatcagggagcaaggcgtaagtcagttagttacacattcttaattatcctcagtaatgctaagcttcattcatatttcttttttcctgcttatgttgccaattggtagggtttagttacttaaacatctcaagccttttacttccatggttccatctactgtgatggccaattgcatttttcatcaggtatatgttgtctgactaaaaacagaattaatgttggtttgaattcattctaacttatatttttatatttatccagtatggcaaagaaacatgatgcaataaaccatattgtaagaaaatcctcttggcaatacatcaattagagtactgagcgcttaatattccaatattgtactaagttatcaactgtacaaggcaattatctgtgttgactgttgaagttttaatctctcgagcatgccgtcccgtgctctcttgagcgagttagtgcctgcagatgagctgatcttcaggtgtattggaaaaaaaaaaggaaaggaagaaatcggctttaagtagagtttgctgggaccattttgcagattataaatggaagaattttggcatactagttaaatgcctgtgctttactatgtataaaaggaaaaaaaatcataatattgcctaaaataaataaaaacatattttttattaaatatgttgcccacccttttgcttttgggatactcaccttaattttgggtatccatttagatttagttgtcatataatattaagaagttcaaggtgtattatgtaaaaactacaatgggagtaggtggggtagcatattcactgccatcaccattggagtacttttaaaggagtctagagatattcgctcatcaggttcgtgaatcctgaccctggatctttctttgaagttctacttttaatgtcatctaacttatatcccaaacttcaaatatgtcaaaaccaacattttctaaacaaagatcatatgaaaaagaaagacaaattgctgatatgacagcttttcactgataactaaaactgtgtgcatcctgttttgcatttggttctgggttttaaaacctttatccataccaatggagtgaacaatttctgcagtctaatttattgctagtaaaggttgacacctagtatctaggtaggcgagtagcaaacacggaaggagcaatgtggagggatcttgaagcaaagcagcagctggcttgaaatagagcgacctgcttgaagcagaataatcagcattccaacaatatggtggactggcaggcagagctggtggtggagaaactcatggctatgctagatctccaagctggtgacggtgcagcttcctctctagaagtcctggtgccttatttgctctccagaaatcctgcacgctaccttttgagataacaaaatgggcaagcttcccacctggacctgtgtggacacatgcatgcacgctcacacaagcaaagtcgctcagttgactccctgtataaattggaaatctttgtgttgggtgctgtgattgcataaatgttgactagttgaagtgaaattgtacttttgaattagtagtttatggtaatacaaagtatgcatgctaacaagaatgttcttttgctgcagtggaggtgcagctatattcaccaaatcgaccagttgtagacctttcagcatgcttcttgtggataatggctataggaaccatagtttgtgcttcactctggactgaatttgttgcatgcgagcaagttgatgagcgttataatcagttgacacggaaggttttgacttttgtgctttacctttctatccaaattatgtcattttaattttatattttcacacacatatggtagcacattcatacccattttctcttggtaccactctacaatttttattcttacgatgtgaatagttttttttaccaccttaagtccttaagtgaaatggcttgaatactttgcacaagtggcaaaatatgtgatgcagactgcagtgccactaaacaatgcatcacatatagaaaatagataagttattgataaaacatgcaatatataattgaagcatataaagaccaatttcaactctatgatgtcttcggaaaattttgctgtgagttcactatttaatggaatcatgttacaatatgccttgtgttcaattttggttttcatgtattcttttaaaaaataaaatcacatgtcttccaagtatattcttttcaatcattggatgttgtttttatgtaacctgcctttcagcatttcaaaatacaacaacttatcttgttgccttgccaagaacgtccttgctgcttagaacatatctaggttctgttatatcatatttttgtagttcgtcactggattatgttttactgacagatttgttccttttcgtgctaaacaggatgggcctaattctggaacaaccaacagagaagataaagaaatcttcgagatcagtgccaagggggctattgtttttattttagtagcttcagttttcctcctcctcctcttctacttcatgtcttcttggttcgtctggctgctaattgtattattctgcattggtggtattgaggtattttctcatacatttgttatgtgcattgtgctatttcttattggtaccatcttaacacttctttcccttttgttttcattgaatgttgaagtataccttttttttttttttcattttcctttgttgagagattcagctatgagactgactatgaattttacagggtatgcatgtttgcttggtcacacttctcactaggtaacaaatgaactaatttggatataggaatttggtcaccgctgttcactttatttgcctttcttttcttatttgatgtacttcacctaacaggatttgcaaggattgtggacagaagactgtacaactccccttttttggggaggtgttgaccctttctgttctgattgtaccattttgcactatctttgcaattctttgggctgtctatcggcatgcttcttttgcttggataggccaagacatccttgtaagactaatttatcttcattcttgtgtggtctttctatattttatatatgaccttgtatggtgtgcttctcactaggaggtgcatttttttttctatattttgcttcagtaccattcaaaagtatgcaactaactgtacatgccttcagaggtaccagcaagcaagtctggattcacataatataagtatattacaatatactgtaaaggctaacatagtgttacttctgaa

SEQ ID NO: 33379 - DNA, 1739 bp, Oryza sativa
  unsure (1)..(1739): unsure at all n locations
nnnnnnnnnnnnnnnnnnnnnnnnnnnnnnnnnnnnnnnnnnnnnnnnnnnnnnnnnnnnnncgtctagaattcgtccttttggtttaaggtccctaggctttcaccaaagaacagttttgctataaatctatcgtcaaattttttccttaaaatttgacgttttttcaactgtccgattagcacctgattagggcaaggcacatcccacggttcgtgcggaagagacagcagggcgcactgatgaccaagtgaagtactgtatgtatgcatctttttctagctttgccactgtatagaacgaaagcgattgaacgataaaacgtccttaatacgggtcagagatctcccgtgatgtctatttcgtatgagcagcagtgttttaaaagttacatgcaagttacactagaattaatgtaagttacaatgtaaactataattgtactatgtttctttaaaatataaaactacagtcctatataactaaaattacatttgtaaatttatttgacatgacatgcaagtatattgtaattttggtaaaaatattatgtaagtaaatatgtattcgttattttctttaaaatataaaattacagtcctatatataactaaaattacatttgttaattcagttgatatgacatgtaagtgcactgtaattttgataaaaataatgtgtaagtaaatatgtatttgttatttttttttgtagtccgttggatgtaaatctagagatatgaaaaatctgggagatttttttttgttagaaatcacccgacaaatggataggcagaagtctaaactttcgatttatccgtccttagacttctgggctgtgttcgttgatttgggttgggaatccaactcctacacacggaaaacggagcgattcattagcacgtgattaattaagcattagcttatttttctcaaaaatggatcaatatgattttttaagcaattttcttataaaaactttttgcaaaaaacacaacgtttagcaatttgaaaagcgtgcacgtgaaaaacgagggaggggagttgggaaactggggaaaaaacttagccatgtatcagtgaacttcagaaccgaacaatattcatccctcaaattttcaaaccatatactctagacccctaatcctgaaccacggtggtttcagtttagatggcgcttatatagtactttctttgtcccaaaatataaaaacctataactggataggacgtttcctagtataacgtatcttctactagtaaatgtctcatctagttctaggttattatattttagaatggaggtagtatctcgttagcgaaaatcattcaaacgtctgtctctggtttctcttcacctttcacctttccaccttttttatccttgtgttcaacaccaccatgccctctttgtacccggatgcctgcaacctactggccatggatagaaatagatcgagtaggaagtagtaagtgaccagatatgcctcctcgtttctctgattgatgccttttgtgctccattttgtaattgatctgatctgttctgttatgaagtactagtataagtagtaagtattattttgttgtccgtggagttgagtagattactacatgtgcttctattgtgagctccggctaggtggtcgatgagctcgagctggtgcagtagagtgagaaagagcaacggaggaaaaagcagagtgaatgacattttttttttttgggaagagtgaatga

SEQ ID NO: 33380 - DNA, 2622 bp, Oryza sativa
cctgcaggtcgactctagaggatcccctgtctcatctagttctaggttattatattttagaatggaggtagtatctcgttagcgaaaatcattcaaacgtctgtctctggtttctcttcacctttcacctttccaccttttttatccttgtgttcaacaccaccatgccctctttgtacccggatgcctgcaacctactggccatggatagaaatagatcgagtaggaagtagtaagtgaccagatatgcctcctcgtttctctgattgatgccttttgtgctccattttgtaattgatctgatctgttctgttatgaagtactagtataagtagtaagtattattttgttgtccgtggagttgagtagattactacatgtgcttctattgtgagctccggctaggtggtcgatgagctcgagctggtgcagtagagtgagaaagagcaacggaggaaaaagcagagtgaatgacattttttttttttgggaagagtgaatgacatgttgaccagctgtgtgcaatttttttatttttcgaactaaccacataacacgtaagtgccacatcaactaaaaccacaataggttaaggacaacctgtataaaattaattgtttaaaaggttgagcgatgaatagtatctggttttaactttggatgtttaggggcctaaaatcaacttattgctatttaaaacttcaaaaagtagctagtatccttttataggtcaagtatgtgttgaggcgtaacatcctgttatagcatcttattacgattaaatgaatactacatataacatccataggaaataagcaacaaatatgggatgattcccgaaaaaaaattcctatattatcttctgagcacacacaatgattcttctgtgctaccttgaaattcacgggaatatgggctactgttccattggaatttggtggaaagctagctaacacgagtattgcattgctattcctaatgtttcactgcagctactaaatgaagtttcaaagccccacattttgtacaagaagtgcatttatatgtctctcatcccaaaatttgagagcatggacagaaagatcctgaaagaggagcttggaatactaaagcatcgacctccgcgcccttcaatacaatgtgttgtaagtagaacttacctcaactatatggtaatggctagttataatctatgtaaagtgagtatagaaataatatagtcgaggaagtacattactttctgaaaatatataaaataatatatatggcatcctttatatcctaaaggatacaggaacagacgcttgtttaattttatgtttctatcttataccaatttagacctgaattaaaatgaactttcctattgcagagctattccaactatttgtcatatttttgggccaacgataacgtcacacgagagtatctcggaatcaagaaggtaaatttgtggttccttcatttttctagagatgaatacacgcttgtttgcagtttacatacaaaatgtatgaagttgtcttcgaattctatacatgctaatatttcagggaagcgtggatgaatggattagatgccacgataacgatctaccgtacaccaaagatatcaagagcagcatacagtaccatcacaatgttacattaaatggttatcgtgctttagtatacaggtaaagaaaaattatcaccaagttacttgctgaagcttacattagttgattttcagaagaaaaaaaaatctgtcatagataaaagtaaatgatgtgggatatgacatagaagaggtgttttctatttgtttcactagtggattactagtaatcatgcatttgcaaggcacgttttggttatatatattgcctataatcaaacatactattttcttatattgcaaatctgacatcaatttgcggaagcaattctacttccaagaggtaaataagtaaggtggcatagttacttcacatatattacaaactttacctcatgaatcaaacttatatggtttagcaatatgaaatgttagaaatagattctgtctaaagaataacaatcattatgcttcgaaatccacatgacaatctgcaaccaccagacatttggtgttatctcaaaagataaacaaatggcagcacaatcttgaataatcggtaagatgaaaaaaagaagagaacttctaaagtcaatcttgaatggcagcacaatccattcgcctcacttgcaccaccattcccctctaactctcctctaccctgcagcgggccgccattccccttcaactcccctctatctgcagcggacacaaacgggcaaccataaaaaaaccaagtactcaaaacaaaccaatccgagacgaaacctagtgtttgcataaatgaagaccatactaatggtaccttggtacctgcgacctaattttccggactacagaaaaggatagttagtaagaacaaatgataaaaaaacatatagaaatttcgttttctacccatagtaagatagtgaataattgaaaaacaatccaattgctcaatccgtgatttaaaaaaaagaagaaaggaaaaagtggcacagtacattatcactgaataatccactcaaaaaaatgaactcaagt

SEQ ID NO: 33381 - DNA, 1228 bp, Oryza sativa
ctaaaacagcattattccgtggccggagggggtactattattactgccaagaccttctaaccttcatcggttgctttcgttgagaccttcttgctctgaattagcagttgaatctgggtttgcagctgagctcacgtttgtgggacaatgtttttctgttttatgatccaagcagttactgatttgttgatgcttgtgcaggtgaggatccagttgggtgagggctcggcggcttctgtcaccaagaaaatgcttgcaaatgagggaattagtgccttctacaaggttcgttgtcttgaggccgtggtttaaaaattccagtatttgcgttgtgcactaacccagtactgtagcatgttacacacgtacggaacctgcagttacatcatctggatggaaccccgtagtcttgtaccacttgactattacatggtctccataattgtcctttgactgctaatatctattgtaacatagttctaaattattctaaatcatcagctttcttgtcactcaaactgttattgcttaaattctttgtgtccagggcttgtctgctggtttgctcaggcaagcaacatacacaaccgctcgtctcggatcctttaggtttgtacgtactacttagcccataatatcttttgctagtaagttaaagtgactgtcaaataattaacagctttgacttgacatcctgttcttttcagctgaataataaatcagcagtatgcaatattatcttgtattgaaatgaaaacctgtggttttggttgataaaatacaacagcaaagtgcaatactatcttggatcttataactgtcctgtagatgcatatatttgtttttgaagcaatgacacttcatacctagcaaactcagcctaagtgcattaccgcccgatacccctactagcaggtattcagctaaagagtatcaaacaaaccaagtgtagtgcacctctgaaggactcctcttgtagtaaccatttaatctatcgatggttttgtttcaggattatgtcatgttgaacagtttgtcaagcagggtcactaatgtagataaagttacattgccttaattccgtaagttgcagcaaaatataactgttggattcttgagagaatcaataatagaaccttctgtcctgttgtcgggaggtgtttaacctcctacccagctggattcaatgtcctagtacaagtgtcggtgcccatccactcctggtgtg

SEQ ID NO: 33382 - DNA, 722 bp, Oryza sativa
  unsure (1)..(722): unsure at all n locations
atgaatggttcgatctggataaatggcagctagcgctagatgtcaccggactttctgtgcgaaggtcgcgaccatcggtgtgacagcatggagattacgtaggtcgacaggcgacgtcagggtgagcagcgttgtactgtcctaggaagacggtggtcagaccatggtcagcggagcaacaaaggagaaggacaatgacggtgcagtgagggcgcaagaacaatgagaaaatcatgacaacacctttcatataaccctccctaaccaaacataaccacctcaggttgacgggcgacgtcagggtgggcagcgttggactgtgctatgaagacggtggtcagaccatggtcagcggagcaacaaaggagaagggcagtggcagtgacggtgcagtgagggcgcaagaacaacgagaaaattgtgacaaaacctttcatgtaaccctccctaaccaaacataaccacctcaggtttcacccccactcctcaacaggcagtggacagccccctctcgtgcctaggtaaatccggaaacagcagagaccaaagctagttccgaactacaccatcgcctctacccttgccacagtatatcgactagattaagttatactctagatttagcctggaactcaagctggcttgtggtaagtatgannnnnnnnnnnnnnnnnnnnnnnnnnnnnnnnnnnnnnnnnnnnnnnnnnnnnnnnnnnnnnnnn

SEQ ID NO: 33383 - DNA, 5649 bp, Oryza sativa
ttttcttaaaattagatggcagatccggattcacccgctacctgggagttgagcttacctcaatcagaggggtatgtcattgagctgcatcggatgttgaggcgtctgcgatactctgggttcccgtcataccgagtgagacagtgtggctcagtttgggaggcttgggtcgaggttcacccccgagtcccttccgagttggactacagctttctgacacgtcaccaccgagacctgccagaaaccgcaatgcaggatgcagcccgagaggccttcctccgactcagctctatccaccgagctgagttagcgagtaccgagtttgctcatcacccgttccgggaggagagcaactcagtttgcacagttcaggacacgccctgctgctacaacccgatggtgactcggttgtcacgatgggctgaggcagtagatgactactacgaggaggctctgttggagattgacgaccaccagagacgtatgggagagctggagactgagttgactgacctctcagtgcagcagcttcaattggaggaggagcaccaggcttggggcagtgagatagactcactgaaggcacagctccaggtccacggcgaccagttccagcagttatctgaccagtacaacgatcgccgcgggatgatggatactcttgaggagcagctgagagagagtcaggagcacgtcagccagctggaggagcagcttcgagcagccaagatcagcaccacaggggcttctacttccacagcagtaggtcgtgaccgctacttattcctcaccctgccatacccaccggcgttccacgttcttctgggagaggctagtatgctagctaccgagtcagcaccttacctagtggacccgacagcgacacagccacctgtcccggagatggtgcacactccactgatccctacaccttctccgcagctgggttccagtttggagactccgatccaggtcgactccgagacagaggggaccgacaccgagccaaagatcgagccagacatcactgatcctttagaggatgagacccctgttccccgcatcaccttcctcggaggccctcgcaccctcagcactgctcgcaagagcacacgacctccgggcaagaggcccaagccagatccagaggccactacttctgagccgtggggacttaggtttgcgcgtgccagcgaccaccctctacctgccccaggatcctacggatggctggaggactagactgacggactccttgcagcttcgatctcgtatcagatggtttttggatagcatgcgagacacccccccctttacctagattgacgagtagtttgatgattagttcgttgtatcttttggacaaaccttaactggactgcgtatgtatgcagtcgattgcatcatgatttatgtactatttgtgaaactctgtgatgttatttatgatatctattgtggttgtgttataaatgagtttattccaccatgcttgcaaaataaagttcacatcaaaacaatctcccctaatgggataaagccgtaaaaaatagctagagaattaggatacttactcaatcaatcaacctgcacagatggcaagccgacgtcgggcaacaaccagcaatgacgaaacccagacacctgacctaaccaccctggccggagttatggccacccaaacccaactcctgcaagccattgcaaataaccaaggcaaccgtggcggatcaagctttggagagtttatgaggaccaagccacccacattcgccagagctgaagaaccaatggatgctaaagattggttaaggatcattgagaagaagctaactcttgttcgagtacgtgaggccgataaagtgatctttgcggcaaaccaattggaaggaccagtcggagactggtgggacacatacaaggaagcccgagaagaagatgctggagaaccaaactgggaggaatttaccacagacttccgtgacaacttcgtgcctgccgcggtgatgcggatgaagaagaatgagttcaggagactacggcaagggaataccacagtacaagagtacctgaactgtttcactcagctggcgcgctacgcgactagagatcttgccgacgaggaggaaaagatcgacaaattcattgaaggcttaaatgacgagttgcgcgggcccatgattggacaagaccacgatagtttctagagtttaatcaataaggtcgttagactagaaaacgaccggaaggtcgtggagcacaatcgtaaaaggaggcttgccatgaaccgcccgccccagaccgcaccccagcgtcctaaaggggcaacctcttcggcatggagaccaacagtggtgacaaccagtcgacctgccacctccagcaatttccacaggccggttaccattcaaaaccgagctcctgcaccgaatcaggccgccactggatcagtaaggccaggaagctgtttcaactgtggagagtatgggcatttcgccaataaatgtcctcatccaaacaagacacccattcgcaccggagctaatgcaacggctattcatgggactgctactcctgctgctggacgaggtctattcaggactccgcagactaacaggaccgctaccggatttggacgcgggcaagtgaaccacgttcgagctgaagaggcccaggaagaccaaggcgtgctgatgggtatgttttcactcaacttcactccagttaaagttctcttcgattcaggagcatcgcattcatttatatctctgaaagcaagtcaacaacacaatttaaccagagttaaactaaggcaaccaatgttagtacattcacctgggggtgaaatagccgtggacacagcttgcattgatgtacctattcgccttagggatgtggtgtttccctccaaccttatggttttgataccacagacccttgatgtcatattgggtatggattggttagcaaagcatagaggagtaattgactgtagacgtagagaagttaccctgatcacaccctggggatcggatatgagagcaaccatggatcaaaatcctaggctaaccgaacgtgccggaggtatatttaccatgctacccctaaagggaatgcccgtagtgcagcgatttcctgatgtgttcccagaagatttacctggaatgccaccagatcgtgacatagagttcattattgacctgatacccgcaactgcccccatatccaagagaccatatcggatgccagtcaatgagttaaaagaacttaaaaagcaaattagggagttgcaagaaaagggatttgtacgccccagttcgtcaccttggggagccccagtgctatttgttaagaagaaagacggtagcatgagaatgtgtgtagactatcgatcactgaaagaagtaactattaagaacaagtacccactaccaaggattgatgatctcttcgaccaacttaagggagctaaggtgttttcaaagataaaccttcgatcaggataccaccaactgaagattaggaccgaggatatccccaaaaccgcgttttcaacacgctatgggttgtatgaattcacagtaatgtcatttggtctaaccaatgccccagcatacttcatgaatcttatgaacaaagtattcatggattacttggataagtttgtggtggtattcatcgatgacattctgatctactccaaagatgaggaagaacatgcggaacacttacgattggttctccagaaactccgaaagcacaagttatacgcaaaattcagcaagtgcgaatttcggttgaaggaagtcgcttttctgggtcacgtaatctcagccagtggagtagcagtggaccctgcaaaagtggaggctgttacggaatggaaggcacccaagtcggtgaccgaaattcggagttttctaggcttggccggatactaccgaacgtttatcgaggggttctcaaagatagcccggccaatgacacaactactcaaaaaggagaagaagtttgtatgtacccgaacaaggaggactgcaaggattaatcctaaaggaggctcacaaatcggcatactcattacaccccggaagtaccaaaatgtaccaggatctgaaggaaggctactggtggcccaacatgaagagagatgtggccgaatacgtagcactctgcgacatatgccagaaggtgaaggctgagcaccagaggccggcaggtttgttgcaacctctcaggatttccgaatggaaatgggatgagataggtatggatttcattgttggattgcccaagactgcaacagggtacgattccatctaggtgattgtggatcgactcaccaagacggcaagattcatccccgtcaagacaaactatagcagtgctaaacttgccgagttgtacatgactaggatagtgtgtcttcatggtatacctaagaggattatatccgatcgaggcacacagtttacctcgcatttctgggaaaaagtgcatgaagccctaggaagttatcttgcttttagcacagcttatcatccacagacagatggccagacggagagaaccaaccaggtcctagaagacatgctgagagcttgtgcgttggattttagtaaagactgggagaagtgtttgccctaggccgagttctcctacaacaacagctttcaagcaagcctgaagatgtcccccaatgaagcattgcttggtcgacgatgccggacgccgctgatgtggtctgagacaggtgaacgggcggtatttggacctgacatcatcaacgaggccgaagagaaggttcgcctaattcgagaccgtctaaaagtgacacaatcacggcagaagagttacgctgacacccgaagaagggatctagaatttaaaaaaagagattacgtgtatctcaaagtttctccgatgaggggaacaaaaaggtttaaggttaagggaaaactagcaccaagatatgggggaccctttcaaatcacggctagaagaggagaagtcgcatatcagttacagctaccagagaatatcgctgatgtgcacccagtcttccatgtgtcccaattaaagaaatgcttaccagtgccggaagaacaagctccgctggaagagattcacattagcaacgatctcacgtatccagaacacccgatccggatattggatgaagtagaaaagaggactaggagcaaagtgtggcgtatgtacaaggtacaatggagtaatcacactgaggatgaagccacctgggaaagcgaagaattcttgaggacggagtacccgcatctattcgaaaactggtaagaaatctcgggacgagatttatttaagggggtaggtttgtaacaccctgaaaattcgaccgacaaaatcaaaactctaaaaatacggattttcaaaaactttttaaattaattgcatcatgcggatcttattcgtctattttatctggatttgatctcgaagattattaatcgtgagtaaagaatagttaattaggaataaaccttaaaaacaaattggtaaaataaatacaaattaaaataaagattaggtgtggatagaaataaataaaatattatcgcgaccatatttggatcaattaaatttaaatacgatggaataagaattaaccct

SEQ ID NO: 33384 - DNA, 694 bp, Oryza sativa
aaaaattaacttagaacttcagcaacaacccaacaacccctatttctttggtcccatttctatttctgttctattttaatatacacactatatatttatgcctagtttaacactagaataattcaaacacgtagaattattcaaccatatctacagtctcatcttttcacttatacttatacttatcagccaaaatttaaattttcaaccttaaatttagagttgatcttggggttttttttcatcgaaatttatttttcagcctttgcttttagaactttaagaacatatatataaaagttttattcacaaattatttttcatttgcaaatatgacatttagcttattcctcgaataagcgaaacaatggggaccctaatttacaattttgaagaccataattcaaatttaaatttaagattttcaccatttcaaaatgcataataaaatttaattcccacagtaacacacatatgcaagttcacaagcattatataatctttttctataaaataacatattctacaatgatgaatggttcgatctggataactggcagctagcgctagatgtcaccggactttctgtgccgaggtcgcgaccagcggtgtggcagcatggagattacgtaggttgacaggcgacgtcagggtgagcagcgttgtactgtcctaggaagacggtggtcagacc

SEQ ID NO: 33385 - DNA, 541 bp, Oryza sativa
  unsure (1)..(541): unsure at all n locations
nnnnnnnnnnnnnnnnnnnnnnnnnnnnnnnnnnnnnnnnnnctactgcgacgccgatgcccccaacaacactttttttacgctgagccccgtcaacaacgtggccgccctgaccttcagggctactgctccacttcatacacaccgacgcgctgccgccgacaacccagtcccgggcccgcgacacgaaggacaacgacgacgaggccgtggaggcagacgcgcttaggcggctggacgcgggggcgaagaggctcggaacggagaggctgcagctgatgtgcgaggactcgctgggcaagagcctgagcgtgctcacggtgacgaagacgctggtgtgtgaggagaaccaccaatgccacgcgctcaatggggagtgcctggactccctctcgtgcaagaggaagctgtggcatgcgacgagggtggacgaggacttccgggcgagcactaccacttgcccttcctttatgaaggagctctagcgcaagacttgaagtcgacacgacacatatcatattgtgacatagtacgagatttg

SEQ ID NO: 33386 - DNA, 637 bp, Oryza sativa
tctgccgccaccttcaccacgcgccgccgcctcgcgccccgagccaccgcgggccgtcgccatcgtcgcctgccgccgcgccgccgtcgccatcgccgcctgtcgccgtcgccatcccatcgccgctgccgcgccgtcgccgtcgcgtcccgcctcgcgccgcgcgtgcgtcccatcaccgcctcgcgcccagagccaccgcgcgccgtcgccatcgtcgcctgccgccgcgccaccgtcgccatcgccgcctgtcgccgtcgccatctcattgccgttgccgcgccgtcgccgtcgcgtcccgcctcgcgccgcgcgtgcgtaccatcgccgcctcgcgccgcgcgccaccactgccgcgccgtcgccgtcgccatcccgtcgccgcgtgcgcgttccatcgccgcctcgagccgtgccgctgccgcgccgtgcgccgtcccgtcgcctcgcgccgcgcatccgctgcctcgcgcccagcgccgctgccacgtgccgcgccgccttgcgccctgagccgcgccgcgccgtcgtcatctccgcccgcgcgccgcgcgccgtcacatcgccgccgtcgcctcacccccctccaccgcccttcccttctcttccctctcccccttatcctctctttccc

SEQ ID NO: 33387 - DNA, 599 bp, Oryza sativa
agtaagtgtcaaagaaatcttcgccttctttctgagtatagcccttttcaacaagctgagccttgtacttttcaatagtaccgtcaggcgtaaacttcttcttgaacacccaattgcaccccataggtctacacccatagggtcgctctgttacctcccaagtcccgttagcgataatggaatccatttcactacggacaacctccttccagtagtctgcatcaggagatgcatatgcttctgaaattgactgcggagtgtcattcacgaggtacacagtgaaatcatcaccaaaagacttagccatcctttatctctcactcctccgacgagcttcactgccatcctccttaatgacatgttcatgtgtatgttcattttgttctggtggtgtgattgaactgggaattatttcagagggttggctagaagtactatgtgtatccttcattggaaaaaaaagctctcaaagaaggtagcgtcacgagacaccataactgtaccaacatgcataaaatgtacctcagatttaactattaaaaatctataggcagtactgtgatgagcatatcccaggaagacactgccacagtcttagg

SEQ ID NO: 33388 - DNA, 912 bp, Oryza sativa
  unsure (1)..(912): unsure at all n locations
nnnnnnnnnnnnnnnnnnnnnnnnnnnnnnnnnnnnnnnnnnnnnnnnnnnnnnnnnnnnnnnnnnnnnnnnnntatgcgtacttcggttgacctgattctcacaatgatataaatgtccttacacggttgccattgtttgcaaagctagcttaagagcacgctcctaaagttaattttagtatcaaagggcatgactatgggttactatcttacatatggtatttatccttcatgggcaacacttgtgaagagcatgaagctaccacaaggaaataagaggaaatattttaccaaagcacaagaagctgctaagaaggacattgaacaaccatttggagtgcttcaagctcactttgctattacccgtggaccccctcgtttttggaggagggggtgattgttggacccaatttttattttggtattcctaattcagatttttggggaatcaaatattgggtggttgatgggcatgctctaattgcccccaattaatttggaatttgggcatcggattgggggggatttggtcgggaaagaagctaggttttcgggagagagaggaggccggcggctggaggtcggggacgatcagcgtgtgggtcccacctaccagcgcacacgctgccgcgcgcgtgcatgcagcgcccgtgaggggcacgtgaggcacgcatgtgtcacgcctggaaattcccgaatagaatttcaagcagaatgtgaccggccagggtacacaaatgacaatgttgtcatcaatggttgcagtctatcagcaaaaactttacaaataatttttacaaagaaattcatgagggagatcagcctgaagtcattaggggattgaggactaggcttctttgggaccaaagttttgtaagaatatttgattgcagataagttaacggtactt

SEQ ID NO: 33389 - DNA, 8674 bp, Oryza sativa
  unsure (1)..(8674): unsure at all n locations
nnnnnnnnnnnnnnnnnnnnnnnnnnnnnnnnnnnnnnnnnnnnnnnnnnnnnnnnnnnnnnnnnaatggttgcagtctatcagcaaaaactttacaaataatttttacaaagaaattcatgagggagatcagcctgaagtcattaggggattgaggactaggcttctttgggaccaaagttttgtaagaatatttgattgcagataagttaacggtacttccccagaaatcagtacaaagtctacagaagtcttgagcaattattccctagcaagatttaaaaaaacacccatcgaagccatctggttcaagagctttgtcaccaggcatttttttcacagtctcatcaatctccttagtggttatctgtgcacataaagaagagagatcccctttgtcttctatcaactcagagacatcaaaaaccatttcaggattatcagtaagccccattctatccttgaaactttccaaaagatggcaccctttccttcatgatcactcacttgattgccatttgaatcttgaagaaaggagatgtcattatttctaaatctttcagtggccatggcatgaaagaactaagtgttttcccctccaagaagaaccagtttctgtttaaatatttgcttccaatattgttactgccaacttagaagagaagcaacttggcttttaacaatcattttgaatcttagctctggaacattcaataagcggaattcatccagtttatcaagaaacaagatcaccttgttacaattctctgtagtcctggagagtttagccaaacaagaactccactttttaagagagcttcttaatcttttgaaattggccgaaattatgtttgcctgatcttgagtaactctgaagccctccaacacatttctgacttgatcatgaaaacctgcctaattcagccaaaagttttcaaagcgaaatacatttgatttggggattgtagtagcaatttggactttaatcgaagcatgatcagaggcacttctagccatcaccaaagcatgagtattaggtaaaaacctactcaagttgctcaagaagaggatcaacttgcatgttgctccatgtataagaacggccttgcaaaggaatttctagaagcccttgagagctaatgacttcattaaatataaaattatcgttcatattacctcctggcttatttctgttctcgactgatcagtagaaattaaagtccccaaggacaatccaatagtcattatcaatctgtagatcttgcaaccaatttacaaagtcatctctaccaggaccatgggaaggaccatagacatttactaaaacccaagttaacccattcatctttcaggtaaaacttatcactagggcatgttgagtttgctccacaagagaacccgaaaagacataactacaccaaccaactaggacacccctgaagcacccactgagggggagaaaagatagctatcaaatctttttagggctaaagatctaatgaagctgtggtcaaagagatccttctttgtctcttgcaggcaaaaaattgaacatgcgctttcatctatttctgcttaacagcatgacagctagctagagaatttaacccccttacattccaacaaagaacattccaggattaaagaacagaactaaaggtccatgcatagcataacacccacagtgaccatgtctgacacaaaaaaatccaaatatccaggcagacacaagagaggagctggtactgaataagaaaagtatgacagcaaccccacaggctttaattacaagtctagtcccacaaaaataaacagcaattcaacccattaagcaaatcatggagaagcatcaacatgtttcccagctctagtctgggaagtcaaggcctcagctgacacctcctccttgccaagaccacaaagatcaacccctatctgctgtagaagctgaatagaacaatcaaagggggcagcgtcagtgtcatcaccagaattaggaggatcagtgaattccaggggcaatggattaagggagaataaaataccactctcttcagccaaagctttaagcttcttagaactcttggcctttgtttttctccttaggcttacccacaccctgattgggatcaggggacatgaagccatatgtcaacttgttgattcttgcactccttcttctaccagagtcaataagaaccacttttcccaaatttcttttacccctgctaggcttgggaagcagggttggagatatgtcctgttgaaaaggattagctgggagctccaagggggtaggatcagcatgagggtaaacagcttgaatgggctgaactgtcaaagcctattgagcagtccaattatccttggcccagatcaaagaagaggccagcagagcaaactggaccatctgatgaactgccagctgatagtgggctaaagcattggtctggcccagaatacatccactagcagcattcagccttggcccacccagaacaaacctatagatactgagcaatttccagaattgggggtaaactagcaaggataaaatagttccagatacatcctgcactttattgacaatggatctaccaggaattgaaacaataggtgcatgactttgcaaaactagaattatttgccaatcccctaagtattgttgagaaacaacacttatgttatgagactgctcttcatgggcttcattattgctgttctcccccatatcttcatcagcattttccaaattagcatttccttgttgatcaacttgttgtggctccagaattggaatatggtttactagggcaggtcttcatcagccggctgagcattagcaaagtccccattcaggacaaaaatagaaatagtccaggatcgcccaactcccccaaaactagtgtactttttaatcactatcttggaggggacttcttctaccatggagaagatgactttagccagaactctgcctctgaacctcgggtcgttagaccatctaagcaatcgaccaaatgtgcctactgccttgtctataatgcggtcagtttgaagatccaaaggaaaatccagaaacatcacccaactttgactaattggaggagaattacgacaagtagaagtgttgtcatggtaggagaaccttagtacaaactgataattgaccaaataggcccccctaagaactagggcatctcttaaaacaacagaagctaagtgaacataagcaaactccgaagcatgcctactagtatccaaaacatggaatccaagagtattctgaacataatctactatcatctggatgaactgggcatagagttcaagcagcgaagggggcaagaagcatcttcatgcctcttcgggggatcatctgtgataatcaaatccgcacgagggaggcgatgcatccaagcatcattgatggctattgcaggggcacgaacagggttgggtctggattaacattcgccattggagaatcttaggcactgtagattggactgggagcaagaagcaaggaagaagaagcggtggacggaaactgcctagaatcgaggcaagtaatcggacaagagctgattaaaatatttttatttacggccacatgagataacttcggagccactgagacaatctccaaaaaactgggctgcgaactgggttgggccttgtggacccaagattggctcttattctttttattccaacagaccaaagcctggtgatccagtttgtagcaagaggcacaacgcactctactaatacattcagactccaagtggcccaattttaaacacttgggacaaggaggcccagtggggtttgctttctttttagaggaaggcggattcaacacttttgaatttgaattatcaacagagtcagcaaaaaccacgcccttacctttagacttatccgaagaaccagcatcaatcactcccttgaaattagactttgaaattgaaatacttgatgatcctgcattaaccccgcctgcatgaatcacgccgtcgacagcagaatgattgagacccttaccaccgacggtgatcgccggaaaagaagaagaaagccaatcaaaaacaaacttaaccggaataagagaattgcccattcgaacactagagtgagctctaagaaaatccttcggtcatgcggggaccagcacctactacacctacaatgggtggcaatatttcatcttattttttttatgatttttctactttgattttactttgattatcttttcaaacatcgctcagagctcacgaaactttactttgatttgatttgaaaaaaaaaatttgctactagaatgctgctgagtacacagattcctgatttgtggttaaaaacctgtgacatcttttttttctttcattggactacggtccactctgcctccaaatcagttgaccaaatctcatactctttgcgccaatttggatcactgtctctccaaaggaaaaactgagcttcataatctttgcaggagaaagattggagggtgtaaacccaaagcccaactttctttgaacacaataagaaactataacatgaagatcacccggagaaccaccaatgcaagcacgcaaagcaagagcagcagatgaagaacataaacggaatgaagaacgagggaaatccaccactaggatgaacggacgacgagagaaaaaccgggaaaaatgcaccggagaatgtaacctggagaggacctcatccccaatgtgatcatccagggagaagtcccaccctcccggcggccctgggctcaccatcaccggagaggagcccgatcaccaagatcgcctcacaatcacctcaccacccttccggaaaacgcggagctccagtcttcattaattgggtaatattgacggtagaaattattcaagtaaaatttgagggctctttttagatcatggagaatttaagaaaaatactctggaccacattcgcatttttcttgtacgcattttaatgttgccaatttcttttaggattttaataaattatattattacttttaaaaaatgatttttaatttggaatgaatttatcaggacgtgacaatgaccatgcattttcgaagtctataaaatcgaggggcttagaagatgtatctcccattaactaaaagggaaatcccatctcatttattcacatcccactacatacttcatgaaaaaccctaactaccaattacggagtgcatttggtagccccaaagtgacttactttgagctacaaggattctacaccaaaactacttgagatcaaccgatgacaatttataatccttagaatgtcttatgttctgtgtatccaataatatggtctacaacttgtggacgatttggcatctctatattatacacatgagacaagattatcaattaatacctatgctgatgttggaatcatatttttccatatatgatagacactcgttgatcttatgaaaataacaagtaatatcacataaagattctcaggaataagtcacacactcattggtcaacaatgaattatctatttcaaggaacactttattattaatttataaacataatacatggtacaatcatatctatgagtaactaaaccagtgtagctcgactaatagagctccataggttgtctggttgtgaggtttaggccatgcaccaagtattatccgcgatcacatcccacaaggttctgtttattcgtttggatattgcatatgcttgcggcatggcatcttttggtcatagcccattcatcccgactaaatcccagaatcgggttgtggacccatccccaatggtaatgaaaggccaccataggttgttggcgagcatgttcttttccatttgatttgcattttccacccgttatgttgcccatacccacccagaggaagctctttctctgcttgtcaagcacttctagagattccttagtgacctctattgatgtcaaaaggtaaacgggctgcgaggagagcattgacttgaccaacgtagtgcgtccggttagcctcatgtttctcccgcgccaagttgccattctacccaaggttttttcgaaaagaggttgtaagtacaacttacgcaacgaccgacagcaagaggtagccctaggtatgtcattggcagggatgctctcaagactagtgttttctgtagcacgttattcagatctatgctctcacatctgattacttttacctgggatttctgaatgttggtggagagaccagttgcttggccgagtttgcatagcaggttgaagaaagcttgcacttcacttttgacaggtttgatgaaaactgttgcaccgtctgcataaagcaagattcgaaggcgtgcagatcgacctcccagcttactaagcagcttcaaatccgtggcgttgtcaagcagccgttgcaacgggacgatcgcaaggatgaagaggagtggcgagagcgggtctccttgccgcaaccctcatccatgtgatttgttaagttttaggtaattcacgtacctaaaagtaaaatgatatgatgatttagggggcgcttggaaatggaaatagcacaaaatttatggatgtgggtggctgaaccgaatggaattctcagatagcacctaaatgtaatacctaacacaatagatgggttgcgttaagctttcatgggcatataaggtccatggtgaattggagaataaacctacatatgtggagacaaagaacgaccgatcatatcaaatcacaaatgattatattttgtaaggatttactgctatattcatgcttcctttcagtgcacgacagaacaaaaaacaaaatcaagcaactctctctctctctctctctctctctctctctctctcaacaaaactaaagaaaagattagataaagcaacgtaataacagtgtcaaacaaatggcaaaccagtaatcaacattcaacaacgtattgttctcatggtacttggtagtcgtgttaaactgataacagtatgtaagcccaaaatttaccaagaaatgatccaaagaacaataaatgaggtgatcatttggtgtcaatggctcaaagcaccaaggaagcatataggctaaagattttgtttatcagaagcaattgctcgactatgtacacctggactgttgttatgtcttaggtaaggacagcatgaccgaaccaaccagctcttagaggcctaaacgcttctcgagcttctggatctcatttaggaatatccaagtcatctgcacaaaagatgtcattagttaagaatggtagaacatgcagatgtgatgttttctgctaagcaaggaagaaatgtgtgataattgcattaccatggcatgtggtgcaatcctgacacagtacacaggaaagccagtgtagaacttaaatgggcctccactcttcaaggtcttcatggcacaatcaagagacccagtgtatggatacttcccggaggcatcaggctgcatcttttgaatctgtgtcttcacataatcaaagggtaaactgcaagcagacgcacataaccctgaaacagcactggcccctgcaatcaaaatataaaatcaattttgacatgcaaataatatttaggttggcactactcaacacatttgttgcacacactaagcacatgataggagacttttagcaggcctactatcatgtgcttattttcaacaggtaagtagagtttaagtccaaagagcataacaaaggtagagatcatgaacaaaatataaaaatattagtggaactatatgaagacatctgaaatttttaattgatcaactttgttcttttgtgcccacaagttgatatatatgtctggaagtcgacctatagaaagttgcaagcattaagtcactctggatccacatcctcaaacgcttgagaaatgtttgatagagaacaggtaaatcagaaagattgcatgaaaccgaaattcaaatgagtattatcttaccaagtacagtagtgacttctccagcaccaagtgtgtctctaaataactccacactctgatcataggaggcaagcatgcccatatttagcgacatagctctcactacagttggacctgcgcccttccaaagtgctagaacaccttcatcagcagcaatacgataaagtgcatgaaaagcattcttataattgcgactttgggctgctggcaacgttgaatcagcctgcatcctaatgagtgccaaatccgcaggactaccaacacaggctccaattgctcctgcggtgagaccaataccagctttctggactagaggcagtggcttcccatcatttgcttcaaccgctttgtttgttagaaccctgagggaatacagtgtgaagaaactcaaccaaataacacaaccaaagtataggaagggaagatcagatcaaaacagctgaaaacattgcataagtgactttccagattgatattcatggttatggtaaagcctaacagttaacctttcctgcttggcatagagcaatgtcagaaaacttgactattgcagcattctttcttgaaaatttgccaaaggttacttctattattcacaacaagagttgatgggcaccgacacttgtactaggacattgaatccagctgggtaggaggttaaacacctcccgacaacaggacagaaggtt

SEQ ID NO: 33390 - DNA, 12786 bp, Oryza sativa
  unsure (1)..(12786): unsure at all n locations
nnnnnnnnnnnnnnnnnnnnnnnnnnnnnnnnnnnnnnnnnnnnnnnnnnnnnnnnnnnnnnnnnnnnnacatgctacagtactgggttagtgcacaacgcaaatactggaatttttaaaccacggcctcaagacaacgaaccttgtagaaggcactaattccctcatttgcaagcattttcttggtgacagaagccgccgagccctcacccaactggatcctcacctgcacaagcatcaacaaatcagtaactgcttggatcataaaacagaaaaacattgtcccacaaacgtgagctcagctgcaaacccagattcaactgctaattcagagcaagaaggtctcaacgaaagcaaccgatgaaggttagaaggtcttggcagtaataatagtaccccctccggccacggaataatgctgttttagaggccgtgtagtccacataaattgactttgaccataaaatttgtttataacataagtttgaaaaaatgacatggtcaagtttgttatgaggaaacattataatattacactagcgtaactattttagatttatgaaaaagaattaagcagccaaagctatgtcttactgaatttaaaaactccaaaatgacattcttatccgaatcgaggcctcgagggagtaaggaatctcccacgagatgtacaactacaagggacctcctttccaactgtgctaactcctcagccatgaaaaatattacaagacatcatcttctcgatgttgagctaaacagtcgaactagcattcggggccagcactaaaatcttgaagagggaaaaccttctatactaacgaatgcaaaaactgaacccaaacgataaaattcctcaaatcgacagccattcgtcgcgggtacatcaggaacaaatagaaaatacctcagagacaatcagtaactcaatatcacactcccgattccagtacgaaaatcgttaagaatcctgtctctaaccaagcaatgaaacaaaaatgttcaacagatggagacgtcggcaatgcatcaaacagctcatccgcacaccgctcatgtttcccttagaagccattccgcacaagcctagcgcaccaactagccccgcgcgcgaaccctcacaccaaacctccagcggaggcagggagccccagcccgtggggcggcgttcgtaccttgaccatgtcgatgggctggatgacgcaggtggcgagcatcccggaggcgccgccgttggcgaagggcttcaccgtcttccacaccccgctcgccgccgccgccgtcgccgcctgcggctgctgctgctgctgcttcgcctccgccatctcctcctcctcctcgctctcctgtgccgcgcgctgctgcagtttgggactcccggagaagaggaagaggcagtggtggtggtgggagtgggaaggaggcgagagagacgcgtgtccaatccatgggcgctcgcaatgccgaggagagccacgaataatattaaagtattcttctctttttttttaatctttttccgcgacgtttttctcgtctctcatttttcttggtaggatcattctctgcatggtctgtatcatccgcgtgctgcgtgcagccgtccacacaccattgaatgtttcgtcatcttaggaagaaagtttgtgttttattgttcaaataaaagtttgatgttggtacgtgtgttcgtacttacggttaatgttttgtctctacattatatccacaactaaatacaccattcacgtcagtcaaaatgtctctcctaatatttagtaaaagagatggctgtgatataaaaaaagaaatataaaatattctcaaacattatgagaagaaaataaaaagaaaaaggagaaaaggagtgtatgttcaccaatgttcttatgcagcatgagagaaatatagtttgaacaaaaatagtcatatgtccaattaggaataaaaagaatctatggcaaagtagtaccagtgggcgttcggtttttatagttttcttagttcggtgttttttgtttgaaaaaggtcggttttcgatacgtaaaatctaaatcgatagcgctctcgtttttttttcctatcgagtaacaccgatcatatgtgagagaactagtactatacatctataatttgctatcaggtcatacatgtcttttttacttcttatagaattttctgttaaaatacttatccgatttcctatctggttggactgttgtattcattgcaacaaaatctttataacaagatctcaaatgattatattctaataaaaaatatgtatgcattttaaaattactttttagacatttatgaaagaaaattcaataaaacataaaagtaatttacataagtcataaaagtaatttagcacaaatggaattaagttgtcacgatattagaagtaaatccgttctaggggtaaaaacatgagtcaatctagactttggagagtgaggtcacttgttatgacaatcgagcgcgcactctcctcgtagtcatggtctcctttttggtagttgcgaaccgaaattttcaaatataagagcaagtttagtagtatagtcaattactagttccaaatcgtttatagccaatttagtagctaattcatacaatagttacctataaatatgtactacactattaatatccggtcccacctatcattcacacattatgtcttatagcccgtgctgcagctggctacaaatttgtatcccgctgcttatctgttttatttcatctactcgatatgtgtttatagctggcttatagtgtgttattgtacctacctaacaaacaaaccgaccaaaacaagccaaaccacttcggctcagttctcggtaaaaccgagcgaagggctgatgggtgcagggcgctcctaatgagcgactggtcgcgcaggagcgtgggcgcgcgaccagttcgctcaggggcagagcccaatgaaccagggggtgcccaggaacccggcccaatatttaaaataccttgttaccctcatatctacagcatggaggcaccaccctagcccaacacagggaacccctctccttgaaagacccaaccggaagaaagccccaaaaccaaaaattacgcagtgggagacactaaaacgcctagcgcacaggagtggccgatgcggcgacgcttcccatcgaagcctcacgtgatatcaaagcggtagtttcgattttctcgcctgagtcgcctcaacgctcaatctctctcctcgctctcgtctgacctgtcgcctctccctggaggtcgcccttgcctcgccggggacctagcccggcagccccaatcggggaaatttctcatgtgtaaagcctctccctggtaggttgcctcttttttccaattttttgcactgatcaggctagggcttgcaactatagaggcatatagaggtagatgacaggggcaggaggaggaggactggaggaggacgacggcaagctgcaagctagcaacggccaatagctggagcttgccggctgccggctcgccctagcttaccgatctactctgagccccacaaaaattgcagccagcagcactagctgagggcaagtgttatgggtagatatgactactacaattaaatttatccacatcattcactcataaattaagaggcaacctatacactatgtctcctctagtacacaaataccaatgtctcttatactctcacacccctcttgaaatttgtgttgaggttgccttttcatttaggggtggttcaccatctctctcctcacttctctcctccacctcatcactcaatccaatgtggcacatttaggggcagcatatggagcattatagtacttgccctgagagcaactgaataagtgaactctttctctcaatttttcttatccttagtttgtagttttgtgccaaaataaacttgaaaatttttatttggtcttaatagattgctatatagcaccggatagtacgaacaatatgaagaaatttgttttattttgtaccaaatcatttcataacttattttctgttgagaattaaactatattttcaaagtcattgtcctatggaggaatgaagacgttgacattcgcatgatatattcataagattttgttaatggaggtctttgtcaatggttgaaccattatcaactttacaaatattattagttgatttctttattagggtacgtattttttaactcttttttatgtatttcttgtggtatattatcttcaaatgaagaaataatgcttatatttattggtatgcaactatttagtataatatcgctctataactgtagttgtcattattacgtaaagaaaagtagaaacccctcgtcttttctctagctccgcccctgagttcgctcctactaccgctggtgctatactgctcttctagtagtactactactcctcctcctactgctcctaccgctgctcctaccgctagtgctgctctgctcctgctactactactggcgtgcgctgctgctactagtctactacagtagtagtactactactataacaatactatacgtgtatatatacatatgtatatactttatataaactttatattgataaaatataaattttttacatgtgtatacaaagtatatataatttttatgtgtaccaaaatattaacgtataaaaaatatacatatatacaaactttgcatatgtgtatataaactttacatatgcatatacaaactttgtatatgtatatattaaaaaccgagagaaaaaaaacacgaatacaaactttgtatgcgtacaaatacaaaatttggtatacgtacaaatacaaaacttggtatacgtacatcttaaaaaaccgaaaaaaggaagagaaaaaaaccggaaaaaccaaaacagaaaggaagagaaacgaaaaaaaactaaaacagaaaaaccaaaacaaaaatcactcgcacgggcgccgacagcgccctccgcgcgcgacacatgtctagtcacgcgggcgacacgtgtccagtcacgcggggagggtgcgcgctactggtcgccaattagctctttctgtgcagaggggagcgtgctagagttggatcgcgatggcctgggcgcaatggcttcagcgactgcggctagatgggctagcagccgtggacttcctatatgtgggctgtgaaaaattgtagtagatgggccttaatagtggtgtgggcttgaattagaaagagaacaaggaagattgcagcctagtttggattaggattatacggtatgttcaggttccaccttctaaacaccgagccgaacaccgaactccgatctatgtaaaaaacaacacctaaaaaagaacgataccccccaaaaaaccattatctccgtttggctcggctcggttcggtttccaggaaatttgtgctcacgctaaccacataccaccttccaccatatagccacacttgtacatcttaataagtgaaagggtcaattaagcctagaggggggtgaataggctaatttaaaactttatgcggaagctaaaactgagttagggtcggaaagtctgatccacagtcagactatccgaaaatatcagatagtctgatgttggatcagactgtctgatccactaaaggaagactacaagtagatctagtgcacaaacaagagtatggcgcaaacagcgactagatctaaagtggcacaaaagcaaagctaaataataggagaagagattcaccaacaataaagttcaccgagttgttcccggagttcaaatccttgaggggattctactctccgttgaggagctcactaagagccgggtctttgctaaccctttccttaagaggtggcactaagcactcctccttccactaaggggtatctctttccttgtggagacgagatccggccttcacaaacttctcccggccaaccacacgtagatcggtggctcgggagtgacacctagccgtctaggagtcctcaacctccaagagtaacaaacaccacacaactcttggtcaaaccctagtgctcaagatcgagtgaaacacacactaggccctcaaacaccaaatccacaaccaccaagatccactacacaaagaacaaagagggatttgagagagggagagagagctcaaagatccaaagcactttagcaccaagctcaacccaaagtgaatgtgaatgaatgagttgggtaaccctagaaaagggttaggtggggggtatttatagaagcccccaaaatgtggccgttgggagagaatcttttcatcccacctcggaaagtccgaggtgacatcggatagtccgatgtttttgactcccaagcaggccagagatagagaatgaaattctggagaatttcggacaatccgatcgatcgggtagtccgatgtcatatcggatattccgttatttttgaaccaagaatttcatcctctcacagagactcaagttccattgaatttcggagtctctggatcatcggatactccgatcacatcggatagtctgatttaaaactcactcaaaaggaataaaaagcatttcaaaacagagagtgaagttctgagaaatttcagatagtccgacgtatcagatagtccgaccttatatcggatagtccgatatttttttagccaacactcagaccgaagacagtgagcaaagttctgtgaaatttcggatagtctgagcatcggatagtctgatcaacatcggatagtccgacagacataaaacaggaatacttcaaataaatgattttgagcactagtgttctaccaattatatgcatatgacatccctcttaatagtacggcatcctaatactcaagaacacaagatatacatggattagaagacaattaccataaaagatgccgcaatacttattgtgttgacatccactcctttttcatccttgcatacatctcaacaaaaagcattagttaccctctaattgtgttgtcattaacaccaaaataaatgaggggtcctagatgcactttcaataagattgtataatttgttttctcattagatcctatttttgattttgcaatatatgtaatacaagtattgtctcgttattttctcccaccttgagctccacgtataaacattttagagatagaataaaaaaaagaaggcaatactatgccttggtaaggaattatacgcattgaacgatatgcgagaatcatttgagaaactttgggttttatttgcataattcgtgaaaccctccggaaagaaagttgaataaagagtaagacaaggagaaggtaaaagccccatgggaaataaggtaagagaggtaaaagtactattatcaacttattcaaattatatatagaaagacatattctactcatggcaacattgtgacataaaacaaggtagaaactcctgatcaacaacctagtttatctttactcgagtacgagcaaaggtttagtttgggggtattgttgacggtcattaagtaccgatttcgaccatcaactacttcaataaataaaaggagaactaacacttcatccacgtatattagttataaataatgtagtttcatttgtcctggcgaattactatgtatgcaaagattatacactaaagtgaaggagaaaagagccaacatggaaataaacacacctctggcgaatcatgtgcgagtacacagatcgatgggcccacaagtcatatgaaactgatctaaagtggagccaaaccatcctcaatcgctacagagacgcacctagcagcctttggtgaaaggcagtggagaaaggtggcgcccaggggttggccggaccccttgttcggctgaaccgccatcagctccccacatctccaccttccaaccaccatacaaccatcattacaggactatttaatgatgagagtttctcacttcacaatacacacatcaaagagccattctctcattccatatattgtattctctcgagtaatagtggagttagccttagagtagtcttcggtactctagtcctctcggagattcgggtatgtgtttagtactttactcttctgtaagacaatagttgaaataaaggaattattttgtttacttattagtgttcatagttcatatacttcttactggttatgtgttttataaatagttcatactttatttatatgcttcacctgattttcttggagattcgggtatgtctttagtacttcactcttcttgtaagactatagttgaaataaaggaattattttgtttacttattagtgttcatagctcatatacttcctattggttatgtgttttataaatagttcatactttatttatatgcttcacctaattaggctagtcaatttatgctacagtaatggtccaattatcataacgggttgcagtagttcaaacttattcatttgaagggttggagttccaggggaattagtgatattatttattaatataagcatggtgctcaggttagttaaatatcattggatgcggtatgccccacggaaagtgagataggtggcaggtgatgaaagccctatccatcctttgtattcctccacatccaagtatgacgtaaccatgctagtagactaccaatggtctctcggtagtacctaggtaacttagaactaaattctaaccttgtaagcatgtatgtgttaagtgtaaataaatattagtaataacgaagtacgtatgaatcttaggtctctttagtccttctccactgtctagtgtatctttatttgagatgaatctcctacgtgtcacactacctaaactaccattatcatcttaacccctgtttagactatgataaagtaattatagcataattacgaatatatgaaaaatatgatactcccggaatactcctaagtaaaatgctaaagcagtatccgttcgtttgtggatttatctatgaccataagaaataccagcaacaagcatgatttatatagaagaaatagagagcccccagtattagaccatagttagcctaatacacgaaacgctcgcacaatagatatttgtatgaaatatgctttaggtaaatttaataattaagttactgctccgttaaattgtatttaatatgttgtgtaactttattgatatatgccggatatagattaattaatttaaaaacctaatacgaaatggacgtaactatacagctaaccactccatctataagaggcaccatccaactatacttcaaatataatttttctcttaaactactcatccgatctacgattcgattacaccgttgtgttcgtaaaaattaaatctttacaacaagatctcacatgattatattttgatgaaaaatcataaattacttttatgatatgtctaaactacttttagatttcactaagttacttcttagatatataaaagtaaattcagtaaaacgtaaaattaatttacatatattatagaagtaacttagaacaaaacgaaggtaactttagcatgtcatttgaagtaaatccgttgtagagataaaaacacgactttatctagaaattaaattaatcagcacaaattatggaattaactaaaaaaataataaaagtaatcacctcagagcatttatgaatgtataggaagtattttaatcaaatctaaaaataactcatatatatatatatatatatgataatttgttcaatggaaaaaggcattaattaaagttactttcttttgttataagttacttctataatatatgtacattacttttatattttactaaatttacttttatatgtctaagaaaaagtaatttgtgatttttcatcaaaatataatcatgtgagatcttgttgtaaagatttaattattacgaacacaacggtgtaattggattgtaaatcggatgagtaatttaagagaaaattttatttgaagcatagatgataggattatttttcctacttgctcaatagattaatagcaaccaaaacttctaaaacactagcacgtgaatatatctggttagaactaattagggagatctctccaattagatttaccgatacgaaatacatctgttgatttgtatgtgacattggaaattgatgtactccgaatgtagtcctctctagcttggtgcatggctgtgtgtgcacgtgtctgtccaagcttcatgcatagtagagacgtgttgattattctgttattactgatacagactcggagcagtaccgtgcccgtgcgtaagagcaagggcaataatatagcctgctgttaactctaaaaaaattaaaaaaattagacatgtcatatctagtgtagctaatatgtacataaatattttattattgtagtgggacccatcattttctccaaccttttgctttctccttcctttccccttccttgcctgtcttcacttctttacatggctgactccggtagagtgaaggtgatgctcggcggcggtgtggacgcaggaaatggcggcggccatgcggcggatgcggttgacaccggcggccgtgcatgacgaggaagcccatgcgcagacacaagatatggcggtggtcgcctggtcgggccggacgtcgggcgtgcagataacacgggagacaagcgagacgaaggcggcggccgcgttggcggacgcagaagacgacggcggccgattcgagcgacggttgacgaggaagacggagacggccgaggcggacgacggtggccgtgcgacggacgcggaagacgggggcggcccagccggacgacagcagtggctgattcgggcgacggcggacgacggtggccgtgcggcggacgcggaagacgggtgcggccgattcaggcgacggctaacgaggaaggcggaggcggccgaggcagacgacggtggctgtgcaacggacgcggaagccggtggccgtgtggcggacgcggaagacggcggcggtcgatctggacgacggtgaacgccgaagacagggcggccaagccggaagatagcgacggtcgattcggacgcggaagacggcgacgaccccgacggcagccgcaggcgacgacctcgccgatgagggcggacggactcatgtgatgagggcatgtgggcgccatggctgcgagcagcgggcccacgacctcgagtcgcgcgtggagccgggcgcccgctagttctctctcttcaactatctctcctccacgtcacaaaaaaaatcttacgtggtgttgttatcgctggttattatacccgctctaagccagcatgcttatatgtatctggtacttgatttgttaaggatgtcatacgcgatgacaaccccgatccgtatcgtgctgctgggcccatcgttatgcgggaatcatgattctctgcactgtagcgcaacgaactcggatgtctttcccggcaacaatccgtccactccggttatcgttagagaattttgggagaggggtctaggcgtcgggcgccagatggagtggaaaaatcgagcgctgatgtcatgctgatatcagcatatcagcatgatgcatacgtgaaaaatcacttcaaactattttttctcttaaattatttatctaaatcatgatccgattacaccattaaattcgctacaattaaatttttaaaacaaaaccacacatggacatattccgatgaatttttttagcttattattgaattatttttaaatattgcacgctgtttcaccaagtatatcgaaattgttttactaaataaatcgaaaatgtttcaatcctttaaaccggtcattgttttaccttttataaaaacaatgtttcagtaaatagcaaaagaatgtttcagttcactgtaacgttagatctatacatagtgaaacattgtgagtacacaaggtgaaatatttttttgttgaacaaaaaataaaacaaattcccttaataacgggtttccaaaatatatcggtgatttgttgcaaaagaatgtttcagttcactgcaacatttgacctatacatagtaaaaaattgtgagtacactaggtgaaatattattggtggaacaaaaaatgaaacgaattcccttagtggagggtttccaaaatatgtggatgatttgttgcaacggagtatgtggtggggacacatagcaggtagatagggacacatcgtggggcccagggcgcacatgcgcgcgcgtcgggggggggggggagcgaccgatttttcccctcccccggcgaacgaggcgtagaataatcggatttttggcagtgatatctcgaagctatgtgaatcctaaaagattaatttattggatgacgatggttctgatcgggtcgggttatattgtcacacctggagttttttcattttccgtagtttctaaatcattgctaaatcgtctatagaaaatactctgttaaccaagaggaaactctaaataataatgtggttaataattggaattgttagggagaattttttttgaattctctttactttaaatcactaacaagatgttcagcggaatatttagagtataggaagtactaatgttaatttgaaatgttaggagttgaattaataattctttcatctctctcctttggtcgtgaaccgtccccggttcactctccctgttcacagtactttgtatccgccaacccctttgctaccgcagttctattttgtatgacgagccaagtcatattctttttccggtccgtttttttttttttcccgaaacggcaccgcattggttttcctttccttttctttctggtccctc

SEQ ID NO: 33391 - DNA, 1939 bp, Oryza sativa
cccttcctctcccctcacgcgcccgaccccacctaacctagacctactctaattccgcctcctcctatttaagtccctataccccctccttttttctatttttcctccgcgcaaagccttagccacctcccctagccgcgccgctgccggccgccgtcgttgtcgcgtcgccggtgagctgcctcctctcccgccagtatggttcaccatcatgttttctccctagggtttaatctaacctatatcctcgtttgtatagcatcgcgtcgtctccgtgtgttgccgccgatcgtcatcgccgcctcctcctctccgatcgtcttggtttggtgaggaatccatctatgttcactcaatttaggtttaaatttcctagtcacattgtcgtcgtaaccttaatcgcgtcgccgtcgccaaaccctagctttgctgcagccgtgcgccgttgccaccgttgccgtgcacgccgccgccaccgctgtgcaccatcgccgccgctgccgagcgccactgccgctgctgtgcagctgtcgccgcgccgcccctgctgccgccgccgccgccgtcgctgtgccgcgccgccgcagccgctagccacagccgcttgttgccgagcgatgccgtcgcttaccgccggtcatgccgccgattgctgcggctgtgcagtttctaaatcgtgtcaccgtcacggcctagccgctgttcgtcgctcggtagccactttgcctagccacagccatacttccgagttgctaccgacctaccgattgccgtacctatccgttgctgcaaacagagtcaagtctaccggttgtgccacagtcgttcgctagccgttaaccattcgttcacacgtagtatagctgaagtcccgttcagttagtagttcggagtcgttctaagccaccggttcgttcgccggttcggttgacgtttgagtggtcccgtgtcacagtggattgactcgttgagttgctatcctgtgaggcttgtttaccggtgatacatttccattgatctttttggctaaatgtgtaataattgactaaggttttatggtgaatagtaattacacagctcatattctaaaattcatatctaattcatctgagttccgttttaatccattcaagttgcagtgaattcgttaaaatatttagaatcaattaaaattggtttcttttgctgtttcagtagagttattggatgtattattgtatgctttgtttgtcgtttagattctggcagttccgacactctagtttatttcgaaatggttgctgaggttccgtcagctcaagagcaaggcaagtaatacatacaacattgatcatgttgaacctattttataaaatcccctgctttctattaaattgcattgttttagaatatcatgtgggattgagaactatcgtagtcagccttttgttaccttatgccattgataacttcggatataattgactagatgattgatttaggaatgcttagccatacttagatcaattagatcacaatgagattcactataataaaatcccctgctttctattaaattgcattgttttagaatatcatgtgggattgagaactatcgtagtcagccttttgttaccttatgccattgataacttcggatataattgactagatgattgatttaggaatgcttagccatacttagatcaattagatcacaatgagattcactataatttagtccttaattatattgatgatgtaccaccatggttatggtttaattaaactaaaatatgctttaatggtgggttgttggtgcatggttttgcaagtcgtgcccatgataattaaggacctgttctcgagaattcctagaagataaactcatacttaccacaagccagcttgggttccaggctaaatctaagtataacttaatctagccgatatactgtgg

SEQ ID NO: 33392 - DNA, 30578 bp, Oryza sativa
  unsure (1)..(30578): unsure at all n locations
tggtcttcaaaattgtaaattagggtccccattgtttcgcttattcgaggaataagctaaatgtcatatttgcaaatgaaaaataatttgtgaataaaacttttatatatatgttcttaaagttctaaaagcaaaggctgaaaaataaatttcgatgaaaaaaaaccccaagatcaactctaaatttaaggttgaaaatttaaattttggctgataagtataagtataagtgaaaagatgagactgtagatatggttgaataattctacgtgtttgaattattctagtgttaaactaggcataaatatatagtgtgtatattaaaatagaacagaaatagaaatgggaccaaagaaataggggttgttgggttgttgctgaagttctaagttaatttttatacccaaaagatgggagcgatcccatcaagtcattaagtgctttagaataggggctattgctaaaaatgttcgagttagagccatttcttgtcataggccagctatcatttttgcctttaggggcttgaggtatttattccctccgccacatagtacaagggatcttaggtggatgtgttgattcattgtactaggatgtgtcacatctatccaaaatctcttatactatgggacggatggagtattacgatggaagtaatacgaagctaacttactttaaaaatttcttcctccatttgaaaaattttaggaagacaaaataacattattggatttgttacgaacttttatctttatattgagtatattctaagaaagacaaagttgttaagggtaagcaaagtgaacgtagttcaactggttaggtttcttgtggcggaactagcccacacgggtacctagatttgacatgggtgctcgcatttgtaactaattattctgccagtggtatatgacgtacctatccacagcgaggtacccgtggtaacttcgtcaatctcaatatatgttgggccagttttttaaaggttattataaggttatgtgtgcacacgttagcgcctacatttgttgtattttgtttctaagaaaatatgctgttaaagctaggttagaatgaacaattggcatgagttttttgacggcataagtaacgaagcgagttgttagggtacgacagctgactgagtattaattattgtaaacttaaaatgaatttatttgtttgttaaaaacatagatatagaaggtttttcttaaataaaaagaacgtatagcatgttagtaaacatgctaatatatgagggagttgttcaccccttaggctgcgttcggacccctcctcaccggcacgtaaaacgaaatacgtattattacatgattaattatgtattaactattttttttaaaaagattaatataattttttaaataactttgatttaaatttttttaaaaaaatacaccgtttagcagtttgaaaagtgtgcgcgtgaaaaagggaagaggtgagttgggaaatctcaggggaagaacacagccttaacacacaaatgaatggagccgtactagtgtccagtttacttgggttactcggaccatatgccatggcttatatgccatagaaaataaaaatgtcagccaataaactaatgtacttttatgttgataacaaatacatgagatagcaaagcagtttggatgaattatttcaggtataaatttgctgattagcagtacatatctgacgaaggaaacttgatattgatacagcattactaaatgaatataaatcacaaaataacttgagtttcgcaaagactccctcgaaagagtggctgattaatgggcttctgctcagggttcatcggcttgcccaagaggcctactaggtgatgccatccgagagaaaacaagttcattttacctccctaatctatagccaagtatgattttgtccctctgtcacaaaaccagatatagatactctttcaactatcaaaactgggttaatttggtttattaacagttttatctgatgtggcactttcatagcattaaaagctagcgcaagtggatcaccctgcgaacccacttataggtcaaataagtagggttcgtgggtcgatccatttgcactcttgcgtggcatttaacctagtcttcattatacatggcatggcattatagtaagcaaacagaaaaaataaaaatactttctctctacacccttttctctatgtcattcgaggtcaacctaccagagcatcttgttgcaggagacgacattgttgcggtatacattacatcaatttggttttccacgccgtttccgttctcagtcttggctttcgcagacacatgatcgtattctcagttccaatcagggataggcggggcagaaagacacattgttcggatatcgattgaagtttttaagtgttgtaggggtgaaggttgagcctataggcacatcaggaaacactttattgacggtcgttaagtactgatttcaactgataattagagaactagcatttcttatatgcatattagtttcaaataatgtagttccacttgttcttgtaaaatactatggatgcaaggaattgctacaaaatgaaggagaaaatgagccggaatgcaaagaacacctccggccaatcatgagagagcacatggactgaagggcccaaaagtgagactaaaccgatatatcttagaccaatccatcatgcattatccttgggacgtacacgtcagcctccaggataaggtcggtgcagaaaggtggtggctctggtttggcttcactaggctttgccactcccatccccacctttcacgtggcgcttcctcagccattcctaacgaaggtttcagagtcttctatatagcttcactaatctagagagtaatactaatgagaaatagatagattgcttcttaagcgtgagctttgagagcaagataatcgaacaaatatttcgttttcataagccataaaagcgtcacatggatggtgaaaatcatagggtccgtgtttggtttgacaagccgaaccctagttccgcataaccaatgccaccacctctctccaccaattttctcctagaggctgacatgtgggcccctaggacagtgcacggtgaattgcccttatatatgtcagtttgcttttatttgtgggttcttccatccgtgtgcatgcaacagtaatatacatccacctgactattcattgatcaagtccaaaccaagaagatccaagaccagactaaccttcaaaagcactaagaagttgtatttgtcaggtaactttgcaagtgaagcattacctgtggtagattaaatcgaactgatttctttgaggtgggaagtaggaggcacagtcgagaacacgccttggcgggagcatgcactggtcttccctcccggtggatctccatcgcaccgcttcaatccctgctgtcaggtctcctctcccttgcaggccctcgccgaagaccacgatcaagtgcagatgtgataatcgaagacgtggcagcctggatctgggcaaaggactatggcagggagtcctggattggagcacacctggggagggaggagtggagaatggttcccggcggtggacgggagtaccaccaggggcgtggcggatgaggggtggcgatgccggcagatgacgcaggagagcgatgaaagcggccggcgaggttgtctggcagtgatggagactaccaacaaggtggagatggggaggaggccgagcaattttgtggatggcaaaatcgagtgtaggtggtgcgtcatcgatggcgagatcaagggggaggagccgaggaagctatcggcagcgtgattgagggagggggaagcgacgatgcggtgacggagtgcggggaagagatgcgagtgggcatcgggtttagaggggaggaatttgcggaggcggcgcgaagaccctgcgcatggccctaagattctcatgatttggccgcttgattgcacagtgcaaactcctcctatttatattagtatagatgatgtgtatatgtgttttctagtttcatattgtacctgctgagtattttcgtacttactcttgtgtttatttggttttaggtacacattgagatcagcatgcatgggcgggaagtagcacccttatatacacatctatctgcacactatcaaactatatcgcttaggtccaaaatgacacttaaactatattctgggttggtcttgtaataatcttttacatacctattagtttctttcaatggatgtatatggatggatagcactgtgggaatagaattataactatctatcatgaatgtccatatttataggggacactgtcgaaattctcaatgaatttaggacttcatggtttttgtttcgtattgggtagcatccgatttttttacatgtaagcacatgcatcagtttaattccaaatataagcaagccaaacccaaatttcaatccatagacaagatgctcaggtgcaggcgttgttccataacataatgtccaagcgttgtttcataacataatgtccaacaaaataataggccattgaattgagttttgttactttgtattaatgtttgacatatttattaagtatggttcaaaaatatgttattttgcttttacaaaatattgttacactttttttaagtataattatatagcaagttaatagacctaaaaaattgctactattttacaaataaatgagtttacattaccgggctgctaacttgtggatgttatcgctagaaacgaggttgcaaaaggtccatttattttgtttggcattagattgagggattgacgtggtcatgtacacatgtttacaaatggaattacgaatatggtgtgctcagatacgtagtaaaagagctgcacgtgcttagattaaaaaaatcggcgatatgcttcgataggcctcctggtcgactggattcacagtgctcacgtgggcatgttgcctaaaattagaattccaaacaaatttgtttggattaattacattagtaattactggattgcatgtgtcactactaaaaaaccctaggaccggctttataggtgatggttcatttaaaaccgacacctatgagccttttcctaccttcgcacgttgaaaaaatatacaaccggtacctttaagaatgataggtgtcggtttattaggaaaaaccggtaccgatttttagaaagatccgacacacctataatatattatatattatagatgctggttaattaaaaaaccgacacccatacaaaactgagccaaaccaggatagctgagccggccttagctttatccgctccacgctatccttatccgtgcgaagtgagacgcggacgccttgtaacgccccgatttttgttcgggactaaaaatcattaaataaagcattttctagaaattaaataaaagttaaagcaatttaatcaagtgaaataatgggagaattaaaaattttcctttaaaaatcattggccgtgaatattttgtaatattctttgtgccctaattattctctgaaattttcccatgaatttttggagctcaagaagtaattataataatacaaagttcattaactcaattaaaataaaaagaaaacgaattaatccttccctcttcttccttttaggctcggcccagctccctccctcctccttcccggccaggccggcctccccttcccctccttcagcccactcggcccactcctttcctccctcactcggccttctctctccctggctgacaggtgggtccgtgggccctacctgtcattcccttcctccggctccccaagtccaaccgctatggccaccgttcttccccacgtcgccgccccatccggcttcctcacgcctccctcgtgcaggccacgtcgccgcccatcccttccacctcgtgcctgcaaccgcccccacttcccctctatccccgcacgaatcggcgccgtgtgccgtcgcctctctcctcccccatgatgccgccccttccccgccggttgccaccccaatcgaccacggattccctcccccgagcccataaaaacgatccccgtgctctcctctcacatttccccaatttttcccgagctccccgcgccctctcccactctcccctcgccaagccgagccgccgccgctcgccggagctgtctagccgcgggccggtgcgcgcgtggactcggtccaccgtgcacccgcctcctttgagccaccgataggtagggcccgcttgccggtgccacctatcctctcggtgacgtcataaatagtgttaataattataggaattcatttaatggctcaaaaaattcataactaattcattcgaactccaaattgggccattcaactagcaaaattcatctaaaatcgagctctacatgtttgtttacttttcatgtactgcttacttggtttttattagagtttttccttgttttgcgtgccagcgcgtagattccgccgtttcggaagttcgcgatcgcgaggaaaagtgttcggaagattctttcaaagaagcaaggcaagtcacaaattcccctcgagcatattgagcctactttacaaatgttttactgtttgcaaataaatatgcatgttttgctaattaattgggatcatagtttacctatctgctcgcttgtgccatgtttacttgatatatgtcctttgtgaaccttgggtgataattcgactagcttgtgttatgttgacctagctagaactatatgcttagccatgcttaattaccactagctcagttgatgggataattacagtattagactttctagtatcatgacgagctgcgtgctcgagacatccggccatgtttcattggtcgtagttatccaactaaaatgcgacttgatggtgggctgtgggtgcatggttttgctagccgcacccatggcaattaaggagtggttcgcgggacaccctggaagacatacaacgcttgccacaagcgggaatgggtaactgcctgacttgaagtatagctttcctttgggtgacgcatccaggcaagggtgagcatgatggagttcggatgggcactgcgatgacctatgtggctttctgattcgcctaggcatgagaggggattgcccgctgcctgttgaggagtgggggtgaaacctgaggtgtggtctgcttggtcagaaggggttatatgaagggtcttgtcacaatcactcgacatggtgacgtgtcaggcctggcgcggtgacatgccggtggattgtgtcttgtgggtacagttgtgcacctctggctagagtaaaactattcgaatagccatgcccgcggttatgcgcgatcaaccagattcaccatgattagtctcaccttagtaaatcgactcaatgcactggttagttcaggtgggttggttgggcctgttcaacgtggtgtagcattgatcagtggagatttaatgtcaccttaattactcaacagttttactgttttgctcaataaaatgttttacaaccgcctttatgcaaatagccgcaagccatccttgtatccccttgcacgtctgtatcattggtgtggcttgttgagtacggtggttgtactcagccttactattattccccctttttcagaagtatagtgtttctgagctaaagacgaagttggaggatcaaggctcagaccccagttgagttttgcctgtggagtgaagctgaagccccgctaggatcgccttttccgctgctgctgctttcgcttcggtgcgaggactaagtgcctcttctgtaagtattttatgctttatttacgtttggaactatatattacttgttgttttgtgtaccctggctggtcttggacagggatttaatacacaaaatagtctggaaatttgggttaaatttctgggcgtgacacgcttcgactcgttcgtctcgcctgtatcctcctccgccgcccttccctccccttctccctctagcacctgcagcctccccttcgctcccctctcccagccggccggctggccgcttccctccccctgcgtccccctctcctagctggccagccagccgcttccctccccttgcgtccccctctcccggacggccaaactgtgagcagcggcacctgtgaccggcgccctcaccacgggcgacggggatgtgcaaatcaggtcccctcctcttcttcttctccctctccgtcggcctcaccggagttagccatatctagggaggaggtggtcgggctggtgggttggtggcggcgacgtgcagcggcggtggtggccaagggaggtggtgggcggcctccccataggtgacggggtgcagatccggccggtctccctcctctccctcttcgtcggcctcccaccaatggcgcgcagatccggttggtgggttggcggcggcggtggtggccaagggaagcggcgacagcagcagcgggtggccaagggatcccagctacgactggcagcggcggactgacgatgacggagtgagttcgtgcatcttaattacttatgttattgatctgtgatttgtgatggattggattgttgctgacctgggactttgtgattgtcgttgttgatctgtgatggattttgttgttcataggagatatgtgatggattgtatctgtgattgttgttgttgaccgtaaaattatttttattgatttgtgatggattgcatctgcttcgcttgaatggtgtggctcacaagcatctgcttggcttggagccagcttctctattttttttaatcagggagagagcaaaggtgtcggttctacgaccggcaccaatgacctagtgtcattactgccgagcaataggtgccggcagggaaaccggcacctattgctagttcccaaccggcacctatcagtttctgtactagtgtgtttaggtataaaaaatttgggtgttacataaagtctacctctattttaccacaaagatatttactttttattgttagataatctgccgtctcttatggtgtatatagtgatatatgattttttttagcattctttttttctgaacaacaaataaataagatatctgtgtatttgcgcaggctttctttccagttgttcataaaaaataatcaaatcattgatttcacaaataattgaatgtaacccgtgaaaaaggtcgttcacaaatatacattcgcgggtggtatgtcttgaaggtatgcatgcatccaattattcttcaaggagaaaccaacagactaatcttaacaaagtgaaaagtgaaatccaaagttaaacgggaatgagccacatcatttgacaaatattagccgttggatttactacaagacaaaagagagtgaatgaatcttggaccattggattatggatggtaataaaacacattccggaggtaactactagaagtagaaagaaagaaaggaattgaagggaaaaaaaaccctcgtcctttaactaaagattcattagtcaagattgagctattcagggcatattcaaaatgtatgtttatgtgattacttttgtttgtagcaattattgttaatgtattagagaaaaaattgctacagagacatgtacattccttccaataaagaggtcatcctcacctgaatatatgtttagtgactttcacataaaattaaaaatgaatctaaaattaaaatattttcttaaaaaggtacaaaacctatgaccatgaaaaataagtggaggagaaaaaaaatcatacaatggtaaagacacatataaagacgatgaatcatacctattaaagtttacaataaatattaagccacactagtataggaatgatttttctgaatgggagtcatttttgattgcagacgaactgtaagtggtcgcgtctgtaaaaaaaatatgctccattttcacgtgcggctcattaaaatgaccgcatagaaaaatcaatattcgcaggtgggccacttattttcgcgtgcggacctattaagtgacccgcacacgaaaattgccacccacctttttaatccctccgtcgctgccccatacccactcctcccatctccctctcaaatcccatcgccctctccgccccacacccactcctccctctctccctatcgcccgcctcctcccactccttcctctccctatccccctcctcctcccactcctcccatctcccggtgacggcgacggtctcggctagggcgatggcagcatcggccatggtggcggcggcggagcggatccgtcgctggccggggaggccggatccttcgcctgccaccgcggggaggccggatccatcgccgcgtccgtggggatgatggtggcaggcctcaggcaaggcgatgacgacgacgatggcggtgacggcgacgacgacggctggattagggttccaggcggcttttgatttttttatttcgattttttattttcccgaaaatctcgcagacacctcgttccagatgggtgaaagatccgcacgcaaaaaccgattccgaccgtacggaaaaatcgttattctactgccatttactgtatcagggtaataccatcactcattttaaccaatttttttcgtagtaataagaaacataagaaaaacaaattgtcactctcacatatcacatgacggaatgtgtagagtcatgcaaatatgcgaatcatgggctagttaaaatatgacacagaaatttgaccctattgaaagatcttcatatattatttttccgggactatggttttataatcttgtgcacttcaccacagagacgtgcgtgttattgattcctccgtggggccagaccgacagtgcgtggtaaaaatactgttagaaccatgattattttcttcccagtaacccttccaattacacgcaacctgacaccaacctaaaaacggcgaacatatgttttattttgatctgatcatatcgttgtatatcgttgttattaaaatttttaataaaaattatataattatattttgataaaagaaaaatatatgtttcaaaccgttaagtttcatactcccttcatcccataatataaaagattttagagggatatgacacatattaagacaatgaatctggacaggagctcccataatataagagattttggaggaatataagagattttggggggatgtgacacaaaatccttccaaaatcacttatattatgggacggagggagtacgtgatatcgacatatttcaatgtgtatcttcactgtgtttcataatttttttaaatgtttcagttgctatttttttcgtttcactatatataagttaattttcatttgttggtcaactgcaatatttgatagtccgactcctttttttttttttttttttagaaatcaggcacccaaggtgtagtttctctctgtctttctccatagttgtactttcgaaatctaggatttgaaattttgtatatcaagccactagtctagtaggctattgatgagtcagagctatttcctccatcgtataagattttatttagatttatagtattaaaatatgttatcttttatcaggtttaattttttattgacatacttcctatatcctaaaaaaaagacaaaccctgatttccgtgtccaacatttaaccgtccgtcttatttaaaaaaattatgaaaaaaattaaaaagataagtcacgcataaaatattaattatattttatcatttaacaataatgaaaatactaattataaaaaaattttatataagagggagtactgctatagcctatagcgctgtgccatgccgtgcagcagctacatgcctcctgtctctgtgcgtcatgccgtcatcggtgagatttgaacacatacataatatattgtgtgctccgcgaggaaaacgcggggtgaccagatagccgggccaccacgtctgaaagcccatgtgccgagggcagttgcaacctcgctagctgctaccgcttgccagttgccgttctcccgtgcgaggacaaggcagtacagtacaatggctgtgcggctctgctgctgctgcttcctcctcttcgtcaccatcgctgccgccggtggctccctgacgcggacgaacgtcgcgacgctgccggggttcgacggcgcgctgccttcacgcctcgagaccgggtgagacaactcaagaatcattcccccatctgctctgacgattttccatgctccctgcatcagtataggtgagaggtcctgtggtgtcactctgtacaggtacgtgacggtcgacgaggagaacggcgccgagctgttctactacttcatcgagtcggagggcgaccccagcaccgaccccgtcctcctctggatcaccggcggcgaccgctgctccgtcctcagcgccctcttcttcgagattggtcagcaacccaacaacaacaagcctccttgtctagagtgtcaggcgtggttcatcccgttgcaattattaccacgcagggccgttgaagctggtcatcgagccctacaacggcagcttgccgcggctgcactaccacccttactcgtggacaaaggtcgccagcatcctcttcgtcgactcgccggtcggcgccggcttctccttctcaagggaccctaaggggtacgacgtcggcgacgtctctgcttcgatgcagctcatcaagcttctcagggaggtaattcattactacctggttttttttggtccattggttccaggttttcagcgtacttggttcttgctagctcttggtttaatatctcgtttgactctgattcagtggttcactgagtatccgcactacctctcaaatccgttctacgttggaggagactcctatgccggaaagatcgtcccgtttatcgtgcagaagatctcggaaggtgctgcaataatgttaccttggttactctttaaatctcaaaggaatatgctcttgttttcttatgtgtgatctaaatagttatataaaaaaatcattttataccactgaatttattcaacgatttattattgacttcatctccatctatggtatatatatctccaactttactttttctataatatatcattggggctgatacttttcaaaaatgatgcttaaaatgccttaagacttacaagagtgactattgattaagcaacatgaagatatatatacatatatatatatatatatatatatatatatatatatatatatatatatatatatatttacttacatagtcttcttacataatataatatagaagtttttttataactaatatagaagtgatatattatagagaaagacaaattcgatgaccaactgttgaactataataaatttaatggcatagaatagattttctctgaaaaaaaaactattttgacaagttagattaatgtcataaaattttaaatttgattttacaaattagcgaaacaaatatgacgtgagcacacgtatacgtaatccattctttttggtatgagttactgatactgaatttgaactcccacatatttgtggataaatatattactagtagtgtgcctgtgctaatatatcctctaattctttttcaaattctttcacaactatttaaatacaagcaacaacgaggggaaattgcctaggattaaaattccatttccagatttctacaggatctcttttcaagatcgatcagttcgcgcaccaaaaagcttgacaattttgtgctctgttttcagatattgaagctggcgtcagaccgacgtttaatctgaaggtagagctcatgtctttttctataaagctacaactcccggttaatatatatatttgaggtgttagtgataactagggtgtccatcgaacattaaaaaaaaacaaaagtatatttcctatatcaagatatagttgattatcaacttgagaccaagagatagtttaaaacccctcatttagcaatggatagacaacctgtatcatgatctgtaaatactgcaattttactaacatgttataatatatacaatataggatcatgtccaacattttctcttaaaaaaacatatacttcatccctccttaaaaaacctagaaacggataaaacctagaaacggatggtatattttctagcactacgaatatagataggcagtctgtccagattcatactattaggaaatatcttatccaattctaagttctcatattttaggacggtagagtagttgattaatgatctagcggcaattaattttatgtttgggagattgtcagggctatctggtaggtaatccgagtacaggggaacgcattgacctcgaatcaagagtgccgtacagccatggagtcggaatcatttcagatcagttatatgaggtgaacagtcgaacacgcggctcacaaaatttaattatgtcctaaatgattcctgcgtgatctttgttaactctgattgcacatgcattcacgtggtttgtctgaagatgataatggagcactgcgaaggtgaggattatgacaatcccagcaacgtgatttgccaacaagctttggctaggtttgacagcgtaaggagacaagtacactctttttttttcctcgattgtattagttgaattttcatattatcgaaaaaactatttagttgcatttttatattatcgagaaaaagaatttcttggataattctgtctgaattaacttattaactacgaatgtctaaaaaaatggcgttttctgtgtttctcaagaatatctagtccttttagtgtaatttattctttttgcagacagtagtaacatatatacagtagtaacatgtattactcacacgacagcaaatacatatccacgtgtccatcctgtatgtaggactaacacttttgcccctttggagcaaaatatgcacctgctgttataaacatacataggccctgtttggatccggagagctattaaatagcctttcggaatcttgctatttaggagtattaaacgtagattactgataaaacccattccataacccctaggctattttgtgagacaaatctaacgaggtatattaatccatgatttgctacagtgacgctacagtaattagccgctaattatggattaatatacataattaaattcgtctagcaaaatagcctaggggttatggaatcgattttgtcgttaatctacgtttttaattaatacttctaaatagcaagatttcagagggatatttaatagcccagaggatccaaacaaggccataacagagatttgctaaccagctgaatgcccgtattttgatagaaaagaaaatatgtgcccgtattaatgtgttatcttgctatagagaatattgaccttaatctaattttatatgtgtagacttgattgtttgtaacttaaactttgtatgatttggaccctagttttcgggcacattatatataggtagtcccaaataaatagcattcacgtgtagttctcaaattgatgaattttaatatttaaactaagaaggtggccagcgcgtatgcacgggcatccatattatttaaatgtaatattatattttgatatgtattataattaagggcaactcaaagtcacacgtatcttaaaaaccattcatcgaaatttaaataaatgatggattaaggtcacatgacttttgaatcgatttaatgataaactgccgtagctaattatctgtggacccctgtttttataacaggaatcattcgtgtaaacagtaccatttccctggatcaagtagtctggtacacgagttcatagctgaaataccaaaagcacatacacgagagtctagtgctaattattacatcataagcccgtaggcattgtcttaaatcatcggaccgagcggtccggaatacatccaaaagcaaaaatagataaggcagcggaattcaggcagcggcataccattgccacaggcaacgaccgtactaagacctactgagcgccattgtcttcatctccctcctggtagtaggcatagggatcctcggaagcttcatctcccgcttctgattaattttatatttgcaagggtgagtaccaaccgtactcagcaagtcaccacagcaacaatgcatatgaaaggggtatttcaaaggatggctatggctcttttgcgctaagccagttttgtaattcttttcacaaacctaagacctagcattgactgatcaaattttagtaccagtgtttgtatttaaacaacgacggttctgtccaccatccattgtgatcccaaggatagcttcccgccattgagtcgttatggttttctgaggacgcccaccttcccccttctcaggaagtggctccaacagcataaaaattcgtcatgcaacaacccatcccacataagttaagaatttagagactagccaagtgtaatacatgtcccggtgctcaataaccgcgagcacggctattcgaatagatttcgttcactcacactgcagtggatgtacactttactcgcactccgcgactgcccaacacatgagcctcgtctcaacacatgaggcgcgtcacggcaaagcttttcgataacctcgcattggcagtatccgctctatgaacttaaatcctcatgcactctaggcgtccatgtttctagcagtgtgaggagttctggcggtcccgggaaagagaagtctcacacatattaaattatggttcaagttaagttctctctctcacacactcatggcagttctaccaacggcgacaccgatgtagggcacgcctctcggccctacctcaacggttgtcccatcgtagcgcacctgcctcactcaggggtgaaccatctatgcagggatactgcctccgctcggctatctaatccgctaggtctatacccattcgagaagtacggttgtacgggggtcgtttcatgcttaacttcatggctcggtccttaattgaccggggacggtactagcctttcccagataccacccaaatcatccgtccgccccagttgaaaacagttgttttcgctttattttcctttcacaaatcatgttatcaatttcatggcaatgtggtgctcatgtctccacatgccgcatctcaattaccttcccaaaggtaattgcccaagcatttagcatttgataaatatgagtatgcatgatcctagaatagcatttctaagcaattgtcataattgactagggactcatacgtaaacatggttacgaaggaataagggataaacaataatcaaggcatggcataatcacaagtaggatgttcatcattgcatgcaattttatttataaacaaaataatttcgcaattgggatcaacatgttcaaggaatagtgatgacttgccttgctcaaggtcttgggggtcttggccttcacttggatccgcaactccctcgggctctatagttacgtgcgaaaattgatttggattcgattagaattcaaataaaaatccaaatggaagtcgaacgcgaaagtcgattcttttatattaactttactattcgcgtactagggcaaacccaatttcgatttgtatatcctaaactattttgtgggtataaatattttgttatcataagtttttaatttaatctacccgagcgttatatccatataataggttggaaatttctatcgcaagctaaatatcggacggaatccaaaaattatcttataatattatacgatttaattttagtctaggactaaacgactaaatataatatacgtctaaaattcctagtgattaagtccgaatttctaccgtgaatcaattacttatagagattacccaaaataatctataatagtctataagaattcatctaatcgtttagttcttaattacatttaaactactaccgcgaattgatttcttgtagaaattaccaagaataatccataatttatattaaatttcgcaattctacgactataactaatctataactaaattctaattattttaaatttttaaaacttccctaatctccctctaatttcctatttatttcccttttctttttcttcccttctttttctttttccttcctttctttttcttttctttttttttctttctctctctcctttcttttcttttttccttctcactatcccttttcttttctttttccttctctctctccctcccggtttctctcctcgttccttcttctttctctccctcggcttctcccttcctccctctccctcggctctctctctacccggcggcacggcgacaaacagggggggaaggcagcgactcaccgacggcggcggcggcgacgacggcggcggcgacgacggcgcacggcgcggcacagcgcggcggcttcgtggcggcggcgcggtggctcgaaggcggcggagcggcgggacaacaacggcgacgcgtggagatggggagggaaaagggagaggaggaggggatggagtggggagaggggagaatggtgggcctttataggggaaagagaggataagggggagagggaagagaagggaagggcggtggagggggggtgaggtgacggcggcgatgtgacggcgcgcggcgcgcgggcggagatgacgacggcgcggcgcggctcggggcgcaaggcgacgcagcacgtggcagcggcgcggggcgcgaggcagcgggtgcgaggcgacgggacggcacgcggcgcagcagcggcacggctcgaggcggcgatggaacgcgcgcgcggcgacgggatggcgacggcgactgcgcggcagtggtggcgcgcggcgcgaggcggcgatgggacgcacgcgcggccctaggcgggacgcgacggcgacggcgcggcagcggcgatgagatggcgacggcgacaggcggcgatggcgacggtggcgcggcggcaggcgatgatggcgacggcgcgcggcggctcggggcgcgaggcggcgacgcgtggtgacgttgccgagagagagagagggggaaagaggagctgggttaggggaccacgtcgaacacctggcggccgatgaatagtgacttttcctatttgtcccgattttagtgtattttccatataaattttattccacaattcctaattttgcatatatgcattttactcaatatttgtgttatcttaactaatgaattcaccctagattaatattactcatattttatttttatataatttatttgagttttaattagggttaattcttattccatcgtatttaaatttaattgatccaaatatggtcgcgataatattttatttatttctgtccacacctaatctttattttaatttgtatttattttaccaatttgtttgtaaggtttattcctaattaactattctttactcacgattaataatcttcgagatcaaatccagataaaatagacgaataagatcggcatgatgcaattaatttaaaaagtttttgaaaatccgtatttttagagttttgattttgtcggtcgaattttcagggtgttacattatcacttctaccatctgtacacatagagtgtaatatggctataagcaaaacttgtgagactaaggaaatcaaagttctttgtgttgaatcatttcatgaaggcacatgatacagtgacaaccaaattaaggatagattatatgttggattttttttctacgtagaagttcaactagttcaattttttacacagttttgaagaactttaaaggtatgttagaacacataacacccacacaattgcttggctggtaatgcaaaatattagcaattgtttcaagctaattactttgttttttcatgcttgattgttttctttgaaacaacatttgtttgaaataagatcaatagtgtataaatttgattagtgtgtgtagtgtacttataaattttgaagtgttctacagtaaagtttgcttttgtcatgtagtccaattatatcaaagaatatagttttatcatgtaaattataatcaataagttcaatataatttatatcatcataattaatgaaacttatttaaaaaatatgactacttaaaaaactatggttcgcttttttttttctccttatttactggtgcctttgtctactcggaatcaaagaaaaaagtaacacgtcatgccatagttgatatatggctatatgctatttatcagtactctatgtccactcattgctcagtagtgtcttccactcaccaatcatcttgtgataatcatatagacaatatttgtctatttgtttagtttacctaaagggcaacaccacattgctcctttctcatgcatggtcgtagactctaaaatgatttgcccaaagcatgttcttcattaacacatgtaactagaacattaattacataatattatacaagtgtggcacacttggtaattttcgttctagtttcacccctgttctggaaaaagtgctttaggaaacaatatatacataattctttttctgaaacacatcatttaggaacttgggaaatgtgcaaatgaaaatccaaaatccattaggtaatcaacccttcattttagcttacactgagttgcattttgcaaaaacttgacccactggacttgattattttccttttgaaacacacgtccaatttgttttcactttattaacaaaacaatcattattgattgatgatttgatgtgtcctcaccttggcaaactagtagcgttgtggtgatcctgatcaccttagtttccttgatctggtgcgttgcattgttgtatgtgcggaaggcaaaggtgtacgcatgtattgtgtagaggaacgaagaccaaatagtttaactaaaaaatagatccatcagtttgaatgaaaatcgatgaccaaatagtttaactaaaaaattgtatcaaataatgtgtccacttgttggtttaagtataaattagttgatataaattataaattgttaatttgatagatataaaatataatggtataaacttcagacaatgtattatttggaaataattagtccaccagtttaagtaaaatattatcttatattattaatttaatgggttaaaaatataactttataactttatttttaaacattgtagagctaatgttcagttatatttatttgtaaagtgttactttatgattatatatatagtatatgtttgtaatactatattttttaaatttattatgactaatataattattttctcacatatacatgaaaaaaggtggaaagaagagggaagctggtgtatttttttaattgatgtatataatttgtgtttttagtttttttggctttaacgttcattttttggctttaattgatgttcatttttgtcttctcacataatgttttacgatatgtatgtactttgtattttgggtttttttacgagcaatacttatgtgaacaggagattagaagaagggagttttttaaaaaatatatctaatctaacgggtccatcaatttatgtgaaaattgaaactagatgttttgcttttttttcttagaatttcaagcaatttctttaatttattagagtgccacgtgacggcttaagagcatttgtagaaagtttaatgaacttttactatataatagatagataatttaaatatagaatgctgaagcagtgttgattggatattttatatgcaagatctagtttaactgcatatatttatagagtaatatacattatttctaaatagtagaaaatactatttcaaagctcatcgattttttttcaatgacactaagtgttttttttctttactttatcgcttaggttaatcgtttttcttttagatgtatgttcgtaatacttctttttctttttccggcctataagaggaaagtattatcttttaaaataatacatctaatctaatggtgtaaaatatcgggtccatcaatttaaataaaaatcgatgatgagattaaacaatgccatgtgacgatctaggagtgcttgtatgagcgctacatgatggttttagagcgtttgtagattggttttagagcatttgtagttagtttaatgtattttgaagtatataatagatacgtgtcagggctgtgcaaccgtcggttttaattactgtagctttctgtgaacaatagcagttcatattggtacataagagtcctgttataatcttagaaacacggttgagacaagcatggtggcccaaataccaccataatttattctatttgtccttctcccattatcaaattttttgtcacataaagtagctggccggctgtgacgtttgggccaacttattgaaatagataggtggcttgcttgtcatatacatcctccgtttttggaaagaaaaacaatttttaagaatgaatctgggcaaatgttcttttttatttacaggtagtaccttaggatgaaatacggttcaatgatagggaataagatatggcattgttatcctactaggggtttcccggattatctatatattaatcattgtttttgagggtggaaaactatatatgttaattaataaatcgatagtgacatattgttgtttcactgcagctactacacgaaggttcgagggcccaaattttgaacccaaattgcatttatgtgtcccccaagccaaatcatgagacaatcgacagaaagatcttgaagggggagcatggaggactaaaacatccacctcctcaaccttcaataaaatgtggtgtaaggaactccactacacgtaatatcacgtacatatttctatatatatttaagttcatctgaatctaggtgaattttcgcatccacaggtctatgccaactatttgtcatatttttgggcaaacaacaactttacacgaagaactctaggaatcaagaaggtaatttcggggcaccttttcatttctaggaatcactcctttgcatttgccatacgagcacatttttcaaattatctaaatgccaaatatccagggcaccataaatgaatgggttaggtgccacgaacatgatctaccatacaacatcgacatcaggagcagcataaagtatcatcgaaatgttacactaaaaggttaccgtgctttggtatattggtaataaatgttattggcaagttctcagtagtacctgtacaagctattatttagaacatttcaatagaatatccaaactagatgagatggctatgacaaatatatatatatataccttagacaagtacatgccatggctatcacaggaaaagggagtatttcatatttttgataaatattcttattttttgaggaaaatataaatagtcttattatttcgtcattaccagctagagatagcattgtaactatgttttgaataaaagattgttcctaaattaaacctatacttaaacgtgttctgttcatattatagtcttggttgttcatatcagttcttgtaaccacttggtgagaattgtacttaaaacataaataaatcatacacggggataaatcgaggataaaccaaaccttctgttagaataaataaattagagcccacctcaatattgactttggttgtgcagaactcagacgcacacaaaccaatttatttatgcaaaattctccttttgttgaataaaatattagaaacaattaccaggaattgattttacaaattgatcccatcaacacgttggattatgaagcagattactactatctgtaccaagggcagatattttctttatttataaaaaaatggacagctgaaggaatttctggatgtgttacataaacacacaaacattaacctcaattgaaagaaattgtattttttatatatatttcagcatgacatttcaaaaaggaattagtgaaaaatccttttgaatgaagctattcagggaaaaaaacatcaaatttgcaggtccactcttactaacatttcgactttaaaatcttttaataggaaaaactagtggtcattggtgaaagtaatgttggatgacagaacaacatgttggatggaaactactaacccaactaacaacgaatgtgtgcatctagcaaaaatctcttgatgataagtaatactttgattcactgtgttgagctacagacacatttttaccttcttaagatatacccagtattgtaaactactgtttcatcaaatttatgtgcagtggtgaccacgatgctgttgtgccattcctcgggacacaagcctgggtgagatcactcaactacccaattgtggatgactggagagcctggcatatcgatggccagtctgctgggtaagattaatgttgcctaattcgttttcttgtttagttatgtataacactactacggggtgattaataagattttcataagtttaaaatacactgtgtttttcagttcataataaactcagtcgaagagtacattacctgaaatacgatttatttatttgcagattcaccatagcatatggaaacaatttgacattcgctacagtaaaggtgacaatatatctgtctacaaatgcatgattcttgtttttcaaaaagcaaatgaaacttttcttttttacattcattatttttactatggttattttgaatgaagttaattaactcctacagtttcaaacagtttgggagtatctaggttctaatgatttgttaaataccagatgcaaatgtttggttgcagtatgggttgaaagttgaaactgcaaaacgaaaattttgaattaagggtacaagttgtacactccacattttcatgaatgaaaacttcatgcatagtgatgagtaaaaataaatccaaccattaatgtaataaagctatgtttgttattaaagataagtgaattgttcatgcttgttcaccagcataacttttgaatgaattggcttggctggtgcacagaactaaatttacgtactattagagctagagatcttgagtatgaatcactagtgcaatccatttattatatactaaaagtccattaaacatcatataaatgctcctaatacgcaagtagcactcttacaaacaatactaagatgccatgtgtactccaataaatcaaagaaattcctaaaaaaaaaaatccaaccattgcatttcatttaattgtgtggacccattattttcatgcatttgatttattttagattagaaaaaaaacacttcccaacccaacgtcccttccatggccagcacgtatgtcgatggaaatgcgtacgtactaactactaacgtacacaactcccctcgttatcttactcctgtttactcttctatttacgtgcaatattagttaggaagcataatttctaaaaaaaaaagtttaaacagctataacatctaagttatatagctaataagctaattatatgttcctaggttatttatgactaaatttacatttaaagacacatatttacttatatttcaagtttcaaaaaaaatatgtcacttctgtcttattttttttattttcgtgtgcaattaaaaaatattaaaaaaggaagatatagattttacctttgtacgtaacttcacaatgtctttaaaactagaaaaactctaagaaattgtgaggaaataaacatccaactatcgatttttcactaaaatcgatggacacattgttttcaaccattaggtatatttttagagaaatcgcgatcatgtgtcatgtcttacgaattagaaaaaaatatttgaaattatcaagaagaagcatcaggttttcacttaaatcgtttagaaaaattagaaatacgaactactttctactttatcctactcctaaaatgcacataaaacttgccccgccccctctcctcatgactcagtctctccgatctccacctctacctttctccttgtttctatcaaactaaaagagaaacgatctataacattaacatgaccataatatttaagccatagatctgatttctaatctaactattgccatattcataactaaaataacagttaaatgtacacaatgcctatatttctaacttaaaataagaaccatgtaaaataaaaaaacagaaaatagcaaatgtcaatacagactaagttgagccatttggagaaaatctaataaattcgtaaaataatttggtttttaatttttcacttaaattgaaacaaccatagctttttccattgccataacaattttaagtgcatggtcaacatatatattaatggcctcccatctatcctatagcgtgacataagttgacaaagtgtaattataaatttctccacatattatttcattatgtggctgggacaaaagtgattttttaatctaggagacatttttatcatttaaatatattaaagtttacggtctatttcacgtcatagaaatgataagaggtgacttcttttagcgacttcttttagcattgctttcataaaacaataactaatatgcccacgcatctgcaccggcttccatcatagttaaataaaaaaacacagcccacttctatgagttgcttgtacgtatagcattggggagtgttgaagtataaaagtattattctctcttcctcattcagcttatgtttttcaatgaccaaaggcagttgatgcaactcaacacaaatatacagcaaaattacagcctaagaggcacgctttgaccgttttcgtataatggaaacaaatccaataacatatgctttgagctgaacctaggacatataattaatttattttatttctagcattcaaataatcaaacaacattgatgatgtaaactattcctttagtggcctctacagcaaggaacttctatatctaacccgtagtcattattaacagttcgatgaaagaaaccagttatatttcatccttagtcattatcaacgacaagatagaagaagaaaaaaaaattcaagaacttgacaaaagaccaactaattattgtttgtgattttacttgttttgaatatgcattgtaatactgttttactctctccaaatgtagggtgctggacacactgcaccagagtttgagccggagaggtgctttgcaatgtttaagcgttggatttccagcataccactatgatgatggatgtgcatatcgtgtaacttgcacaaatggaggattgtagtatgaatgtcatgggtgaataaaatcaattcttttttgggaaggctcaaaacaagactattttttgtaaatttgattctttttgacgagacccccactaggttccaggcggaccagaagtnctctcacctacaaaaatcgctccttgggatggttaagggaccgcatgcaaaaatttatttcacaatcgtctccttaagaggtccccttatgataataggtggggtagcccgcgaaagtatatattcccaagcagacaacaagaaaagaatgtgtgccccatgcgtccccgcaatgacacgcactaccttatctttcttgatcttcaccttgtttacacatcctctccactcacacacacctttcttctcttctcctcccctttgctctggtgggcttaaggcttcacattccctctccactccctcttcctctcctcatctcttccccattcctctcccccttctcttctccggtggttgagacggaggcagctaggagcgacgctgacggcggcgacggtgactactgtgagggcggagcagaaggaaggtcgatccggtggcgccgcccttgggagcgtcatatcaaccgttagcatcacgaggtcgataagcccctcaactgccacttagtcgtcacattccaccgctagaacgcacctccctctagccagcaatgcgtgcctccccaggtcaagccggtccctgtccgccacctcctccgtctttcctgtcaccggttcgccactatcgacaccgacccggagccgtcgccatcttcctcgcgtcgccatcgtcctctcatcattgcccgctgtcgtgagccctcggtgagccgcccctcctcttcctccccttctgccgccgctccgcgcaccctccgtcgcgccagatggtcgccgtctggcaccatcgggctgtgcatgtcgcaccctcacggtggggaaggccgaccgcaggaagccgcttcccagccgtctgatatgccccacgacagatctaggccgtccaccttgccgcccgtgtggctgctgcgtcggcacaacatgtgcaccacatggtgcacctgtccccagcctagtggacttagtccactgtgcgccgccctccttatgtcaacaacgtgtgcggcccgcttgtcggtgctggcctccattcacttacgtcagtgctcgagctttcatgcgcaataattcataaagttttttttctattagtatattcatccgagctccatttatgtcctttcaaatcgcactgaattcatcaaaatgcctagaattcatttaaaatgtttttattttccatttcaaaagacttatagcatgtttgctttgtgtgcattgtttgtctcttagattccatcagttgtgaacccccgttttacttcaaagtggttgcagaggtttcagcagcactagagcaaggcatgtcatgcatcctcattaaacatattgtacccatctaacaaatgtctcgctttgtattaaatactgtattattttacaatgtcatgtggggtagtttcctacatacttagccacagtttaatcatcttgtaccattgataagttgggaattaatatgactagatgttggtttaggaaatgcctagccatgcttagatcaactacctcactatgggaatctcacatataccttatttcttggattaatgatgatgacattggacatggatcaacatggtattaattcaacgacaatatgcgtaatggtgggctatgggcatatggttttgatagaagcgcccaggcagctaaggactagttcgtgggaaacaactgggtctgtagtatagctcttccctctataacgtatccaggcaagggttggcgtgatggagttgggttggccctggtttaagcgttgatcagttgcgagattcatcgcggtgcacatggggttgcccacccctatttaaaggtggcggttgttggtatttcttacgttcacagataaatctgcaagcgcacggatattgttgtagcattttacccatgagtattcccaagggtatcgtatttatattctgcaggcacggcggcggcgtaaagatataaattatacatcattcatctatctacaattaatccaccatagtctaaaaaggagttaaagataatatgattaaggtagtggacacacagtatgttcacctctatattaatgcttagtagaacagagtattagagaactatgatacaactgtacttctatactaatcatgtctaatacacacttaacatatacatgcttacaacataggacttagttccaggcacctaggtactaccgagagaccactccctgctagtctgcaagcgtagttattgcatttacgcaatacgtcacacccgaacgtggaggaatacaaatgatggacatggatatcaccacctaccatctacctcacttttcgtggggcacacccacatccaatggcatttatataacctaagcactgtgcttgtgctagtaaataatgtcacttactcccctaggactcccaccctacgggtagacaagttagcgctagagctacctataaaggtcattagaccgttactgtagcatggatcaactagcctagctagaatgaagcagttatacaaagtatatactaatatactgcctggtgggcccttccatccgcgtgctcgcacatgattcgtcggaggtgtgtttctttgcatgccggcttcatttttccttcactttgatgtatattctctacatccatgttaattctctaggtccagtacatttaatttatttattatctattatatactaaaagtccattaaacttcctacaaacgctcctaagccgccacgtggcgctctacaaacgctcctaaaccgccacatggcactttaatatagtagagaaaatcttaaaaattctgataaaaacaaaatacatctaaccattgattttcctttaaataggtggacccatcaattttaaccattagttctctattaaaaaatccggtacaacaccccgcaccgtatttgcgcacgtacgtaatccgtactccctccaccctccgtatctcttctcctctcctattttctaacttacctttcatatttttctagctaacagttaatatataattgtaattagatagatcataactctcaaaagttatcataaaagaaaaaagaaaaagatccgtccgtcgatttcaactaaagctgatggatccactatgcatgtcaaacagttagattatatttgtaaaggggcaattgcttatttgaccccgttttgaaccctaactaccaatttgaccctactttgttgagtttgcttatttgaccctcctttttgaaaatgaatatacggactaaccctattctgggaaaggcacctaatggtgtgaactgaagcacaaaatgtctcttatgc

SEQ ID NO: 33393 - DNA, 5087 bp, Oryza sativa
aaaggagggtcaaataagcaaactcaaaaaaaaatagggtcaaattggcagttagggttcaaaatggggtaaaataagcaattgtcccatttgtaaaataacaggcctatgttcggccttggagctattcaaaaataacgaacctttttctctctctctaagtgtacctacatatgttaggatatgtttagatcccactttaaattttttcactctatcacatcgaacgtttgaacacctacatgaagtattaaatatagactttaaaaaaaactaatggtacagattgggactaattttcgtgatgaatattttaaacttaattgctctatgttttgataatatggtgctattgtaaacatttgctaatgacggaataattaggcttaataaatttgtctcgtggtttactaacggattctgtaattagtttttttattagtgcccaaacaccccataatcgtatataatacctgatgtgacacaccaaaactttacacccatggatttaaatacccccttagtcaaaaaataaagtgtacgtatatagtgcaagagtataccgtggttaaatacttaaaaatagtattcaaataaatataacttcttaactgtgcatgcaatttccaactggtttgtatttttatattatttttgattaaattaataatttaagacccatgttaactatattttgattatagttatgatattctatgcatcacagttatgaaatattttctaaataaatacgatatcaaatgtgctattatatattaatctagaaacgtatatgtagttaaatttgatccatgataacaatgatgacgatgctctacgtatttccatggtgtatataattttttaagtagtgtcaaataaccaactacactcatcaaatttaaaagatgataaatgtttatatactactaaaatttgatagtataatttaagtgtaccaattacttaataaaaatgtgtctccactaaataaaaaatagactcaaaacacgtaatgattccctcacggatacaatattcttttgttgatcttccctatcttcaatttgtctccgtgaatcttctcattgtcctcccttatagtccccaccaattcatcccataataaactatcataatatatatgcaattaaaaaacaccttactttttacttctgttgacatgttttccaaagaaaataagtctaccttcttttcatatgaagaagaagattataaataattgcttacagacattacttaaatatgatataatataaagctaataggttagaaaattataaaaacatttaatgtcgatgaaaaaactttatggagaaattgtggcagatgttctccggttaatatttcgcttttataagtgtctcaaacttagcatacgatatatgcccgtgtaaatgtgtgggctacctttctagttgttataagtgtaagaaatattagttatccttttatttattatgatagttgacagtcgaaattggtacttatcgaccgtcaacaggggtgaaacctcaacgtggtaagcttgattaaagggagttgtgtgaagggtcctgtcccttttttgatatgttgttgtggcatgtcgacgcatagaaacgtgttgtttggctatgtttcatgggtacagtctgcactctgtttgcagatattgaagatggggtcagatcgacgcttaatctgaagttagttcacatgtccatatttttctttttttctatagatacattcaggtgttttacacgcgatgatttaattaaataataaataagtggtgttagagataactagattgctataggttgtcgatcaaacataaagaagaacaggtatccttacccatatcaagatatagtttactatgggctcgtggccattaattaatttgcaatttgggagatggtcagggctatctgataggtaatccgccgcttactggcgaaggcattgtctacgcatcaaaagtgccgtactgccatggagtcggaatcaattcagatcagctatatgaggtaagcacttaaacacgctgctcgcaaaattttaattatgtcgaatgattcctgctcgggcttgattaactctgcttggaaatgcatatgtatgtgatttgtctgaaaatgacaatggagactgcgaattgaagttgatttgcaaacaagctttggccaagcttgacagtgtaaggagacaagtacacttccgttttttcgcgattgtatgagttgaattatgatgacaattgctagcaggaaaaaaaagaaatttccctgataattctgtcacaattaactcattaattgcttaagcctaaataacatgtcatttttttaagtttcttcaaacaaatacatacacaagtgtccaacctggatagctgaaacaggacaaacactttttccccttggagcaaatatatgcaccggtggttataaataaactaattaacattagacagaaaattaggggattgtgatcccatggatgaatttttttttcttccaagatttggaccctagttttcggtcaaattctatataggtagacccaagtaaatatcattcatgtttagttctcaaattagtgaattttaagatttaagtactggtgtgtcaggactatgtaaccgtttgttttgattaacgtagctttctgttaactatagtagttgattggtatagatgcgtcatcctgtgatatataatcctacaaaacactcatgttcagacaaaaatgggtggcccacgtatatacctccatttatcatgttttcgccgataaagttgctgcagctggttgtgacgtttgggccaatttattgaattaagtagacatttttgggttttgcttgttatatctatgccacctcttatccacgggtaattatcaaaatctaaacacttcatcttctcccccgtatcattttcataacattttaacattcattatttgtacaatattttacatatatccatcctatagcctaatgattacaagagcctcagtagcacctgaggtcctgggttcgactccccatgggagtgaattttccagtatttaacggcgttgtgctttcagtggtaggcgatgtacccgttgacaacgaggcgcctgtggggacttcgtcaatctctccaggatttgctggcccaatcttcgaagatgctcataagggtgagtgtgcgtgcgttgtgagtgtctgcattgtactgtgtaattctaaaaaaaaatttacatatatgcatctattaataccacaacaaaacacgaggtatcatccaataggaacgatgaaatgaaccaggttcagtgattggaaaaaaagtacttaaaaacctatgtattaatcattgttttgaagtgtagaaactgcataaatcaactactcctttcatgactctgtccctccgtcccaaaagttgttatattttagaatggagagagtaataaactgatcatagctaaacattagattggttagtcatatcaaactggctatggaagacattgtgggcaactttttgtgacaagtcgacaagcacgattgcagcacctaaacaccttgcggtgatatggagtcaccaacctcctcgatctagccaaatggccaaatcaagatgggttatgtagaaaaacaactaaaccggctaacggagccgatttagagatcaaaatcagcctctaagccggtttagatcgatatgaggataattacatgtttcgtgggcaaaacgaaaggttttcaggacaaacctacaaagatgtgtcacactctcgcagcggcggcggacaatttacggcacaaatcgacaaagatggactaaaactagggtaaaatagaaaacatagctaaaaagtaaagataaaagaaaaagcgattcaagtatattgtgtgtatgggagattacaattgaaccggccttgtcccttaaataggggttggtcttgccctctacaggctctcctccatgtccaacttggtatagaaaccaaaggaaatccaaaatatgccttcccaagcaagaaaacccgagacccgacgaaaacatactcagactcggaatctgacggtctgaccggacccatacctgcggtcagactggagttcaagccacggtcagaccgcccacatacctacggtctgaccggccccgtgaaggaaacccgacactttccaaactttggcaattttcccctatttcgtgcataggtgccaaatttcggtgtaaacagacatattgttgttcaactgtagctactactacaccacggttcgaaggcccaaatacgtccccccctaccaaaccataagacaaccggtagaaagaccatggaaggactagcatgttgcactgaggcaaaatatgttacaggatatccagaaaatttgtaattggctagagaacaccgcaaaaacgtgtatcaactatagagcaccgcaaataactggtaattagctgcttgttggcgctgttaatgacaaattttatgccaccaatacctgcataaatcaaagaaatagaacatccaatatagtgatagcgttaaattctaacatattccacaaagtgttagtgtatatttatatgcaggtaataaaccgccaaagatggatgaaatatagacttaagtgaaggagaattcccatccatatcaagagtgggccagaaactatcagaaaacatattcaattgggccttccactcgtagatatggatagtggaggaggaggagagacaacatgccaaaacttgggcctgttggacctggcctgggttcggccgaaccactcccacggcagttcgatcaaggttttggcatgaacggtcatgggttctgccgaaccactccaacggccgttcgatctaggttttggcatggacaatctggatgaactcctgatagcggttgaagggcaaaaaggacattttgtgttttctaaccgtcatacctacccttatataaggacttcacctcttcacttcactcacacactgcaagcttgtcacgcccagaagtttccccctttttccttgctttaaatatttgttaaataaatcgtc

SEQ ID NO: 33394 - DNA, 978 bp, Oryza sativa
tttcccccattcaccgtcctctcccacgccctctaccgccgtcgcgccgcgctcgccgagctccgccgctgccgcccatctccggccgcgtgccgtcgccactagggccgccgccgcgccaagccgccgccgcggctagctccgccgccgtgtgggccatcttggccaccgcctcgcgtcgccggaaccccaccggaaccgcatctcccctcgcgagccggtgagctatccattcccctccgtctccggccagccactttggtcgtcgcggtcgccttctccatccctaactcctctcctcccctcctctaggtgtcgccgccgctcgtccgcccctcctctcgtcgggtcgtcgtcgccgccttcgtcttccgctccggccgccgtgtcgccggtgagtcctccctccccctcctttcctcaccttcccgcgagcgccggccacgccgctgctccggccatgcgccgctgcctttcggccgtcgccgccgcttcccgcaccgccggtcaccgccgtcggtggccgtgcctcgccgccgcctcgccttggtcggccggtcggcccttaggcagagccgagcccggccggcgcctccctcgcctcccctttgagccaccgcctggtggggcccacctgccaggcgccacctccctccctttggagccgctgacccgtggggcccacgtgccggcgccccccctttcactgacgtcagccctgggctttattgcgcaataaaatgattaaggctttttctttattagtaaaaacacagtttatcttctaaaattcttaagtaattcatccgagctccgtttaagtccattcaagtctcagtaaatcaagaaaaatgcaaagaatccattaaaaatggttttgtttcctgtttctgtagtcttatagcatgttttgcttgtgtgctttgtttgtcgcataggttttggccgtttcgtcgatccgcggtttctcgaagacgg

SEQ ID NO: 33395 - DNA, 739 bp, Oryza sativa
gacaggaatacacttatctagacactagcacagagaattccaaacgagcaaatataatcttttactaagcatttgcatttctaaagaaaggtatgttgcagtgtaatcactagcataatttgtgtagttcgcactaattccctgccccttccaagaagaatacttaacagcagttgagagtctaaaggccagttatgtttccagatcataaacaagagcttaaactttaaacacatcgggagagattgtgtgcgccaaagaagcttaagagaaaaaaaacgttgaacaagcatgctaagtgaagctaatgtaaactactatacagaaaatgggagctcctgaaagcattagtatacttttttaatgtaactgatttcatatgtttaacagatgaaagttggcattgacttttgtaacaacctgaacgctggaaagcatcccacataatgtcttcgtgctcttggatgccaaagagacacaagggtgcagcttggatgccaaatacttgccatagtaactatccggtattgctttggcgcaaaaagtcctgcaacaatagagtattagagatactggcatacccagaagaaagaacagaacaagaaattcaacataaacccctttgaagagaccttcggatgcatatatagccagaatctaattccctgccatagattgcaagaaccaagcttcgcacacatacaatcttccattggcagccaacactgtagttttaaga

SEQ ID NO: 33396 - DNA, 403 bp, Oryza sativa
aaaacttagcgagagcttaaacctcttggaaaatttccttcgaatctatctctctcatctggttcctgtattttttctatggtccaatcaaacggttattcctgtgtttttcccgttattttacaattctctgttttacactttcattcatgttagaatcatatgtttttcctattcctccgttttttcatttttgcaattcaaatgagccttaagaatatttggtctacttatcactattttaatattactcaacatcaaatattattgatcggaagaattgttcttatcctcaacattcatcacggtcaataatatctcatgatattagcaattactccatctatactaaaataactcaatctagatgtgacatatccttattcaaaattgttatagcgtg

SEQ ID NO: 33397 - DNA, 477 bp, Oryza sativa
aagcagttttcaggtccatggtgctatgagaattttgtccagctaacatccctgaggagagcacaggatgtcagaaaacagctccttgagattatggacaagtataagcttaacgttgtctctgcagggaatgatctcaccaaggtgaggaaagccatcactgctggcttcttcttccacgctgccaggaaggatccccagggaggatacaggaccattgctgatcatcagcaggtgtatatccaccctgccagcgctctcttccagcagcaaccagagtgggttatctatcatgaagtcgtcatgaccacaaaagagtacatgagggaggtgacagccattgacccaagatggcttgttgaactggcaccgaggttctacagatctgcagacccaacgaagatcagtaagcggaagcgccaagaaaggattgagcctctgtatgacagatacaacgagccaaactcatggcgcctc

SEQ ID NO: 33398 - DNA, 672 bp, Oryza sativa
ataggctgaggaggctgtgtattcaccgtggttgtttagcttccaagtgatctagtcttcttgatccgtaaattgcacacttcgaatggcgctccaaacggcaatgacttggtcgattagctccgttgtccacccttcggttgttggtagagcaaggtcaagcagccattggtccatctgagcggcctgttggagagtcctgctcttttttctggaggctacgtagactagtggtgcgacatcctttagtcttctcccctatagccaagccaagtcccagaaacttgcttttgctccgtcgccaacttgtattgttgttgcagcagcaaacaacagcatgtctgtttcatcgcaaggcgtttctaaccccacccaagccttttctggtgacttccattcgtgctagagccatttcagacggagggcccttgcaaatttcttgagatttaggatgccaagccctctcgaggcagtaggtaggcaggtacgcgtccaatttaccttgcacttcccccagtgacggtttcattcccaacccacagaaattgccttcgttgtttgtccagaatttcaagggattccttagatgctttcaagcccgtcagcaagaagattggttgggacgtaaggacgacttttaccaaggttgatcgacctgcgagaccaacatgc

SEQ ID NO: 33399 - DNA, 307 bp, Oryza sativa
ttttactttgtgatttgatctgaaaattaattgttaatctaacttgattattgtgctacttaggaaccagcgcaaaggacaagtcataatagaccaagggggactctagtcaacaagacaatcaagtttgatcgagataccgtaaggtcatttctgattgtaaaagtgctaccagctattatagcaagttggtctccagaagaagcacacaacactatatggattcagcaggataatgctccctctcatgtcctaagggatgatcctcaatttgcctatgcagtttcccaaacagggtttgacatcc

SEQ ID NO: 33400 - DNA, 373 bp, Oryza sativa
cgcccccgccgtagttgctgctgtcggcgccgtcaacggctggcgccgcggcggcggcgaacagcgaggcctcagccatcggcgcgcgcagcgccgacgaggcggaggtgccgcccccgccgccgacggaggcggaggtggagtccgagaagcacgaggtgtcgccgccgccgccacttatgccgaggcggcccttgcggacgacggggaacacgccgggcttggtgaagatcctggctatcacccactcatcctgcacgacacatcaacacagagaaattaagaatcaaggttgtgtagcaacacgaatttaactgtgtatatatatcatgaactaaaaaaagggtagtacaaggttgtgtagcagcagtac

SEQ ID NO: 33401 - DNA, 564 bp, Oryza sativa
cgctttgcaaccactcgcacccgagctctctgccctagcgccgtgcaccacccgccgccaccgctctaagcgcctccggccaccgctcgccgccgttagagccgtcgccgagcctcgccgttgcctccgtcgggttcgcgagcccgagggccacgccgtccacccctccgccgtccgatcccgtcgccggaatccgcctttcaccgcacgcaggtgagctcgccattgcagccgccttcggccggcgtctccgtccgttgctctctctctctctaatcgctcccatttcgttccccaggtcgctccggagcccgtcccgccgtcgcccgccgttttccgccgctcgccgtcgctcgtcgtcttcggtgagtccctctttttccccctctctctcttcctagccgccgcctagccgctagtgccgccccgctgtcgctcgccgccatcggccgtttgccgtcgtcgggccagcttgcgccgccgccgcttgccgccgcgccaccgcatgccatgccgccgcacgccaggccgccgggccggcttaagccacccgcgcgtgcgccg

SEQ ID NO: 33402 - DNA, 748 bp, Oryza sativa
cagagattcttgtgggcgctgcgcgcgcccgcgggcacgaagccggacgccgcgatgtctcttcttcctgacggattcttggcgcggacagccgacagaggcgtcgtggtgaccgcgtcctgggtgccgcaggtggcggtgctgcagcacgcatccacgggcgcattcgtgacgcactgtggatggaactcgacgctggaggctgtcgcagccggcgttccaatggtgtgctggccgctcgacgcggagcagtggatgaacaaggtgttcatcgtggaggagatgaagattggcatcgaggtcagagggtataaacccggggcacttgtccaggccgacatcgtcgatgccatcttgaggcggatcatggaatcggatgcgcagcagggagtcctggagcgggtcatggcgatgaaggagagcgcagcggcagcatggaaggaagggggatcatcgtgcactgcattcgctgaatttctcaaggacatggaggaggggaatgttgccatggcgcattccaatcaggttgaaacttgaatttcttcctgagcatggctcttgacctttgcatttgtcttccatcaattaggatccatagaaaattgtccaaacccatctgcaagcaccacagttggtcaaatgcttgtttatgataagcttaagttcaaatgaaattcactgaccccaaatatgtgatgacaggtctcttacctgttagaaattcaagcttttcaatttcgtagttcgt

SEQ ID NO: 33403 - DNA, 1010 bp, Oryza sativa
  unsure (1)..(1010): unsure at all n locations
aaatgcttagccatgcttagttcaactagtacacaaatggggatcacattattacatagactttgtctattggcatagctttagattggtgccaccgcaagggtgtcagttaattaaaatattctgaatggcgggctgtgagtgcatggttttgctagtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccgaggtgttcggttgtccagctgccggattcaccgcggcgcaagaggggaccgcccactgccttttgaggggtaggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagtttaggtggttggttgggcctgttgcaacgtggtgtagcgttggacagtgattggttaatattgattaattactacagctgttttactgctttcaactactgctttgaaatgcctgctttatgcaaaagaacccctagcttcctttggttatatcctgcatcatacctcctcttccggtatgacttgctgagtacagtgggtagtactcagtcttgctctcttttcccccacaccagagttgaagttcttctcagttggagccgtctcagagaggttggtttcgttgctgccgtcaaggtttgcctgnnnnnnnnnnnnnnnnnnnnnnnnnnnnnnnnnnnnnnnnnnnnnnnnnnnnnnnnnnnnn

SEQ ID NO: 33404 - DNA, 6640 bp, Oryza sativa
  unsure (1)..(6640): unsure at all n locations
atactgtgcatatttgatttgttcatgttatcgtgcttagtttacatgtgtagatctaatgatacgttcatgctagtttacatcttcaatgtcatgatttatttatggaataaattaaatcattatgtgcttataaattcaacaatccaaaaaccttattataggcactgtggttttactatgattggttttgccgatgcactgaagccggataaattcaccggtgtgcactttaagagatggcagatcagggtcactctgtggctgatagctatgaaatgcttctggctgagtactggcaaaactatgggagttcttactgctgaccagcagaaagaattcgatgaggccactactctctttgtgggatgcattcttaacgttcttggcgatcgtctagtcgacgtgtatatgcatatgaccgacgctaaggagttatgggatgcactgaataccaaattcggtgctactgatgttagcaatgatctgtacgtcatggagcagtttaatgactacaggatggctcatgaaatacagaccatggctaaggaactcgaactccttacatgtgtcttacccgataattttgtggccggatgcattattgcgaaactacctccatcttagagaggttttggtactgcactcaaacacaagagataggaatacgccatttagtggttgatagcgtctcttgatgttgaggagaaagctcgagaaaaagataccgcgtctaagggcgatggtggacagtctagtgccaatattatgcacaaggcccagaacaagaataaggggaaatataaagctcaacagaccaccaacttcaagaagcagaagaagaacaacagcaatccgaaccacgatgagtgaacttgctttgtgtgtggtttgactagtcatctggccaagaagtgtccacaacgcaaggggatgaaggcacctgtagggcagacttccaagtttgctaatgtaaccattggtaacactggaaaaggaagcgggtatggtaatttacctactattttttcagctaatcagtctactaattggtgggttgatacatggggcaatgtatatatttgtgctgatgtttcgttgttttcttcttatcaggtagcacgggattccaccgtcctaatggggaatgggtagatatgaagttttgttgttcatggtgtttgcacggtagatctgaagtttacttggggaaatatcgtgcagttgaagaacgtgcagcatgtccctacaatcgatagtaatcttgttagtggctcccgtctaactagagacggatttaagttagtttttgagtgtaataaagtagttgtgtctaaacatggatattttattggtaaaggttatgagtgtggaggcctgttccgcttttccctttctgatttctgcaataagtcggcagtgtggatgatgaggctaatgtttggcactcacgtttatgtcatattaattttcgcttgatgtctcgcctttccaacatgtgtttaatttctaagttttccattgtcaaaggttctaagtgccatagttgtgtgcaatgaaagcaacctcgcaagcgtcacaaggctgccgaggagagaaacttggcacctctaaaactcctacattcagatcgctatgaaatgaatggggtgttgacgaagggtggaaaatgatatttcatgacgttgattgatgatgctactagattttgctatgtgtatatgttgaaaatgaaagacgagggtctagactattttaaaatttataaggcagaagttgaaaatcaacttgacagagagataaaaagatttaggtctgatcgtggtggagagttgttcttaaacgagtttgacttattctatgaggaacatggcatcatacataagaggacgcatccctattttcccgagtctaatgggattgccgaaaggaagaaccgcacactgattgacttggtgaatgccatgttgcataccgcggaactacttaaggcatggtggagggaggcattgttgacgtcgaatcatgtgttaaacagagttcctaacagaaacaagaacaaaacaccagacgagatatggattgggagaaaaccatcactttcttacttgtgcacacgggggtgcttggcgaaagtcaatgtaccaataacgaagaagcgcaaacttagacctaagactgtggacagtgtcttcctgggatatgctcatcacagtactgcctatagatttttaatagttaaatctgaggtacattttatgcatgttggtacagttatggtgtctcgtgacgctaccttctttgagagcttttttttccaatgaaggatacacatagtacttctagccaaccctctgaaataattcccagttcaatcacaccaccagaacaaaatgaacatacacatgaacatgtcattaaggaggatggcagtgaagctcgtcggaggagtgagagataaaggatggctaagtcttttggtgatgatttcactgtgtacctcgtgaatgacactccgcagtcaatttcagaagcatatgcatctcctgatgcagactactggaaggaggttgtccgtagtgaaatggattccattatcgctaacgggacttgggaggtaacagagcgaccctatgggtgtagacctatggggtgcaattggggtgttcaagaagaagtttacgcctgacggtactattgaaaagtacaaggctcagcttgttgaaaagggctatactcagaaagaaggcgaagatttctttgacacttactcacttattgctagattgaccacaattcgcgtactactttccntaagcctcacatggtcttgtcgtttatcaaatggacgttaagacaactttcctcaatggagagctggagggagatctatatggatcaacctgatgggtttgcaattgaaggtcaagaaggcaaggtgtgcaaattgatgagatctttgtatggtctgaaacaaactactaagcaatagcatgagaaatttgatagaacatttacatttgcaagcctccaagtcaatgaggcaaataaatgtgtatactatcgctatggtaggggtgagggagttattctgtgcttgtatgttgatgacatactaatatttgagacaaatactgaggtgataaatgaggttaaatcattctgtctcaaagtttcgatatgaagaagttgggagtagctgatgttatactaaacattaggaaaagtaggggtgagaatgggattacactcttgcagtcccattatgtggagaagatcttgaatcgctttggctacattgacagcaagccttctccaacactttatgatcctagcttgctgcttcgcaagaacaagagaattgctaggaatcaattggaatattcccaaatcattgaacataaggttggtgctgtttcgtggaggtcttcacactgggtggtggtgttgtttcgtacccatgtgagttatactattgtggtaacccagtctatgtgatcggagatcccgtgaattggatcctgggaagaacaagccataagttaactgaaggagagtaccaatataaaccctctctaagtgaagatgcatgtactctcgtgagctgcaaggcaggttggctatgccttaatgagttttgttggctttaatttgcgaagatgctgtcctgcagagcattcttgaaagaactcacctttgtgagcttgactgttggtcgcagtctacggagattttggatgaatcttctaggaagcttactaaaagaccaaggagtatgacttatacgctccaaatgaggggtagtttacagacggtctagtatcagataagactctgagtaaaatttgcttgcacaagacttgcaatgcaaggcatagtccattgttcaagttgtgagtaagtgtagcttggagttctagatggatgttcaaccttaatcggtctccatcgaaccgttggtctataaaaagtacattggaaaaggaaaatctcagtgagattttaagatttggtgggggattgttggaattaacagatgggtcttagtccacttgaagattaattctttggaaaatcacaaaagcccacctcatgtgatggtatgcatggggagtttagtaccaccttgcttattctaggagagggggacctccttaaaagggaggatgccttcctagccacttgaagcatgtgaggtggagagaagaggcgaacacacccgcgcgctcactcgcctcgcctggtccaccaaaattggttcctcacccttgcgcagatgcaacctccttttgtagttttgttttgttgtaggaaattcggatttgtttgttttggaaacatttcgaaaaatccggtgcgtgaaaatggcgtggagtccggataggttacgcgcgatttatccggttcggttacacggagtggacatcgtgtggacgccctgatcaagcgacctttctctatataaactgagccgccacctccatgcaacgacacaaaatcaatctagggtttgcctccacgcaacaacatcgtgcgggcaccctgatcaagcgccgtcgctcgtagtctactccatcccgctcgtaggcgtgcaccggcgatcgggagagcaagtctccggaacctctaccttcgatgtcctgcatcgggagaaggcggcaataatgtttttgggaagcgcttcacgtgactgttccctgttcgaccacgacggctcatcttcctgttcgttcgcgtgctccatgctgtcgtcaacgcacacagtaccctcggtacgtgttcaacgtgttacacatatttgatctgttcatgttttactgcttagtttacatgtgtagatctaatgatgcgttcatgctagtttacatctgcaatgtcataatttatttatggaataaattaaaccattatgtacttataaatttaaaaatcgctgacgtatatcagcacctacagggggccacgctagtcaaaaattgctggggaggggtgaattcccagctacctttaatactttcggttgcaacgtaagacttttaacttatgtggcgaacttatgtggcgctgtattaaatgagagagatgaaaaaaaaacttggtcttatacaacacatatctcaaagggaaaaccaatacactattgctgcccccagttttggaaacaaaaaatatattttgtttccctataccaacccctagaataacagttggtacatacaaaaggctccaaaatgtaacgtacccaaactctagacctttaaaatttcttgtcaagatagttgaaagattacttttatatttttgtgagacaaaaattttcattttaaacataggtgaagataaaaccaacctttatatgtaggaaaatgagagcaaaattaaaacctttttcatttctaacctgagattaaaaaaaagtgcaaccatatgtgtaattatgcatacttgcataggacatagtttaacttgagtcttttttcttgtgcatttgtatttttggttggcatggcataataggtctgatgaacatgattaaaagctaacttcactaagcaaacctaaagtcattcttgaggtataactttaaagacatgaaaatggagttaagtaataacatgtcaggtcaagagaaatccaaatataattcttataaaatttagatgcatttatgcattggaaacacacatataaagaaaggtcttgctaattatcaagaacaatccatgcaagacaaaatcatgagaaaattcatgaaagcacaaatcaatataatcagctcactataatttttactcaaattaatatttaaatttcttagctcaaataattcagtcaaagcagtcaactataggatgtaaaatttaactttaatctgctaaaaacataactcacaaaaatgtgcattaaactgcatagaagtgtatgagtgaaataatttattcacatactaggttaattatcaagagcaaatataatttttctagagtttatttcttctatttagacctcctaaaattcaaacaaagttctggtgagcccatattctctatttgtctgacagcaaactacacataattagtacaaccaaagaaaatagaatctagataatttcatctacctccggaaaaatccactataaattattctgcacagaaattaaataattgaattactaaagtgagggagagaaataattcaggaaaatcgttggaaaacatcttccactcatgttcctacccttacctctcttacccacatagctaccatcgacctgggcccatctagcagctccttggccacgcgtcgaccggtgcctagccgtgtccgagacataggagtttcgagaaatgccatcatagaaacgattttgtaactcaacagcacggaatagacggaaccctaacagagatggtatttttagaataaaattgttagtacgatgatatttcttggaacttacacttgtccatggtgtttctgggacttagacgcttgtcaatggtatttcatagattatctcttattatatatgtaagtctaccgtctattccatctagatatttctttagaaatcgctcatggtggtgctgtgctgtcctgtccttgaatccgacgatgtccctcctcctcctcctcctcc

SEQ ID NO: 33405 - DNA, 2284 bp, Oryza sativa
  unsure (1)..(2284): unsure at all n locations
ccccgcaggcccattgaagctggtcatcgagccctacaacggcagccttccgcggctgcactaccacccttactcgtggacaaaggtcgccagcatcctcttcgtcgactcgccggtcggcgcaggcttctccttctccagggatcccaaggggtacgacgtcggcgacgtctccgcgtcactgcagctcgtgaaattcctctccaacgtaagcccatgttctagttctacgcaattaattggctgtatttttcgaccatttttgttccaagaaacgcctctgatcgcctgtttcagtggttcggtggccatcctgagtacctcacgaatccgttctacgtcgggcgagactcttatgccggaaagatcgtcccatttatcgcgcagaagatctcagaaggttttgcatgtttcgcagcaattacgactacttcacaatttaacgattccctgtttttcagatattgaagcgggggtaagaccgactcttaatctcaaggttagccatctgtctgccattgattaatcgcagaagaatcattaccatggttaatacgcagtggctaattaacaagtaaaattgcagtctctcgtccttatcgaaatacgtcctcgtgtacaacttgcatctaactgtagttcatgtacggtcgatcttataatacgggcagtagtccaaaacgttaccatcgttcttgattaataatgtttgttcatcatataatagtacaaataagttcacctaaaagctttgacaagtttaattaggactgaccattcgtctatatggctagctatatccatttataattgtaggaactgttgttagagatagcaactgaactaaatactggcgccaattttattcagtaactagtcgaatccaataccaatatccggtctctatatccatgcatgacagattatgtactcgtactaattactttgcattttgagtgttattcagggctatgtagtagacaatccaactacaggcgaaaggatcgactacgaatcaaaggtgccatatctccatggtgtcggaatcatttcagatcaattgtacgaggtaattttaattaactaaacacgcttcccatttattatgtcatcagtccaatttcattcagactgactttttacatttcttaattacaccggccttaagacaataatggaacgctgcaaaggggaggaccacaacaaccccaagaacgtgatttgcaaacaagctttgactaggtttaacgatgtaaggtgacaagtacaacttcattttttatcatccttttgacttctttttcccggttcaaattacgtgcatgggaatttctgttcgaatcaagggaaacgtctagaattcgtccttttggtttaaggtccctaggctttcaccaaagaacagttttgctataaatctatcgtcaaattttttccttaaaatttgacgttttttcaactgtccgattagcacctgattagggcaaggcacatcccacggttcgtgcggaagagacagcagggcgcactgatgaccaagtgaagtactgtatgtatgcatctttttctagctttgccactgtatagaacgaaagcgattgaacgataaaacgtccttaatacgggtcagagatctcccgtgatgtctatttcgtatgagcagcagtgttttaaaagttacatgcaagttacactagaattaatgtaagttacaatgtaaactataattgtactatgtttctttaaaatataaaactacagtcctatataactaaaattacatttgtaaatttatttgacatgacatgcaagtatattgtaattttggtaaaaatattatgtaagtaaatatgtattcgttattttctttaaaatataaaattacagtcctatatataactaaaattacatttgttaattcagttgatatgacatgtaagtgcactgtaattttgataaaaataatgtgtaagtaaatatgtatttgttatttttttttgtagtccgttggatgtaaatctagagatatgaaaaatctgggagatttttttttgttagaaatcacccgacaaatggataggcagaagtctaaactttcgatttatccgtccttagacttctgggctgtgttcgttgatttgggttgggaatccaactcctacacacggaaaacggagcgattcattagcacgtgattaattaagcattagcttatttttctcaaaaatgnnnnnnnnnnnnnnnnnnnnnnnnnnnnnnnnnnnnnnnnnnnnnnnnnnnnnnn

SEQ ID NO: 33406 - DNA, 8618 bp, Oryza sativa
  unsure (1)..(8618): unsure at all n locations
nnnnnnnnnnnnnnnnnnnnnnnnnnnnnnnnnnnnnnnnnnnnnnnnnnnnnnnnnnnnnnnnatgattattaaaactaaaacaaattgatacttatgaattttaagtccaaaaataattgatattgcatgttttatgagagaagaaaaaagagatgatttgaaccaaagatctatcacccaaaaactataaataattggggtgatgtggcttagtgagaaaagagagaaataacattaactaattcttagtggggatgaacatataggattctgcatcatttctccttgaagcacaatattatatattatataaaaaaataagcttgcaatggtcggctgtcattaaaaaaaatcagatcagaactatttttttaaagtatttatcataagtggaacatgtttatgtttgataattaatttttagaaattcatgtagtttgacaacatgtaggttattatgaaagtattttttttatggtgaatctaattgatattacatagttcataaaattaatagttaaaatataacaatgtgtgtttagtataagtaattttgagacgtaggggctacaatcatcgaagaaacctaatccaacaatagtgattacatctccatctgaataggctcaaagaaacagctgaccgagttgatctgaaaaggaaagagactggcgtacgtacatgctagtcactggaagagaagatcgaggtaatagaggtagtgcaaccacgtataatatataatagaaacctaaaaactaatatagcatttaaaaagaggcgtatgatatatttatccatatcatcatgagtgtaacttttactcccatatttaaccataagtaaaagttttacttctactctgaatcatatgtattttcgctacatatttggtttgtactataagtttggtttgtgaccaatgttggccttaccaaaatttggcatgctaatttttggtaacgccaacatgtgtttagattgaagccaaattaaactaatttggctattgaaatggcctatgttatataggtatgctaaaatttggtttcaatccaaacatacacaattattgttgaggttgccaaaaaattggcaagcctaatttaggcctcaaaccaaactgcccataattttttctgggaagagataacagtggtgagtggaagccaactgatgggagcggtagctgaccaaagtaggtttcaccattttggaataaaatttttaaatgctccaaaaattgatgcaaaatgttatatcgaagcacatattttggtttttactcttatgttctaaaatttaagcatatgtactccctccattctaaaatatagtattttttgggtggatgagacatatcctaacactatgaatatggatagaaatatattccatccaacaaaaaattgttatattttgggacgaaagtagtatttctatatagaaatgttagtaatatttgttagtaagtgttggcagtgtgtatacctgaaagtttatgtgttcacccctcatcctaacttaaaaaatgcatatctgaacatagcacagagccaagagcccatttgaacaatcaagctagactcacaaaaacaggaaaacatagttttgcgaaccacaattgagagaaacttttttgtcattatactctccacgttataataaacgaatacgaaaactaccaacagtttctagtattaataacttataaatcatacctccagcatatgtaacgaatacgaaaactaccaacagtttctagtattaataacttataaatcatacctccagcatatatttaattccaagataccaatggaaacctatattatttgagatttactccggttcaaaaaaaaatatatattgagataccggtatctcattataccaaatcatttccgatcgttgaatctaacaatgcacattatacgtagctagatccaacaatcagaaataattttataccgtgaggtgaggtatcgatatctcgagatattttttattaaccggagcaaatctcatattatgttatattatgttatgtgtcttgtctacttcaagacctgcgcgaagagctccttgataacggaagggcaagtggtggtgagcagacggaagtcatcgtccagcctcgtcacctgcctcagcttcctcttgcacgagaggaagtccaggcacgccgccttgagcacgcggcatccgtgcttctccgcgaacaccagcgtcgacgccaccgtgaggacgctcaggctcctgcacagcgcgtcctcgcacatcagctgcagcctctccatcccgtacctcgccgccgccgcgtgcagccgcctcgccgcctcggccgccgccgcctcgtcctccttctccttcgtgtcgcgggcgcggggctgggcggcggcggcagcgcgtcggtgtagatgaagtggagcagcgccctgaacgtctcggcgtccatgtcgtcgtcgacgcgcagcgtcatcattgtgttcttggtggcgtcggcgtcggtgtaggccgcgtcgtcggagtcaaggtcgatgacgagagctcggccgccatgaccggcgatctcgccgcgagcatccaccggtgcgccgtgaacgtcttcccctggacctcgatgaagacgtcgccgctggattggttcttccagaggagatcggcgaggtggcggtgcaggttgggcggtggcaccttgatcccctccttgatctgaacccctctgcggccgtcgccgtcgccggcgctgttgacgaatccgagttcgcagcggacgaggaagccgtcgtccttgagaaaccccgacgtctcgagctccgccctcttgatgttcatcccgaagtcgttcccggagaagtcgacggcgggcatgccctggacgaacgacggcggcgccggcctcccgtcgcggtccacgaggctgaacctggcgtcggcgatgaccggcttggcgtcgccgccgccgcggcggtaggcgcccgcgatgccgacgtagacggagacgacgccgacatcgcgggggccgtggccgttggggtagaaccggatgaaccagcggtggccgccgacggtgaagttcatggcctcgatgaaccttcccctgcggaggttcttggtgcgggagtagccgtcgatcctgacgaggtgggacaccgtcgccggcgcggcggttatggagtacatggccggagggtggctgggggggaagaggaggtcgacgagcgacactagcaagtccatgatgatggaggaggaggaggcggctacggcgacgcagctcgcgggatcgcgcgagatggatcggctcaggcggtgggcgatcgaactcgcgaggagacggggaggggagatcgagtagggtacgggagggtaagggtagttatcgatgtggggtttatatttgaagttctgaacgccctacgttctcggctgaaacagagtaatgataatttgtgttctttacggaactgagtaaactgtagtgttataaacatctcttctctacttctgcacaaaatttttggtacgacatcctattcctattccgatagaatatcagtgtacgagtacgtggtttttatttctatatctgtacttaaaaaattacggaaggcttcggtggatttttctttatgaaactctggtccggccagcatcacctgagcacgctgccaactcgcgcttgcgaaccaatcctcacggatgctcccaatgcccatctgttcctccgtggttgctgccaagatttgcctccacttttgcctaggccgtcgccgacacaggacaagcttcggcatggctaccaccaggggcatcggttcctccacctcaacttcctctgcttaagtcatcttcaccaagatcctcacgctgacctctcctaccatgttgccgccacctagcactagcgcctgtctaccccgccaccccgacaccttctccaccgccggcgcactgagggactcatcctactaggaccttgctcttccccaacctctacgcaggccgagagtcgccgttaggccgctggtgctgccctgcagccatccccaagccttgccgatgggaccctgccccttgcacgccgccccaactcctcttctacatcatccgcatctttggtgtcctcccccgacctctgtgctcaggacgccaccatccaacctccgctgcctaaggggaaggggcgtcctcctgtatccgtagtacctcgatagctacgccgatctacgcgggtcaccaccagctgcttccttccactgagcgtgtcgttgtcgcctgctcaaggttgggtgagggacacccatttatccggcctggtctgatctgtaacctctgctcctcttagctcccacgcttatctcttcttgtgttctttaaactgaagagagaacatagaataatctttctgcagacatctggaatttagatctttactgcacgcaaatagaatatgaaccattttagtgctctttatctccccttgcatggtgtccgcgcggtacgacaccaacgttgttcgtgtgtgaacctctcggatcatacgggatggcagaagctaccgacttctcgaagtatgtttgttgcaagcccggtcactctatttggcagtattataccggcatgtcagtgtggtatcatcacaaggttcaaaactaaagacattattacactggtttattttcaaattatcacaggctccaaacctgatatgaagctaaacttgtgaagctggaaaaaggtactccctccgtcccaaaatatagcaacctagtactggatgggacatatcctagtataacgaatgtggacatactaggttgctatattttaggacagagagtatgtattttatagggcagatccacccactccggctccaggctccagctcctcggacaagatagcggttggagccatgtcaaacatgcccataatatataaaaaataacttccagctgctccttgtctacagacaagaaaagaaatggtagaggcacggatatagactgtatagtgaatatgcttattttaaaaaataaaaataaagagcaacacttatgttagtacaatgcagcactgaatagtactacattactaaaactatatactgcaggtaagcaaatcacattgcatctaacttttcttgcaaaaagtaaactgtgtacatttctgatattgttccaggagatccactgggcaattagtatctcaattgtccgcagattcttctatggttcgtcgactaaattttctgtttgacttctaccataattccatagatcatgaagttcacctctaaaccaaccaagtataacaataagccctggaacgagaaatacatgggagtcgtcacttgcaatgacttaagagtcatatggaaagaaaagaataaaaacaatccatgattgtgtgctaaaggaacgatgcatatacttacctaatgtacatggaacaaggtacagcagcgcaggttgaccatgcccgtccatcaggaagagcgcaagataggtaaggaaaaggcctacatgaaaaaaaaaatgtaatcccattacgacatatccaaggtctccacaaacatgtgttcatgccataacacaatgacatgcatgtacacatgaatccattttgcaaaaaaaaaaaaaatcaaaatcaaaataaaaaacattcaaaataaacaagttagccattgtcaatttcattctaaaaagaaggggaagaaaacaaagataattcctgcaatggaacagtaacattctccctcgttgattggtactccctccatccacaaaagttagacatacttcacatttgagtttttccaaataagttgttcttatttgtagtctttatgcattcaagacttaaatgaagagataaattaaatgtttgattagaaccaaaggagtcatctagatgttagaacttcaatggttactctcattgagaagaggatggcactcagagtggggcaattttctggttttcttcattcacaaactcaaaagccatacctacccgagggaggttggatacatatatatagccatagctggctgctagcctattgctgcaccctcctagtctaaaattcaaaatttgaatgggatgctgtcctagagggcatccaaactgaataaagcataaaggaggcataaaggagatgctaactgctgctgtcctactaaccgcagctatcctagcaactgaaaaatatgctaaaggggtagatgctgtcctgaaaaggtgaaactacccaaaagcaaaaagaagaatcacgaccaaggaccacaaagacttatccaacactaaatactcattggttgtatgcttacattcaatccttgattttgtaatatccaagatgatttaatttcttcttggtcttgatgataaaagtaataggtgtaacttttgtggatggagggagtatagttttacagctggaaacgatgctaccagtaacatatggcttcaactagtcctaagatggtgtgaaaaccatgaccattaattaatactttctatgtttgttcagacttatgtagttcatagtcaagtaactattaggcaaactgcacaaggaaaaaaaattcaatgtcacagtacacacgatatagagcatagaacataggtaaaatataaaagtgtaaaaaaaaaagaatgaacagcttaccaacagcatatcccaccgtcagccatagaaaatacccattgaagaggccccttttgcttgctctatcaaatctacacggtatcaaattgatgtatgggggtaaacatgattgaatatatataattgaaatagtcataagtaaacacaacagatatggaaagggctaattaaacctcacagagaaataatgaaaccatcaaacaaacgccggcatatataataacatgcctggccccaattttctatgttaccaagagtgaaatccattatgcaaggatgaaaataaaaacaggtaaaatcaattgcaacatgaatcgattaccacataaaaacaggtatttctaacttcggaatcctaaacagttaattatattctgcttgacaagtcaaattatagcatgatgaattgattacaacagaacatactttatttccaacataccaaataaaggactaaattagccaacagtacgaaaccattgggagaggtttttatgccttaaagttgagtttcaacattaacaaaaaaaaaatggtgatataaggtgtatttgttgtcctaccaacaagaataccaccaatgtgttggcgaaatcaaaattttggtaaggttgtataggtaatgtataactctgataatccaaatagactctgattccattggcaagaccagtggtactattggcattaccaatatttttggtaaggcaaattttggaatcaaccactggctcattgcctttatgttccttgatgacagaacagtgtaaaatcaaaggtcattaattcaaacagaaacatggtgtttgatcctcttttccaccacgtaacatcttggtaccatggtacactaacttaattagcaatcaaacaaatcatgaaacgtgataggaactttcaggagccaattagcatattgctttcatatggtgattggtgaattccattttctgctaacattctcagtatcatttgattttaaataaaactacaccctacggtaagtgttcctaaagttttcagatggtttacaacttcactgttttgatttgggattatgttttcctcatcaacagtatatttaccaacctaccgacactttagcgtccagtgaaaccaaggcatcaaaagagaagttacaacttatattgcagcaatatatatagtataatacctgtagctgaatgcaactagcaatccagggaaaataatgtcaccaaagcctatcatgtcatagccaccccatggatcaaagaaacgaggtattcttaagagcatcggaattgcttccccagagttatcaccacgagcaacctgtgcagtatggatagaatcatatctaacactataacacttcataatagataaaaggtatatcttacaggacagatctaactgaagatacacatatcaaacttatatgaattgtcttatcaccaaattttctaacctccaagtgaatgctttcgaattagattgaaacatagaacaaactaacaaaatagtacgctattactattagtaagcatgtgctactatctggttttgaaaataacatggaaactagtagattcatgagccacgtatgcagcatattatggtactattatcaccactggataaatccacagtactaaacagtaagtaataaaaagattgttgcaaaaaaataaaaatcatgcacttactgcaatcatgacactttcatggaatataagaggtgaaatgaacacccagaaaacatcatacacaaatgcagcactaagaagagctgatgcaacctgcaaagttatagtcatgatgaataattctgatacacatatgaaacatataggttttgcacgactacattaaacttaaagacatggcaatannnnnnnnnnnnnnnnnnnnnnnnnnnnnnnnnnnnnnnnnnnnnnnnnnnnnnnnnnnnnnn

SEQ ID NO: 33407 - DNA, 631 bp, Oryza sativa
ttggttttaaaataaaaatactgtacattaaactagtatgaaaaaaaataaaaattcgaatttgaaattaaaattttggtttataacataagcaaaaggttgtatgctttataactggtacccactaactgatgagggagttaggtcccgatcttccgataggtattgataaacagttaatttgggcggagttgcgatacaactcgatccggcttctgaacgaacacgctactgagccccgcaatcgcagcaccacgtctcctctggttatcaaccgtgccgaaacccggttgacctcgccgagaaggctaatccctgcatgcgaatcgaagaacacaagaaagaacaagatagattgcaaccaaattacatatgaatgattaagcactcggatttggggtttcacaaatcgatctagcggcgaaactgttcttgataaaataatttaagcaaaacccgactctaaacgatgacggctaatgaataaatatgattaaggacgtcctagggttgccctagggcgcacacccccttgggctaagcccacgacacagttacaaggcccaaaacgcaaatcagattcggactggatgagatacgtggcttgttttgcagtttcccggcagcttgg

SEQ ID NO: 33408 - DNA, 730 bp, Oryza sativa
  unsure (1)..(730): unsure at all n locations
nnnnnnnnnnnnnnnnnnnnnnnnnnnnnnnnnnnnnnnnnnnnnnnnnnnnnnnnnnnnnnattaggacttgttaaagttggcgataaacgtggtgggcttggacttgataaagttaaagacaaaagtactgaaaattaataaagtaaaagatattttaatcttctaaatcttatattggtaattgtaacatagattaaaaaataaagttaatttaaaacagaaatagcatgagaatagccagtagaatttgtggcttaaaaaactatatacgacgacatacatgtgacacctaaacaaacaactgcatcaaaatgttgcaccaaaccgctcaacaaatcttctcactgtagattttgcctttttttaagagtgaattgcacttagtttcatgttagaccatccctagttcaatctttctactttccactagctaaatttatgatggttttactttgtaccgcctaaaccacttcggttctagtacgctagcgaaatccttcacctatgaacagaacatatcatgttatttgtctgagtataggatggacataactaagaaaagattcgggaggtctgaagcactactagaaaaacgatttttagcaacattggccttttatttttccaagcgggtatgaccatcggacccaaatattcggctagaaaaatataaactgaggtgaattttcgtcattcgcctacgaaaatcgatttatccaggcggacc

SEQ ID NO: 33409 - DNA, 745 bp, Oryza sativa
tacgtatgattgttcaaattttatgatactgtaggaatctaaccttgttactatgattcagtaatattatcatagatgggtagtaacatgctatgttactttaaaatttataggtcgttactgcacttttggtaatagcacataataaatattgcaataacagagaaaatgtaataataccagtgatgctataatagtaatgcttgtgcagatatagaaactttaaagtcccaatcttcaaagagcaatatttcttacataatatcttatttttctaatccatttgcaccataatgttcataaaaaaatatttaatgaaactagatctatcgtgactatattttgacgtcattactacgaaaagcacatgtgttactgcatactgaccgtcacgttactacgtaatttctacatgatgagggcaacaaagaggttaaattgggttgagccagtaagttcgagctctgcaatctatttttcctatatagttggttcccactacaagaataactcctataaagctgtctccaggttaagccacgttatcatcaccttacagccgttggatcaagtgccatctttgttcgattcatagacctgatagaaactcaaccagtccaaagtccacccagacacgatgaggaattgctagcgttggatcagcttgcagtgagttagaaaaatggagcgttttctgtgcgtcaaatttaggaaactgattaaggtgactgaggagcccatctta

SEQ ID NO: 33410 - DNA, 732 bp, Oryza sativa
tgagaggcctcccactgctcccgagtgagatggagcttcccgccgatggtgatgggccccgagagaggctgtggctcatcaccatcgacgaccttgaggcgacctaacgcctcctcgatcgacattgtggagaggtccagcagagattcgatcgagcgagcgatctgcctgtacttctcagggacgcagcggaagagcttctcgacagctctctcctcgtcgtaggtgtcgtcgccgtactgcaccattttctgcaagagagtgttgagacggagagcaaagtcatcaacatcctcacctggcttgaaggccaggttctcccactccttgcggagtgcctgcagtgtggacttgcgggcgcggtcgctgtcgatgcgtgccgtagtgatggcgtcccaggcctccttggcagtccgcttctgggaaagcgagaactgcatctcgggcgggactgcagcgatgagggcatccagtgcctgccgatcctcgtcgtagtcgacgtcgccgtaccggactgcctcccacatgtgccgcacctggagcctcaccctcatcaccgcggcccactcgatgtagttggttttggtgagggtaggccacccaccgccgggaccaaagtccctgaccaccgtctggacgccgtggtgaccatggcgccggtcaagggagagccgcgctgtctgtgagggccacgtgtgggctccgggctgccgccggcacgcccgcgcccgt

SEQ ID NO: 33411 - DNA, 718 bp, Oryza sativa
tttagttgtaataattgatacttcgacgactttggttatcggagataagacccgatcagagcatgttctctcttagatcgggttcttatttaccgtagaataaaatatgataaaaaccacgtaattaacttcaaaattaagcactaaaatttaaaatttaacttataagcaaaactctaaccgaaaatgatggggatgaacgtgttttagtgcccgcctgctctctgtgattaaaagagaagtgggcttgctacccagcgcagctttgtcgttggcaccgtagcccgtgggtctacctacattcacctaacagggctcagcccatgcgatgcaactgaacgtacggtacgtactgattcctgaatattgtaggagtaggagcctaggaggcctcgttcgatgtgttcgaatgattctattttctgttaacacgttactaaatgatgtattcgatgtgaaaattttttttatataaattcctttaaaatatcaaacaaatctattatttagatttataattgttaaaactcaattgatcatgtgctaattgatttttcattttccgttttctggctacatcttcatcttcgtagagaaacgaagaacaccactccactcgttgatatacgataggatggtattttgtgtaatttcggcttatggtggaattataatgcccaaacaacgcgctccatttctccatttctttttagccgat

SEQ ID NO: 33412 - DNA, 493 bp, Oryza sativa
tgacaggcatgatcaatctcttcctggccagttaagaacaagaggatatcaccttcaggttcagtcagatggatctgtgatactgtgagcagcgcagcatgcatgtaatcactctctggctgttttgaatagagtatctccacaggatatgttcttccgggaattgtaaaaatattacaatcgaagaaatatccagagaacttctctgcatcaagagtggcggaagtgactattaacttgagatcagttctacgcctaattagcttcttgagtaaggcaaagagaatgtctgtatatatagtcctctcatgtgcctcatcaagcatgaccacggagtaactagagaggtcagtgtccaacaaaatttcacgaaggagcatgccatccgtcatgtacttaatgacagtatctggtccagtgtgatcatcaaaacgtattgagtaaccaacttcctctcccaatcggcaaccaaactcttccgatactcgcttgg

SEQ ID NO: 33413 - DNA, 745 bp, Oryza sativa
atccaggcaagggtgggcgtgatggagcgggatgggccctgcgacggcctttgtcgcttccggattcacctaggcacgagaggggactgcccgctgccttgcgagtagtgggggtgaaacctgaggtgtggtgtgtttggttagaggaggttatgcaaagggtcctgtcacggtctctttccggtatgtcgtggtggcatgccggcggacggaaacgtgttgtggggctatgtcttgtgggtacagttgtacacctctgatcagagtaaaactattcgaatagccgtgcccgcggttatgggcggtcaaccagattcactgtgattagtctcaccctagtttagtctaatggaattgattagttcaggtggatggttgggcctgttgcaacatggtgtagcattggacagtggatggttaatattgattaattattagaactgttttactgctttcaactactgtttataaatgctagctttgtgcaaatgatccccttttagccttcctttggttatatattgcatcataccctccgttccggtatgacttgctgagtacagtaggaagtattcagtcttgctctatctcccaaccctcagagttcgagtatgcgtccaatggtggtttctccgaggagtaggctttgtccgtgccgtcgaggatgcctgtggagtggtgttcccgctgctatccaagtccagacttagctctagttatcttttatatttccactgcatttatg

SEQ ID NO: 33414 - DNA, 747 bp, Oryza sativa
cactttatgcctgcttggagccttggagcaaaataaattttcatgccattagcagatgatctacgaagttttatgcttggaaagggggttccgggagaaaacctttactctatgtacttgctgtaactgttatttttttagtagttaacatggacgtatcaaatgttaaaccacctgttgagtctgagccaaacaactgtggttttgtagtccaggatgctgcattcactggatatgtctcagatgatttcataatatttcacttgtaatgcacctttctgttaaagctcttaaatttcttgccactaattgaccagggatgggtatgcacttgcttcaggtggtagttagcaacatttctgctgatctggatgataattctggcaacagcctattcgttatgagttcagctccaataggaggaataaatcagtcttcattagaaagatcttccagcaacaatcaggcattgcatgggaaaagctcaattgctgggagccctgaacctacatgcattagaaaatcaatgtcttcactgtgtgtcaaaatagcagcactggaaacatttgaagtacttctgactctggtatgtgtataactgtatatttacgcattcttttgcttaagcaatcacttctcatgcttaagcgaaatagatttcttttactaatacattgtagttaaacaagagtgcataactgtctaattcacctatttggctcctcaactagattattgtaaccaaat

SEQ ID NO: 33415 - DNA, 1003 bp, Oryza sativa
gccgcccgcccgtcgcgtcaccgcctcgagccccgtgccgccgcgccgtcgcgtcgccactcgtcgccgtcaccctgagccccgtgggccgccgtcgcgtcgccattaagccggccacccccctctccttcttccccctcttccctataaatacctccaccccctccccatttcttcccaccccattcccctcttttctcctctcttcctctcaaccgcgccgccgccttcgtgccgcagtgccgccgcgcttggtgccgccgcgccgtgcgtcgccccgccttgcgccgtcgtcgccgccgccgtcgtcggtaagccgccccccccccttgttcggtcgccgttgccgcctgggtaggcagggagccgagagggaagggagaagccgggagggagagaaaaagaaagaaaagaagaagagagaaaaagaaagaaaagaagagagaaaaagaaatggaaaaataaatagaaaattagagagagattaaggaggtttagaacatttaaaataattagaatttaattatagattatttgtagtcgtagaattgcaaaattttatataattatagattatttttggtaatctctataactaatcaattcgcggtagatattcggatttaattactaagagttgtatttttcgttgaattttaaagaagatacttttaaatcgcaaaatgacttaggttgaatgagcttaaaattggaatagcgtggtttcgcaaactttgtagtcgatatagaaagatcgattcgcgttcgactttttgagtttattggatttttatttgaattctaattgaattcaaatcgtttcttcgcatgtaattttagggcacaagggagttgcggatccgagcgaggatcaagacccgcaggactacgagcaaggcaagtcatcactattctttgaacatgttgatcccaattgcgaaattgttctgtttacaaataaaattgcatgcaatgatgaacatcctacttgagatgcggcatg

SEQ ID NO: 33416 - DNA, 389 bp, Oryza sativa
gcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagcca

SEQ ID NO: 33417 - DNA, 914 bp, Oryza sativa
atgtaaatcatttgtagcattttccaccatcatattgatattaatgaatctagacatatatatctatttagattcattaccatcgtcacacaaggacagatcgttctatctgtgacgggctctaatatgcttagaaataccgggccgtcacaagaaagtcatctcaattgggccgaaaagtgcccaattgagatatggtcgcacagacatgttagatgggtataaaacttaagcccgtcccgaatgacacctatcagtgacgggccacaactttaggcccgattgagataagatcatatatctcaaacgggcctcaagttgtggcccgtcacagatgaccatcatctgtgatgggccacaactttaggcccgtttgagataacattccatatctcaaacgggcatgaccatcatctgtgacgtgcacctcatctgtgacgtgcaccaacttgaggcccgtttgagataacaactagacccgtcacagatgactcatcagtgacgggctatatacttaatctctatcgggcattaactaaagcctgtcaccgatgactatttttccatttttcatatgaaatgtttatatttgtaagttgactatagcaaaataattttacgggtagaaatgatttcaaatggaaaaaatgtcaacaacaaagttgtataacttatcaatatttacaacttttagtttggtcatttttcaatataacattttttttgaacagtttgaatttgaatttaaaaatatgaaaacttcaaataacattttcaaatactaaatgatttcaattgaaaaagtcatcaacaacaaagttgaataactcatcaagatctaaaacttttatttttgttatttcttcatctgacgaaatgttagtaatattattcacaaattttacatatatgtg

SEQ ID NO: 33418 - DNA, 6038 bp, Oryza sativa
  unsure (1)..(6038): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggatgtgcatcgactacaccgaccttaacaaggcatgtcctaaggacccttaccccctgcctcgcatagatcagattgtcgactccacagcggggtgcgaccttttgtgttttctagatgcatactctggttaccatcagattcgcatggctagggaggatgaggaaaaaactgcattcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactctcgaatctagcggaaacttttgaaagtctccgctccgcccgcataaaactgaaccccgataagtgcgtgttcggtgtacctgcgggcaagcttctcgggtttttggtctctgcccgaggcatcgaggccaaccccgagaagatacgagctatagagcggatgcgcccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgtcccggagccaaatgaacccttgctactctacttagcggcgaccccacaagtggttagtgcggtgttggttgtggagcgcgatgaggacaatcctcattccgcgcacccccaccctgtgctggcttggctcgggagagagcagggaggagaggcccccgagccgaacggtggcccaaggcccctgacgaccggagctggtcctctgcctgcttgtcagacggtgccaggtgcccccgacccccaggatggcccgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcccgcttgtccgacgacgccaggagcccccgacccccaggacggccccgaggccactgtgggaaggccgcccctgttgtcctccgaccccgaggtcgtcggcacagaagacaagtgcgccccgcgaggccgcttggacaaagagcgcccaagggatgtggcccctagcgaagaggatcggccccaccgaaaggtgcagcggcccgtctactttgttagtgaggccctccgggacgccaagacccgataccctcaggcctagaagatgctttacgctattctgatggcttcgaggaaactgcgccattatttccaggcgcatcgggtcacggtggttacgtcttaccccctcggccaaatcttgcataatcgagagggtactggacgggtggtgaaatgggcagtcgaactttctgagtttgatttgcactttgaaccacgccacgctatcaagagccaggccctcgccgattttgtggcagagtggaccccagctcccgagcccgtctcagtccccgaggccagctcgggtccctcgcagctgcctcacaccgcccactgggtgatgcagttcgacggctccctgtctcttcagggcgccggtgcgggggtcacgttgacctcgccgagcggagacgtcctcagatatttggttcgccttgactttcgggcgaccaataatatggcagagtacgagggactccttgcgggactcagggtggcagctggactggggatccgccgcctcctggtgttaggcgactcccagctggtcgttaaccaattctgtaaggagtaccggtgctctgacccgcagatggacgcttacgtgcgccaagtacggcgtatggagcgccattttgacgggatagagcttcggcacgtgcccagacgggataacacggttgccgacgaactctcacggctcgcttcctcgcgagcccagaccccaccgggcgcctttgaagaaaggcttgcccagccgtcggcgcgacccgaccccttaggggagacggacgcgcctgacaggcccccgatgcccgtcggagtccaggcctcgggacccgaggggagcgctcctagctcccttagattgattgcttggatcgctgagatccaagcatacctcacagataagactctacccgaggaccgcgaagggagtgaatgcgtccagcgcatctccaaacgctacgtgctggtagaagggaccctctatcggcgcgcggctaacggaatcctcctgaagagcattcctcgggaacaaggcgtcgagcttcttgccgatatccatgaaggcgaatgcggagcccactccgcctcgcgcaccttggttggcaaagcctttcgacaaggtttctattggccgacagctctcaatgatgcggtcgacctggtccggcgatgcagagcgtgtcaattccacgccaagcaaatccatcagccggcccaggccctgcagatcataccactttcatggccatttgctgtctgggggctcgatatcctgggaccgtttaggcgggccccgggcgggtttgagtatctgtatgtcgcgatcgacaagttcactaagtggcccgaggcttatccggtcgtcaagatcgataaccactccgcacttaaattcattaagggcatcatagcccggtttggagtgcctaaccgtattattacggataacggcacccaattcactagtgaactttttggcgattactgcgaagacatgggcatcaagctctgcttcgcctcacctgcccaccccagaagcaacggccaagtggagcgcgccaatgcggaaatcctcagaggccttaaaaccaagaccttcaacatcctcaagaagcacggcgattcgtggatcgaggagttgccagcggtgctctaggcgaaccgaaccacgccaagccgagcaaccggggaaacgcctttcttcctcgtctacggcgcggaagcggttctcccatccgagctcaccctgaggtctcctcgggccaccatgtactgcgaggctgatcaagatcagcttcgcagagatgacctcgactacttggaagagcgaaagcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctaaagggggatcgggtgtcaggtttcgggctcgggccaaccccgcacccccctcgggtgtgcagggttggccgggggctaccacatatgcatattcttatttctcttatatctgtatttcaataaaagcattttcgatttcctaaaggctgtatctgtgctgttgtttccttttgaaggattttgacttgaaataggtcacttgtgttcaatcctgccgtcgggggctcgggtcggctaaaatcgccaaacggggcccagaaccgagccgtgccccggggcgtggtgaactccgggggggaatcggcaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacaaaaggaccgcggcacagacatcctcgcctcatacacacaacaaatagaattgacacaaaaaatttcctctttatttgattgcagattaaattagtctatacaagaaggaggcccgaaggcctcggaagaagaaaagaagaaactatttaaagattggcgggggcctgggggctcactccgatccacccgggtcgccagcctcgtcgccactgtcgcccacaccgccgtcatcgccctcctcgtcggagttgagggcgaacgcgagccgaggggccgaaccctcgaagctgtggacgatatggtcggcggcgtcccggacctgcgcgcgcgcgccatcctcggtcccgggagggaactcgtccagcgccgtccatggggagaagtcgggatccctggcttggtaactcgccagtacgagctccaccgctcctcgggcgaggtccctcgaggatgacttaatcgtcctctcgagctcctcggggagccgttggagagtcccgaccatctccgagaggcgctgagcgaggcccccctggttgccggcgtacttcccagtccgcccgccccagaggcctgcctgccggccggcgtgatctagacgggagacggcgtcccgaagcatgccgggccctacctcgcctgccaaacggagggcctcgacctccccggcggacgagtctagcgcgccctgcagatcggcaatggtgtgttcggcagctgcgaggcgggcggctaagtcgctttcgcccgtggccgccccgccgctgcgcgccctcgcgtccagctcctttgcctgcgcctcgagttcagcggcccgctggttcagtgcggccttctcggcgcgggcaccttccaaattgcggcgcgcttgttcctctagcacagcctcacggagggacgcgctctccgccagccgttgcgccgtggcctcggcctcctcaagagctcgctcccgatcggtgagcgcgtcctcgcggaggcggagtgcgcactcctcctcggcgcaggcggcctcgtgcgccgccagcgttacctcccggatggcaacggcggcctcgcggtccgccaggtccctctccacgacgccggcgcgctcttccagcgccatggcacgagcctcgagggcctcttcgcgccgccgagacgccgcctcggtctccgccgcccgccgttcttgggcagcggcagcgtcaaggaccccccgggcggtgtcgagctttttccctagctccgcctcccagctcccgtattgaaggcggagggtgtcctgcgcctcgttcatcacggtggtggcgatgagggcagccccccgctcctcctccacctccttggcgatctcccccagcaccttccgacgggcttcgagctttgagacgtgccggcggtgtgccttgcggcccacctccaccatggcctccaccgagcgtcgcccctcttcgacacgcgcccatgcggcgtcaagctccgcccgctctgcttgcagggtctccacctgggcacttaacccgtccaacaccgtggtgtttgcgacggccaaggcctgcagaaggggttctgcgctcagtggagcaacggaaggcgtggggaagagccgcctcggtgaggatgccgcgcggctcggcccgccgatgaacgtgccggactcagggatgtcccccagacctggcttgtcctgagcgtcgcccgagggaatgggcccaagcgatgcgcccgcggcctcgtcgcgagctgcctcggaagtcgtcgccgcctcggcctggcgaagtctggcctcctcccgagcggcttcttcagcttggcgagctcggacggccacctgggcggcctcctcggcttcccgtaggcgatccgcggcttctcgccggtcagattcccgcctccgagcctctgtggtcgccgggtcctcggcctcagactggccggacttggaatggcaggagggacgcgacgagatctcgctgaaacagaagaaagaccagaagacaaacaagatggatgagtgaaaactcgcgttgagggaatgaatacggccacgat

SEQ ID NO: 33419 - DNA, 8167 bp, Oryza sativa
cagctggaggcctgcgccgggggctggctcggaagtcggaggcgcgcttcgtcggcgaggggggtgtagaaccagtcgctcttccagtcatcccacttcttgcggaggacgcagggaatgtagcggttcaacaccggccccgcggctggaagtagcaaccaccaaccaccgacggcggcgacaccggctgtacagtgaagaaccaccggaacagccgaaggggtgggcgcaccccgatgaacatctcgcacaggtgcgcgaagatggccaatgtcattaccgcgttgagggtgaggtgcgccatctggagatcgtaaaactccagaacatccatgaagaaagaagaaaatggcggaaccagccctgccattgcaaaagggaggaagaagacggaccgccccgggtagcatggcgccgggcgtccctcgcccagcgtaactatctcccggccggtggcagattccggcatgaagcggcgcggcagcccggcctgcctctcactcacgatgcgggaaggcggcagcacgctaccatcaagcaaagcggagccccgtgccatgacgccggaggaagagaagtttaagagcgagcgcgtgtggcgaaggtagggcacaggaaacaaggagttagggcgcaagcggcgaagacaaggggaataatggcgagaggaaggaagcaaatctcttcctcggcgtctttatacccttgccaacgctgcgcccggctcctcgcttctcgcgtccactatctcgctccctcgtttctcgcgcccacgcttccactaatcccattcgcccgtttgcggtgcatgaagtggatatgcggctgtggcagttgagatggaacatctcgtgcgcgcgttaattacgctcgccgaccgaagcgccatcatcatatctccaggaaaaacgaaccggcttgtcccgatttttagaccggccccacctgtcaccaggccttaggaagtggcgtcacgcccgaccgcttccctcgaggagagcgatcgccttggcataacgccgggggctactgtcagtgacatgggaccgggagtatcatgacttagagacttgaggcagacacgatcacccacgtggcctaaccccctcgggggggtcgggcccgagggtgatacggccgcccttctctttgtctccccgaggggtcggaccgctaccgcctcggccccgagggccgaggtgccccgaccccttgtgggttttgcgccgcgtatatggggtaggtgagcatagcggggctcacttaaccacatttattgcggtttggacgagcgcgtcacgccgcatgtaacgcagtgcagcgcgctcgtttatccggtctgtgaccggtcacagaccggtcagatcgtgggttaggtggcgacaggcggtctgacgcacgcctcgccccatcccgtcaggacgagagcctccaagcactcgtccctagccggaaccggcatgttagctcctggagatggcacgttggttccggtcagatatatgccaggcttcatcctaaccattacaggcaagatattgtatgaagaagggcgaacatgcagattgataaactgacgcgtggtggacaagaatgaccgatttgtgaccggtctgacactggtcatgtcgtcagcagacagtgtcacgcccagaaattcacgaaccagaatttctaagctgaatgtgtattaaacccctgtccaggaccagccagggtacacaaacgacaattgttgacatacagatccacgtcttacaaaaatataaaagattacaaatgcaacggaaaaagataaaagcgagctaagcctgaaggcttgactcctgcagcgggcgactccattccacaggcatccttgacggcagcgacgaaaccaacctcttcgagacatcttcaactgagaaggacttcaactctggtgtgggggaaaagagagcaagactgagtactacccactgtactcagcaagtcataccggaagaggaggtatgatgcaagatatatccaagggaggctaaaggttcttttgcataaagccggcatttcaaaacagtagttgaaagcagtaaaacagttgtagtaattaatccatattaaccaatcactgtccaacgttacaccacgttgcaacaggcccaaaccaccacctgaactaaccagttccaaaagctaactagggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgtcaggacccttcgcataaccctctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcttgggtacgtcggctagagaaaagctacactacaagcccagccgttgcccacgctggcttgtggtaagtacgataagttcttccagggcatcccgcgaaccggtccttaatcgccatgggcacgtctagcaaaaccatgcacccacagcccaccatgtagtgtattttaattagccaacaccattgcggtggcactaatccaaagctattgccaataatcaagtctatgctttaatgtggtccccttttgtgcactagttgaactaagcatggctaagcatctcctaaaccaacatctagtcattttaatacccaagttatcaatggcataagggaaacaacatatagctgagtaataggacccatcccacatgatattgtaaaacaatgcaatatttaatagaaatgcgggacatttgtaaattaggtacaatatgatcaattgcaatgtatgacttgccttgctctcgcactgatggaaccacagcaacgtcttcgagaaaccacgaatcgacgaaacggccgaaatctacgcgacaaacaaagcacacaagcaaaacatgctataagactactgtaacaggaaacaaaaccatttttaatggattctacacatttttatgaatttactgagacttgaatggatttaatcggagctcggatgaattagttatgatttttagaagattatatgtgtttattactataaaagaaaaacccttaatcaatttattgcgcaataattcatcccagggctgacgtcagcacaaggaggggtggcgccgacacgcgggacccgcgggtcagaggcacaggagagagggagagggggcggctggcaagcgggacccaccgggcagcgtcacaaggggggggggaaagcggcgaggcgcccggtcggtccggctcggcttcaaaccggccgaccggttatggcgagggcggtgccgcgcacgcacggtcgccggcgacggcaaccggaggcgcgggaagcgacggcggatgacggcggcgcaaaggcggcggcacacagccgaagcggcggctcggcccggcacggcgctaggagggagaggaaggggaaaagagggggaggggcgcctcaccgcgagttggccggcgtggggggggaagacgacggcgaacggcgacggcgagcgaccggggaacggcgacgataggcggacgagctccgagacctcctagggaacaagatgggaggtattagagggagaggggtggttaacagcgagcggattcgccggtcgaaggcggcggccatggggtactcaccgacgcgcgaggagaagcaagctccggcggcgggattgaccggggaaacggcggacggggtggcgcacaagctggcgaacccggcggcgtcatcggcgcggtgcggcgacggctctagcggtggcggagtgcggccggagcgtggcggcgagcggcggaaggcgggatgagaggcgcgggagcgatggagagctcgggagggctcggccgagaaaggaaaaagagagaggaaggtgcgggcgtgcttaaataggagggggggcggcgagtcgtggccgggaacggcgcaatttccccggagtagtggaggaggtggaggaggagagagagagtgggggaaatttcaaatcccccgccgtttgcgggcgcgcgagctggcgggaggagcggggaaagtgggcggcgacgtgggcgtgcggtacgggcggagtgggcgcgggagcagcgggatacgcggcggcgtgggcggtggtttcgacggcggttggcgcgggcgtgggcggccggaggttagggaaagggctgacaggtgggccccacctgtcagcgcccgagagggagagggaggccgggtgaacttcgggagtgggagggaggagcgggccggcgcgggaggaaatgggccggcggcccaagaaaaggaaaaaggagggaaaagaaaagataaaaggaaaaaggattttcccagggatttaatattgcactttgcttattttaattggttaaaattatttccaatgctctgaaaattccactaaaaatcctgttagcatattttgacatgtagaatccaagaaaaattccacatgccgattccgattattatttgcatttattaatttagggtttctctcttgcctctaaagaaataatttcttccaaccatttattaattgaatttttgctagggaaaagaacttctgggcgcgacaaacctaccccccttaaacggaatctcgaccccgagattcggaagagctggcgaagaggtgcggatgggcggcctttaattcattttctctttcccaggtggcctcttcctcttagtggtggctccactgaactttgcaaaatctgattactttgtttctggtccttctctcgctggtttccaggatacgaattggcatctccacgtaggtcaaatcttcttggatgtcaatgtgctctgagctagcttgttcctcaggtaccctcaaacacttcttcagttgagacacatgaaacacatcgtggataccaaccatattaggtggaagctctagctggtaagcgacttcacctctgcgttccaagatcctgtatggtcccacaaagcgtggtgccaacttgcctttggtttggaagcggtgtactccccgaagcggagtgacacgaaggtacacataatcccctgcttcaaaagtaagctctcttcggcggttatcagcataactcttttgccgagactgggcgattcgcagtctttccctgacggtcctgactttctcctctgcttcggttaacacttctgttccgaacagttgacgttcgcctgtctgatcccagaagagaggtgtgcggcacttccggccgtataaagcttcaaacggtgccatctgtagactggcctggtagctgttgttgtacgagaattccgcatatggcaagcttttgtcccaagctccaccaaaatcaagagcgcaagctctcaacatatcttccaagatttgatttactcgctcggtctgaccatctgtttgcggatgataagccgtgctgaaattcaaacgagtccccaattcttcttgcagtttctgccaaaattttgaagtgaactgactccctcgatcagatacaatctttttgggtaccccatgtagacacatgattctcgagaggtagagctccgccaaccttttgcccgtatacgtggtatgtactggtatgaagtgagcaaccttagtgagtcgatccacgactacccagattgaatcgtgacccgatgatgtccggggcagtcctgttataaagtccattccaatctcctcccatttccattccgggatttgaagaggttggagtaaacctgctggtctttggtgctctgccttcacccgttggcaaacatcgcagagtgcgacgaattcagctatttctctcctcatgctgacccaccagaatttctctttgaggtcctggtacattttagtactgccgggatgaattgaatactgagtttgatgagcttctgtgagtatgagatccttcagttctttgtcgtcaggcacacacaatctttctcccaaccagattgtgccatgctcatcctcatggaaatctcgggcttttccgaccctcatattctttttcagctcagctatttcaggatcatttacttgagctgctctgacttgatccacgagcgtaggccgtgcctctagggcagctacgtacccgtgttctacgatgcccaaatttaggtgctcaagatcttgctgcaatttgtcacacatgccttcggtacatactgcattgcaatagctctttctgctcagagcatctgctaccacatttgctttgcctggatgatagtgtatccccatgtcataatctttaattaactctagccatcttcgctgtcggagattcaagtcaggctgagtgaagatgtacttcagactcttgtgatcagtgtatacttcacagcggttgccaataagatagtgccgccagattttcagagcatgaaccactgctgctaactcaaggtcatgagtgggataattggtctcgtgtggacgcaactgtcgcgaagcgtatgcgaccactctgccttcttgcatcaacacacatcccaacccttggcgagatgcatcacagtagacttggaagtcttttgtctgatctggcaaaattagaactggtgcagagactaacctcttcttgagttcttcaaaactttggttgcactcagctgaccacttgaatttttcatctttctttagcaactgtgtcatgggcctggcaatcttggagaaattttcgatgaaccgacggtaatagcccgcaagtccaagaaaactccggatctaagaaactgtctttggtggggtccactttgtaactgattccacatttgatggatccactgccacgccttgagcagaaatgacgtgacccagaaatttgacctccgataaccagaagtcacacttgctaaacttggcatataactggtgctccttcaatttctcgagtaccagacgaagatgatgctcatgttcctcttctgattttgaataaataagtatgtcgtcaatgaataccacgacaaacttgtcaagaaactccataaacactttgttcatcaagttcatgaagaaagtcggtgcattggtgagtccaaaggacataaccgtgcactcaaacaacccataccgagtggtgaaggctgtcttgggaatatcctcttcccgaattctcaactgatgatagcctgatcgcaggtctatcttggaaaacaccttagctccttttagctgatcaaacaggtcatcaattctgggcaacggatatttgttcttgattgtgacctcattaagggcgcgataatcaacacacatcctcttggtcttgtctttcttctccacaaagataaccggagcaccccaaggtgaagtactcggtcggatgtaccctttctgcagctgttcgtcaacctgcttcttgacctctgctagctcattagctgccattctgtacggcctcttgtaaattggagcagtcccgggtgccagatcaattcggaactcgatttctctcttcggtggcattgtagtgaggtctttaggaaatacctcaggatattcttgtactataggaatatcctccaacttcctgggacttttctccactgtttctgtctgaccctcaatagcagcctgattcagactcgctacggacttctgcgacgctggggaacggaaggtgatcttctcccatttgtcgttggttagggtgaattagttatgatttttagaagattatatgtgtttattactataaaagaaaaacccttaatcaatttattgcgcaataattcatcccagggctgacgtcagcacaaggaggggtggcgccgacacgcgggacccgcgggtcagaggcacaggagagagggagagggggcggctggcaagcgggacccaccgggcagcgtcacaaggggggggggaaagcggcgaggcgcccggtcggtccggctcggcttcaaaccggccgaccggttatggcgagggcggtgccgcgcacgcacggtcgccggcgacggcaaccggaggcgcgggaaccgacggcggatgacggcggcgcaaaggcggcgg

SEQ ID NO: 33420 - DNA, 22895 bp, Oryza sativa
tttcccagggatttaatattgcactttgcttattttaattggttaaaattatttccaatgctctgaaaattccactaaaaatcctgttagcatattttgacatgtagaatccaagaaaaattccacatgccgattccgattattatttgcatttattaatttagggtttctctcttgcctctaaagaaataatttcttccaaccatttattaattgaatttttgctagggaaaagaacttctgggcgcgacagacagccatgttcccacgtcgcgcctgcttccggcggaagtggaggtaggtatgggcggtcccgtcagaaggtcattcggacggcaaccatacaagtctccgtctgtttatgaataaaataggataagtccccacaaaaaagagagagatggtgcatgtggtatccccttgaggtataaaaggaggaccttgcccacttagaaaggggattgaaggggggaaaaacaatcccagaacgatcgggggctggctcgcgctttgtagcttcttcatacacagatccaccaaaacacaggagtagggtattatgcttctcagcggcccgaacctgtatacatcgcccgtgtcttgtgtgatttcactctcgcgaactttccacagaccaagagcttagaacctcacccagggcccccggccgaaccggcaaaggggggcctgcgcggtctcccggtgaggagccccacgctccgtcagctacccttctcttcttcttgtagctgtcccatctcctttctccttctagtgccgccttgacaccatcctccccccaatcttccgctcaccgttccaggcgtcaactcccagtgaggacggaagcagaatgacgtctcctgtctctagcatccatgagaccatgatggcattgctacgacaattgccgttgttgattgcatcttttgatccaggaagaagtcaaagaaaaatcctttggacttagaacaggttttgttcatctctgcttgatgcaatctagcacaatcccaaattcgaacggtaagggctcactgtaatgagagagaggagatagggggagagagacgagagggaatgataatgaagaagaaaaagacgaagcaagcaacaccattccgacattcttcaatattggcacccaccaagaccgacggtgttgcacgacgtcgaagccagtgtagaacgtcatgaagacataggcgtgcaacgctatgctgggcttgtgacttggcattaccacctccctcgtctctcctcctgcctgctcagcctcgccggcgcctatatagatgccaaagaccagggtcgatgtgtcatgtcatagaaaaccaccatatataaaaaccggtttaggagtcgttttgtacggtttaaactgttggaggcgttgttatacctgattttgcggttgaggggtatgaatcaaattcgacctatatttgagggagtctagttgaactttcccctttctatttggatccgaatccaacgcgcatagccccagttgagttttgaagtaaacacgacgccgagttttatgcatgcgacgcgactcgccgccggtcacgaacttacgatggcgtccaccgccgccggcgacgacttccgggattggtccgggctgccggaggacctcctgctcaccgccatggaggcgatgcaactccccgacctagtccactccggcgccgtctgcagatcgtggcactcggcgttcgccacgttccgccgcctcggcctccggtcgccgccgcacccgccctgcctgctgtacgccgccgccgccgccgccgacaatgccgtccgcctctactcgccgtcgtccaccggcgcccacttccgcgtgcccctcctcgacgaggaggcggccagcggcgtcgtcggttcggcgcacgggtggctgttcacaagcgacagggacgccaacccttaccttcctcaacccgctcaccggcgcccgcgccgcgcttccgccggccacggcgctcgggcgcgtcaggggcaggaggttcgtcttctcccccggcgacggcggccgccggggcgtcgcgtacgacgtcgacttcggccggcggccgggcggctcccccgacgtcaggcaggtcatggcgcggcgggcgaggcggtggatgtaccgccgggtggcgatgtcggcagcccttccgccgcaccggctgcgtcgtcctgctcctgcacatgccggagcgggagctgtccttcgccaggccgggcgacgagcgctggacgccgctcgtcgacggcggcgtctgggccagccacggcacctccttcctcgacgccgtccacaaccccggcgacggcctattctacgtgctgcaggactccagccccggcggcgacaccgtggtgcactccctcgacctcaccgcgccgccgccgccgccgtcctccccggtggccacgatgctcatgttcgcgacgccgccgcgtccgtgcaaccaccacctcaagaagaccatgtgcaggtacctcgccatcacgccgcagcacccgcagcacgtcgccggcggcctcgaattcctcgtcgtggagcggaggtggcgcaggtcggggagcgacgacgacgcgagcacgacggagatgtacgtcgtcatgctcaggcctctcgacctctacttctacgagcaggtgagcctgcccggcggcgtggggggcgacctcgcgctgttcgtcggccacgccggcgccgcctgcctccgcgtggaggactaccccatgtttcgcggcaactgcgcctacctcaccgacgaaagcgacggcgacggcgaccacgcgaacccgccgtcgtggaagcggctggaccttgctctgtgggagttcggcgggagcaactaccgcgggaggttgacgaagctgcgggacatgtggccactccaccatccatggcaagataattccccgcctcctatttggtttacgccatcgctagattagcgcatctccaattcaaaggtgtgtgataagctatatattgttgttattttttaaaaaaaataatacaattgtaatgcaactaattacattgtactcataacttatattatagagaaaattctctacatacccttgaaaagtttcacaatttcttctatacccctaaattttacttcatcctatacatacctttgagttttcatttggatcttctctcacctatacgaacgctatgattttttcatttcttgctcgtataaatcttgaaacaaatttaacaattcaacaattattaaaagttatatacaagttacaatataattacactacttagattgagaattcgagagaaaccaggtgaggagaattggacaaacaaaataggaatggagctagtacttagattgagaattcgagagaaaccaggtgaggagaattggacaagcaaaataggaatggagctagtacttagattgagaattcgagagaaaccaggtgaggagaattggacaagcaaaataggaatggagctagctgaagtgttcttataaaataaacttgaaagatggagttaggtttagattactctacaactttacttcagacctacaactttacttcagacctagctcttacctagctcttgaagctaaacttacaagttggaaactaaatataaactccacttcttttctagccattccgctctatcggatctatggtagtctcagattcttttctagccatttcgctctatcggatctatggtagtctcagatttggtattcagtagaatttcagaacatactcaacatagcaatcccctacaaccatacaaggcaagcagaatctgaaggcaaattctagactaatgattcatgtatcttttaactcccaatttaaacagacagcattggacatttggaaaccaactgctgcaagcctgcaacaggtgaagaaggatatactgggcaaggaccaaggagaatcaacttataacacaaaataattcacaagttgcattgatgttctgcaacagtcctagcctgcccattgacatataactccaatatacacaagaaataaaattttaacatgaacaaattttcaagcaatatacaatggaatgcttaatgacaagctgaaaaaaaggggatgtctactccggaaatgacaaatccacggtactttgagcgaatcaactttccatgaagcacacacctcactattcacaagactgcaagaagggattaaataaccaaatgtgcaatcgaatcaaccttggactggaacttcattcgaagcaaccaaagtggtggcccggtctggccctgttgcatcctcaacaccatgttcaacagtgagcccctctgggccagaaggttcagcaggagggatttcaaccgagttgtcttgcaattgctctaccttggctcttggagcttttggttttgtgtttgaggttttctgctttgtcacaaggggttttgtctcggtctttgcagtggcagatgcttgggaaggaatttttgtgactgatctttgagcaggctttctggcagtagcatgaggtttgttattttctgtgctttcggtcaatttggccaaattagttatgctccgaggactctcacatgatacagaaccatcaacagaagcagcagcagcagaattggttggcttgtgccggccaagctttggtgacctagcgcgtgttggtgggatctgcaaatagtcacatgagttgatttcattatttctttataaatatgaatgggaacaggttcttagtgccatacaaaagatagcatatgtataaggaaactgaacacccaaaaaaaacataagaaaccacagagaagttgtttatcatgttctgaactatgaatagtctagcttactgtaaaatggcaaagctggttctgctagcatacagcttggatggagaagaccaagtatttgtcagtactccgattaaattaccttacaaactacaaatcttggtgattactccgtcaaaacatatagacatattatgatggatgatttgaatacattaggcagttcagggattcaaaaccatgaaaactaaatacagaaaggtataaactgacaaggtggaacctgccattgtatagccctagcaccaagatttgcaagaaaaatgcttggcatactcaatcattacagtacaagcctgaaatttgtacagctacttcaatcctcaatactattatgaagatccagtagaacataagtaatatcatgccagaagatctagcaaagcatacaaaattatgcacagctaggcctagttaagtttcccctccataggtaggcctctttctctaggaactggacccagctcagttggtgggaggtgtgcttataaactcccaccatctacgtacaagccctcttggacttgaatttggtgcctattatcttcttcattaaaaaatatgctagttcctcctaggtattcctgctttctttcatactagatcaaaatgatgacttatcacatatatctatcagcactcaacgggaccaaaattcaaacttcaatgtaggatcattttgtcaaccaatgatgatttaggatcagatctgctaattgttagttgagtactcttgttagtttacacgtttatattgtgctaaaattggaaacgagcaagaatgaaattgacaccaaaagatgccagtgagcagaaacatgaggcagcactcctagaagggttacaactaaggtgttatcaaaacgcgacttatcaaaaagatagcacaaacagataataagcatgtttttttttcttaagacgtcttcgcccctaatacctccaagcatgttgctaataaacaagttctggtattaattcctggtatattaagctacagattgacatcatgtaatgcttattttaacattctaataacagaaactagaaacaaatgattatttttcaatttatatcatacagtgaacagagtatttgaaatgtccatgcaaacttgtcaaggcatgtttggtggtgaggatattgcagtctagaactctagaagtcttgaataatgtggatttttttttgccaacagatatcagcaactttgcaagatcaagtttatcttagtacctttttcaactcaactttaggaggttgctccttgtaaaagcttggcatgggtgtcgctttaaatgtcaggctcttcctaagtaatttgatctcagcctcttggctctcctgagtaatagattaattttcagatccaagtggtacaaatattcaaaagttttatattaatgatatcaaaaaggttctcactttagattttgcctgcaaatttgtttgttcaagctcctttgcatggatcttctcttcaagtttttggtagaactgaaagtaagacagcactaaacctggtcagcataaggggggaaaagagaatgtaaatgaacatatggattagcgcaatgcctttatgggtataatatacctccttcctcttctcagcacgctcctgcagcctgaaactaaaaccagcagcagcagcagcattcttgcgttgagcagctgctcggggagtattggtactcctgcatgaataaatgagcatgtttcatgttaataaaaacacagggcataaaaaaagagcagctatcaagaaaataaaaatgctttacgatgtggtggagtgcacatcatcctccattttctctggcagagtctgttccaaagcatttgtggtgttctcgtttgacctgatataaaagatcaaccatttcaggccaagcaaaccccaaacagcactattatgaattatcagtggcagtaccatataatttttttctggcaagcatcacaacttggatgcacattaattgcatggtgctaactactaaacaacaactgaaattgcaatccagaagaaagaaaaggacggccaaaattgttggttggtgacagaattgacactcactcttgggtttcaggagaagcatcatttggaggcgcgtccaccgatccagatttaacaggctacgtcacagaaatctgtaattaatttttactgcattgcaactaaaaattgacaagattgttactcgcggaagatcactcaaactcatgagttttaccaaggagcggcttgcggcaggcgtccgggctgaattcaccttcttctccacggctcgccctgcgattccatccaaattcagtaaacgcaaacatcaatcaaccatcacaattcacaaaacccgagcgaagaacaagtcccaactaaactaaccagccgccttctccgatccattgggcacagcgcctttcccgtccgtcgtcttggcctgctttggtgtcgccgccttcttggcagccgcccctctcgccgggaacgacgcgctctgcgacagcgcgggcttcttccccaccttgccgttggccaccgccgccgccaccttcggctttctcgccgcggccgcgccccccgatccgcccttctgcgcaaaccaagcaagcaaacacccagagagtcagcaacgaataccaccgcactcaccgtcacaggaatcccgcgatccccgtaccttggccgtcgtcccctccgcggccatcgccaccaccaccaccgcctgatcagatccacccgccgccgccgcctcccccccactggcgagatccccctccgccaccacctccgctacctccacagccccattcaccctcacctcgtcctccccctccatccctccactgactcccacccctatcagatcccagcaagatcgatcacggccaagattcaactcactctaccactactgatcagtgcgggagaggggaggcgatcggtggatggatggatcggcgtggagagatcagtgagaagatggtggtggtggggaggggagaaggcaaccacccaacaaccaccgcgctgggctggctggcagccgatgcggctgcgagtagtgtagagagggagagggaggttgggggggagtgagttggtgtagggagggggagggagacggagacggagacgggacgtgctagccgttcgcgagctggacggtttctctgccgttttttttccgcggacggttttgccccctctcctccactcctcggagtcctctctttttctcatttctcccccgtgtgcgcccgtgcaaaccacctccggaggaggagggggcagagaccccgtgtgtggggtgtggcttttgtccattctgtcagttggtaatacacttcggttgttttctctcctctctcccaacttccacctctctttttccacgtttatacttcctgaacgattaaacggtaattattttaaaagaatttatgttttaaaaaaatcatattaattcatttttaagttttaggctaatactcttcgttttatattataagtcatttgatattttagatgttgcttatttttttataaacttgatcaaacttatcgaagtttgattagaaaaaaaatgtcaaactatttacaatatgaaacggtggaagtatttaattattcatatgctaacggcttgctccgttttatgtgccgagggattagttcctaatctaccataccgaacacaaccttctactctctgtgaagatatgtttaatggtggaggtctcattgtttgatttatgcttatgtttagattctattcggtaccgctttagatctcagacccacggtagatttaaagtttgtatgttaaattgtaattgtttaaagtactaaatttcatctaaaacatgaacaaaaataatttatctgaattttatcaacgtaattatagatctagacctatgcatggatttgtgtagttcggaataccgcttcggaaaattttggatccgaagttgtgccaaagaaaactttataagctaaattttaagttttaacacttaattttggagttgattttatgattttttttaatcattacttatttttatagtatttggttttaaatcgctaacagtacggtaaatgttttactcgtaatatttttttaattgaaaataaccggttctgatatacatatgcataagcgaaaatatagggcgaatgttaatgatgctacacaaatgtaggtggtgattcgttcgttcggagtcaaatcattttgtgtgttagctatgtttattctttggacacacagctgtgtggttgttcttatccgctagtaacacggaaaaggtgttaggagagcactgttggtaaggttagactaatgattacctttcctccacaaaatgctgaaaataaacatcatgttcctctccctttcacctatacgagtttcatttaaggattaagagtttttgcatgcatcaaatggtatatttgacacgcatatatatatatatatatatatatatatatatatatatatatgcccgtacaaccatctccgggggttgagaccgtgcgagttgacaatgtgccgactgttaatcaaattacacttctcacactcatatgttcaacaatgtacattgagatattgttgtaggtagtgatccatttatttaaaaaattaatcactggttgtggttatgcatactctttttcaaacacaatcgtgtttattcttatcgtctcataagaagagagatgctaggggcaatgttgggtatgatatggctagcatctatcgacacaaattgccaaaagcttcaatcatttatgttgcccataggtttctgtgggcttaaaacatgtgtgatgtgatggtttcaactgttggtaagtttaattaataagtaacataaatataacattctgcacaagatttctgtttttttccttaaagaatctgttataaatagctttctattgaataacatattagcatattataaaaatcatttgtgctatacgtcgccactacaaatgatataacaaaaaagaaattacattacaattttttaccttaatattatcttatattactgctagatggttagttttatctactactatcttatattaatgtagcataatactattctactactacgaatctatataaaaatattagtattttattttttgagacgaaggaagtaacctatcatcaaccgacgaccatccatccacccggcacgtatagatacagcaccgcaccgcaccgcacagcacgtcagagagaataaagcgagaatatttgtcgcgtcagccagccagtcaggggcagtgccgtctcacctgcacgagctgagtcgacgaccagtccatgtccaccaccacgagaaccacacgccgcgcgcgagtggggagcatccgcggcacgcacgcacgtaaaccgcgcgccgtcgtctccggttcttcgctaccgcgtacgtgaagcggagcgcgcgccgcgcggctcgcacaccggccggctgccagtttgttcgggctggagtagttgagcacccccgcggcgcgcgtcttagcttattttcctttggaattttgtggctcgatcgagagcttgctagctgcttgttgcttgtccggatcgatcgatcaaaaaggacagggtgtggaacaaaccgcacgcgtacgtgcatgttcggttgtaggggtgaaaaaaatgtacggaaatttccgacggtatcaaacctgttttgtgtaaaactaatattaaaataatactccctccatccaaaatgtttgacgctgttaattttttaaaatatgtttgaccgttcgtcttattttaaaaaattaagtaattattaattcttttcctatcatttgatttattgttaaatatacttttatctatacatatagttttacatatttcataaaagtttttgaataagacaaacggtcaaatatgtttaaaaaaatcaacggtgtccatttaggtaaggagggagtatcattttagttcattttctcggtcagttggagaagatcgccggtctaatcagttgtcaagcattcaaacggctttttttttaaaaaaaaaaacaaagatcatccagccgggttactatattgttttccataagcacacctataccgaactactaaatgatacttcatccgtaaaatataaacatttatagtaatgaatctagttaactacatatccagttttaactaaaagttgttatattttgggatggaggtagcacttttattttttgcaaaaacattctatataaaacttttttttagcccttataaaaataaaacgaattcttaaacctctttcacgctcatgtcacgtgagagttcatgctcagcgtgaagaaaagctaattttttgggaattttagaccaaacttctaataaactcttttaaagttcaaataaacccatttttctaatttataatagttcatactcaactaatcatgtgttaatagatgatctcattttgcatactgcgaaaaagcgtagccaatccactttgtccaacggagccttagttaagtatatgtgcatacaactcaatatgatatgaaataaaaaatttcacataatttttccgtttcttttttactttatactggatattactcatgtaaaaactttgatcgttcatgttcttttttcaaaaatataaatatttcaaagaatcattgcattatcaaagtactttatatgccaaatataactatatttcgtttatcaaaactttgtaatttttttttaaaaaatattggtcattgataaaattacatttgtcaacacgtcaaaaaaaaagtaactgagggagggagtaattaaatttcaaggatcaagttctacaaatatttagaactaaaatatatattttttaggaaaaaaaaagcctcgacgaggcttctgtgcctgcaaattaaaggttcaccgttcctggacggtcgagttaattaatttcgctgtttttcatgttaatgaatcgagttgattaatacacaaagtacaaaaggcaaaatcgtcaggtacagatcaaaagatcaggaggacggattttctcgttttggcggtgaaaatcaagtttactgctcttccttttgactctcaagtctcaacacgatctcttttgagagcacgcttaagaaagcaacactggggtgggtctctgccgttaattcaacggacggtgtatagaggctgtctggggaggttcctgcagctgcagcttcttctataattagaagctccgtcaaacagtctagcttttagtctaaattctgagaagctgtagttatagaataaaaaaattaactagaagtcagttttttcagattttcagaatttggctaccaaccagctgcttattagaatgttaaccgtccaaacaggccaaagtgttcttcacccgtgcggtgcacccgtgcaacaaaccacctccagaggctgcagaacttgtgggggtacgtgtgtcactgtgtcagttggtaataactttgtactttcgcaagctgcaagcatatctgaatatgttggatggtgtacggtgagactattaattgtacttgttagtggtgattcgtttttttgaagtcaaatgatcgacttgtgcttttgaaacacacatctatcggcgttcttcagctagctaatacgaaaagatgatatggacgacgaagggtatggtattgtactatggttagatggtttagcatcgacaactagatcatgatcgatcatggatcaataattttctttcagtagacgtttgatgtcgcaattctggtatttgtatagtatggggatcgtcggtgctagaatacacgcgagactgaggtaaaagagatggagacgaggatttttatacaggttcgggcccctgaattgttaggtaataaccctacatcctgttggccggagccggtattgctcttattcaccataatcacaccagtacaatatgtggggtagcctatctaactgttgtcgacatggcggtctgaaggtctgactcgtagtcgacaacagggtagccttcctcctcgagctcgcgcccgtcgaaatcagcgatagcgctagattcctacggccgacttctgtaggtaccggatagggccaatccaggcatatctctgatgtcgatatccggcggcttgtcttggcgtatgtaggcttgtatgttgtggcttctggtgggtgtatgttgattgtgttggttctccctctggtcctcctagggggtcttgtatttatacccataggtgtccccttgtacaagtagaactaggaaaaccaatatggatacaatccgagtagtccttgtcgtttccatgtagaactctggttgtctttccttatcggaactcctcctatatccgcaggttgtttccgtataggacatggtatgtggtggatcctatcgagatttagtcaactactattaggtatgtggtatccataaccatgacagtagcccctgacttcaatgcaaatgaacaagttcatgttctcgactgctgaccatggagtaactgttatcgagctcaagtgaccgttctcggtgagttcagagataacgttagacttcctttattagcctcgtgcgggcacctaaagggtttgtctgagtcaatctccgacgacaaccaagaaagtacatagcgtacgactaagtctcttgtcttgccgtaatcgagaatttggattgaaatcaagaaattttatctcggcgggtacaccatctcttcactccgtattccttgtcgagatccagcaaccgttctcgagcgatcgagaaggcgtagagtctgcgacggagccttgtcaacatttgtcgtactcgccttagtcgatcttggtgtagaaccacagagacatggagtcttcaacaatgtcgaatagaattttcctgaaatcaatactcagaaaaaatattaaatagaaatagcccccgagcgaacgctcaaagggtaacatgttataatataacagactagtgaattgaatgtacagactaatgttttgttatatgagcgtcttctctcttaccgactccaatcagtcagtttgtagagtcatacactctccctagcccctagccttgtcgtcggagaatcgttctcggatgataaggctcttggacctttgacctgcctcggttgaacaagcactgatcctagcccccagccgtgaagttggaaaactcattttccgattacacggcttggttaatacgcacggcgagaactcttacacgaccagatcttacatggtcttttgtctctacaggatccgacaaggccttatcggctttgggcgtccccagctgaagttcccttaggttcctcggaggccttgtcaagacggcgtaaagggacagtaggataggtttcaacgctaggtgtcatcgtggcaagggatctctggataaaacacttggcgatctcgtgtacctgatatcaactttgttgaagtagaggtagtggaaggattgctacgccgctagtcgaggaccaggtagtagtcgtaactcgacaacttaaagtggaaatagtgggagaaacgctacatcgctggttgaggaccaggcagtagtcgtaactcgatcacttaaagtggaagtagtgggagagacgctacatcgctggtcgaggaccaggcagtagtcgtaactcgaccacttgaagtgaaaatagtgggagaaacgctacatcgctggtcgaggaccaggcagtagtcgtaactcgaccactagaagcaaatgtacgagagatcactacgatcaactggttgagaaccagtgagaaggtgtctctcgatcatttggagtcgtggcacgaggactgctacgctaccggtcgaagaccagtcgtagctgttcctcaaccatctgaagtcatggtgcgaggaccgctacgccgccgtagtcatacctcgaccatctgaagttaaggcgcgagagattgctatgtaccggttcgagaaccagcgagcgagtagaattatctctcgaacaccaatggaagttgcggtgcgagagattgctacgtcctggtgcgagaaccagcgagcgagtagaattatctctcgagcgccaatggaagttgtagtgtgagagattgctacgtcctggtgcgagaaccagcgagcgagtagaattatctctcaagcaccaatggaagtgctagagttggtttattacatgtgcgtctcatgtggccagcatgactcacacacccaactcgtagcatatccggatgtccattcgcaatcatgtcgggtgatcaagccgacggcgtttacgaggaattatccgttaacaaccttttctcgagtagtccagcgatggccggtgctatgagataggtcgtcggtcttcgttggcaggttgggtgcgataactccgcatttgtcgagaatgttctcgataatggagtgtacttgaccataacctacccgagtacttaattgtttctgaaaaatattttctagaaggcaagatatatagcagataatgtcgagtatatactcaaaaaactgcatggatcttctagtattatcaggacataactgcagatgtaattatcaggcattatgtaaaccgtaaacaagcataatttatacagaagagaacggagcgagcccccagcgttagaccgtagttggcctgacatcggaagcactcgcacaatagatattgtataaaaaacatgctctaggtaaacataataaattattgatctgacaatgctgtatgatctgaataggtacgataaattgcatataaaatattacgtacctttgtagatacatgccggatgtatctacgaaattagtagatcaatttgaaaaaccaatctaccaattaccttattgcgtactcgttcgacatcatatgatctgacatcttctggtacgccgcgtatcttaaggcttgggtgatctcgatagaccaagttgtcgatgacaatggtggttccgatctcgtcggaagacatgctccggtcaggttagatctccacagccgaagtcatcgagtagcttgttgtcggagaatccatctcttaaaccaatctcgtcgaaatcctagagcaccaaagtcccctacctggcgcgccactgtcgacgtttgatgtcgcaattctggtatttgcatagtatggggatcgtcggtgctaggatatacgcgagactgaggtaaaagagatggagacgaagatttttatacaggttcgggcccctgaattgttaggtaataaccctacatcctgttggccggagccggtattgctcttattcaccataatcacaccagtacaatatgtggggtagcctatctagctgttgtcgacatggcggtctgaaggtctgactcgtagtcgacaaccaggtagcctttcttctaaagctcgcgcccgacgaaatcagaagaagcgctagatccctacggccggcttctgtaggtaccaaatagggggcgatccaggcatatttctgatggcgatatccggcggcttgtcttggcgtatgtaggcttgtatgttgtggcttctggtgggtgtatgttgattgtgttggttctccctctggtccttctagagggtcttgtatttatacccataagtgtccccttgtccaagtagaactaggaaaaccaatatgggtacaatccgaatagtccttgtcgtttccatgtagaactctggttgtctttccttatcggaactcctcctatatccgcaggttgtttccgtataggacatgtatgtggtgggtcctgccgagatttagtcaactactattaggtatgtggtatccataaccatgacactttcctatccgacaaagctgttgaaagttgccgtagctttacctttaaaaaaaaggttgtcatgtataggtgagatcagcagtgaacacatgactaaattttagtgggtgctatgtttggaactccaagttctaaactccattgcttcgttttccgcacgcacgcttttcaaacggttaaacagttcgtttttttaaaaaaggtttctgtacaaaagttgcttaaaaaaatcgtattaatctatttttttaaaagaatagcaaatacttaattaatcacatactaatgaaccgctccgttttccgtatgtactgtttaggatgagaactggcatatgcgaacacaaccataggcaaaatacatgccaagctgattaaatataaaacaaatctaaaattcatacataaatagattatgtgtcatacataaaatttgtacataaataatggcctgatacttatttatctttttcttccctctagcaatttttttatctaatagaattggatagtacatatagtgggtttggccaacagtaggagggactcaagctagcccaccttgcccccctttgggatcgtcattgggtgagatctctctctatgtctccttaggatctgtttgagttaagagaaaaagataatattgagaagatacgtaaaacgagataagtcattagtgcatgattaattgattattatttttaaacttaaaaaataaattaccatgaatttttaaagcaatttttctatagaaaattagaatatctccatgagcctctctaaattttgctctccatttgctcatttagctaactaggcaaaaaaaacgttgctctccatattttttatctactcttttcttaagaacattttctacatactcctacatcctctctatttaccctctccattttgacaatgaaagccacacgtcaatctctctctccttccgatccccttctctgcacaacccgtcccttccccagtccccacccaccaccacgagaggccaacgttggccactcgcgctagcagggtggctacaccggaggaggaggcgattgatagcggtgatggaggcgagacggacagcactgccacctcgtccacggtggcgtactgtgcggcgaagagaagggaggaagaggcggcaacgtggtggaagacggatgcaacggtactcatgcgggcaatttatttatttatttaaaaattcatatattaaccaaatattaagacagagttcagggggatgtgatccccggtacatcaccatagctgatagaacttacagagcacaccatcctttcggaggccaactgaactaagaaaactagcatccaaataaaactaaacagcaatagaggatgatgtcgcgtacatagcataactgactgactactgccttcatcctatgaagttttaacggaaattaagactgaggtgaaaattaaataatagaagtttatgattgattaagacgagaggtaggtgaagaagttgattttagacattaaaatatgctatatgtgggagggaactacatcttttatagttgaacattttttttatgcgcgagggcaaaagaaaaaagagttacaacctcttggagaaagaaaaaaaaatgttagtttggtagacaaaaatgtcctattctaatctttattttgagctgaaacgaaaacagtcttaaaccctcttacgaaggcatctacgacgtgttcaaattggagccattttaaatcatacatttttcaaaaaaaatgacagatatatggatatatttagtttgttatcaaacataggtaatgcatatagaattttaacaacaatacatttagcctatctgatagacttggtaatgttagcaatttaccgaaattttggtattgctaaatttagtcattttgaaaatgtttatttcaacactaataacctagcatcaaccatccatccacccaccaggccacaggccagcacatacatgatacatcacggtaatagcatgtacaatagcatgtacaatagcagactataagctagctataaacacatatcgagaagataaataagaagagataagagcagcagactatatatttgtagccagttgcagcacagactataagacgcaatgtgtgtataataggtgggaccatatattacttgtgtaatatatgtttatatgtaaaagtatgattagattattaaattgattatagataatttagagctaatactgattggctatactattagagcaagttcaatagtatagccaactactagctccaattatctatagtcaatctaatagcttattcatacaatatttacatactacactattaatacctggtcccatctatcatacgcacacggcgtcttggagtccgtgctgcagctagctacaaatctgtagcctgctgcccttctctctcctcatttatctccttaaaatatgtttgcagctgacttatagtctactattcctcctcttaaacttgctctaacgccagagaataattttcgcgtcagccagccagccaaccaaccgtcgaccgcaagcccaggcacgtatacaccggtccacgtagtacgacgagcccacgagcgcgcgtgcaacgcacgcaaacgtaaccgcgcgtccgcgacccgtcgtttccccacccgacctgcgcccggctgcctctgctgcatctatggatcggggacgcgtacgagcgcgtgcgcgtgcggcgtgcggtgcgatgcgggccgcgcgcggctgatcaccccggggtgccagtttgtccggacgcctcgtccgatcgccaccaaacggccaaacagctagtagtagagcgggcgcgccgcgcgttttcatacgtttgcctttggagttttttgcagcctcgcttgtccggagtcgtcgagcgggcgcgccgcgcgcgcgggcgcatgcgtgcgtgcccggtgggggtggagcacatcgccttcccaactaattaatcagagcaaaactaataatacaaccgatctaataatacaaccgatctgttaagtataagattttttttagccttctctcagcatgtttatataatagttagctctttataattaatacatgacccacttatctctctcaaagagtttattggttcttatgtgttcaaaccagctataagtttatagcccacttctcctctctctctcctctatcctctcctccacctcagcatttagtcggcttatagcatactattatacttgctctcaagtgcgcctccgcgaccgacgaccgggttcgcacttcgatcgcgcagttggtttggttggaaggtgtagtacgtggaacgagagatttttttttcaagtacagctgtggataatttgctaaactttttcagcggggcctaattcttttcaggttttaagggctactggactttcgtgggcacgtcttgtaagacgctaaaattttccatatacgggtatatatacgttcgaataattgtatcaccttgatgcaattgacttagtttaataaaagcttccattatctaaaaaaaatgtcgttacgtgctagatagactagaagggatattggatcagatggttatgcaagcggagtggacgtttcagggcatccgcaatatactctaaaaatggtccataagcaatataatatttgattcagctacttagcaatattgtggaactagtccataggaaagaaataacaaaagctacccataagcatatgggctacccatagagaataaaatatattatttgtctctatctcttctctcctactaatactactccgtatttgctatccatatatattgtgaaggttataatagttagggcctgttcactttgataccatttcaattttgttaaagttacaaaaaaaagtggctacatttagtttgctgccaaattttggtaactatataagaaatcctgccaaaatttggcaagttgccaaaatttggtaatgttttttttttttgcaacaaagtgaacaggcccttaaagctcatatatgtggtttccatctctatggattacttttgccatatacattattgttacccttatagtattagataaaatgtatatctttttttaaaagaatcaaataaataattatttttaaatctgataagcccatacctcactgtaaaatggacctaaccgtaggcacatacggagtacggtttaacgtgatatcatattaatatattaacacgattaaattcaaatttaaactgtcgtgcgcaacaattttagaattatagagagcctcagtttttttttgtgtgtagtgtttgcttgtattgttgactgtgttttgctagagttaggctgtttcaggtaataaaaagaacttttgaatttgaatatactaaggctatgtttttcggtgcatgtccgactctacttccttatttttttaagcacgctttttaaactactaaacggtatgtgcacaacattatatagaaaatttgttttaaaaaattatactaaactattttctaaaaaataattaatacataattaattatgtgctaatgaattactccgtttagaattatttctcttccgtctgagagcaaaaacagcttggaaagctatctatcccctctcttcctccacttgttttctggattcacgtactggttggctgtgttcggatgcctcttttcccaacctctctcccttgttttctacgcacatatttttcccaacccctctcccttgttttccacgcacatgtttttcaaactgctaaacggtgtattttttacaaaaagtttctatacagaagttgtttaaaaaaaattaaattaatctatttttttaaaaaataacaaatacttaattaatcacgcgctaatggatcgctccgttttccgtgatcaccgttccggatgggaacttgttatagcaaccacagcctaatataaaatagtgagataccaattgaaaggaggagacggatttttccctttcgggcggtgaaaatcctgttagtgctcttgcttgactctctcgaaacaatccctttttaagcgcacgcttaaatgtgcatgtgttctttacaacactttctttacttctaatatttattttctatatgttttcttaaacaaaaattttagaggaagttacttttagaaaatcatattaatttatatttcaagttttatctatcaattaattaatcgtgcactaatcttatatagtgaaagcagcaagctttcttgcacgaggatgtgccacattatcaaaaatatattagccgtcggataaaaagttcggataaataatggtcattagatcaaaaaagtgcatgtattaagaaaagaatcaaatttccggaggtttctggtatatcctctaaacatatgatataaagagaaagtgaacaaagagaagaaagatggggcttttaatgattcctcttataaacatatactccctccgtttcacaatgtaaatcattctagcattttccacattcatattgatattaatgaatctagacatatatatctatttagattcattaacatcaacacactagtacagatccttctatctgtgacgggctctaatatgcttagaaataccgggccgtcacaaggaagtcatctcaatcgggccgaaaagtgcccaattgagatatggtcgcacagacatgttagatgggtataaaacttaagcccgtcacggatgacacctatcagtgacgggccacaactttaggcccgattgagataaaattctatatctcaaacgggcctgaagttgaggcccgacgcggaccggatttgtgagtggcgggcacttgaggcccgcccgacataccagctagacccgtcacagatgactcatgcgcgacggggtatatacgtgatgtctatcgggcgtcggctaaagcctgtcacgcatgactatttgtccattttcatatgaagatgtttataatggtaagttgactatagcaaaataattttacgggtagaaatgatttcaaatggaaaaaatgtcaacaacaaagttgtataacttatcaatatttacaacttttagtttggtcatttttcaatataacattttttttgaacagtttgaatttgaatttaaaaatatgaaaactttcaataacattttcaaatact

SEQ ID NO: 33421 - DNA, 6541 bp, Oryza sativa
  unsure (1)..(6541): unsure at all n locations
nnnnnnnnnnnnnnnnnnnnnnnnnnnnnnttaatgcccgtcacagatgactcatctatgacgggctataattaatgcccgtcacagatgactcatctgtgacgggctatagttaatgcccgtcacagataagagtcatctgtggcgggcgctagttgtgacccgattaagataggtcatctgtgacgggctatagtttgactggttgtctgggtcaaagctatcggtgacgggctttacttagggcccgattgagatagaatcatccgtgacggccgtttgcccgattgagatagctctttacatcagtgacttctagcctgtgacggacgccatgcccgattgagatgagagtatccgttctagtgacatgaacgtgggaattgctagaataacttatattctgaaacggagtaagtagtactacttggactagaacaatatatacttcgtaaacaaattaacttatatcaaaaccttcttaaaagttaaggtaaactaataaggcatatacaaaagttcttaaatagaattaacagtcgcgcatcgcgcgactatgtggctagtatatgttgttttgtttaagttgtgagaatatcccttaaaaaagcactgcgtaagaaaacaacactcattcgtcactagcttcaccaacactaaagataaacattctcgctgttcagtaatgatgacggtaataccgatggattaggatagatagcaaaagatctcgatcgtccaaatccgaatggagagtgccgtacaagctagcaatacagacaaaattaatagttagtactaattcgtatccagttaaaattctcctccttttttgggtttgacaaggccgcgggcaggcccagatagaatgtgacgtaagcatgactacctatacatttatcgataaattttctattaaaaatttatcaaatgtaaatacaatataattatactgtgattacactgtaactacagaataattacactgtaacttacgtgtaattacactgtaactatagtataactacactgtaactataataattacactgtaatttagtataactatactataactataatataatataaaacttgcatgtaagtgagatgtaactttagaaaacttatgtttggcactgcccacgtgaaagagggattacggactcgcaatgtctgtttgtacaatgcgtgcggaggccatcatccatgcatatgcatgttcggctataccctgctgctttatctctgcccttcgtctgtcatctacgcgggcatgagccacgcctgaggtcggcggccggcggacgtcgaaagaaacaaattaaagcgtcgacacaaaagcacgaatcccaaggttcatcaagcggttcaaaaatcgataaattccaaggaagaaatttgtcagcagatttatagcaaaaccgttatataaattgtggtctaatccaaaggttaattatataagcaattcctcaatacaaaatgtcattaaaatagtggtatatatgaaattgtataaattcttcatgaaaaaatgcgccgccaacagctagcccctcatccacgactccacctcagctcctcgctgccctcgcccccatgctactgccctagctagatgcgccgatgacagcaccggatcaagtcatggggataccggatccagcctcagcggttttggttctatccattgatgcaagcccttccagtccgttctaaaatataaaatacaattatacttttcaccgttctaaaatatataaggatttttagtgtttcctaaaatatatatggaggttttgtgtatttctgaaaaaaatgcatcggaacgtcgagaaaaattttggaaatcacgtaataatccttatattttgtacaagaggccaagagggagtagtttctagagatagaaggaattaccagagttgtccatccaaacaaatttagtttcaaataaacgacaatcatatttcggctagttttagtgttatgatgagaaaatttctgatcacgcacagcattcatcttgactttgaaaaataaaatactttttttttgtttttttgggggcaaatacatttttttttgttgaagagagtataaaagcatatattccttggtgaactttggggatacacannnnnnnnnnnnnnnnnnnnnnnnnnnnnntcgatttatccattaattttaatattggtcgctgtcgaccagctagctaagcgtatacgttcaacaataccagatcactctgctagtacttgatttctctctctagataatctctaaataatgagtcatttggctggtttgttcatatattccattgtattgattgaacaaactaaccagaacattttatactatggtatgcatgtgtggtgtgtcctaccgtgtttctttaataatcgggtttagcacgtccgagatcacaggctcacaactactggacgaaaagaagttttaaaaaaacaaactcttcgtgcacccttgatgttagacttgccaacaagacatggaatatgtgtacacgtattatatattttttattactgttatgtggtctagaatatatgttatgtgttctagaacaaataatattaatatatacatttggatggcccaaaattatttggggtctatcatcactccatgctccgtatgtaaaagtggcaattttttttctctgttttgtattatctcggaacttggtatagcactctgtatttagattgatcagtttgcgcaaaactatttgaagttcaatttttctgctggtccagggtttgaagatctaagaatgggcatggcaaatatatataaagtaggtaggatgtagaaaaaaacagagaatcaattaagggaagcaccaggtttatggtatatcgagtgaaatcatcacatcttaggtgcccacatatatttacatgagtgaaatatatataaggtctctaaatttgtgtaggtatgtcatctagattactggatctttgtgtgatccgaggaaccacatgagcgaggacctacacgtttttaacagaaagttggggggttttgatgcaacattctgattgcatggcgtcgctagtccgtgactttctcagcatgcgtacgtacggtgtttagagaggtaatgttagagattttgtcgctgacctcatcgagcattcacaattgcgggttgcgggtttgaggggtgtgaacgcggacattttttttccatgtgggtctcgtatatgtaacttaaaaaaaaataagcgagagaacaagtaaaaatatcaaaaaataaaactaattaatgccgctcggtcctatttaacacaacactaaattctatatccatattgaatttaaagtttgtatgctaaaatataatggtttaaaattttatatttcatttaaaatagaaaccaaataactcattctaacgctatcaacatatataacataacagtaaactcagattggtaggtttgtgaaggtatatcaatacccaaccttaaaaatcttatatatgtggttatgccaagtaacatcccaatgatcccatatatcggggaggtcgaagctagggagggaggccgaggagcggcgatttgtagtggcttaattaggctgtgttcgggttgtgaggtgggaactaatccatcgtttatataaaacgaagtaacccattaatgcataattaattaagtattagttactttttttaaaaaatagatgaaaataattttttaaagtaactttcatatatatatatatatatatatatatatatatatatatatatatatatattaaaaaacataccgtttagcagtttgaaacacgtgggctagaaatgggttggaaaagttggctgccgaacaccgccaagctcttttgtggcgcggtgctctcgcgtcgcttgccctgtagttcatcctctggccgtgtggccagattgatcgatccggcgaaacaaaatactgagcatgtaccacttcagtgcctctagtggtagcagtagaaaagaaccgagatcgtgtcccatgtggccgtattggtggcaggcagccacacaggctgcatccatgcagatgaggatggagctctatagctagctcagctagcgtgtggtgatcccgattcgatcggaaatgttaattttatctcctcggtcataaactaatactcctaatgatgcttacagagactaattaatcaagtgattagaagcgttgagttactcctaattaaaagtcctaggttaccactacatgacagtggaccacagcatatgttctactccctccgtcccataatataagaaattttgagtttttcatgctgattgaccactcatcttattcaaaaaaatttggaattattatttattttttttgacttactttattacccaaaatactttaagcacaacttttcgttttttatatttgcataaattttttgaataagatgagtggtcaaacaatgcaaataaaaactcaaaatcccttatattatgggacggagggagtacttaattaattaccttagtcatactcccttcgtttaaccacttttaaatttgaatctgaacatagttgagaaattgtttgtagcactcgggtggacgaccacttatttcttacatgttgactaaattgttatgtaaaaatttcacaaaaattgacaagatagagtattatattatatatcactccatagacatgtaagtcaaatttaaattctacaagttttaacaaaaataataaatttaactgtgaatatgcgtatactagttagagtttaatttattgttttttacaacttgtagaaaatcaaatttgaatttgcatgtttacggagtaatatattacatattaattatcttgttaatttattttaatttttataaccatttattcgacgtgtaagaaacgagtggacgtccacctgaaagattggaatctatcaacgaacatatttacgtccgcttcaaatccagaagtgggtcttttttgggtgaagggagtacagatcggagaacagtaaaaaaaatataggggtagttcacgaaagagggagagctgtaaacaaattaaagaataatctagctgttcgatcccactgtactcctgttatttgcaactgctctcgacgggatgagaacgaaatcgaccgaccggccgaccgggcggccgttgcgttggacggaatccgatgcgaggcgaatcatcatcacccgtccttgcttgtctcctcatctacttctccactcccatccagctcaccgtgcgtggagaagccatatcatgcagattctaactacacttgcttccataatcacgtctttctttctaatatcatgtagaaatggcgcatttctttctaatattttttcttagcatgtttttctttttgctttttttactgacgacgaaaaccatattttctccctttttgcttttttttttctcgtgtgtttttgcctattttttctgacaattattttctcgcgcgtttttttcttgtattttcgaatgttcttttttgctttttttcaatacaggagaatatatgacgaaataaaagccgtgtagcagatggcaaaaaattgatgaattctatccgactcaagcgtctatcaatttagcgtttttctgatagttttttcagagcgatttgttttttaatacacggtacttttttcttgcgaggttttctcaaaccattttttttagaaatggcacgtttttttgtagttttttcctcgcatgtttttttttaaaaaattaccgacgatggaaataacttttctcgcacgtttttttatggaagatggaaaacctttttagagtgtttttttgcgcttttttttgacttttttctcatgcgtttttttgaaccgtttttattttctcatgcattttctctttttaaatagttagattagattagagatagagaagagatatataccgattagaaatcagactttgtttcacccattctatttttttctcgcatgcattttttaattcatacgaagcagatttttattttttacgaaccatttttttccactttcttaggaaatcggatgaaattttttagatgttttttttcagattttttttgcctttattggaatcagactttttttttcgtttttaaaggaattggatctagctttttttcaccaccttttgtttgccttttataggaataggattttttttttgttcggatctatgtttttttggccacataggggaaacagacttttgttgttgttgttgtttttcttttttcctttattttttttgcggcttttctttttctttttatgcacctttctgtctttgttatctcccttttattattattattttttaaaaaagacctcaaataccttgttgcaagaatatacggacttaaatgtaaatataaaaattatagggattcaaatgcaaaagtacacacccaaaaattaaaatcatataaaaatagaatgctctcgatatgtaggttccttttttgcaaacatattcccaat

SEQ ID NO: 33422 - DNA, 13669 bp, Oryza sativa
  unsure (1)..(13669): unsure at all n locations
ggtttttttttacgaacgatggaagcacctcttatttttttttaagtagtagagatagagaattgttgagttcattttgattgtgtttttttaccatactccatttttcagaattattttctaccagtggtggagtcagaaaattttttaagccctgataaacttcaatataactagctataaaaattccatcattaattaaccctttattattaaagtttagtggactttttgccagcgagcccaggcggctgcccggctagccaggcggtggatccgccactgttttctaagttgctaagaagtaagaatacataaaaaaaaaactcccaaattactttttaccgttaatgtgttatgttggcttacaactgctggcatggactgatgtcggcaggcagatggacatagctaatcacaattgacaaagataaaggtagtttaattctcttgtgagttgtgaaacgtgaagctagcgaaggatcctgacagggatgttctcctgtggccctgtgggtagcagccgatcagtggagttagagaggttttggtacattttgatgtatatgtttttccatagattttgccattgccttttgcaaagtgttgggctaatttagcatcacacggtcctgcgagagtcagcctgtccgattagatcaggtcgttttcgtgtggttcggtgtgtgtcctactagcttttctgattgatgctagctttgttgtcacctgtacttgaacacagctatatagctctcacttttccttaacgaaatcaaggcatcgttttaatggacgtgggccttaattcagcctatatgtacatgtttatgggccagaattttcgtactataaacttttatgcaaacaaaggagtaaattgcactcacggtgcatcaacttggtaggtgggtgtaatttggtgcaagaacttgagatataagtgttctagtgcaacaacttggcaggtaggtgcaatttagtataaggcctttataagtgatcatataaatgcaacaacttaaaggtaggtacgattttgatacaaagttatgcggacttaattatttggagctagattcaatttttaagtacttattttgacactatactagcatgtatttgtataagaatatttatatttttatcctaataactaataattgaaagtcaattaaattggatgtagaaattattatatttcggttgatatttgagaaggtgaagaaaacaaaaaattcttaaaaggtaattagatgcaaattgtatgtgcagtataattcttaaagattaaatttactatgtaatggcatattgacatcgtgaaaaaaattcacccactatacaagttgatgcaccaaaatactaaattgcgaagttcttgtagtaaaacacacttacttgtcaagttgttgcattcggacgttcaatttttaagttcttactctatatcgcacccacctgttaagttgttataccatgggtgcaatttactccaaacaaaagtgtcagggttatggataccacatacctaatagtagtcgactaaatctcggcatgacccaccacataccatattctatacggaaacaacctgtggatataggaggagttccggataaggaaagacaaccagagttctacatggaaacgacatggactactcggattgtatccatattggtttccctagttctacttgaacaagggacacctatgggtataaatacaagactccctaggaggagaggagagagaacatagacacacccaccacaatctacggaacaatatatcaagacacaagatcaatgtacaagccaacatacgccaagacaagacgccggatatcgacttcagagataggcacggctagtcccctacggtatctccggatactgataggagagacattgtgctgtctctgatctcgccgggcacgaactcgaggaggaagactaccctgttgttgactacgagtcagatcttcagaccgccatgtcgacaacagttagatagtctaccccaaatattgtacttgtgtgatccagatgaataagagcaataccggctttggccaacaggatgtagggttattacctgacaattcaggggcccgaacctgtataaaaatcctcgtctccatctcttttacctcagtctcgcgtatatcctagtaccaacgatccccatactatgcaaataccggaatcgcgacatcaaacgtcgacagtggcacgccaggtaggggcattttggtgcttcaggatttcgacgagatgggttcaagagatggattctccaacaaaaagctactcgacgacttcggctatggggagatccaacctgtccaagtacatcttccgactagatcggaaccatcatcgtcatcgacaacttggtctatcgagatcatccaagcctcaagatacgcggcgtaccaaaggatgtcagatcatatgatgtcgaacgagtacgcaataggtaattggtagattggttttccaaattgatctactaatttcgtagatacatccggcatgtagctacaaaggtatgcaatattttatatgcaatttatcgtatctattcagatcatacaacattgtcaaatcaataatttattatgtttacccagagcatgtgttttaacaatatctgttgcatgggtgtccccgatgttaaatcgactacgatctaacgctgggggctcgctctgtcttgttctgtataaatcatgcttgtttacagtctacataatgtctgacattttctgctcgttatatcctgataatgctagaagatccatgcagttttttgagcacatactcgatattctatgctatatgcttgccttctagaaaatatttttcaggaacaattgagcactcgagtaggttgtggtcaagtacattgcattatcgagaacggtctcgacaaatgcagagtcgtcgcgcccaacctaccaacgaagaccgacgacctatctcatagcaccggccatggctggactactcgagaaaaggtcgttaacggacaattctcgcgaacgtcgtcggcttgatctcccgacatgattgcgaacggacatccggatatgctataagttgggtgcgtgagtcatgttggccacatgagacgcacatgtaataaaccaactctagcacccccattggtgttcgagagataattctaaacgttcattcgctggtcctcgaaccagtacgtagccatctctcacaccgcaacttccattggtgttcgaagagctcgctggttctcgaaccagtacgtagcaatctctcacaccgcaacttccattggtgttcgaagagatgtttctactcgctcgctggttctcgaaccagtacgtagcaatctgccgcaccgcaaactccattggtgttcgagagatgattctactcactcgctggttctcgaaccagtacgtagcaatctcccgcaccgcaacctccattggtgatcgagagatgattctactcgctcgctggttctcgaaccagtacgtagcaatctcccccaccacaacttccattggtgatcgagagatgattctactcgcttgctggttctcgaaccagtacgtagcaatctcccgcaccgcaacctccattggtgttcgagagattattctactcgctcgctggttctcgaaccagaacgtagcaatctctcgcaccgcaacctcagatggtcgaggtacgactacagcaataacgcagctgtcctcgcaccatgacttcaaatgatcgagagacacctactcactagtcctcaaccagtcaattgtagcgatctctcgtacatttacttctagtgtttaagttacgactactacctggttcttgatcagaggtgtagcgattctcccattacctctacctcaacaaagttgatgtcaggtacacaatatcgccaagtgttttacccagagatcccttaccacaaaagacacctagcgttgaaacctatcctaatgtccctttacgccgtcttgacaaagcctctgaggaacctaagggaacttcggctggggacgcccagagcggataaggctttgtcagatccttcagagacgaaagaccatgtaagatctggtcatgtaagagatctcgccgtgcgtattaaccaagtcgtgtaaccggaaatggattttccaacttcacagctgggggctaggatcagtgcttattcaactaaagcaagtcaaaggtccaagagccttatcctccgagaacgattctccgacgacaaggttgggggatagggagagtgtataactcaacaaactgactgatcgaagtcggtaaaagagtagatgctcatatacaaaacattggtctgtaagtttaattcattttcggttttccatacatattataacatgtcaccctttgagcattcgctcgggggctatttttatctaatattcttttttgagtactgattttaggaaaattctattcgacattatcgaaggctccatgtctctatggttctacaccaagatcgactaagacgagtacgataaatgtcgacaaggctccgtcgcagactctacgccagctcgattactcgagaacggttggtggatctcgacaaggaatacggaatgaaaagatggtgtacccgccgagataaaatttcttgacttcaatccaaattcttgattacagcaagacgggagacttagtcgtatgctctgtactttcttggttgacatcggagattgactcagacaaaccctttaggtgtccgcacgaggctgataaaggaagtctaacgttatctctgaattcaccgagaatggtcatatgagcacaataacagttactccaaggtctgtgcgcggttgagaatatgaattcgttcatttgcatcgaagtcgggggctactgtcagggttatggataccacatacctaatagtagtcgactaaatctcggcaggacccaccacataccatgtcctatatggaaacaacctgcggatataggaggagttccggataaggaaatacaaccagagttctacatggaaacgacaaggactactcggattgtatccatattggtttccctagttctacttggacaaagggacacctatgggtataaatacaagactccctaggaggagaggagagagaacatagacacacccaccacaatctacggaacaatagatcaagacacatgatcaacatacaagccaacatacgccaagacaagacgccggatatcgacttcagagataggcacggctagtcccctacgatatctccggatactgataggagagacatcgcgctgtctctgatctcgccaggcacgaactcgaggaggaagactaccctggtatcgactacgagtcagatcttcagaccgccatgtcgacaacagttagataggctaccccaaatattgtacttgtgtgatccagatgaataagagtaataccggcttcggccaacaggatgtagggttattacctgacaattcaggggcccgaacctgtataaaaatcctcatctccatctcttttacctcagtctcgtgtatatcctagtaccaatgatccccatactatgcaaataccggaatcgcgacatcaaacgtcaacaaaaaggcatagaagaatacgcttatttttgtgcaaggaaaatatgcatgttagagcaagctagaaccacatatcaagaatattaaagaagagagaaaaaaacgaactgtagatttgttgccagtggcaatacagacttgaagacgttgtgtgtatatgagaggtgtgaccgggtattaatagattagtatatttttattcgtaactattatataaataggttattagattagttatactccctctgtttcacaatgtaagtcattcgagcatttctcatatttatattgatattaatgaatctagacatatatatctagattcattaacatcaatatgaatgtggaaaatgttagaatgacttacactgtgaaacggaggaagtagatgatttatagatatcatttggctatactattaaacttgctcttacctttaatcttgatttttggccggaacagcacagggacgcttatcgattttattagatttaggaggaataacttaatctcgtctcaaagcaaaatatttgttttatcccataggtaaatatcaaaaggaaatatgggtctaggatttgacatgctacttattagtattacgacatgactatgccccattattttatcacgcaaatatagggttctcaatggctgtatttagttcaccaaaattaaaagtttggttgaaattgaaacgatgtgacgaaaaagttagaagtttgtgtgtgtaggaaatttttgacgtgatgaaaatgttggaagtttgtttaaaaactttggaactaaacacggcaaatatatcctaagtgaaatatactaaagtgtagaacaggaagacaacatgatccatgattgtgtagaccacgaaatactcccccatctcacaataagatcaatttttactaagtcagtttgtccaaaaagaaaattatttttaaacaattattgaatcggagttaatgaaattggaaagtaaatgcattagaagcgtgttcagtgaaaaataattacattaggatttgataaagtggggtattgtagtcttattgattttgtattattttggagtaactaaaatttttaggacggcgaaggtagctagtatcactgaattaatgataattccagtgctcttccgtcctactcatattaagagctcatttgaatcaaaagatttatataggaatttcataggattcaaattctatagaaaatttttctatttggccctttgattcaaatgattgaagctttccaaatcctatgaaattcctatggaatgacatattacatatggtaaaagcttcaacctccaggcacggggttaaaataatagaaatgactataggacatggagaaagtggtgaaatgactgagtactgtggttacattaaagaaataatagaaatcagctttgatggcaccaaacctctcacacttgtgctcttcaattgccattggtttgacccaagccaagtctggtactcgccaagatatggccttgtcgaagttgctcatgcatcaatccttctcaagtttgagccatttgttatagctcatcaagcgacacaagtgtattacatgccatacccatgcaaatctgtgcaagatctcactaattggtgggttgtatataaggtgcagccaattggtagattagaagtacccactgatcaagattatgattttgtccccaacactgatgttgtccactatttccaagaagatggtctgctcggcagttttgtaattgatcttggtctgaactttgataataattctgaagaggttgcctccagtagggatactgaagatatttgcaatggcaaggacttggagcttctcaatggatcatctattcaagatgtcaacgacgatgatgacgagtcttattgtactgactcatccaatgaagatgatgaatatcccaccaatagggatatcttatttgatgaatatttctaaggtaaagacctcaatctgagttggaggccaatctgccaatttgttatatcctacatctgtaaatacatatttatttttatcaaattgcccacaatcgagctttcataaactaatgtgtactgtaatattatttgacagctaacttattttttcatacttacaggcatataatgatatggcaaaggactagagtttatttttaccatcaatccggttaagacaaccactagtgtctattgccttcctaggagaggtgtaagaacttagactgtagtttctatggcatcatgtgtacctagttgttggatgtattcatattgtgttcttctatcatgttccttttagcactgagaatctgcagctaattgtcgatttctaggatcgacaacatattttatagggtgcgctagatcaaagaaagaaatggtgacacaaatgttatactggttcaggccctcgacgtgaggtaataccctagttcagttgtatatggattggatctgtgtccggtatgaagagtggataatgacgcaaggtgcagccatcatccgggttgtcgagagtcatccctcgtctcgggaccccttcccctcttatataggatgaggggggagggttacaaggaaagtatctagttgattgcaactagatccctctattccatctataaaagatatgtaggatcctcgggatttatactttatcccgggtttgtctatttccttatttacaaggcagccatatgggcctatggcccttggcccaccgtatgtcgcagggcccgaatgcctctccttgggtacccgggtaccgtgtaacccacagaagccagctgggagagacaagactggctgagtacttgtagacccccgattttggaaattggaaatcttctgtgtttatccgtaccaatccctggatcagtagttggtacacacatacatagttggatcacaacatatcacgaatgaatttaggctaaaagagttaaatacttacattagggccaggtaggctaacaactatcagagaacaacagcaaaagacaaaataatataagggcctggttaacatgccacaggcagtcgaccggggaacgagacctagaacaagaccgcactccgatcatcttgtgggatacgcaagcgtaccgacaagggcttctcttcaacactctcctaaaagatatataaatagcaagggtgagtaccaaccgtactcagcaagccaccacaacaacaatgcatatgatagagggtattcaaggaatggtttcaggttcttttgcataaagctgcgttttgcaaatattttcacaagcctaagacctatcatagactgatcaaattttagttccagtgttcacattaaacaacgacggttctgtctaccatccattgtgatcccaaggatagcttcccgccattgagtcgtcatggttttttgaggacgtccacgttccctcctctcaggaaatggctccatcagcataaaaatcaccatgcaatatcccatcctacacaagttaagaatttagagtctagccaagtgtaatacatgtcccggtgctcattaaccgcgagcacggctattcgaatagatttggtttactcacactgcagtggatgtacactttacccgcactccgcgactgcccaacacatgagcctcgtcccaacacatgagacgcgtcacgacaaagcttttcgataacctcgcattggcagtacccgctccgtgaactttacatcctcatgcactctaggcgcacacggtttctagcagtgagaggagttctggcgcacccgggagggaaagacttacacatgcattaagttataattatgtttaaattctcacatgacagtcctaccaatggcgacaccactgtagacacccgcctcgcggttctacctatggctgccccaccgtagagcccctgcctcacacatcaagaaaccactatgcatggatactgcctccgctcagccatctactccgccaggtctatacccatacgagaagcgcggttgtacgggggtcgtttcatgcttaacttcatggctcggtccttaattgaccagggacggcactagccttttccggataccacccaaatcctctgtccgccccagtcgaaaatagttgttttagttttatttctcttttcacaaatcatgtcatcaatatcatggcaatgtggcgctcatgtctccacatgccgcatctcaattaccttcccaaaggtaattgcccaagcataaagcattttgataaatatgagtatgcatgattctagaatagcatttctaagcaattgtcatagttgactagggactcatacgtaaacatggttacgaaggaataaggggtaaacaataatcaaggcatggcataatcacaagtaggatgttcatcattgcatgcaattttatttgtatacaaaacaatttcgcaattgggatcaacatgttcaaggaatagtgatgacttgccttgctcaggatagtccttattcttgatataattcttgatcaaccttcacctcctggaagttgctgacgttgcctcacgactatccgatacacaaagtctataatacgcgagaaaaaccaatattcaagcaacaatcaaatatgcacaaacaaaatatatttgttgaggttgaacctaaggttgctcatattattcgcgcttgctaatgggttccaacatgctaagggctaaagtttcttaatctttctgttatcatggtggtctatttaggagctagccaatgtagtgtgaatgagatacgtatctggctaatttgtggtttagtctagctaatggctatggaaggattatggctacacatgcatctatctaaataaaatggtcgtatactagaggttctgttgtcggatggatttaggatcaatcaaataattacagtgaatcatttgtattatttattttattgatggaagctttactttaattatgaacatattttacttgtcacaataaattataaaaggttaataattatccatgctttgtatgttagagttgtttaggttaatcatattatggttacagattatcccatcacataattttacaatgaataatactaatttacagttgaactataattataattatatgaggtcaagatttataactagtatttatctaatatacatgtttgtcatacactccctcttaatttcatatatgcaacacgcaaattaatactataccgtaccactataatgggatgtatagtatatgtgtaagcaacaatatcttattattggatcatatatttgagtagtttctttttactgtaagctatacaatacatgttgattttaagatggctctatttggttaactaatggatatcaaccgactatatatatatatatatatatattctacttcacatgacatggtatcaactaattttttttaagtggtccaaatacaactagctctgtgattactctcctaaacaagttaaagattcatctatatgtgtttatagtttagttacaaaatatgaggctaaactttatgtaaataatttataagtcatggaattagttatatttggacataggctagtaaatggcactaatattttcctttacatccattaatttgaaggattgattataattaatttatttggttgctacagtgacaagatatattaaagataattatgctactgtacaatatccatttttttatttattggcacactatttaggttaactattatctaatcatttgatattaattaatttataattataaatatattttattgaatagtgaattatatattattggaaagcttatgaatttagatgaatttaggttcaagtttcactcaaatccgagttaaaatgaataagttatgctagtgtaaagattcaaatttgaattaatccgagaaattgcgaaaagctactgttcataaacgatttatttttaatccaagacatatccattgacaagtgggaccccgggtttatcctttttcctaccgaattattttctaaagggaaataggaagagctaatgacaagtggggcccacatgtcataaactcgagaccaaaaaaacttctataattagatttttaaccacccggacccacatgtaatagattcaactaataaagattaagaaggggtttactattcactaaacacgtggggcccactctaatctctcctctcctttctctctctcttttcttttcttttcctttttctctctcttttcttttcttttcttctcctttctctctctctcttttcttttcctttctctctctctcctttccggtttctctcctccttccctcttctttctctccctcggcttctcccttcctctctctttctcggctccctctctacccggcggcacggcgacaaatagggggggcagcggctcaccgacggcggcggtggcgacgacggcggcggcgacgacggcgcacggcgcggcacactgaggcggcggcgcggcggtcacgaatgcggcggcacgacagcacgagggcggcggcgcggcggctcgaaggcggcgacgcggcggcgcgtggagagggggaagagggagaggagggggaagatggagtgaggagaggggagaacggtggctcttataggggagagagggaataaggggaagagggaagagaagggagggggtgacgcgacggcggcgcggggctcggggcggcgcggggcttggcgcgcggtgagggcgacgggcgacgcgacgatgacggcggagcgtcgacgggacggcgacgcggcgacgggacggcgcggcgcggcacggggctcggcgcgcggcgatggcgacagggcggcgcggggctcgagacgacggcgacacgacggacgcgacgcgtgggcgcaggacggcgtgacagcggcggcgcgcggcgcgaggcagtgacggctacggcgcgcggcgcggcagcggcacgcgacgggtaanggcggtgcggcggccaggcgnacagagagagggggaaagaggaggggctgggttaggggaccacgtcgaacacctggcggccgatgaatagtgtcttttcctatttaatccccattttagcctatttcttgtgtaaatttgattctataaatcctagattttgtataaatgaagtttacccaatatttgtgtcattccaaccaatggatttattctagattaatattattcatattttatttatataatttatttgaatttttaattagggttaattcttattattattatatatttttcaaagttttcctatttttcttcttttagggttttggttgatttataaattgagaaaagttgcaaattaaatttgtatttactcctaagcatttaggtgaccgtattaagtgttcaaatgtgaatttgcccaaaatttaatattgtccaatatttaaggtttattaaagattctataattttctaatgagaccgttattaacacaataccacattagctcaatttatttatatgttagtttattttatatggaggggtttaatatatcaaatttcaatccctaaatgcaattaggaacttggtgcaaaatcgatctacatatcgaattaaatactcccgtaattctattatatatatagagagctcagtttatttgaatgatcatcatttcatgtgtacacatattatggcacccacctacattattcaaatattttaatatttgataaaataggttaataataacttttcttttatttgattttaatatcttgtgcataattatttgtaggattaaatatattcccgtaaatcatatctattgcttaaatgtagttcttttctttactttcttggtgatcatttacggtttggcaagcaatagcaatcataacaaccagcatgatgcaaaagttttaaaaagttcgaaattttcgtgattttcattgtcttgaattttaaggatgttacagtactcatccccagcgttgccgagtgatacttgttgtagccgagtccttgtccaactgac

SEQ ID NO: 33423 - DNA, 1493 bp, Oryza sativa
tggtggtgtaagcctctagcggtgacgaagtagccgtctagcatggggacggcgtcacccgacagcggtgtaggtggccgtagtgaaggtgcgagcctccaggaggcgatgaagtagccgtactgcacatagacgacgtcatccgactgcggagtaggtggccggcgtggaggtgcaagccaccgggcggcgacaaagtagctgtccagcatggggacgacatcacccggtggcggtgaaggtagccagcatggtggtataggcctccaggcagtgacgaagtagctgccctgcgccaagatgacgtcacccggcggcggtgtaggtggccagcgtggaggtgcaagccaccgggcagtgacgtagtagccgtccagcacaggggtgacatcactgggcagcggcaaaggtggccggcgtggtggtgtaggcctccaggcggtggcaaagtagccttccagcacggggacggcgtcacccgacagcatcctaggtggctagcgtggaggtgcaagcctccaggcggcgatgaagtagccgtcctgcacatagacgacgtcatccggcggcggcatgggtggccggcgtggaggtgtaggcctccaggcggcgacgaactagccgtccagcacagggacgacatcacccggagaaggccataggtaaccggcgtggaggtgtaagcctcccggcgacgaagtggtggccaagtaaggctaccctccagggcacatctcccgagtacgcccacccagacctgggtctcatgcccgatcttcagcaaatgcaagtcagtagctatacctagtaggcccctgactccatgtcgcaatgactggggtcatcgcggagtggagttgtcttgacgaacttgaagcgaagccgggtagcatcctgactccgtaccggggtgactggggttgtcgcggggcagagttgacttgaagaactcaaagcgaagccgggtagcgtcccgactccatgccgggacgatgtaacgccccgattttcgttcgggattaaaaatcattaaatactacattttctagaaattaaataaaaattaaagcaatttaatcaagtgaattatcgagggaattaaaatttcctttaaaaatcatggtcggaaataatttgtaatattctctgtgccctaatgtactctctgaaatttcccgtgaattttcggagctcaagaaataattttaaaagcataaaattcatttaatcaattaaaataaaaagagaacaaaataaacttcccttcctccccttgggcccttttttcagcccaagccctcctttccctcctccctctctcggccggcctcccctctcctctcttgggccgtctactcattttccctctccttcagcccgccctcgtgaaaatctactttgccctcctcccggtctcccctctctctctagccgacatgtgggacccgaggccccacatgtcagctcctcctccttccttcagccaccccgca

SEQ ID NO: 33424 - DNA, 8248 bp, Oryza sativa
  unsure (1)..(8248): unsure at all n locations
nnnnnnnnnnnnnnnnnnnnnnnnnnnnnnnnnnnnnnnnnnnnnnnnnnnnnnnccctcctcccggtctcccctctctctctagccgacatgtgggacccgaggccccacatgtcagctcctcctccttccttcagccaccccgcaagcaaccgccatggctgccaaatccacccacgtcgtcgctttcatcgcatggttccctctcccgtgcgtgcgtgggcgtggtcgccgcccatttccgcaccgtttcctctactctcctcgcaaaatcctgccatgccaccgcctccctcatctctctgtctccccccacatcgccggcagttgccgccctctaccgccttgcccgaccacgatcccaatcccccgagcccataaaaacgatccccggagctccctctctcatttccgctcctctccctcttcaacaacgcgccaccgccgctcccgccgtcgccgcatcctgccgctggcgccaccggctttgccatgccgctccgcaccccagcacccactccacttttaccttccacccacgaaacaccatctccactgtgaatcccctagtgccgctgccgttctgcacttcggtcggccaccaccgccgctcctagccacctcaagtcgcgccgtcactgccgtttgcttcacctcatcgaggagtgccttggccgcccttctgttttgccccaaccgctccggagtggttgcctcctcgcgaaaggtgagctccatcattccctcctcttctggccggcgattgacgccgcctccccctcctctaacccttcccccttgttccctaggttccgccggttctcggccacgcctccgccgcggttgggagtcaatggagcgtcgtccccgactccaacccgcaagcaccactgccgtctctcatcgttgagctccccgcgtcgcttccttgcctcgggcacttggtgagcacccctctctcatccccgccgccatcttgcgccgccggtggccgagcgccgccgtcgcgccatggctcagccgggccagctttgagccgcgcctgtgccctggccgcgccactctatggccgcccgatcggttttggccgatttgggccgtcggttcccgtggaccggcggtggaccacctcgtggttctggtccacggtggaccgctccccttgacccactgacgtgtgaggcccgcctgtctgcgccggcccctttgatgacgtcagcaacagccttttctttgagaaaatatttaataattgcatcataaatcgatgttaattctagaaaatcattcaaatggctcaatacttctaaaatttatatctaattcatacgaactccaaattgggccatttaacttgcaaaattcatctaaaattgagatctacatgtttgtttactttttatatactgtctacttggtttttattagagtttttcctcgttttgcgtgccagactgtagttttcgccgtttcggaacatcgcggttgcaaggataagagttcagaagattgttttgaagaagcaaggcaagtgacacattcctcttgagcatattgagcctactttataaatattttatcatttgcaaatgaaattgcatgtcttgttaattatgtgggatcagggtattacctatctgctcgcttgtgccatgtttacttgatatccttcctttgctaaatttgggtgataatttgactagttcgtgttacttatgtgacatagctagaactataggcttagccatgcttaattaccactagctcagttgatgggataattacattattatacatcttagtactcagatgagctgcgtgctcgagacatccgaccatgtttcattggtcgtaattatccaacaaaaatgcgacttaatggtgggctatgggtgcatggttttgctagtcgcacccatggcaattaaggaccggttcgcgggaaaccctggaagaattcatcacgcttaccacaagccagtgtgggcaacgactgggcttgtagtgtagcttttctctagctgacgtacccaggctagggtgggcgtgatggagttgggtcggtcggggtgttcggttgatcggctttcggatccactgtggcacgatgggggctgcccgttgcctactagggatgggggcgaaaccggaggtgtggtgcgattggttagagggggttatgcgaagggtccagtcacggcgtctttctggtatgtcgtggtggcatgtcggcgctcgaaaacgtgtcgtgggctgtgtcttgtgggtacagttgtacacctctgatcagagtaaaactattcgaatagccgtgcccgcggttatgggcggtcgaccagattcaccgtgattagtctcacccttaataaatcaactcaatgcacttagtttgagtgggatggttgggcctattcaacgtggtgtaccgttgatcaatggagatttaatgttaccttaattacttaactattttactgttttgctcaataaaatattttacaaccgcatttatacaaatagccacaagccatccttgtatccccttgcacgtctgcatcgttagtatggcttgatgagtacggttgttatactcagccttgctattgttcccctttttagaagtaatagcgcttctgagctgaagacgaagttagaagactaaggctcagaccccagttgagttttgcctgtggagtggagttgaagccccgctaggatcgccttttctgctgctgtcgttctctttcggtctgaggactaagtgcctcttctgtaagtattttatgctttatttacgtttggaactgtttattacttgtcgttttgtgtaccctagctgattcctagacagcgatttaatacacaaaatagtctaaaaatttgggctaaatttctgggtgtgacaaatgactgggttcatcgcggggcggagttgacttgacgaactcgaagcaaagccaggtagcctctcgactccatgccgggatgactggggtcgtcgcgggttggagttgacttgatgaactcgaagcgaagcccggtagcctcccaactccatgccgggatggctggggtcgtgctggggtcgagagtgagtgatgtaaggacctgtgccaggctcctagatgcgcacccagcacctgcggagccgggctctgaggcaggagatcacaagcctcctacgtggcaataccaaggaaacaaggaccgtgaagcccatgaacccgaggtcttcgctcaactcctagagggctctgaccagggtcgggtgatggcctaagggtagtgggcccccgggtgtggccgtacttcatgtgacgggggccgtcggacctgaagcctttgctcaacccctaggtggttaccggccacctgcggggccgatggtataaggaacacctagcttagccgggaggggcatggccagggcctggcggttgccgggagatttcgagccttcgggcgtggcagaatttcttgtggtcaggcccggcagcgtgtgatcttcccctcgtgccttgacggttgcggtcccctggttggcgaaggagacgctcctgacccgataggaagggtgagtgaaggtgtgacctatggcactcggtttagcctctaggcttttggtgtttgcgcggcggtcgttcgtgctgtctgggtgagggcggagctcccatcgtgcggcatagcccccgggcgtagtagtcatgcccagggcggagtcgagccagccaggtgaaggtggagcccccagcgtagtagtcggtgaagctcctcgtggcagcgtcgtgccgaccaggtgaggatgtagcccctagcgtgcggcgaagcccccgggcgtagtaatcgtgcctagagcggattcatgccggcagggtgaaggtggagcccccagcgtgacgcgtagctctcgggcgtagtagtcggtgaagcccccggggcggagtcgtgctggccaagtgagggcgcaacccctgcgtgaggcgaagcccctgagcatagtaatcgtgcccagggcggagtcgtgccagtcgggtgaaggcggagcccccgggcatagttgtcatgcccagggtggagtcgtgccggccgggtgaaggcggagctcgctgcctgcggtcggcgtagcccccgggcctagtagtcatgcccagggcggagttgtgccggatgggtgaaggcggagcccccgggtgtagtagtcgtgctcagggtagagttgtgatggccgggtgaaggcggagctcccaggcgtgcggcgtgcggtgtagagcccaggcgacgagagaggtgaagccccccgagcctgtagggaggttggtgaagcgtgccagctgggtgaaggacgaagcctcccagcgtgcggcgtagcgctcaggcggagaggtaggtgaagcccccgagcccatggaaaggtcggcaaagcgtgctagccgggtgagtgacgaagcccccggcgtgcggtgtagcgcccaggcggagaggtaggtgaagccctcgagcccgtggcgaggtcggcgaagtgtgctagccgggtgagtgacgaagcccccggcgtgtggcgtagcgcccaggcggagagggtggtgcccgtggcgaggtcggcgaagcgtgcttgccgggtgagtgacgaagatacccggcgtgcggcgtagtagatgacagagcctcctgtttgtattggtggagccgtggggcgtccaagtggtgccgatggagaataatacatcgttgatgtggtccgtcgatcgtgttttcttctgagttgtcttgcatacaagcttctatacggatgatgatgatgtcaggctgatgtggcctcgtctcattggttggccatgttgccatgcatgctcctgttgactgtacgtgcaaatttcaaaatatataatatttttctcgattttgtatatatatacatgtttctaaaaattttacgaaaatatacctttcccgctgataggtgatgcggcaccgtacctttggcgcacctcagaaacacgggaccggctgtaggggggcggtcccgcggcgccaatatgcgctgtggaagaatctaatatgttgtattattgtgttttcttatattttctgatatattacatctaccctctcatgaggtatatataggagtacataggggatagagacttggagtacaatacaagtaagagtagatttatctctaggattctatctctaggactctatcttatctctaggattctatctctagaatatatcttatctctataatttgtatttgactcttatctctaattaacatattatacttctaacattccccctcagtcgtaacgggagcgaagcaaacgattgcgactggatttgaaatcttctatttcttcatctctctgagtcatcatcatcgattgcatctctgatggtcggtcctccacctggtggctgcgtccccttctgtgtcgtcccttgactatcctctattccctcccgcagtcatagcgggagtgtcatggacgatagcgatgacacggacgctttgactggagttgtcgtagatgattcttgttgtagacgttcgtcgatgtagccaatcatgtggtagtcgtggtcatggtagtcatggtagttgatgtagccgcaaatagccgaaggcggaaaaaaaaattcacgccatggtgtgaagacaaaaactgcaattgttagcatcttgcatcttatagatgtcagaggatgagagaatgccattggggacgtcttgcatatgtcagaggacgtcgtttgcgatgaggccaccacttcagttggtccttctgcgccgtgaagcggtcatcacaataatgatgccgagttgatgcagtcgttgtcgttgtagatgacgtgatcgatgccgtcatcggtgacgcggtcgttgccgtcgtagaggacgcggtcgatgtcgtcgatgaagcgtcttgcagattaatctgtcagaggacgcgaggtgtccatctatgtgaacgagtcggcggcggcgcgcttgttcttatgttgatgaagacccatcgccgatgttgtgtcggagaagacaaatgtatggctgatgtagaggaggaagcagttgtggcttgcgtcgcggccgttcataggagcttggcgaagatgatcgatgcggattgcttggtgtcttgacgcttgattctcctgtcacctgtgcaccatgtgcttctctcaattgagtagatggatgcaccagtagatggctcgatgacgtttggtgttcccgtcgctcgggcttcacggcgacttggacggtggtgctgtacgccacggcctcgccttctgcttgatgatgctattgagcgacggcttgcgacgaaatcgtcgtcgtgttggctcctagagatcgtagggttcgatgtggcaaaaaaataaattgatctaattctaatattggtaaaatctaatctatggataatttgtggagctaatagatgcggcgccccagggagattataagattgatctcatctccccagggcgacgcggggatcgaacgacgttggtctctaaggctctgataccatgtggaagaatctaatatgttgtattattgtgttttcttatattttctgatatattacatcgaccctctcatgaggtatatataggagtacataggggatagagacttggagtacaatacaagtaagagtagatttatctctaggattctatctctaggactctatcttatctctaggattctatctctagaatatatcttatctctataatttgtatttgactcttatctctaattaacatattatacttctaacatgcgcgaccggacggcataggatcggtgcctcgccatggccatgtgggaccaatgggaacggaagggagtgacgatggcatgaggttaaaacgtgggactggattgcgatcccgcagaatggtcgagcgacaccacgcctaatgcaaacgatcatgtacataatcaaataaacttattcctaatgcccatagcattagctaattagtatgtgctgtgtatatgcatgtgtatggccactttgatatactaatcattaatcattgtacactactacatgatagatcattaatcattgtacactactacatgatagattttcctgaataatcaaataaacttattcctaatgcccatagcattagttaattgggaaaattggaaccatgccattataattttgtaaaatttgagatatgtcatcctgacctacatgtcattgactcatgtgggtcatacgtgtcattgagataccgatgacatatcttaaactttacaaaaattataatggcatggttccacttttcccagtaaattggtgtgtgctgtgatatatatgcatgtgaatatgtgtatggccactttacaacgtgtgtgacggtggcgaatattggtcacgcggcatcgccggcggtgccgcatgccagttctgcgcgactggatgggctgccagctgaggagcaggcagacgcgttaccgcgctgcaacggtgagggaccgtgacggtcgcgcgtgttggcaccgcggaaccgtcctcactaatcggtcacgcatctttgatctgcgcatacggtgcggtgccgcgaccccaatttacgggagaggtatatttgtgtaaaatttttagaagcatgtatatatatataaaatcaaggaaaataatatatatttcaaaatttaattcgctaggcttcgtccttgatcgtaggagcagaggatgttggcgaacttggcgtcgagtggcagcaacttgctgcgttcttggggagaaggatgtggtttcttttctgcattttaattctccgccggtgcagatgcggcgcggtcgtcttgtacatggcgttggcttagcttgcacgtagaggaatggcttcacgtgattggttggccatattggccatgcatggcttgcatgcatgagcctgtcatcaggcttgagcagcaggttgtcgatggcgtcggagacgatatatgtcgtaagggaaccggcggcagctgtcgtccgagccgcaccgcgaaggtgtattcactggtggagaaaccatctttcgtcggtcggccgaattccacaatagttccggttgcaataaaaaccgggactaaagatcaagtcccggttaaaaaaggtaatgggcatatttgatctttagtcctggttggtaacaccaaccgggacatctttagtctcggttcaaatgctgtcagggcttgtcaggcccttcgagatct

SEQ ID NO: 33425 - DNA, 3429 bp, Oryza sativa
  unsure (1)..(3429): unsure at all n locations
nnnnnnnnnnnnnnnnnnnnnnnnnnnnnnnnnnnnnnnnnnnnnnnnnnnnnnnnnnnnnnnnnaataccacgtataaggcgtttgttcaggaacaaggggaatgctagaatgatgcattggcacgctgaagagcgtcaacacgacgggatgctgaggcacctcgccaatggttcgcaggggcgaaacatcgacagaaaatttaaagacttttggaaaggacgcacgaaacatacggtttggtttaagtacggatggcatgaatccttttggagagatgagcaacggccatagcacttggcccgtaacgatgtgtatctacaacctccccccttggctatgcatgaagaggaagtacataatgatgctgattattattcaaggccccaagcaacctagtaacgacatcgatatgtacctaagaccactggtcgaagatcttaaactgttgtggaagaaggaaggtgtccccgtgtgggacgaggacaaacaggaggagtttaatgtacgagcgctgctgttcgtaaccatcaacgattggcctgcacaaaagcaaatgttctatgaaagttaaggtgtttgcttggcttctcctaattgacagattaaacacttatgatatgctgcagagaaggcactaccctcctgaaaattctgatctagcatgtgtcctttgtccagctcaagcaagggaaacatctttccaccttttctttcaatgtcaattcagctcagattgttgggcgcagctgggaattgtctggaacctttctctcaattttgatgatatgctgctgcaggcaaagatctcatatagatccactcattttgttgaaaaaattctctatgctgcatggaacatttggaagcaacgaaatgctctcatttttcagaatgtaccaccttcggttgtttcctggaaagctctctttaagattgatctttcccttttagtctttagattaaaagtttatgagagacaagctttatctcagtggataaacattttgtaaattatttgtattccttcttttaatttaatattaactgtgggggcttcccctatagtgtttcccctaaaaaaaatgattggcctgcacttagcaacctattcgggcagtccaacaaggggtacaaggcttgcactcactgtatggatgaaacagaaagtacgtatcttaagcactgtcagaaggttgtgtacatgggtcatcgtggattccttgtagcaaaccacccagtacggaagaaaggcaagaactttgaacatacggcggaccaccgtacgaagccaaaacatcgcagcggtaaaacagtctttgctatggtaaaagatcttaaagtagtgtttggaaaggggcctggtagccagcctatagagagcgaagatggtcacgcggtgatgtggaaaaaaactccatattttgagagttaccctattgcgaattcttggacatccgccacgcaatcgacgtgatgcacctcactaagaacctttgtgtaaacctttttggcttcctaggtgtatatggaaagtcgaaagatacactggaagcacgtaatgatctgaagcatatggaacaatgcgacaaccttcacctggaaccgaatgagaaaggaagccattacttgaatccagccagctacactcttagcaaggcagagaaggacaatatgtttgaatgctttgagagcatcaaggtaccgtcaggatactccacgaatataaagcgaataataagcacgaaggagaagaagttcacaaacctaaagtctcatgactgtcacgtgttgatgacatagctgctactagttgtaataaggggtatcctcccagacaatgtcagggcaacaataacaaagctatgtgctttcatgaacgcaatttcacagaaggccatcgatccggatagattagaagcccctcagaatgatgtggtgcaatgtcttgtcagctttgagttgatatttccaccttcattttttaatataatgacgcatctgctttgtcaccttgtcaaagagatcggtattctcggccctgtgtacctacacaacatgtttcctttcgagaggtacatgggcgttctgaagaaatatgttcgtaaccgtgctcgtccagaggcaagcatcgccaaggggtatggaacagaggaggtcattgaattttgcgtagaatttattgaagacatttgcccaatcggggtacctgaatcacgccatgaagggagactacggggaaagggtactctcggaaggaaagcaataatgacggtagacaacaatttattttgtaaagcccatttcatggttctacaacaatcttcattggtggcttcttacatcgaggagcacttggctctagttcgtgccagaaacatctgtaagtccgatgcatggattacacagcatcacattgatactttctccgcgtggctgcgacaacatctcatgggtaacaagacgattaaccaacaactggccttcctggcgaggggaccatctggctcgatcgtgacattccagggatatgaaatcaatgggtacacattctaaacgagagcccaagacatgaagagcacgaaccagaacagtgttgttcgtatcgatgccatgggacacgatggtacaactggcacgtattacggtgccatcgagtacatatgggaacttgactatggacctctcaaggtccctctgttccggtgccaatgggttaggctgactggtggaggcgtaacgattgatgacagtgggatgacaacggttgaccttaacaaggttggatactcggacgaaccttttgtccctgccaatgatgtaacgcatgttttttacatcaaggacatgtctagcaaaggaaaaaagggcaaagggcctgacgagccgaagcgccacgtggttctcccaggaaaaagaaaaatcgtcagagtagaggacaagactgacgaggattacgatcagtttgatgggcaaccccctttcacagtgacgattgaccctagcatcctcctatcaaatgaagacaccccttactcacgtagcgatcacaaggaaggaacaatagtgaggagaatgtacgtgcggtcagaaagtacgtgcggtcaaccgtcaccgccgatgtattgccgtaattgttgtgtacacgatgaaaactatttttggtgtattgaatatccatacaaatcaattgttgtatggcatatgttaattatgtatgattattagaatttttatcaaattgaaatcatccatatgctagttatatatgattattataatttttaaaagttttaaatcatgcgcatggtatttacatatgttaattagaattttcaacaatttattatcatgatatgctaattatatatgattattagaatttttattaatattaaatcatgcatgggtaccgagctcgaattcgcc

SEQ ID NO: 33426 - DNA, 28633 bp, Oryza sativa
tgccgcgccaagacgccaggccgcgccacgacgccgtgacgccaagacgctgcgacgccatgacgccgccgtggcacgccaccgccgcgcaatgtcgccgccgcgccgcgcgccacgccgaagccacgccgcggctccgctgccgccacatgaatgaacgatcgatcgtgaacgaacgaaacgtgacttaggcgagaacttaacgacaacgtgaacgttaacgaacgaccatgaacgaacgtgaacttaacgtgaatgtgaacgaatgaacgtacgtgaacgtgaacgcgaacgtgaacgaacgtgaacttaacgtgaacatgaacgaacgtgaacgaaacgtgaacttaacgtacgttaacgtgaacgaacgaacgtacgtgaacgatacgtgaacttaacgtacgttaacgtgaacgaacgtaaacgaacgaatgtgcgtgaacgaaacgtgaacttaacgagaacgcgaacatgaacttaatgtacgttaacgtaaacgaacgaacgtaggtgaacgaaacgtaaacttcacgagaacgcgaacgtaaaatacagtatatgttactttgcgtttagcctaatacatttttttgtatgttgcagaaaagaagttgttgtcgtcgtccctcaagccggagtggtagctagcccttgaaggaattcgcgcaggcaagtgatgtaaatatatgattgttagacttagcatatatgattatctagggttgtaatgtacgacacttagacttagcatatatgattatctagggttgtaatgtacgacacttagacttagcatatatgattatctagggtcctaatatacgacacttagacttagcatagttgactattagagttttaatacaagattatttgagttttaatataagattattagagttttaatacaagattattagagttttaatataagattatttgatttataattagacttagcatatatgattatctatggttctaatatacgacacttaggcttagcatatatgactgttagagttttaatataagattcttagagttttaatacaagattatttgagttttaatataagattattagatttgtaattagacttagcatatatgattgtctagggttctaatatacgacagttagacttagcatatatgactattagatttttaatataagattattagagttttaatacaagattatttgagttttaatgtaagattattagatttgtaattagatttttaatatatgattgttagagttttaatacaagattagtacagttttaatgattatctagggttctaatatacgacacttagacttagcatatatgattgttagcatataagattgttaaagcaaatatgacctatagacctaacaaatattttttgtatgcacagatggctgatcgcgacgaggaacagatactatacaatacaatcgcagagggaagcaaccagtactggaacgaagaagaggggaacgaggatccaagccagtacttgatcgaggaggggaacgtggagagggatgcggagacgaacgaggaggggaacgaggaggaggaggctagtggaagtcatccctccgctggacagaagagggcacgcggacaacaaggtgccgcgaagaaaatagagggtcggcacatcataactgaggtggacgaagacggccgacctagtgccccggcagaagcagccaagaattttgtacgccacaacggttgggttgtgagggacaacgtgcctgtcagcacggtgtactggcacagaacaagggcacgcagggataatgacagctttgtcccggaatcagagaaagagatgctgtggaccacaatgctcgagacgttcacgctacccacgggtacggagaacacagtgaaacagttgactcagaagaaaatggcagaacaattccagagcttcaagggagatctctacaagaaatacatcctgaagggactaacaccgaacttcgacgtattcccaaagctaagggatcattgggacgagttcgttgcttacaagataggccaacaagggcaagcgatgatggccagaaacaaagaaaatgccgccaagaagaagtaccatcaccacttggggtcaggcggatatagcgtcgcaatgccgaagtgggaggagatggaagcaggattaattgagaggggtatcgaaccggccaccgctaaatggtcggatcgatcaaagttctggtactatctgcacggtggaacacttaacctagttgatggctcccttgtcttcagcgatcagatacgcgagggtgccagttgactaacggacgcagtggaagcctcttctcagggcacattccgacccgacagagagaaggacgagctgtcactcaccctacagactcccgagcatccaggacgaacacgagggaaaggcatgattccctggaagattggattcaaggaggacatccacacgtacaggagtcggatgaggagcaagaaagataccgaggcgaagattgcagatcttgagtacagggtatcgagctacgagctcagcatgcaagaggaggtggcaagaaaggtggatgaacacatggctgcacatcggtcccaggatccccaaccgtacattcctcctgcaatggtcaggccatcaggcaatcgtagcagctgcgcctcaacggggcaggtaggatcacagagcatggacgccatgcaaacccaggacgaaaccacctgccccgttgatgagatcacgcaacggacaccatgtgagctgcatattcccttcaagaacttatcaatcaaggtatgctcgtagttttatgattttttgacttgtacattccgcaagttgctgcttaggttgattactaatagatgacctctcatcacgtgaaggtggcgtcgggaatgaccatcccaacggacatttcagggacttaccactgcaggccaatttcagcaggatacttgagggtcgaagttgagctggtggaagccgcgtacgaggacctcgagttggactacccaggaggagacggtgagactcatctacgagacacaagccacgccattatactatagcgcaagcggtacatcatcctccctgggcgacaagcggcgtctcgtgcaccatctcctccggctccgccatctcctactgcaccatatcctccggttcctccgccacgtcctcctgcaccatctcctctggctcctccgccacctcctcctgcaccatctcctccggctcctccgcctcctccacctccaccgtgtccgcctgcacctcccaagacaaggtctcaccaagctccaccgcctacccgcacaagggcaacgaagaaggcgaaagttgacgccaccaaaaacaaggagccgccgtacgattgcagtcaagaggagcttgacgcttatgtggcaagagaagtgaagaggcaactcaagcctcggagtcctgaaaagaagatacctattgacccgagcatgaagaacttttcaagggaatgtccacagcaaacaagcagaagatgaagctatcggactatgaccgaacacttaagaaagcctattacaagaagtccaaactagtccctcagcttggagaacaaccaaaccaagaggtcgagccgttggtgaccggcgaagaatttggcataacggaattcatttcggacaccggtctaactatggatcagttgattggaagcgcatcaatcccgaaggcggaagtggcatacaagtttgaactcggtaaaccgcttgtcacgcctgagcagctgcagtccctaccgacacagatgtacaaattcaatgaacggtacatggaaatgagcgccgagggtagagagatgttcggagcgaggatcagaaacctcgactttttgcaaggagaagatgttctctggctccatttcaaggatgtcttcgatctgtaccatctggatgccctcgatgtctctcttttgagcgcatggattttgtaagtatctttgagttcgatttgtttcgttcaataactagctcctgtcatatatgtaaacaataataatttcattttatcgttgtagaatggagattcaaaaggcccgacggcagggggtttacgatactgggttcatcgaccctcggaaaatcaacacccaaatgattgacaagtacgagaaagacacagaggacaatctcgtccatctctaatgcagcagcatttcaagacgttcatactactgccatacaacacagagtgagtttttattgtcgttcgaacaaatttcgtatatatacatatagcatgtacattttcatatatatatctcatctcacgcatattccagcttccactgggtcctgttattctttgacttggacgcatagagagtcactgtgtacgactcaatgaataaagaggagaagatttttgacaaggtcttccgactgatagacaggtgatataatgtcatctattccaaagtcgcgggaattttattgctattatgttgatctcgggtaataattaattaatcatagcttgcaactgcacatgtagggcttgggatcggttccgtcaattggtccgcgggacttggaaagaaaaacttggatggaggtttcattttccggtgaatatatgcatgatccaaaattgtattgaattaaatctctaattacagttaaatataaagattatattaaatctctcatcgtttctcatgtagtatgcaaagcaggaccagggaactaacttatgcgactactacgtatgcgagtatgcccactgcctatcaaaccaaatatacaccacacgagagctcgatgtacgtatacataaaccattcaaaatttcattgcgtatcgatttgttaagttgtttattaatttcatatattgatatgtcattatttttcgaatgatagcgtattcacatgagggataatctcccacacaaggattttatcacggttgttcaagaacaactgatgggattcatcaatgaagaagtctttaatcccgatggtaaattctactacgacggatcgacaattcataacgtcggtccttccttttctgacataacgccggcgtcgaagtcgtagctatagctagcaagaaaatgaattgtactatacatgtatatatatatatatatatatttatatatgtgcgcacatttactttagtgttaatatatattttggtaacatatatatgcacataagatgttaagtgctttatattataaatatgtgtgtatatatatgtatatatacatatacacatatgcacatatatatatatatatatatatatatatatatatatatatatatatatatatatatatatatatatatatatatatatatatatatatatgcacatatatatttctccaccagtgattcggcacctccttctgcggacaggctttaatttggctgtcttggcatggtcgacgcaacggtggagtagatgcatggcaccggtgacaaccgccgcggcggaggccccggccggccgtgaaggagttaaggacgaggcggcagcttccttggtccggagaggagaggcgattatgtcgacgttggtggcgctgggcagcgatctccggccttgtcgaagatgggcttgctaatgtgcttggggaaactcttttccggcatgcatgatgacttccgatgaggtggacgcgatgtggggacctttcccgacgattccccgagccggcgagacgtactcctccattctaaaatattcgccgttgacctttttaaaaatgtttaaccgttcgtcttattaaaaaaaattatagttttacaaattttataaaagttttgaaataaaacaaacggtcaaatatgtttaaaaaaattaacagcgttaaatatttaattagggaaggagggagtacatgggaaggagatgagcttggcgaagcgacacgtacggcaagttgccgtgagagatgtcgtcgagttggtcctcgttgttcgcttgcatgctgtcgaaatccgcagaggctgtgctctcgtggtatggtttcttccctgttaccttccatgcatacgacatgtatgagttacttggtttttgcgcatggtcttgtagcatgcagatgacgtggcctcgtctcattggtcggccgggttgccttgcatggtactgttgctccttgcttgtagatgtttgttgcatgcatgtcatttctctttagacgatcgacgcgtcttcaatggaaaatacttcgtgtcgtgcgttcgatcggaagacaaatatcggatatcaactttctcatctgtactaatctaaagttgattcaccttttccatgactctgactttacatatgcacaattcattttctctctccacgtctcatctttgtatgtagttagcatttatttagcttcatgtagtctatgagtatatacatgcaagaggttctagttgtaagctttaaaggaatttttcttgtaaactatttatccaatttactatccgattgcacaattgtattcgttgcaattaaatctctataacaagatatcatatgattctattccgattaaaaaaaatacataagtttcaaccgatgagtttggatgtttcacgtgtaagaaataaatgattcaatcagagtttggctatattgcacattttaagttttatgttgccatggatcttataaaatgttccatggcattatttcgatgtttcgataaacatttttctgatgtttcactagtttatttgtgaatgttgcatgtggtattattggatgtttcagtaagtattttctaatgtttcactaattcatttttaaatgttgcacgtgttgtttgggatgttgcaatgaatattttctaatgtttcaataattataactcgttgtttcacgtataatatataaatgttccaattagcaatataatcacatttataaattttatcagaaatataaccaagtgagatattgtaaagatttaattataacgaacacaatggtgaaatcggatggtagatcggataagtaatttagaagaaaaattagtttaaaggtttattggtagagaatatgaagagagagatttcatgcatgtatacacgagagtagggtataggcttgcatcatagcagcttaactacgatggttttttttgcatccaatcagacaggtgggtgagcaacgtccgaactgtagcagtcgctttttttgcatgcagttagacaggtgggtgagcaatgtccgatcttttgctaaatatcggacgtccgatctgtagcagtctccggcttcaattcatcgttgctgattcttgatgctgctgtagtgaacggcctgaaaggagcggatatatagcgaggccgtcgtcgaggtggtcaccagtgtagtcgcggccgcgtcgagcgtggtgaagatgtcggcgtcgaggctgtcttcgtcgctaacgcggcattcgttgctggatatatggcggcttgtgtgtgtgccttggacgtagatgcgtgcggatgtccttcttcatgctctcgtcgcagccgttgctgctatcctctgtggccttgccgtaattgttgttgctatcgtcacggctgcagatgagcacggtggtgtcgaggcctcccggtcggcctcgccgaggtggcaggctgtacagagcttgtcgtgttggcaacgtcacctctttcttcggtgtcgtcagtgacgaggtggcgatgaagacggcacggcacgatggtgtagaaggcatcccggccggatttgccgatgtcgcgggcagcatgggggtcgtgtagcatatatggccgcctggttctttgatgtcgtcggtgccggcgaggtggcaaagtagataagttcggtgattgctgcggtggtggagtaggcggtgttagaaaggttgttcctgttacatgtgttgttacatgtgataatgcatgagataataggataaggttggttcggttagtttgtttcagagtttgtttctttcttctatccgaatcaactgagattgatctcatctattgtaagccacgttgggggctgttcccaactcatattaacacacgtacgcggcctcgagagaggtgacaacgcttccgtattttctacatggtatcagagcgaaaatcgcatcgactggattgcatctagcgatggcatcctctagctccacctccagcaacccccctatccggccaatccacccctgacaagctcacccgcagcaatttcttgctatggaaagcgcaagttctcgccgtgatccggggggcgcgcatggaaggctatctcaccggtgcaaccaaagctccttcggagacaatcacggttgtgccggagaaggaaggtggcagacccacctaaaccgtgaaccccgcgtatgaggcatggctcgccgcggaccaacaggttctcggctatctcctctcctccttttcgaaggaaattctgacgcaagtcgtcaccatggagatggcggcgcaggtatggaaggggatcacagagatgatctccactcggtcgcggtcgcagtgtctcaacacacgactcgcgctctccatgacgcgcaaaggtgacttgagcgtgtccgactacatcaacaagatgaagatgctggcggacgagatgaccgccgccggcaagcccatggacgacgaggaactgatgggctacgtgcttgccggcctcgacgacaactatgaaccggttgtctccagtttggtaggcaaaagtgagccggtttcaatctctgaagtctactcacagcttctgagttttgagtccaggggaaaacttcgccagatgacggctaatcacggatactcctctgcaaatgccgccaagcgcggcggcaaaggcggcgacttcagtcgcggtggaggcggcgggggtcgcggtggccccaggaacaacaatggccgtggcgaacgcggcggcttcagtggacgcggacgcgatggcaacaacaccggcggctgctacaactccaaaccccgtccggtgtgccaactctgtggcaagattggacacgtcgtcaccgattgcaggcacaggttcgacgactcgttcgtccctgatccaaagatggcagcagcagcctcctaccatgttgatccgaactggtatattgataccggtgcaacggatcacatcacgggtgaactagagaagttagcaacccgtgagaagtacaatggcaaagatcagatctacacggcaagtgatgaaggtatggaaatcaaacatataggccattccattattcgcacacccacacgcaatttgcatctcaataattttctccatgtaccacatgcacagaaaaatcttgtatctgctcatcgtcttgcccttgataaccatgccttcattgaagttcattctcgtttctttgccattaaggatcaggtcacgaagaatcttcttcttagagggcctcgccgaaacgggttgtatttgctgccacggtcgtcgctcccttcatccaagcaagcacttggagttatcaagcctagtctcaaacagtggcatagtaggctaggtcatccttctttttcaattgttcagaaagttattaataataataatctcccttgtttaggagatcttcatgagtctggattctgtgatgcctgttagaaagccaaaagtcatcaactcccctatcctaagtctattagtgtgtcaagtgtgcctcttgaacttatgttttcagatgtgtggggacctgctcctgattttgtaggaggcaggaaatattatgtgagttttatagatgattttagcaagtttacttgggtatatttgcttaagaaaaaatctgaagtttttaagaaatttcttgatttgcaacaacttgttgaaaggctctttgacctcaaaataatctccatgcaaaccgactggggaggggagtatgaaaaattacatagcttttttttttaccaaaattggcattagtcatcatgtgtgatgcccgcatgctcatcaacaaaatggatccgctgaacacaaacatagacatattgttgaggttggcctatctcttcttgctcatgcttctatgcctttgaaattctaggatgaagccttcttagctgccacttatctcattaatcgcaccccatccaaggttattcaatttgctacgccattagagcgactcttaaatcagaaacctaattattcatccttgagaacctttggatgtgcatgttggccaaaccttcgaccttttaacactcgaaaactccaatttcgctccaaacagtgtgtttctcttggatatagtaatattcataagggattcaagtgtcttgatgtgtccactggtagggtttacatttcgcgggatgttgtgtttgatgaacaaattttcccgttttccaagttgcattctaatgccagtgctcgtctacgggctgaaattaatctcctaccacacactcttttgaatccgacttttaccactatgggtgcgaatataaatggtcatatgtttgattctcctgagcgtactgatacttctggtgaaattgcagtacaaatttggaagaaaatgatgtaggttgttggtatttcttaacgtcattactagaaatataattcccagcaatacccagcaatgacgcagaaatactcctggtatattatggttacagagttcatccacaagcgcacggatataccattgtagcatttcacctgagagtattccaagggtatcgtatgtattttatcccgtggaaagattatgtagagagagattgactaatagtttatatattacttgtgataatcatattctaagaaggggttaagataatccaagggtagagtgacagacaagcattaacaactcattctcataataaatgatctaagctaggtggaaagaaaagagaaaggaaatatattcctatacttctaatatacatagtatacatacattctagttaactgatatactagctaataccctctatccgatgccctcctggtattttgagaagccacccctgactgccgagttccttacgacagcccgtcatgaccatacaaccggggctaaatacggaggaataccctccccaggaaattaacttaggattatataccggcgcggaggaatacccgtactaagctgtgaccatcagcggcccatctctcatccgcaatatataacccaaataatgatatcccgcaatctagacaccacgtctaaactaccagatactactctaataccatcgtcatgacatagagtaatagcataagtaaacattatacccgcaccaaagcatctcccagataagctagccgtatattcagtataacatgaacataatgtagagtaggtactcatatactcggaaagtattccaataccaaaattgtacatagaagagtgtcacgaccggaattaacccaacgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacgagaaacagcggaagactagggcgacgaccacaggtgcttgacggcaggcacgagctagacaccaaagccttcatcttccaggaactcctcttctgggtttgggaaaaattgagcaagactgagtacaaccaccgtactcaacaagacacacccacaagtgcagaataaatgcaagggagtacaagggagccataatatagggggttagggtttgcagtaaacagcattaaaagacacttagttgttcaaagctattttgtaaacacggtcctagagctatacaataatcaaggccgtgaacccacacgaacatgccttaacccaaggcctacgatgattcagaccgaactggcaacccgaccctgggtcccagctcgtcccaagccaacccaggccaaccattccatattttagttgttaagcaggttttaataattaaaacactaacttgggtacattgctcggcttgcccataaccgagggcgcggctattcgaatagattatactctgatcagagatgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggctgaggtgctactatcaaaaccatgcaccccgagcccagcctaaaaccattttgaggattttgaatagagggggaggtgtgaatccaattccacaataatccaaccattccatagtgtccaggtgatatgaatattcccaaagtctagagttgtaaaaccacctaatgttgcctaattaaccagcgaagcatcttcctaaaatcatactagtggtaccatgagtagagtgtccactagttggggttttgtttattctagggtgaacaaggaaataataacgataacaataataaggtcataagaaagatacataggcatggctagataaaacagtgataacgcgggaatttaaataaagcgataatgcaataatttaaatcaaaataattttataaactgggattcaatatgttcaaggatgatgtgacttgccttgcttgctttcccaaacgttggcttcaacttccacgaagagcggatcttccgaagctgcagcgtctacacgaccaacggaaaagaaaaggattttactctaataaactccatataacaaggtggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaattttaaaagggtttattgcgtcagccgaggggagggggcgcgcggaccgggtccacgggagtggggcccacgcggcagcctcatggtccacggtggaccgggtgcacccggctcgcaccggccggcgccgtgggtcccacgcgtcagtcgcacccgagagcgcgggcggctgacggccgggccccacacggtagccgcttggtgcgcccgaaggcagccacggcggcgcggccggcgggaggcggcgtgcccgtgcccctatggtcgccggcggcggccataggcacggcggagcggcggccgagagaagggaaggaaagggggaaacgaggcgacggtccacggctcaccctaggtcgacggcgatgacgaaaaggcagccggagcggaggaaggcggcggcgcggctcgggtcgacggggtcgacggcgttccggcggtcgggagcgaaacggaggggtggacgaggtcggcgaggatgcggcgaagcctaaggaggtggcgccgaggtgggaagtggtccggggcgacgacggcggcggaccggagctcggcggcgacggcgaagagagatagtgacgacgcgggctcgattccggcgaggaggaagggcggcgagaggcggaaacggacggaggaggtgcgggaagggtttaaatagagccggggcgagagagggcggccggggaagggaggaaaccggcgcgggaggtcggctgccatcaatggcgccggcgagatttgcgggggcaaatccgcctgtttgaacgcgagagagagagggaaaaatagggggaaagggagaggggatcacagggagtgatttccccctctttattgcacgcggggacggcgggaggcggcaggattcacggcggcggcggcgctagggcgcggcgaggcggcgggagcagcgggaggaaggggatgacgggtgggccccactcgtcagcgagggtggcgggcgggcccgcccgtcagcggcgcgcgcgcggggagaggccgggtgggccgcggggagaggagagagagggggagggagatgggccgagccggcccaagagggagaggaagggaaaggggactttttagagtttttctttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttagaggatgtattttagagtcattttgggacgcgacaaagagtattctaataaaagtacaaagcttacaaaagagaagaggaaagctgctaaagccatacccgaactcttccgaaggtttctagactcctgactcctattctatttctattccaccagctagatactactaaactaaacttaagagaaatgagagagctattgcttgaggtgtgtgttgaagtgaagagagtgagctccttatatagaggtagttatgacggttgtggaaggggaattgtccgaagtaccccgcaaccgccatcaggagaagatctggagcgtccctgccaaaccccacatccaacaatggagagatgggttcggccgaacctggggccggcccaaccagcccacaatttggctgctggcatcctggacttctcttctccgcagacttgtgaaatttggcccaattcatcgtgtcaattctgagttcttggtctattcatacataagtctggttctcgacatcgtccgattgatttatcgtctaagttgatgtcgattctcctccactttattgtcattctctataaaaggttagtatacctaatactagtgaaatattattattctaacaaacatatgcattgcaagcatcactagttctcctctattttagtaatattgacggtcgaaactgattgataacgaccgtcaacacaggttcagcacaaaataatgaaatacagtctcccggagtgagcacagaagatccggatgatgccgtcctttctcccgctccctcggcgtcctcgggatcgccacatccatctggcgctggtgcagacgctggctctgcctctgacgcctcctctgcaagcgctgccagccattcaggaggtgacagcagcccggtgcagcctggtgcagccgacagcacatcgcagggggacagcatgcagggggacagcatggcagccgatgtgcaacggcagcagtcgcaacaacagtctcgccctgtcactagtgcccagaggcattcgcaaggagaaagtttacactgatgatacactcagatataatttccttactaccagtggagaaccacatgatttagatgaagctctctctaatcataactggaaaaatgcaatggatttagaatataatgccctgatgaataataaaacttggcatttagtaccgccttgtaaaggtcacaatataattggctgtaagtgggtctatgagataaagcgtaaatctgatggaactttggatcggtataaggctcgcttagtggcaaagggatttaagcaaagatatggtattgactatgtagatacttttagtcctgttgttaaggcagctattattaggactattctatctattgctgtatctagagggtggtcctttcgccaacttgatgttcagaatgcttttcttcatggccatcttgaggaagaggtctatatggcacaacctccaggttatgaagataaacgaaaacccaaccatgtttgcaagcttgataaagcattgttgtatggtttgaaacaagcacctagagcatggtactccaggcttagtagtaagctttgtgatattggttttaagttatccaaggctgatacttcgttgttcttctatagtaaaggaggagttactgtatttgttttgatatatgttgatgatattattgtggctagttctacacagaatgctactgatgctctattaagtgatctgaagcaagactttgctctcaaggatttgggagatttgcattattttcttggtgttgacgtaaataagatacgtgatggcatattgctaacacaagaaaagtatgcttcagatttactaaaaagagcaggaatggaaaattgtaagtcttctactactcctctttctacagttgaaaaactctcagcctataatggttctgtgttaggagtaaatgatgcaacaaaatacaaaagtatagtgggtgcactttagtatttgaccttgagtaggcctgatatatcttatgctgtgaataaagtctgtcagtttttgcatactcctacagttcaacattggtggatggcagtaaaaaggattctgagatacattaagtcctctatagatcttgggttgaggattactaaatcctcttctacacttgtaagtgccttttcagatgcagattgggctggctcaatggatgacagaaggtcaactggaggattctgtcacatcctgatttttgttttaggatttataaattatttaataaattattattagaatttatattaaatgttcattaatttacaagtgaagttaaatgtgggaaataaaatttcctaaatataaagcatggatggatttaattttttattaaattctccatggttaattatactctctggaatattctcggatttttcggagctcaattattaattttaatcatacaaagagcatttcagtaattattcacatattaaattaattattaaatggtctaattataattttgttaagtacttttagtgtccaagtattttcaggatttttcttgaaattatttgagcattggaagtatttttaacaattcaaagatcatttcagtgattaatttaattggaaaagtaattaaaattcaccttttccttttcgggccgaattaggaaaagtcctctcactctcggcccagtctcctctcagcctgcagcccttttcctctctttcccgaagtcttctttgcgtccctcctttaatcagtccttggtagtagaagcccagccgaaagtctagtttgcttccctgctacagtggcatcttcaatctccagccggctggagacagagcccgagccagccgcacagtacctgtatagccgcggttttcccctccaaatccaaccttttctcttgtgttttcctaaaattagttgaggggaaatattcctcttatcctcctctatcctctcccccaagaatcggagcaaaccgttgagtatcttatccgaatcgaactcgttttcgagtttatctccaaaaccgagtttttatttcccggatcgatttcttgcgggaggagtccgatctcttcaatccaaggctataaataggaccccctagtcctcctctttcgtttgccccctctcccgtggtctcccgtgtcccgtagccttgccgccaccaccgcctagctcaccggtcgccgccggccatctccggcgaggtagcgccgccgtctccatcgtcgtcgccggtcgccgtcaccaccgttgggtgcgctgtggtgagaggaagctcggccacccttccttttccgtcgccggtcaccggagctccgccgccccgtgcaagccgagtcgccgccgccgccccttcgtcgccggccgtcgtcggtggtcgtccggtgtgttggtaagtaccgtcgcgttcgtctcgtcgttctctacgtgtagatgccctccaaaatcccggccgaccaccctagctccggcgaggttgccatccgagccggccaccattgatgacgtcatcatgacatcatcatcttctccttttccagtttttctaatagattgaatcttctgaaattcatagtaactcagtttaatatggttcaagttgcaaaagttgtataaaataaagatctacatattaaaattgtccataaattgaattaaatttatttaattttttttaaatgggctttaattagatttaatcttgtaaaattcataataaattcatttgaagtcagaatgaggccgttcaagtctcataattcatctaaaattatgatctacgtgtttgtttactttttatgtactgtttatttggtttttattagtctttttcctcgttttgtgtgttagcttgtcgtttccgtcgttgcgaaggttcgcgagtgcgccggaagtattcaggaagattaattgaagaccgattattgcaaggcaagtcacacagatcctaaacacaatcctttgagcatgttgattctatatttaaattctctatttatttcaactgtgcatttattttcgaatgtcaccgggtggtgtgaaccttttcctttgttatggccaatttgcattgaatgccctattccttgataccttgggtaataaattgattagcttgaaccttatgtattggtttggttcagctaaatgttatatatataattgcttagcaatgcttagaaacattagctcactaatgtgatgaatcatatatactacattattatttatggttatatttaatggtagctcacgatggttaatcgtgttatgataattaattgataattaaaacttgattaaaggtgggttgtgagcaaatggttttgaaagtcgtgctcatggcaattaaggaccggttcgcgagctactgttgtgagacatttaccgtaccaaccacaagccagcatgggcaacggctttaccttttgtatagcatgattcattgcggggcaccagactgtgaagcggcgagaagtccgtgggggtcgctggggagtccattgcctctggttttgagggggagattatgatccaggaacggtgcactgttttgagttgtgttgtgcaaagggtactgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgggttaagcaatgtttttcgtgattagtcccacacctctcacaataattatggatgttataactggtaataatttgcttagctcctggtttggagttagatctgtacagccggggttggttgttcaggtttggttgggcctgagcagcatgggtgtgctgttcagtgttgattaaaattgatgattaattactctactgttttatttatcttaaatctttgctaaatgctgcttttgcaaatgagcctatattatgccatcctttggtatccttgtgcacttgcatacttgctgtgtggcttgttgagtatgtcatatgctcattcttgcaataatcatcaaacctcctttgaagataaaggatccagaaggagaagacgtttggcttataccccagttgagctgcctgtgggagtggagctgaagccatcgctagaccgttaattccgctgctgttttctttcctttgtaagtatgtaacgttattattaagatggatttgtatattaaattgtcagtttgtgtacctcggctgattcctggacgaggattttatgcacaaattagttcggaaattactagtgaatttccgggcgtgacagattcactgtgtttttaggatcaaatctaatatcctggagtgctagaaagcaagccacagtatccaggtctagtacataagcagagtataaagcagttgctaatgctacagctgaggtaatgtggatacagactttgttaaaagaaattgggattcattcgcctcagtctgcctgtttgtggtgtgataatctaggtgctactttgtcagtaaatcctgtttttcatgctcgtactaaacatatagaggtggactatcattttgtcagagaaagagttgctagaaaacagttagaaattaagttcatttcatctggtgatcaagtagctgatgggtttactaagcctcttcttatacaacagtttcagaagtttagatacaatcttaacttagataaattatgattgagggggagtgttagaaaggttgttcctgttacatgcgtttgcgggtggacaaaaagctcaaaactcgtggctcggatcggcttgtagcaagctcggcttggatcgactcgaactcgtagtcttaatgagtcgagtcgagctagccttttagctcgtgagcttaacgagctaactcgtgagctgctcgtttagctcgttactataaaatatcaccaaatctttatgaacttagtgtttattgactagtgcttagtcttttatttacatcaaaactattcatatttagtaagtactatattagttagtgtttattattatgttaatacataataaaatgttaaatttgaaattattaatatgatactaataagatatagctcgttaacgagcctaacgagccagctcgcgagccgagccgagctagccttttagctcgttaacattaacgagccgagcagagctggctcattaagataacgagctcaaacgagccgagccttaacgagccgagctggctcgttatcctgcgttgttacatgtgataatgcatgagataataggatatggttggttcggttagtttgtttcagagtttgtttctttcttctatccgaatcaactgagattgatctcatctattgtaagccacgttgggggctgttcccaactcatattaacacacgtacgcggcctcgagagaggtgacaacgcttccgtattttctacaggcggagccggcgacgatcatggcgatgaagatcttggcatccgcagaggcggaggcgaggatgaagcgtcgaaggcccccgtaggtctccgatgcacgcttgcagatcggttttttttggcatgtctcatgcctgtagatcgatctgtttgcggacgtgcatgcatgcatgcatgccatcgtggtgggcgcgaggccggccggtcgcccggcccctgcatacgggccggcccgtgcgcatggcttacgcgatcagcggcatggccgaagcccgccgttctgcggcgaatcgcttgatctcgatcccccatccatacatgcccgcgtgcggcaacatcggcggcggcagcggttgcctgcgatcggcaaggcgacgcgacgacgatgttgatcatcagacctcatcgaccggcacaaacatgcaagccaaacaaccaacagattagattcataatttgtaatccaaaatcaatctagctaattaattagcaaggacaaaaagtgattctctgtagatgtgatgcatgtgttgacgatatgattcaatcagtggcgtagccaggggtagtcccggtgggctcgggactacccccgaatttggcccacgaaccctcacccccaatattttagcctagactcaagcctaaagaagcaagcccaataagaaactagaagcacaggggcatgactcatcacttcatcagtgtgcagccgtcaccatcgtcgctccgcgattcataggaatttttttcgtataaaaggattgataggattcaatccttttgtctcaaaagctttcataggatttctacttttttctccaaatcatagggtctaagtaaaagagacttaattagtaaaagccaagtgtttttatgaggctttgatgagggttcgcaaagtctccctcgtcacttagctccagtcctgctcagtgcgaggacagtgcggtgaaatactctggctagcgtaaaaatgggaaggatgcgtgttttacatgcatatgtaaaatatatttcaaacaattttggtaagtctaaaaatatatgtagtattattgttcctatatggtctttaacattatattttgattgttgatttctttcataatattataaaggacaaagaaatccacatcatgagaaaatattttaggatcaaaatataataatactacatgcataagactaagcacggatatttttagttcatttattggtcaagttttcaagtagtgctgatttttatgaacgtattatttccttcatcgtataataatttactatcgtttgtcatagatagttgacatcgtcggactttttctgaatcaaacttttataaatttgatgtcaagaaagacttgataatagggcaccctaagttcgacccatataacgcacttctcaaacaggaattaggagtggcctgctatgtatgcatgctgtagtaagatgtatttaacttctccatgtataagtgcttccttatattttatgatgatgatgccccccacctctctctctctctctctctaagaatattgagattggcaaaatagaatgtgctgtacgactacagaagtaattaagtagtactccctccgtttcgaaatgtttgacaccgttgacttttttaaacatgtttgaccgttcgtcttattaaaaaaatttaagtaattattaatttttttcctatcatttgattcattgttaaatatatttttatataggcatataattttacatatttcacaaaagtttttgaataagacgaacggtcaaacatgtgctaaaaagtcaacagagtcaaacatttcgtaacggagggagtagtatacatatatgattgccaagatacacatgcaccacgtatagctagctagctgcacaacatatatggagtatttctcataacgtacgtacacactacacgtacagtagtgaggaaccatgattgaattaagaaggtacaaattaatagtacaataggatattatatagatgatgaatgcatggtcacacaagcatttttgccgagcgggccacactaaggttgccggccggccaaattgttgttaagatagaaattaaagagtgagattacataacataggggtggtaccccatcaaattcattaatcaaagttaaggtactgcatgcgatgaagaaagatcgaaaataggaaaaagatcgagatacagctgatccaatcatgcaccaacgagacttcactgcaggggctagcatgagatgcaacttatataattaaggagctagctagcaatataagcagtatagcagtaatagatgatgcatatatggatcgatggaggggagctagtagagaccaggcttgtagttgagagcgttgggcagccactgggtgccgtggatgaagcggtcgacggtgtactcctcagctttgctagcgtcgaccacggagaagccctcccagttgacgcggcggctggtgtccgatccgggtcccgtattgttgaacttcatgtacgacacggtcttggtcgtctccaagacgtgcttgctcttgtcccactccacccagcccttcgggtgcacgatgccgtcgaggaacgactgcatgaagatgacgtgcgagtggttcttccacgggcggccgaggaatgtctcgacgcccgtcaggttctcgttgggcttggccatgatgctgcagttctggaagctgaagccggtgtcgtcgccgggcttgtcgcggccctgcgccgtgatgatgttgtgcgcaccttcccttccgcggcgcacgaggagatggcatctctggaacaccgccttggcgttgccgaagacgaagtccaccgtgcctgaaatcacgctgtcgaggtacaactgcagtccgttctcagcgtacaaggtgtcctgaaagctctccagctcgcaccggtacagtacagtgtggttggaactagagcgaagagccaacgactggttcccctccggtcccgccgtgttctgtatcgtcaggtctcgggccatgaaaccgcggcctgaggcagctgcatacagtatatatacgtacatacactgatcaaaataaaatttcatatatatatatatatatatatatatatatatatatatatatatatatatatatatatatatatatatatatatatatgtcattccttcctatacaatacaatatataaacatcagcacataacatattataatgtcatactataattcaaaataacatatttcttttagaagtattggaatatagttaatatgagtctttaactgcaaattagttataaataatccaatgtcgtaagcttataaaaattagctatttattttaaaagattatcataaactatggtttataatctaaataatatagcatgaaaacaatgaaaattgtggcaagtggatagacatattgtaagcatcatatgcatgattacataatctcggtgtacttaatttatgctccagtgcagtctagctaaacaaattatttgtagagaggttggcttcgagtacataattcctaatattaattattccaaaaaaaatgatgccttcgtacgtagttatattttaccatccaatcgtgttcttgctaggctatgtgaagctttgcacacttgcaaaaaataatcctatataggttgtctcctatatactgcgcaatagatttggactctacaagcttgtgtatttaacatagtctcgaaccatcctaatccatcaattaataaataatgagaacatactttagtcttagatgtttatacaaaaatcgattcatttttttcgaaaatggttggcatataaggtgtaacacgctgtcactattttgtcatctcacaaaatctgaacttaaagtaagatttcataaagaaaatagaaaatacaatagggagcaaagtgaactaattatagaaaaacatagaaaattcttagaaaaaagctctttgcttccacttaaactagaacacccattaccataaccattacatatttttcgagtgctccgatgcttacatgtaaatatacacgaaccaattagagggcgatgattgtataaaataacacgtctattaaacactaatagtttttaagatttgtttaaaaaataaagcccataaacaatcaattctaaaaacgaaaacacattacttttaatttacactttatttgtgaaacgagactaagccaatcttctttaaactgattaagcaaattaatggaggtaaattaaatattatataatataaagacaacaaatagtttgtaaaaaaatatttaagaaatactggtgaagaatgtttttgggcaatcatacttttccactgcagcacgaataatccagtagatatgtttttcttatagtttctaacacaacttaatatgtatgcccgcgcattccttgctagttaataaaaaatattcaagctagctaaggtacgactaattaactaattaaattaagcaaggcatatgcatgcaaattaattaaacacagttacatattctttaggtagccataagagaataatactaggactacttactaacggtagccgatgaaggcatgtcgccatgcttgagggagccacggttgccggtgatcaccgtcttgcccactccgtcgccgaacaaagtcacatcacgcctcgtgatgttgagctgctcgatgtacgtcccctccccgatacggatagtgtaggacgaccgtaccttcttcgtgctcttgggcgctgccgccaaggcagcagcgatcgtcctgtaatcgccgctgccgttcttcgccacggtcacctcgaccaccggagaacgcctgccgtgcgccgccgctgatctggcgccgccgcgcaggagacgctgcagccgcggctttgcccaaccagggagttctgcgccactagttgggaggcagcaaacaagagcagccacgacgagaagaagagccagctgcagactagtgttcttcatgcttgctcttggctcactctaactggactgaacgagttgatgtgccagcctctggttaatttccttcatatatatatctatacacacacatgcccggccggctgatagatcatgagctggagctagggcgaagctagcagtacaactccgagcctatatatagctagctagggattgaaggctcagcccaagtatttaacctaacctaattgctagatccctcctacgtactattaccctacttcccctataccttggtcggccacttgtgagttagtatatactccctccatctacttttgatagtcatatttccaaatctgaaaattttatttttgatagtcatatttcaatcaacaacccatcatcttaatgactttctcgaatttaatgcgtgactctccattctaccacacatgattggctacatgggtattgagaaatgtaaatattaatgaatcgcttgtttacgaggaataactagtagcatatttaaatgaatgataagtagaattacttatccttggtctgtgtgtcaaggtgaaatatgactatcaaaagtagatagagggagtactagtgtatcaattatcatagcgtacaatattatattataaaccagctataaacacgtatcgaaaagataaaagaagagagataagcagcgggctacaaatttatagccagctgcagtattgactccaacacacaatgtgtgtataacgagtgggaccatatattaatactgtagtatatatatatttatagataactattatatgaattgactattaaattgactatatatgatttggagctgttagttggctatactattaaacaacttgctctcagttgtgtatccgaccaaaaaatgttaaaattaagataagtggcctgtcataattgttagcctagctactgctgctgtatatcctccactatatattactctactatagctattgtatagtagtacttaattagtactagtatatataggtctcctcccaacgttcatctcgatcgatccgcatcggtcaattaatatatgtttgtgctgtagttgcatgcatgcatgcatgtacgtagggcgggtctctagctgaagtaattcttttcgccattgatccccttgatgcttggtcggtcctgcatcgatcgatcatttccatcaatatcgatcacaagcaagctaggttccattttttagtatcgatcgtctctgtcttaatagtactgaacgatcgcgagagaagaagatcgataattatggggagcaccagtcttggatgcatattatttgtacctgtattatttcgccggtgcaatgttaatttcccgctccatattatcactaccacaaaaatactcattggtgccagttataaaggcctcataggtgccggttttgggcccggctccaattggtcggtgctagatctggaaccggcacctatagctttcaacaaataaaaaaaaagaaaaataatcccggcaacccatcgccggccgtcggccacctcgcctggcgtacgcaccagccatctccaccttcgccgccatcaccagatctggaggaaaagggggtagggcggacgaagaggatgagggagggcccccagggagagagagacctgcatcgatccatcatttccatccatatcgatcacaagcaattaaggtcagattgtccatttttgagtatcgatcgtctctgtgtcttaacagtgatcgatcgagagaagaagatcgataagggagcagcagtcttggatggatattatttgtacctgtatatatatatgctgctagtacgtatacaagctagcaatagagtctgtaatgcaacacagttaatgcttgtgctatatatcagattaattaatggccatactattgtcatatatatctgcaaattaaggagcttctttttaatttcactctcaagttctcaatttgttcagtagtacgtggtctgcctatgaatatatgttcagaccggagaccatgatcacatggtgggcgctggctctgtatctaacaatatatgcaagcatgcatgcatgttctatgttccatcgtatcctcataaaccaactcgatagatctaccagagatgactcaaactcaatgctggagatcgagaccatgatagggagtgtttaatttgtatattcggtttattagtcaaacactaatttaacccaaataaaatattagtctgttggtaattttgctgattatcttataatagtttcagtgaatatttaaaaagatgaagcatatggttgaccaacgttaatcacacttgaatttatcgtttagtcactggtaaaaatatttaaaagatgaagcatggctgcatcctgtcggtcactacttcaaaaattatttttgttgacggccaaaataaaaatttatatataacgtatatagaaatcgcagtgtagttacactgtagttacaatacaactatagtgtaattacattatacttgcgctacaactatactatagcacatccacacaagtaatatacatcacaaattgacacaactttgagtaataaactacaaatccacataagcaaccgtgagtataacctaatctgaaatttggcaatgaaaatttgcagaacctacaagagttggaaatggc

SEQ ID NO: 33427 - DNA, 900 bp, Oryza sativa
gtggtggctggatccacaccctgtaggctagatccggcggccggcggtcgaaaggtggggaaggcggtgctggccggcggtcgggagacggaggaggaagcgaccggtggtggggggagaggctgcgatggccggatccgcgccccgttggccagattcggcggccggcggtcgggaggcggaggaggaagcggccggcggtggccgctactcgcgcgtggagtcggaggccgccgccggacttggtgctcggcgcgtggatgctcattgacgggagaaagaaagaaaaatgagagagagagagagggatggataaggtaaaagaaaaaacgagagatgagtggtctcggaccgtcggtgggagatagataaggattgggttgggtggtttctacctgtgaagaacaaaaaaaggacctgttagagatggattgggttggatctgtgtaacacactgaaaattcgaccaacaaaatcaaaaaactctaaaaatacggaccttcaaaaactttttaaataaattacatcatgccggttttattcgcctttttcattggattttgatttcgtagtttattaatcgcgaataaagaataagtaattaggaataaaccctaaaattcatttggctaaataaataattgaaaaacaatttaaaataaagattaggtgaggaaagaaataaataaaatattatcgcgaccatattggtaacaatcaaatttaagtgcgatggaataagaattagccctaattaaaaattcaaataaattatataaaaataaaatatgggtaatattaatctagggtgaatacattggttagaataacagagtaaacttcatttatgcaaaaataaggatttatagaataaaatatatataggaaataggctaaaat

SEQ ID NO: 33428 - DNA, 640 bp, Oryza sativa
  unsure (1)..(640): unsure at all n locations
nnnnnnnnnnnnnnnnnnnnnnnnnnnnnnnnnnnnnnctacatacgccaagacaagccgccggatatcgacatcagagatatgcctggattggccctatccggtacctacagaagtcggccgtaggaatctagcgctatcgctgatttcgacgggcgcgagctcgaggaggaaggctaccctgttgtcgactacgagtcagaccttcagaccgccatgtcgacaacagttagataggctaccccacatattgtactggtgtgattatggtgaataagagcaataccggctccggccaacaggatgtagggttattacctaacaattcaggggcccgaacctgtataaaaatcctcgtctccatctcttttacctcagtctcgcgtgtattctagcaccgacgatccccatactatacaaataccagaattgcgacatcaaacgtctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33429 - DNA, 1005 bp, Oryza sativa
  unsure (1)..(1005): unsure at all n locations
nnnnnnnnnnnnnnnnnnnnnnnnnnnnnnnnnnnnnnnaatcgtcgggaaaggtccccacatcgcgtccacctcatcggaagtcatcatgcatgccggaaaagagtttccccaagcacattagcaagcccatcttcgacaaggccggagatcgctgcccagcgccaccaacgtcgacataatcgcctctcctctccggaccaaggaagctgccgcctcgtccttaactccttcacggccggccggggcctccgccgcggcggttgtcaccggtgccatgcatctactccaccgttgcgtcgaccatgccaagacagccaaattaaagcctgtccgcagaaggaggtgccgaatcactggtggagaaatatatatgtgcatatatatgttaccaaaatatatattaacactaaagtaaatgtacgcacatatataaatatatatatatatatatatacatgtatagtacaattcattttcttgctagctatagctacgacttcgacgccggcgttatgtcagaaaaggaaggaccgacgttatgaattgtcgatccgtcgtagtagaatttaccatcgggattaaagacttcttcattgatgaatcccatcagttgttcttgaacaaccgtgataaaatccttgtgtgggagattatccctcatgtgaatacgctatcattcgaaaaataatgacatatcaatatatgaaattaataaacaacttaacaaatcgatacgcaatgaaattttgaatggtttatgtatacgtacatcgagctctcgtgtggtgtatatttggtttgataggcagtgggcatactcgcatacgtagtagtcgcataagttagttccctggtcctgctttgcatactacatgagaaacgatgagagatttaatataatctttatatttaactgtaattagagatttaattcaatacaattttggatcatgcatatattcaccggaaaatgaaacctccatccaagtttttctttccaag

SEQ ID NO: 33430 - DNA, 640 bp, Oryza sativa
  unsure (1)..(640): unsure at all n locations
nnnnnnnnnnnnnnnnnnnnnnnnnnnnnnnnnnnnnntcatccggatcttctgtgctcactccgggagactgtatttcattattttgtgctgaacctgtgttgacggtcgttatcaatcagtttcgaccgtcaatattactaaaatagaggagaactagtgatgcttgcaatgcatatgtttgttagaataataatatttcactagtattaggtatactaaccttttatagagaatgacaataaagtggaggagaatcgacatcaacttagacgataaatcaatcggacgatgtcgagaaccagacttatgtatgaatagaccaagaactcagaattgacacgatgaattgggccaaatttcacaagtctgcggagaagagaagtccaggatgccagcagccaaattgtgggctggttgggccggccccaggttcggccgaacccatctctccattgttggatgtggggtttggcagggacgctccagatcttctcctgatggcgggtgcggggtacttcggacaattcccctttcacaaccgtcataactacctctatataaggagctcactctcttcacttcaacacacacctcaagcaataactctctcaattctcttaaggttaagttagtagta

SEQ ID NO: 33431 - DNA, 597 bp, Oryza sativa
  unsure (1)..(597): unsure at all n locations
nnnnnnnnnnnnnnnnnnnnnnnnnnnnnnnnnnnnnnnnnnnnnnnnnnnnnncaacgcgcatagccccagttgagttttgaagtaaacacgacgccgagttttatgcatgcgacgcgactcgccgccggtcacgaacttacgatggcgtccaccgccgccggcgacgacttccgggattggtccgggctgccggaggacctcctgctcaccgccatggaggcgatgcaactccccgacctagtccactccggcgccgtctgcagatcgtggcactcggcgttcgccacgttccgccgcctcgggctccggtcgccgccgcacccgccctgcctgctgtacgccgccgccgccgccgacgacaatgccgtccgcctatactcgccgtcgtccaccggcgcccacttccgcgtgcccctcctcgacgaggaggcggccagcggcgtcgtcggttcggcgcacgggtggctgttcacaagcgacagggacgccaacccttaccttcttaacccgtttaccggggcccgggccgcgcttccgccggccacggtgctcgggcgcgtcaggggcaggaggttcggtttctccccccgcgac

SEQ ID NO: 33432 - DNA, 659 bp, Oryza sativa
  unsure (1)..(659): unsure at all n locations
nnnnnnnnnnnnnnnnnnnnnnnnnnnnnnnnnnnnnnnnnnnnnnnnnnnnnnnnnnnnnnnncgaggccgtggcgtacagcaccaccgtccaagtcgccgtgaagcccgagcgacgggaacaccaaacgtcatcgagccatctactgttgcatccatctactcaattgagagaagcacatggtgcacaggtgacaggagaatcaagcgtcaagacaccaagcaatccgcatcgatcatcttcgccaagctcctatgaacggccgcgacgcaagccacaactgcttcctcctctacatcagccatacatttgtcttctccgacacaacatcgccgatggtcttcatcaacataggaacaagcgcgccgccgccgactcgtccacatagatggacacctcgcgtcctctgacagattaatctgcaagacgcttcatcgacgacatcgaccgcgtcctctacgacggcaacgaccgcgtcaccgatgacggcatcgatcacgtcatctacaacgacaacgactgcatcaactcggcatcattattgtgatgaccgcttcacggcgcagaaggaccaactgaagtggtggcctcatcgccaacgacgtcctctgacatatgcaagacgttcccaatggcattctctcatcctctgacatct

SEQ ID NO: 33433 - DNA, 638 bp, Oryza sativa
  unsure (1)..(638): unsure at all n locations
nnnnnnnnnnnnnnnnnnnnnnnnnnnnnnnnnnnnnnatctatataatatcctattgtactattaatttgtaccttcttaattcaatcatggttcctcactactgtacgtgtagtgtgtacgtacgttatgagaaatactccatatatgttgtgcagctagctagctatacgtggtgcatgtgtatcttggcaatcatatatgtatactactccctccgttacgaaatgtttgactctgttgactttttagcacatgtttgaccgttcgtcttattcaaaaacttttgtgaaatatgtaaaattatatgcctatataaaaatatatttaacaatgaatcaaatgataggaaaaaaattaataattacttaaatttttttaataagacgaacggtcaaacatgtttaaaaaagtcaacggtgtcaaacatttcgaaacggagggagtactacttaattacttctgtagtcgtacagcacattctattttgccaatctcaatattcttagagagagagagagagagaggttgggggcatcatcatcataaaatataaggaagcacttatacatggagagttaaatacatcttactacagcatgcatacatagcaggccactccctattnctgtttgaga

SEQ ID NO: 33434 - DNA, 633 bp, Oryza sativa
  unsure (1)..(633): unsure at all n locations
nnnnnnnnnnnnnnnnnnnnnnnnnnnnnnnnnnnnnntggccatgaaagtggtatgatctgcagggcctgggccggctgatggatttgcttggcgtggaattgacacgctctgcatcgccggaccaggtcgaccgcatcattgagagctgtcggccaatagaaaccttgtcgaaaggctttgccaaccaaggtgcgcgaggcggagtgggctccgcattcgccttcatggatatcggcaagaagctcgacgccttgttcccgaggaatgctcttcaggaggattccgttagccgcgcgccgatagagggtcccttctaccagcacgtaacgtttggagatgcgctggacgcattcactcccttcgcggtcctcgggtagagtcttatctgtgaggtatgcttggatctcagcgatccaagcaatcaatctaagggagctaggagcgctcccctcgggtcccgaggcctggactccgacgggcatcgggggcctgtcaggcgcgtccgtctcccctaaggggtcgggtcgcgccgacagtgggcaagcctttttcaaaggcgccccgtggggtctgggctcgcgaggaagcgagccgtgagaagtcgtcgcaaaccgtgtatcccgtctgggc

SEQ ID NO: 33435 - DNA, 1192 bp, Oryza sativa
tcagtttgatgggcaaccccctttcacagtgacgattgaccctagcatcctcctatcaaatgaagacaccccttactcacgtagcgatcacaaggaaggaacaatagtgaggagaatgtacgtgcggtcagaaagtacgtgcggtcaaccgtcaccgccgatgtattgccgtaattgttgtgtacacgatgaaaactatttttggtgtattgaatatccatacaaatcaattgttgtatggcatatgttaattatgtatgattattagaatttttatcaaattgaaatcatccatatgctagttatatatgattattataatttttaaaagttttaaatcatgcgcatggtatttacatatgttaattagaattttcaacaatttattatcatgatatgctaattatatatgattattagaatttttattaatattaaatcatgcatgtggtatttacatatgttaattagaattttcaacaatctaatatgatcatatgctaaatatatatgattattagaatttttattaattttaaatcatgcatgtggtatttacatatgttaattagaattttcaacaatttgatatcatcatatgctaattatatatgattattataatttttattaattttaaatcatgcatgcggtatttacatatgttaattagaattttcaacaatttaatatcatcatatgctaattatatatgattattagaatttttattaattttaaatcatgcatgtggtatttacatatgttaattagaattttcaacaatttaatatcatcatatgctaattatatatgattattagaatttttcttaatattaaatcatgcatgtggtatgaacatatgttaattactttttttaacaatttaatatcattcatatgctaattatatatgattattagaatttttattaattttaaatcatatatttgcttattacgttttatccacttaatttactacagacaacaataatttttcgaagtaattgtcattaatttttcgactttaaataattttaattcagtgcgtttatcagtagtcccggttcttaaccctaaccaggtttaaaaagaatttagaaatagcgggaaaatatctttagtcccggttggtaagaacaaccgggagtgttcttacgaaccgggactaaagacccaggggtata

SEQ ID NO: 33436 - DNA, 570 bp, Oryza sativa
  unsure (1)..(570): unsure at all n locations
nnnnnnnnnnnnnnnnnnnnnnnnnnnnnnnnnnnnnnnnnnnnnnnnnnnnnnnnnnnnnnnntcatcaattctgggcaacggatatttgttcttgattgtgacctcattaagggcgcgataatcaacacacatcctcttggtcttgtctttcttctccacaaagataaccggagcaccccaaggtgaagtactcggtcggatgtaccctttctgcagctgttcgtcaacctgcttcttgacctctgctagctcattagctgccattctgtacggcctcttgtaaattggagcagtcccgggtgccagatcaattcggaactcgatttctctcttcggtggcattgtagtgaggtctttaggaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33437 - DNA, 836 bp, Oryza sativa
  unsure (1)..(836): unsure at all n locations
nnnnnnnnnnnnnnnnnnnnnnnnnnnnnnnnnnnnnncatcttcttccatttcaaccccttgctctccgtgggatgtccagcagttatagcttggcatgaaccccgactcaaacaagtggaaatgaatagtcctggatgcagaatattcctactgattcttacacttattgcatggacaacaaataaaacctttatgcctgttagcttcgcccactctcaaaaaataatgcacgccgtcaataaactctttgaaccaccggtcagcgtacatccattgccgatccatctacatgaaatgaaaaaaaatcgtacacaaataattattcgtacaataatgatagttatacaataatgataaaataattacaaactctttcaacactcgtacagtaatgacatatcattattcatacaaaaattataaaatattacaccaaataattcttatttactatttctaaagttttaaactaatattaatgtgttgtacttcttttagttttcattttagtttgttttaagaataatttcactaaatttctatatattctttcttccccacacaaattttctctctcatcacacaacaaaattttggagacaaaaaagtgtgcaaaacatagctccaaatgtaatatgaaaaaaaaaacattggaggatgaagttgctaaccttttacgcacctccgatttgtatataatcaccaaaataaattcactagaaattttggcatgaccttccctcttttttgaagaaattttaaagcttgctcgggctggaggaggaaaaagacatatatatatatataggggtgggactttaatcccggttggt

SEQ ID NO: 33438 - DNA, 650 bp, Oryza sativa
acttggcttgggtcaaaccaatggcaattgaagagcacaagtgtgagaggtttggtgccatcaaagctgatttctattatttctttaatgtaaccacagtactcagtcatttcaccactttctccatgtcctatagtcatttctattattttaaccccgtgcctggaggttgaagcttttaccatatgtaatatgtcattccataggaatttcataggatttggaaagcttcaatcatttgaatcaaagggccaaatagaaaaattttctatagaatttgaatcctatgaaattcctatataaatcttttgattcaaatgagctcttaatatgagtaggacggaagagcactggaattatcattaattcagtgatactagctaccttcgccgtcctaaaaattttagttactccaaaataatacaaaatcaataagactacaataccccactttatcaaatcctaatgtaattatttttcactgaacacgcttctaatgcatttactttccaatttcattaactccgattcaataattgtttaaaaataattttctttttggacaaactgacttagtaaaaattgatcttattgtgagatgggggagtatttcgtggtctacacaatcatggatcatgttgtcttcctgt

SEQ ID NO: 33439 - DNA, 364 bp, Oryza sativa
  unsure (1)..(364): unsure at all n locations
ggcgaattcgagctcggtacccttatttctcttccgtctgagagcaaaaacagcttggaaagctatctatcccctctcttcctccacttgttttctggattcacgtactggttggctgtgttcggatgcctcttttcccaacctctcttccttgttttctacgcacatatttttcccaacccctctcccttgttttccacgcacatgtttttcaaactgctaaacggtgtattttttacaaaaagtttctatacagaagttgtttaaaaaaaattaaataaatctatttttttaaaaaataacaaatnnnnnnnnnnnnnnnnnnnnnnnnnnnnnnnnnnnnnnnnnnnnnnnnnnnnnnnnn

SEQ ID NO: 33440 - DNA, 667 bp, Oryza sativa
  unsure (1)..(667): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtcgagttacgactactgcctggtcctcgaccagcgatgtagcgtttctcccactattttcacttcaagtggtcgagttacgactactgcctggtcctcgaccagcgatgtagcgtctctcccactacttccactttaagtgatcgagttacgactactgcctggtcctcaaccagcgatgtagcgtttctcccactatttccactttaagttgtcgagttacgactactacctggtcctcgactagcggcgtagcaatccttccactacctctacttcaacaaagttgatatcaggtacacgagatcgccaagtggggtaccgagctcgaattcgcc

SEQ ID NO: 33441 - DNA, 675 bp, Oryza sativa
  unsure (1)..(675): unsure at all n locations
nnnnnnnnnnnnnnnnnnnnnnnnnnnnnnnnnnnnnnnnnnnnnnnnnnnnnnnnccgccgcctcccccccacactttcggcgcactcgcgaaccttcgcaacgacggaaacgacaagctaacacacaaaacgaggaaaaagactaataaaaaccaaataaacagtacataaaaagtaaacaaacacgtagatcataattttagatgaattatgagacttgaacggcctcattctgacttcaaatgaatttattatgaattttacaagattaaatctaattaaagcccatttaaaaaaaattaaataaatttaattcaatttatggacaattttaatatgtagatctttattttatacaacttttgcaacttgaaccatattaaactgagttactatgaatttcagaagattcaatctattagaaaaactggaaaaggagaagatgatgatgtcatgatgacgtcatcaatggtggccggctcggatggcaacctcgccggagctagggtggtcggccgggattttggagggcatctacacgtagagaacgacgagacgaacgcgacggtacttaccaacacaccggacgaccaccgacgacgggcggcgacgaaagggcggcggcggcgactcggcttgcacggggcggcggagcttcggtgaccggcgaccg

SEQ ID NO: 33442 - DNA, 1095 bp, Oryza sativa
  unsure (1)..(1095): unsure at all n locations
nnnnnnnnnnnnnnnnnnnnnnnnnnnnnnnnnnnnnntttttgtctccaaaattttgttgtgtgatgagagagaaaatttgtgtggggaagaaagaatatatagaaatttagtgaaattattcttaaaacaaactaaaatgaaaactaaaagaagtacaacacattaatattagtttaaaactttagaaatagtaaataagaattatttggtgtaatattttataatttttgtatgaataatgatatgtcattactgtacgagtgttgaaagagtttgtaattattttatcattattgtataactatcattattgtacgaataattatttgtgtacgattttttttcatttcatgtagatggatcggcaatggatgtacgctgaccggtggttcaaagagtttattgacggcgtgcattattttttgagagtgggcgaagctaacaggcataaaggttttatttgttgtccatgcaataagtgtaagaatcagtaggaatattctgcatccaggactattcatttccacttgtttgagtcggggttcatgccaagctataactgctggacatcccacggagagcaaggggttgaaatggaagaagatgaagtggaagacgacaatattccggactttactcagtacgctggatttgaaggaaatcaaacgagcgaggacgaaagggatgctgatggtaacgatgttgcggatgatcttagtcagatgttgcaggacgtcaaggaggactgcgaaagtgaaaagggggcccataaattggacaagatgttagaggaccacagaacgtcattgtacccaggttgcgagtaggggcacaaaaagttggataccactctagagttcttgcaatggaaggtaaaaattggtgttagtgacaaggcatttggtgatttattgaaactcgtcaagaaaattcttccggagggaaacaaattgcccgagactacgtacgaggttaagaagatagtttgccctctaggactggaagttcagaagattcacgcatgtccaaatgattgtatcctatatcgtggtgaggagtacgagaacctagaatcatgccctgtatgaaaag

SEQ ID NO: 33443 - DNA, 600 bp, Oryza sativa
gtggggaagattgctacgtactggttcgagaaccagcgagcgagtagaatcatctctcgatcaccaatgaaggttgcggtgcgggagattgctacgtactggttcgagaaccagcgagtgagtagaatcatctctcgaacaccaatggagtttgcggtgcggcagattgctacgtactggttcgagaaccagcgagcgagtagaaacatctcttcgaacaccaatggaagttgcggtgtgagagattgctacgtactggttcgagaaccagcgagctcttcgaacaccaatggaagttgcggtgtgagagatggctacgtactggttcgaggaccagcgaatgaacgtttagaattatctctcgaacaccaatgggggtgctagagttggtttattacatgtgcgtctcatgtggccaacatgactcacgcacccaacttatagcatatccggatgtccgttcgcaatcatgtcgggagatcaagccgacgacgttcgcgagaattgtccgttaacgaccttttctcgagtagtccagccatggccggtgctatgagataggtcgtcggtcttcgttggtaggttgggcgcgacgactct

SEQ ID NO: 33444 - DNA, 527 bp, Oryza sativa
aaaatcattaagttaaggtagatacacatcttgtcatatgatcaaatggtttcgccaaaaatcaataatcagacaacaaaatgtgcgaactcgatattttacacgactctctttaccaattctgccccgaattacacttaaaacgactcaacagcttaacgttggcttgccacgccttacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacggcttatggtattgcgagcttcagtcgcactacacggtcgttctgttactctttatgagaaagcgttcccgctttcagagcaatgttcaaagaaagctcatgaccaatttctagccgaccttgcgagcatt

SEQ ID NO: 33445 - DNA, 1117 bp, Oryza sativa
  unsure (1)..(1117): unsure at all n locations
gtctggcgggcctgcgatccctggggctcataggggccatggtgtacggcgactaccttcgtcgccggattgcgccgctccagcggcgcgtccggggcgcctgggagtacaccggatccgaagactacatgaggacccaccagggagtcagatgggactgggctcctgaggacttcaagatagtggtccaacgggtgctgaatctcagctccgtggaggcatccctcattcctcaaggagtcctccccctctgcagcgatccagaccgcgcctccatcctgaccatcatgcaggcggtcggggcatcggaggagcgggctcctcgaggccacgatggcgcgggcgggagccgcaggggggaacgatctaccccgggagggggtcgtgcttctgggccccgcgacgggggcccggggagcggccgccctgccgacgcccgggggaagaggaagcaggaaggaacccctcccccatctcctccccgagggggcggggcggcgcgtaccagcagcaggcgcccggagggggccacgccgacgtcgcagcccgagggggagcggaagaagaaacggctccgcaagatgggggggacagaaccatcccggggaaaccttatttcccctccaaggtggtcgtttaaccgtccccctcgcaggttcgtcccacgcccatcgtggccgtattcattccctcaacgcgagttttcactcatccatcttgtttgtcttctggtctttcttctgtttcagcgagatctcgtcgcgtccctcctgccattccaagtccggccagtctgaggccgaggacccggcgaccacagaggctcggaggcgggaatctgaccggcgagaagccgcggatcgcctacgggaagccgaggaggccgcccaggtggccgtccgagctcgccaagctgaagaagccgctcgggaggaggccagacttcgccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33446 - DNA, 427 bp, Oryza sativa
  unsure (1)..(427): unsure at all n locations
tgttgttaaggcagctattattaggactattctatctattgctgtatctagagggtggtccttttcgccaacttgatgttcagaatgcttttcttcatggccatcttgaggaagaggtctatatggcacaacctccaggttatgaagataaacgaaaacccaaccatgtttgcaagcttgataaagcattgttgtatggtttgaaacaagcacctagagcatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33447 - DNA, 641 bp, Oryza sativa
  unsure (1)..(641): unsure at all n locations
accctatatttacatcacttgcctgcgcgaattccttcaagggctagctaccactccggcttgagggacgacgacaacaacttcttttctgcaacatacaaaaaaatgtattaggctaaacgcaaagtaacatatactgtattttacgttcgcgttctcgtgaagtttacgtttcgttcacctacgttcgttcgtttacgttaacgtacattaagttcatgttcgcgttctcgttaagttcacgtttcgttcacgcacattcgttcgtttacgttcgttcacgttaacgtacgttaagttcacgtatcgttcacgtacgttcgttcgttcacgttaacgtacgttaagttcacgtttcgttcacgttcgttcttgttcacgttaagttcacgttcgttcacgttcgcgttcacgttcacgtacgttcattcgttcacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33448 - DNA, 642 bp, Oryza sativa
  unsure (1)..(642): unsure at all n locations
nnnnnnnnnnnnnnnnnnnnnnnnnnnnnnnnnnnnnnnnnnnnnnnnnnnnnnagccatgttcccacgtctcgcctgcttccggcggaagtggaggtgggtgtgggcggtcccgtcagaaggtcattcggacggcaaccatacaagtctccgtctgtttatgaataaaataggataagtccccacaaaaaagagagagatggtgcatgtggtatccccttgaggtataaaaggaggaccttgcccacttagaaaggggattgaaggggggaaaaacaatcccagaacgatcgggggctggctcgcgctttgtagcttcttcatacacagatccaccaaaacacaggagtagggtattatgcttctcagcggcccgaacctgtatacatcgaccgtgtcttgtgtgatttcactctcgcgaactttccacaaaccaagagcttagaacctcacccagggcccccggccgaaccggcaaaggggggcctgcgcggtctcccggtgaggagccccacgctccgtcagctacccttctcttcttcttgtagctgtcccatctcctttctccttctagtgccggcttgacaccaatactacccccaatctttcgctcaccgtttcaggcgtgaacttccagtgagg

SEQ ID NO: 33449 - DNA, 1531 bp, Oryza sativa
aacttggattgatccatgacaagccattcgataggaccacaatgcttcagccaaccttgtatgccattgtcgagggaaatctaaaatcttcctattgatcagtttaatcaaactcttgttagacgcttcggcttgtccattggcttgtgcataatatggtgaagaattcaacaatttgatacccatgctatcggcaaactgaacaaactcgtcagacacaaagacagacccctgattggttgtaatagtctgaggaatcccaaatcggtagataatatgttccttaacgaattgtatggcatctccagaatcaactttcttcaaaggaattgcctccacccacttggtaaagtaatcggttgccaccaatataaacttgtgtcccttgctcgagggtggattaaccataccaatcatatcaattccctaacctctaaatggccaaggcttgatgatagggttcatagccgatgctggcgctctttgaattgctccaaacttcttacaatcttgacaccccttgtaatatctgaaacaatcctctagcatcgtcggccaaaaatatcctgcgcgccgaagcaaccactttatcttgtgagccgattgatgaataccacaaataccttcatgaacctcacccatcacaaccttagcttgatcggcactcaaacatttaagcaacaccccatctattgtgcgataatataactcatcatccaataaggtgtacttcaaagccttgtgacacaaccttcgtgaagccgattgagatggattatgcaaatattgatacacatcatatctctaatcatcggctatgatcgcagctatctccacctcgacgtcctttaacatcggcttgtatcctgatgcccctgagccaaatcatttgcttcaacattttgctcccgagacacatgttttagagttaccaaccgaaaactattcatcaattctcggcacttctcattatagattatcaatgtatcatttttgcactcatattctcctgccaactgactgatcaccatcaataaatcacccataatttcaattgcatcggcttcaacttccttgagcaactgcaagcctttgagaactgcttcatattcagcttgattgttagttgcataaggcttaatagtataggcaaactcgaaacttggcccccgaggagaaattataactaagccgataccacaatcatgagtgcacactgatccatcgaaaaataaagtccaagccacaatttcgactgagccgattgagtcatcacgatgatccacaataaaatcggctatagcttgtcccttaatcgccttcggtgactcataccgaagatcaaattccattaaagcaaatatccactttccaacccttcctttcaaaattggagccgacagcatgtacttaaccacatcggctttacatatcacagtgcattcattggacaatagataatgccttaactttgtgcaagagaaatacaaacacaaacacaacttctccataggagaatgccttgtttctg

SEQ ID NO: 33450 - DNA, 2203 bp, Oryza sativa
tcaactcctgtaacttctttttgtcctccggaagtttaatctttttaattgcattaatactcctttgagttacctcaatccccctctcatgaacaaaaaatcccaaaaattggctagctgacacgccaaaagcacactttgttgggttcatcttcaagctatattttctagttctctcaaaaatcttcctcaaatcagctatgtgattttctatttcatttgacttaatgaccacatcatcaatataaacttcaaccaaccagctgatcagatcgtggaatatgtagttcatggccctctgatatgttgctccagcgctcttcaagccgaaagtcatcacaacccactcgaacaagccgattgcaccgagacacctgaaagcggtcttgtgaatgtcttcctctgccatgaaaatttgattataaccttcattaccatccataaaactgataatcttgtgccctgaagcagcataaactaattgatcagcaaccggcatttggtactcgttcttaggggtagccttattcaaactccgaaaatctatgcacaccctaagcttgccgttcttcttgatgactggcactatgtttgaaacccactcggcgtatcggcatggtctgataaagccagcatcgtataatctagttacctcagccttgatagcatcatacatatcggccttacatctccttggaggttgctagtgcggtttgaatcctggcttgataggtagccgatgttcaataatcgatcggcttagtcctggcatctcataatactcccaagcaaagcaatctctatattccttcaatagctctattaacttggctctgaactctgccgataaattcttactgataaatgttggccttggcctatcccctggaccaatatcaacttcttccaaatcatcagccgacatgaaaacttgtccttgcttgtcatcgagatcatctaccgtgtccttggtgtagacgtttgaaccctccacgacgcactcaaaataataatttggggtctccatcttcaattggctgtatatcacaatcgaacacttttagaaaatatccatcccaaacttttacagacaggcaatcaatcccatccatctcccaaagagttaaatcggcactagcaacattaactgacctgtcggctggtacgatctcaatcttgtcatcttgccattgaatcaagcactgatgcatggttgaaggaatacaacaattagcatgaatccaatcccttccaagcaacaggctgtaagaacctttcccatcgatgacaaaaaagattgcaggaacaatcatgctgccaactgttagttctacgttcagaactcctttggtctccgatggattgccaccaaagtctttgagaaccatgtttgttttgatgagatcatctgaatttctgcccaactttctgaatgtagcatctggcatcaaattcacagcagccccaccctcaaccattatcttggacatcggctttccattgacataaccattaatatacaaaggcttgagatgccgattctccgtcccttctggcttctcaaaaacttcctgttctggcgacaaaaccaatctagtagaggcttcctcaacttcatcaacattggcttgtttggcttcgtattccgtaggtaacagaaacaccatgtttaccgatgcagttacaacactttgtcctttggccaacctttttgctttgtcggcttcaacttcatcggccattgcaaccttgctcttaacgcgccattcttgcttaggcttcgctttcttcagccgatggttgatttcttgctccacttcctgaaacgctccctgttccccattcgttgaaccctccttttctgattcttcataaaaataccagaagggcaccattgtgttgctctatcttcatcctcactttgatagtattctcgattgaccgggcccaacctttgatgaacgggaaccctcttccgactcagccgattacctctgttgtatgaccggcttgaacttcctgtgtcattactacatccagggcaatcttcgatcgatggcagtctcatcccctcattccagtaaaacctgaaaaactcacaaccccaatgaggatcgaaaccatcaccttcttgctcgtagtacctctcctgctgcttatcatgcctcctttgatatttattgataatcttggtcgaattcaa

SEQ ID NO: 33451 - DNA, 6872 bp, Oryza sativa
tgatttcttgctccacttcctggaaacgctccctgttccccattcgttgaaccctccttttctgattcttcataaaaataccagaagggcaccattgtgttgctctatcttcatcctcactttgatagtattctcgattgaccgggcccaacctttgatgaacgggaaccctcttccgactcagccgattacctctgttgtatgaccggcttgaacttctgtgtcattactacatccagggcaatcttcgatcgatggcagtctcatcccctcattccagtaaaacctgaaaaactcacaaccccaatgaggatcgaaaccatcaccttcttgctcgtagtacctctcctgctgcttatcatgcctcctttgatatttattgataatcttggtcgaattcaactgagagccttgagttttccctccattggctgatcttcctgctgtatgtaccatgttgacgggaaaaggattaccatcaactttcatcggcttcttggagtcatcaaatttgatctttcctccctcaatagccgcttggatctgctgcctaaagaccttgcaatcattggtggaatgggaaccagaattgtgccatttgcaatacttcctttttcccagctcctcagccgatggtattatgtgactggcaggaagctgtatctgtttctcccgaagtaaaaaatcaaaaattctatcggctttagtaatatcaaagtcatacctttcttcttttccagaattcttcacccattggcacggtataacattgcttcttacccactcagctgctgctacttcggaatcatcctcctcatcggaatcacatatataaggacacacgtgattgatctttttgaaattcttcttagcctccgcgaacctttgttcatgcaaggtcaccttctgtgcatgatgagacaaactttcaaattcctgagacaaaaacttctccttgatcggagctatcaagccctggaacgcgagatcggctaactaagagtctgtcaaagacaaactataacacttgttcctcatatctctgaacctctggatctaatcttgcacggtttcatcatgcctctgcctaaccgctgtcaaatcggagagtttcatctcatgagttccgttatagaagtagctatgaaattgtttctccaaatcaacccaaccttgaacagaattgtaaggcaatgaagaaaaccatgtaaatgctgaaccagacaaagacaaaggaaacaagcgaacttttaaagcatcaacaaccgatgccaagagtcggctgacatgctcataggtcgaggcaatgtcttgtcttgagaattttgaaaaatttggaaccttgtatcggttaggcaatggaactctctcaaaccacacagtgtaaggatgccgatacaaatttccagtatcttttggcttaagtgcaaactgctccctcatcacatctgcaatcatatcagcccattgtctctgctgaggtgccccttgcacttgctgctgtattgattcaaactgattgaactgaggagcatactgagactgaggtgatcctccttgctgatactggacatgaggcgaaggaggctggtattgataattcaaattacccccttgatagttctggaaattcggctgaatattacgcaccaagtgctcagggataacttgggctgcaaccgactgatctggttgtacagatgcacgagatgttcaggaaagacttgagtcacattttgatgtttgccgactatcgggtgtcctaaatccagtcggcatctgttgcaccgtctgttgccaaatcggttggattctcagctgccttggcggcgtctgctgaactggtccaccagtcggctgagttggcaaaaacaatgaagcaatttgctcctgggacagccgattgatattctgaccaggatgttgcgtttgctctcgggacaagagacgaggattattaactgtctgcctttgtgccgatgatggtgcagctggtgttggagtcgaagctgctgccatcggctgaacttgtggtgcattgggagtactgtgttgattacttgtcgccaagctcctgtagtttgggaaaacaccccctggcaaaaagactggccctgtggtctggtgttcagctattgtaccatcaatcacagacttaattatattggttaatgtattgacaggcactccggactggttaatcaaggcatgttgtacggcgtaatcaacttggtcttggaaattcatgcgcctaggaggttcttcctgtacttcagtgccatcttcaccaagatcttcaattgcaccatcctgaaggccgtcacctttatcgcctgaagcatcttcagcacctttaccaccttgagatgagcttgttccgacctcatcagtagcaacgacctttactttgtgtttttgaacaacttttccctgtcgggttgctgcgaacgacctcatgaactgctcctgagcgttcttcatcattagctcaaactcgttcttttgttctggtgataacttgtctatggtgactggaacaatgtttccttcattaagtacggacctagtaggttttggaatccttgtttgaggagggaccacaggctttcctgccgatgatggtgactgtggtggtttttcagccatgaggaaatgttgttgaaactcggtcccaccaggcgtgccaaaagcgtgttgatgtgaaaaacacacactggcctggaagatctgctaaacttcagtgcgggtccaaaagcttgcctttaggttcatgagcatgccagttgatttgatcctgcaatcaacaagaaataaagacaaaagaaaccgcggttaaatccataaacgatagccgatcggccagcagacgatgacatatcatttattctcgagccgatgtcatatgtgaatcgatcggcaattataagtaagcaaaataagactaaatccactcgatcggctatagatattaacgctatataatccttttatcgatgtatatttaaaccaagtgattgggatagatcggtcgccatgctgagacagtataaatcacttagatcgaagtatacattaacatgaagattataaactcttatagcatagctgatcagatagatctagcatgtatcagctaatactccgataccactctacgttaagatattaaaacatatagaatatatcaaatagaagcctaatatactttattgcaataagatcttaatataaagggcggatttagcatatcaattaagcatgtaagtcataagactaaatcaggtaagatcggctgaaaccccgatactatctctctagatgatcataaaaccagccagatatcataattataaatactactcaataaatcgaactcaaccgatgcaacattaagcataaagacaactatgagatctaagcaagatgatgaaaatctacaaaagatggtagatacacgacacaatctagattaataacaaaacataactctaccgattacttcctaacaataagaaccagccgctaacaagttatatagggcaactaacatagattgtaccacgtatatgataactcgacggattacataaacagggttaaagtgtcataaagatggaagcattaaccccgagaacgcaagccaccataacaagctttacctctagttgaagatcgaatcgatgcagctcaatcgaaagcaagaactcgtcgaaataaacgaaagtaaaatggtggcgatgcgccgagattgtattgaacgattgttaattgattacatgggttcgggtcatatttatacccaaaatacaagatatgtccttgccagacatgacgcttatttctaacaaactctaagataccataagtctttgcggcagactcttgcccaaacatttctctaaggaaattacataaaatatcctaattaatagatacaattgcctatctgagagccctatctccatcgcggcaatcttcgggaagcatcttgattgattctagaaacgtctttgaaaccgccattatcagaatcggctgcatcatcttcatcggctgtatcagttatcctctgtccgatccatctcagccgatgcagactccagctgatgccttcacagccgatgcatactctgttttttgaattaatctctttatcgaatccgcctcgatcccaatgtcgaacctagttcatgacttcccgaatttggttgtcaacagttggttcttcaaggtccaagttgcttaagcaaataagacaagacgagcaccgacataaccatgtcccacacgacactgcaagaagacaaacggaaaatggaaacacacgtgcaactactaactattcgtctactgctgcgaagggccaggacagaaggtgagaaacagcatgccctctgtgctgccactgccagaggctccatcctcctgaggaaccactagcgcaggctcggcgcggggagtctccaagaagcaggtccaagccagagactccaacaagctcgagcctggaggtactcttttgacagaggtagacgaggcgacgcttggggtggcagatctgctcctaggcgatcttgagttgacgtagctgctcctccatggcatccaactccttcttcagctgcaggttctcctgacgcagctccagaatcttcacgttgttctcgaccaaggcacgacgcaccaggtgatggaagtcgatgcgggccatgtcatacgcctccaccatacgtgccaggtgcacgatggtggtgtcgtcctctgagctggcatccttgaaggtggcgtagtcatgagatctgccatgacaagggtggtagcggaagggcgagtgctgcaactcgttcgggtaatgctgatggatagagccgatggcgaggtaggcaacgctcttacaagactccgggaaggaaccctgcctgccatgacagacagtgatgtcctgttgggagagccagtgataatcactgcggtgacctcccaagcagcacaaggcgtgtcgtcgtcgccgtcctgctccggtagcttcttgcctttatagtccactccatgaggatacccagagcaatgcgcaagctctgtagctttaaagcaaagccggtcaagttcagaccctggcggtcgaggttacgatggtatttcttacgatcacagatagaatccgcaagcgcatggatataccgatgtagcacttcccctacgaagtattccaagggtattgaatccaagggaacgtatgtgtttaactctctctccggttcatccaaggacaccaagtgaagataggcaaaggatatcgaggatttcctagtgagaaacagtttctagggaaagcttaattttaatcctaacgcaatacttcaggcactggcaacctgctgttcctagatgttgctctagtacgtacccgaacagggaggacttaagtgctctcgagagctgtcaacacctctacacccacctcaaacgtactgtggtatacactgcaattactagatattaactacctaaacacctaaacgcaatacttcaggcactagcaattaatatctacttcagtgtttataactcactaacgtaatcactatattttagttgattatagtgacaataatcccgtacgctgattaggaactaaccaagaggtaattctcacaagataaatctatattacttaggaagattattctattaatatcagagtaataaacagaataaaagaaacaagagaggattaccgacagctctagaattcctccgacttcttcaactctactctcttcctaattctagtatacaaatagtacaatacagcctcttgtaattcagctcaagcttggaagtgtgtgaagaagtgagagaagtgaagtctatttaaagggcatgtatgacgattattggaaggggaattgtcggaaatgccacccaaacgccatcagtaacgcatctgggacgtccacgccaaaccacatgatcaacggtggagatatgggttcggccgaaccgtggcctggcccaacaggcctaggttttggcctatggactccccatgatttgccttatccatttctgcaaattttgggccgactgtctagtgtttcaatgaagtctaaagcccatccttgatatggatacattctttcttcacttttagtctgaattttgtcccaacttctgggcttatcagcttcatacaaatatacaccaacacttgtggaatatgtgagatttaacacctatcactatgttggatgttttattatctaagttttatgtagacattggcagttttattatctcaagcacataaattattcaaaaccatacatgtacttgtgaactttatcagtggctaacttaccatcttgggtaattgataaatggaacgaccctgattccagtccttcttgctccttcttgctccctctgccaaattttatataaattttcgcaaaacagctctttccctcataatgactttctctctatcactctagtgtctctgaattttgtgggttctcaccaaggcattttgtgccataatttacccctattctacaggctgttatatgtagagcttgatagggataaattataacatacctgctgtcgcgtctcaaaacgactctaaaatacatcctcgaaattatgcctagaataattaaaatcgatgtgaaagcctccaacaattaaaatgtgcaaagttaaaagtcaaataaggcatggaggatttttgtatatttcctaaaagcctaaaatgcgtaaataaattttagtggaattttcagagcacaaataataattattaagaaataaacaaagttaaaatggttttataaaaagaaaagctctaaaaagtcctttcccccccc

SEQ ID NO: 33452 - DNA, 5679 bp, Oryza sativa
aattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcctcgtggaggttgaagccgacgtttgggaaagcgaacaaggcaagtcacatcatccttgaacagattgaatcccagtttataaaattattttgatttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactttgggatattcgtatcacctggacaatatggaatggtttgattattgtggaattggattcacacctccccctctattcaaaaccctcaaaatggttttaggctgggctcggggtgcatggttttgatagtagcacctcggccatataaggaccggtcttcgggcctctgttgcaaagcactaccgtacttctacatgtctagtgggtaaggcttagtttgtggctcagtctggttataaacaaaagtacacggatggagatggaagaagtcaggggtcgatggacatctctaggacaaatgaaggctacacgagatgcggcccggtagtcgagatgtcatggcacagggccggtgtcctgctgctaggggctcagtcctgcctacctgtcccgggggttccggccgtaggtgggattgggtcggtactcttgtctatggctaggatgggttggaaactatgtcacgtcttccgtccgtataccgtggtggtatatggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaagaaggaatggttggcctgggttggcttgggacgagctgggacccagggtcgggttgccggttcggtctgaatcatcgtaggccttgggttaaggcaggttcgtgtgggttcacggccttgataaataatattgtatagttctagaatcgtgtttacaaaatagctttgagcaactaagtgtcttttaatgctgtttactgcaaccctaaccctttatattataactcccttgtactcccttgcatttattatgcacttgtgggtgtgtcttgttgagtacggtggttgtactcagtcttgctcaatttttcccaaacccagaagaggagtctccgaaagatgaagattttggtgtctagctcgtgcctgccgtcaagcgcctgtggtcgtcgccctagtcttccgctgtttctcgtttgtctttgtgtgtgctgggccttcgctgcccatgtaataaattaactttttacgcttccgcttgttgaactctgaactgtattaacttttggtgtaccttgcctcctgggacaaggaataatgcacgcacgtaaggaacgcccgttgggttatttccggtcgtgacaagttggtatcagagccaggttgaccctaggacgagccttagatcccaagccttagcaatattttcaaaactaaaaatcctgtcttaattgtgaaaaccctctagtctctctctgtcctgctgcttcatttatcgccaaaatctgacttttaaatgttgcttttctttttgtttttgtttgtagatggccggcagcatcagccgtcgtggtctggacctgattggtttcgtcttggagctgcggggcatgtgcgttgtcctggggtatccgcatggagtggactaccagggcaggccgctcccggagcaggagggtgacgatgcagagccccacgctgcttgggaggttactgcagtgatcctcactggctcacccgagaggacttcattggcagtcaccgcgggtggagattctttctccgccgcttgccagaatgccgctctcctcgccatcggcactcttcaccagcgctacccggacgagttgcagcactcgccctaccgctaccaccctcgccgcggaggagcccgcgactacgccaccttccgggatgctagctcggaggatgacgctaccatcatgcacctggcgcgcatggtggaggcgtacgacgcggctcgtatcgacttccatcagatggtgcgccgtgggatggtcaagaacaacatgaagatcctggagctgcgtcaggagaatctgcagctgaagaaggacctagacgcagtggaggcgcagctgcatcagctcaagatcgcctagggagaggtctgtcgccccaagcgtcgccgcgtctgccgcagccagaagatcaccgcccgcaagagcacctccaggcccaagcttgttcgtcagtccctggcgtggacttgcttcgttgagacccctcgtgccgagcccgcgcccgtggttcctcaggagggggaagcctccggcgttggtagcacggaggatgcgctgttgctcaccttccgtcctggcccgtcgcagcggtagacgagcagttagtaggcttgcgcgtgtgttctttctcgtttgtcttcttgttggagtcgtgtggggcatggttatgccggtgtgtggcataactgtgtcggagcctgtctttattttatttgcttaagcaacttgaactttaatgaaccaatttaatagcagtaataaattcaagaattatggtagtcgtgggtggttagctttaattgtcagctctctctgtttgctggttctgtgtggggttttcagatggtgacgaccaggagaagtgctaacaccggtgatggcaaccaacctgaaggcagcaaccacaacaaccatggcagcccacctccacctcctcctccgcctccaccaccaccaccagacaccaacgccattctcacccaaatcctcgcccagcaggccaacatgatgactgctttcctccaccacctccaaaatccgccacaacataatgctccaccaccacccccacaacactctaaactcgccgagttcctccgcatccgcccacctaccttctctagctccaacaaccccgtggatgcgttggattggttgcatgccgtggggaaaaagctagacaccgtgcagtgcagcgatgaggagaaagtcatcttcgccgcccaccaactgcaggggcccgcatctctatggtgggaccatttccaggctacgcagccagaggggcagcctattacttgggcccgcttcaccgccgctttccggaggacccatgtgcccgccggagtcatggcccttaagaaaagggaatttcgagagttgaagcaaggcaaccgctccgtgatggagtatttgcatgagtttaacaacttggctcggtacgccccggaggatgttcgtgaagatgaggagaagcaagagaagttcttggcaggaatggaccctaagctgtccgtgcgtctagtctccggtgactatccggatttccaacgtctggtggacaagagcatccgcttggaagccaagcacaaggaactggagtctcacaagcgccgcttggcgaatttccgcaatcaacagggtgctaaccaaagggtccgctacaccaatctgatgaggacatcaacaccatcgatacatccacgtccccccatatacagcatgatggtcctattacccgcgctcgtgcacgtcaactaaattatcaggtgagttctttcttgagttcatattcctcgtctttatacctcggagacgcgtgcactcgtgttttactcaggaacgatggagaggatccaaagggaagaggattcgcgcggggtggattcggactgcagggcagcgccaacttctgacggccgccacgacttcatgcgaactccgatttgggcgtgcaagtacttcatggaaagcttatcaagtctaccttcaaatggatccagccacatgtccatatctgttctggagcggccgcaattgtcattttactcccgactattttttgtccatggtgctgcgtcacctcttttggcccaatgggctgtgtatccatgttggtcccattaggggcgcgtcctagggttggagcatgaccctatggtcgttcttcccctctttttatacctctagtcgccgccaagaacaggcgggttttgatgatagagatagcttcttgctaccggctcgcagcgcgcgtgttggctaaaccgcccgtctgcctgtaatcggaaccccaccatattgtgtttgatagtgaaactttcatctttatctagcaatctcagtgcttgtcctacttgttcttgcttgttcttcgattgcttgcaggacgagtgccctcgtggccgggttgacgcgcaccacaagttcgcggcgaccattggagacggtgtatcggttgctaaggcgcggcgtctttggacagttgtagtcgggccgtgaacgtcgacttcatctaatcgagttatcccttacctctcatcgaaagatcgggccacaaaccctagcgggttcacatcaggtggtatcagagcgtggttcatcggtgagagaatttacccttccctccgtcattaatttttttttcctatagtccagaaaagaccaacaaaaaaaatagtagattagtttttccatgatcctatagaccattgtgccttttcactagtactgcttagttaaggcttgttgagttttcgattgcatcggttgtgttaatttgctggtcttagtgttaggcgattagagtttcgagttcttgccaccaccgcacatcgccaccttcatcaattttgccgtcatcaccaccgtcaccaccgtcgcagtcacccaccaaatcactttctatttgtgtttgatctgttgccgatagcttttgttagttgccttgtatcctgccgccactagaaaggaaatagaaccctgattcgagtgaccttccttaaaacagtcatatctttttcatacggactcgaaattaggcttataatatatccacggacatctacaaaaaaagttacatccgattctcccccgcttcgccgggttcggcaaatttagaatcgccaaattcctcttgcaaaattctgtttttgtggcgagaagcttcgggacctattcgcatagaactttaaaaaaattctacaagcttcatactttgtccgtttgagataagattttctgtggttggttctagtgtgctcctggttgtgaaaaaaaaaatatcaaaaaaaaaaagttgtgcctctctcctcagcactagaaagagcaagcaaaaaaaaaaaaaaaaaaaaaaaaaggatccagcgagcacaccacaccattccccctttgtcaccaccttctaccaccggttcttgttttcgttgctgtttgggtttgtgttttgtggcgtcctttgtggttaggct

SEQ ID NO: 33453 - DNA, 1804 bp, Oryza sativa
tccccacgcaccaaaggcatcatccaatactttacaaggcaagtgaagcagcacacagaaggacttgatacagatttgcaggtgacaaatgagaagattggacaattggagtccacgcagatctccaccaacactaagcttacagggttggagacagcggtcgcccgcattgacactagccttgctgctcttgtgaggcattttgatgctctcaatgctggaggcaatggtgggggtaatgacgatgacattgacggagagtacgtcgaggataatttagaggatgaatatattgctgacactgaacaagatgatcgagatgctcaagatcgtcgacggctacacaacaatcgacgaggtatgggtggtcgccgccgacgcgaggtacgcaacaatgatgatgctttttctaaaattaaatttaagattcctccttttgatggaaaatatgatcatgatgcgtacctctcttgggagattgctgttgaccaaaaatttgcatgccatgagtttcctgagaacactagagttagagctgctacgagtgagttcaccgattttgcttcggtttggtggatagaacatggcaagaaaaatcctaataacatgccacaaacttgggatgctttgaaacgggtcatgcgggctagatttgttccttcttactatgcacgtgacttgctgaatagattgcaacaattgagacagggtgcgaaaagtgtagaggaatattatcaggagttacaaatttgcttgcttcgttgtaaattagaggaaactgaggacgctgccatggctagatttttgggtgggttaaaccgcgagatttatgacatcgtagactataaagattacactaatatgacccgattgtttcatcttgcttgtaaggctgaaagggaagtgcaaggacgacgtgctagtgccaaggctaatttttctgcaggtaaaacttcatcatggcagacacgcaccactcctccggccggccgtactgcttctccatcttccacacccacaaccagtcgagcagcacctcctacatctagtgacaagtcagcgacaaaggccgctcagccagcaccgagtgcttcttcaatggcatccacaggccgaatgagagatgttcagtgccaccgttgcaagggcttttggcatgtgcagcgtgactgccctagcaagtgagttttggtagtcaaaaacgatggtgagtactcctctgctagtgatttcgatgatgatacacttgctttgcttgcggctgaccttgcagataatgagccaccggaagagcacattagggctgcatttgcggatcactatgagagcctcattgtgcagcgtgtccttagcgcacaaatggagaaggcggagcaaaatcagcgacacacgttgttccaaacaaagtgtgtcgtcaaagagcgttgttgtcgcatgatcattgatggaggtagctgcaacaacttggctagcagcgagatggtggagaagcttgcacttagcaccaaaccgcacccacatccatactacatccaatggctgaacaacagtggtaaggcgaaggtaacaaaactggtgcacattaattttgcaattggaaattaccatgatgttgttgaatgtgatgttgtgcccatgcaagtatgtaatattctgctaggtagaccatggcaatttgatagggattctatgcatcatggtaggtccaaccagtactcttttctgtaccatgataagaaaattgtgttgcatcccatgtctcctgaagatattttgcgtgatgatgttgctaaggctgccaaat

SEQ ID NO: 33454 - DNA, 1309 bp, Oryza sativa
tctgctaggtagaccatggcaatttgatagggattctatgcatcatggtaggtccaaccagtactcttttctgtaccatgataagaaaattgtgttgcatcccatgtctcctgaagatattttgcgtgatgatgttgctaaggctgccaaatccaaatgtgagagtgataaaaaagcccaatctgatggcaagaaacctgagacaatcaatttgaaacccaaatgcttacttgctactaaatctgatattaatgagttgattgcatcaccttcagttgcctatgctttggtatgcaaagatgctttgatttcacttcacgatatgcaacattctttgccccctgctgttgctaacattttgcaggagtactctgatgtgtttcccaaggaagtgccaccggggctgccaccggtgcgcggcattgagcatcaaatcgacttgatcccaggtgcttccctaccgaaccgtgcgccataccgaaccaaccctgaggaaaccaaggagattcagcgtcaagttcatgagttgcttgataaagggtatgtacgcgagtctcttagtccatgtgcggttccggtaattttggtaccaaagaaagatggttcatggcgtatgtgtgttgattgtagagctattaataacattaccattcgatatcgtcatcctattcctaggttagatgatatgcttgatgaattgagtggctctattgtgttctccaaagctgatttgcgtagtggttaccaccagattcgtatgaagttgggtgatgaatggaaaacagcatttaaaacgaagtttgggttgtatgagtggttagtgatgccttttggtttaactaatgcacccagcactttcatgaggttgatgaatgaggttttgcgtcctttcattggaaaatttgtggtggtctactttgatgatatcttgatttacagcaagtctatgggtgaacattttaatcatttacgtgctgtttttaatgctcttcgtgatgcacgtttatttggtaaccttgagaagtgcaccttttgcacagatcgagtttcttttcttggctatgttgtaactccgcaggggattgaggttgatcaagccaaggttgaggcaattcagagttggccgactcctaaaacggtctcacaagtgcggagctttctaggactcgcggggttctatcgccgctttgtgcaggatttcagcaccattgctgcaccattgaatgcgcttacaaagaagggagtgcctttcacttggggcacatcacaagagaacgccttccacatgttgaaagataagttgacccat

SEQ ID NO: 33455 - DNA, 13215 bp, Oryza sativa
tggatgccgattgatggaataggtgttttttccattctacccaccatcggtcgaaggctgtacttctcagcatcctaaacttgatattatcaatactgcctagaggtggccctgacagatttagcagccgatccatcataaggaatgatgtaatctctcctctattttgaatttggcaaagaataagctaatcggcagttgacccatgccgaattgccttgcaacgcttgtcgggtggtagaatttgtaagtcatcttgatgcttttgccttggtgaatgccgacaggaatgatacaagggctgatagctgccgtaaagacttctctggatttatcgtatttttcagaattgactttgtcaaatcgaaaatcatctggcagttcaaaaataccatgtccttcgtatgcaaaccagattcttgaattcctgggaaacccgtcatagaagtgattgaaccactctccaaagggttcagtcgatagcttggatacagtactgaccgatgctgcttctccaaacgatctgcattggcgtgtattgattacttctccatcatcactggtgatcggctcaaatcttgggaagcttacatcggctaaaggtggtcaattggcaaccagtctagtatgcaagtttagccaagtctgaagtaaccaccatggacctcctgtaccgatcgtttttccagaggctatcttgtcagttgcagtattgagggtttgatatagatagccaagtagatacttggcaagaggaaagtgtttcttttctaccaggttttcagctatcctttgccagtttgcagttggaccacaacttgggccaccgaataagaatttttctaaccacatcatgataaaagctgtgtgttctctttgggttactggcccagttcccatatacttagccatgtagcaactccagcctccaatgcttctggttttgaactcatgggtgagttggttgttgaggctggacaggttagctgatgaggtgatatctaggccagtaatcatggtaacatctagcagagttgcggtcatcagtccttgtgagaataagaaggcattcatagcagtggaccagaagtaggtggatgctgccatcatgggttcatcccttgccatattagctgcagttaatgccaaagcttgggatatgccgatttcgtcccagtgagtggatttgctggccgacatcctcttgtaccaagcaggccaggtggtttcggcatatggccaagatttgaaggtacctttccactggctgagatctgggttagcaaatctgaaggggatccgattagtttcgccgtttataaactcaatggggtctaagttaccgattggaccaaggaaaagctgaagattatcggcaatgcttgggacagcaatttgatgggcaagatgctgcgaagaaggtagaatcgaagattgagaaaggaagtgtggagattatggatatcccatatctacacggcgacggtatttggactgggtacaggatacctaatgtagatagaatatcttatctgtatctcgggtttgtttcttaacttgtgtatcaaggaaacaccctgagacttagtcggttacgactatatttcatctgtatttgcatattccgttagggatatagattatcttttgtaacacggactccttcccatatataaggggggtccgggcgcctctaggggcggatgttgattttctctaaatcatacaatcaataacacactcggcggattcatccccggacaggagtagggtattacttcttttataagaaggcctgaacctgtataaaccctttgtcttcaaacccatacactttcctagcttgatagccacccccttttattattgccgaaatctagtttcgacagttggcgcgccaggtaggggtagcgtcaagcttttcgccgatcagtgcaatgggttccatctccggcatcgacgacctcgtcttcccacccgggcagacgtttcggttcggcagcctcgacttcatcaccaacaacttcggcaagatttctctcctcgactcggaatcagaccagtcgggagagaaccagatttcggtcccgtttggattcccgaacgcggctgaaagctacttcaagaccatctcaaccgagtcggcttcaaaccactcggccgagatcgcatcttctccaacgacaccagatcaagatgatggggcttacccaccagtcctgatgaagctccccgacgatttagcggccgtcttcaccacgacagcgtcttcatcctgtaggcctaggcggaagtcggcttcaacaccgatttcgcctagcttcagggaagtcggcgtcatcctccaaccactcggcacggtttcgacagatcagctggatgactacaacagctctcccaccgtcgactcacgtcctactgacatcgtggagtacgacgaatttagttctcgctacaacgacttcgacgacttcgacggaagcctagatgacaactacacccctctctactttggcgttttcatggccaataatgagacggaggtgcaacgccaagcccgggagaccgaagaacgtcgctgactggaggaggagcatcaagcacaagaacaagaacggctacggcgcgagcagcaggaccgtgagcggactgcgaaggaggctgaggatcgacgtcagcgagctttggaagcagggcgccgagcgcgtgatctcatcggtcagcaagatgtcgaagggacaccggttttccgcacccctcaacagaatgcggttgccgcgatcacccttctcgacaccctcctcaaccaaaacgagctcaatcgatccgaccacgtcgtcaacatcttgaaccagacgaagaccatgattgcggcctcggtcccagttaactccgaaagcgtccacacgccgactggcagccgagttccccacttccgatctcatgactaccgtcatccaagcctcagcatcaccggcgcaggatccaaccgcaggagcaggggtcacgacgtgcggtctgttcactcacctcccgaccttcatagggagcgccgagtggaacggcctcgctcaccacctcgtcgccgccccatcgatcttcgcgacacaatcatacagcgccgagcagctcgaggctaccatcactcgccggaccgccacgacgacgaccttgacggagtagcagccttcaccgacgacctgcgtcgagtggattggccagccggcttcaaaccaactggaatagagaagtatgacggcaccactaaccccgaatcgtggcttaccgtctacggtctcgcaatccgcgcagcaggaggagacaacaaggccatggcgaactatttaccagtggctttagcggattccgcccgatcttggctccatggattgccccgtggcacaattggatcttgggccgaactacgcgaccacttcatcgccaacttccaaggcaccttcgagcgtcccggcacacaatatgatctctacaacgtcattcagaagtccggagaatcccttcgagattacatccggcggttttctgaacaacgtaacaagatctccgacatcaccgacgacgtcatcatcgccgcgttcaccaaagggattcgccacgaagaactagtcggcaagtttgggcgtaagcctcccaggacagtcaagctcatgtttgaaaaagctaacgagtacaccaaagctgaagacgccgtcaccgcatcaaagcagtcgggtcccagttggaagcaaaacaagggtacgccggctacgggaggaggtggaagtaacaatcataaggaccgcaagcgtaagcctgcggaacttgttgcaaccgccagtcactcttctcgacagcgttcgcgcgtcaacacgttcgacaagatcatgaactcccaatgcccgcaccatcctaactccaaccacgtggccaaagattgtttcgtctacaagcaattcgcggatcaatacaccaagactgcacggaagaactctgacgaagagcaaagcacatcaaggaagaaggatgacggcgacaccccggcaggttttcaagatcaccgcaaggagctcaaccatatcttcggcggccccctggcttatgagtctaaacggaagcagaagttgactgaacgggagatcaatgctgttcagcccgacacgccccagtatcttcgatggtcagagatcgcaatcaagtttgaccgctcggatcatcctgaccgagtggtccacccggggcggtaccccctggtactagacccagtggtccgtaatgtcaagcttcgcagaaccctcatcgacggtggcagtgcactcaatatcctctttgccaagaccctggatgatatgcagatccctcgctccgagttaaaaccaagcaatgcgccttttcacggagtgattccaggattatccgcaactccactcggccagatcaccctcccggtcacttttggcactcgggaaaactttcgcacagagaatatcagcttcgaagtcgccgatttcgagacagcttaccatgccatactcggacgcccggcgttagccaagttcatggccgtcccgcactacacttacatgatgatgaagatgcctggtccccgaggagtgctatccttacggagcgacatcaagcaagccgtcacatgcgacaaggagagttgcgacatggcccaaactcgcgagatggcgtctgcccgagaggatatccgactggctgcagccacggcgagcgaaggagaaatacctgctaccaagacttcaaaaagtggagaaagcgaagccaagactaagaagattcccctagatccctctgatcctactaaaactgctgtaataggcgccgagttagattgtaaataggaaaacgcgctcatcacctttcttcagaacaataaagatatctttgcgtggaaaccatctgatatgcccggtattcctagagaggtgattgagcactccttacatgtcaaagaagatgccaagcctatcaaacaacgactccgccgattcgcacaagacaggaaggacgcgatcaaggaggaattaaccaagctgttagcagcaggcttcatcaaagaagtccttcatcccgactggctggcaaacccggttctagttcggaagaaaacagggcaatggcgcatgtgtgttgattatactgacctcaacaagtcctgccctaaagatccttttgggttgcctcgcattgaccaggtagtcgactcgaccgccggctgtgagcttctcagttttttggattgctactcggggtatcatcagatccgactgaaggaatccgactgcttgaagacttcattcatcacgccctttggggcatactgctacgtcaccatgccgttcggactaaaaaacgcaggagcaacttatcaacgtatgattcagagatgcttttcaacacagatcggccgcaacgttgaagcctatgtggatgacgtagtcgtcaagaccaagcaaaaggatgatttgatctcggatctagaagaaacctttgcgagcatccgtgctttcaggatgaaattgaaccctgaaaagtgcaccttcggagtaccgtcagggaagctgcttggctttatggtgtctcataggggcatccaagccaacccggagaaagttactgctatcctcaacatgaaaccgccaagtacccagaaagatgttcagaagctgactggatgcatggcggcgctcagccgatttgtttcaagacttggcgagcgggggatgcccttctttaagctgttgaagaaaacagataacttccagtggggacccgaagcacagaaggccttcgaagatttcaagaaactcctcaccgagccaccaatcttagcctcaccacacccgcaggagccgttgttgctgtatgtatcagccacctcccaggttgtgagcacagtcttggtcgttgagcgcgaggaagaaggccatgtccaaaaagtccagcgaccgatttattttgtcagcgaggtcctagccgactccaaaacgaggtaccctcaggttcagaagctgttatatggtattctaattactactaggaagctatctcactactttcaaggtcactcggtaacggtggtcacatcatttccactcggtgatatactgcacaaccgcgaagcaaacggacgtattgctaagtgggctttggagttgatgtctttggacatatcattcaagcctcgaatttcaatcaagtcccaagcgttagccgattttgtcgccgaatggaccgagtgccaggaggatacccccgcggagaacatggagcactggaccatgcattttgacggatccaaacgactttcgggcactggagcaggagtggttttgatttccccaactggagaaagattaagttatgtgctttggatacacttttcggcgtcccacaacgttgccgagtatgaggccctccttcatgggctgcggattgcaatttccctagggataaagcgtttaattgttcgaggcgattcacagctggttgtcaaccaagttatgaaagagtggtcctgccttgacgacaacatgatggcatatcgacaagaggtacgcaaattggaagacaagttcgatggactcgagctcagtcacgttcttcgacacaacaatgaagccgccgacagacttgccaatttcggatccaagcgcgagatggcgccctcagatgttttcgtcgaacacctttatacaccgactgtacctcataaagatactactcaagatgcggacactcatgacgtagctctggttgaagccgactggcgagagcccttcatacgatttttaacttctcaagagctccctcaagataaagatgaagccgagcggatttcaaggcggagcaaactttatgctatgcatgaagctgagttatataagaaaagcccttcaggaattctgcaacgctgcgtatctttagaggaagggagacaattgctgaaagacatacattctgggatatgcggaaaccatgctgctgcacgcaccattgtcggcaaagcttaccggcagggtttcttttggcctactgcagtgtccgacgccgacaaaattgtgcgcacgtgcgaaggttgccaatttttcgccagacaaattcacttaccagctcaagagttgcaaactatcccgctgtcttggccgtttgcggtttgggggctcgacatggttggcccgtttaaaaaggcagtcggcggttacacgcatctctttgtggccattgataagttttccaagtggattgaagctaaaccggttgtcacaatcacagcagataatgctcgagacttcttcatcaacattgtgcatagatttggagtgcccaatcggatcatcactgataatggcacacaattcactggcggagtttttaaagacttttgtgaggactttggaatcaagatttgctatgcctcagtggcacaccccatgagcaatggacaggtggagcgagccaatggcatgatacttcaagggattaaggcacgtgtttttgaccggctaaaaccctatgccggcaaatgggtgcaacagctgccatcagtactttggtctttgcgaactacacccagtcgggccacaggccagtcaccttttttccttgtctatggggcagaagcaatgttgccgagtgaagttgaattcgagtctttgcgctttcgaaatttccgtgaagaacgctacgaagaagaccgagtggatgacttgcaccgattggaagaagcccgcgaagcagctttgattcggtcggctcgatatttacaagggttgcggcgctatcataatcgcaatgttcgatctcgtgcctttttagtcggtgacctggttttgaggaaaattcaaactacacgagaccggcacaagttatctcctctatgggaagggccatttattatctctgaagtcacccggccaggttcttatcgactcaagcgcgaagacggtactcttgtcgacaactcttggaacattgaacatcttcgtcgtttctacgcttaagtttatcattgtacttccctatcttgactgtcaacatcaagttttcttcttgaagttgtcagtcgggggctatcatcataataatggagtgtgattttttatcaatttaatttgcttacttggtctatcattgccttgtttggttttttctacttagtttgcgaggactgaaagtttctaatagcttatttgggttttaggctcaacaaagcttgataaaaacttttaagaaatcaaagacttggctagaactatcaagcacagcataaatacaccagtatagtacaaattatgcctccatttgttccaatcatactcagtcagaatcagtcctttcatcatcagagttatcgttactcggctgaaggtcattgttgcggaattgatctaccacatcgcttgcaatcttgtcagccgcattttgagcattgttgataagatcaagagcagcttcttcgcttgtcccatctgcaaatccatcaatggtgtcgatttcaattctcgggtacaaggatttggtcatcgctaatgccatgctagctcccatgcttccagctttcttgatgttcttgaagtatacatccggtgcaactcttagcttgtcaaagatttcggttgcgtcaagtgcactcggaccactgttattaaggaacatagcttggacgagtggtgtagcgacattggcgacttcgtctcttgctccttcaagcttcttgatcttaccaaccaggacatcaaactgagcttgagatttgattttacggtctacaaaatacatttataataagaatctgctgcattaaagagaggacagttcaaattgtcagttggcagtaccttcaacctccttcaaggctgagtccctttccgcagccagttctaccttgtctcttttcaaggcttcaatctgtttctccatctgagccattctggtggcttgcgctgtttgaaatccaagtgtttgaggatgcaattatgacagcataaatcaatggaacagatctggatgattaccttttgatgaaccacttagctcgaagtttgaatcctggagctgggcaattcgatcccttaactccttctctgtctttttggcgcactccttggcctcatgcagctggtccctaactgcttctagagttcccaaatgaggaaccagcttttccaaagttgtagtcttggcctcattgcgaagatggattctctgcatgatggatcatggttcagttctgctaaagagagaacaaagttattaaaggtagtcacccggaagatttacattcacaatgcgagtggcttctccaagtgctttcttcagttggcacacttcctcatcttctttttgacgatttataacgatgccggcgacttgcgagttctcgtcccaccatttgagcaagataggaggacgggagtcatcagccgcctttatgcgaggaattgtttcttcgtcatcgcctagtgttcctgatgtatttccaagacattagacgagtaagctgaagttatttaaatcggcatcacttgataagatatgttacctgaggatgttcctggctgaacatgaggtggtccttgttctttatttagagacccaatcattgagtctttaccagcctctggtccttgggaagttgtcgtttgcgcttcaacttcagggatttcttcatcgggacctacatccgactggtttccagtcgggggctcttgtgttgttgcagtttcagctgttgccgactggtctccagttggcggctggtcactcggatcggctttgtcgtccgaatcatgggtgccagtcggctgcctttcggcagtcggctggctttcggcagtcggctggttttcggcagacggctcagcgtctttggataaatttggctctgtcacagccggatcaggatcttttccagttggatctatgtcggacggtttcctgcaaagtgttctttcgatattcaacgtaatttctatgagagaagcatatcaaagggagatggtaccgagaagtttatacctggaagatgttctaatctttggcatttgacggccagccagttttttcctgggcatggtatgctttgggagtttgttgggtgtgcccttgtccccagatttgttgctgtcatcgccctcatcgtcattaagcaccagctttctcttgcgaggacctgtctgcccagccggtttggaggtttgaggttgtgggtctgacctgattgtcggccctccacttccctgaacggtgtgctggcgaggagatcggcgctgagcaattgggggatcagatttcattaatacgtattcctgaatgagatgcttccacggttagctaactcaacatgaagatgaaattatgttttggtcatgggttgaagatttcagatacatacctgcggaggcggattgaatgcgttatatggcacaactggcagctgatgtgagtagctaacgacgatggcatttgagaagattttatacattctctccttcatgattttgaaatccagagagtctggttcttcgcgattaggatcatgcttgccgtcaaactcaaaagctgtacgggatctttctttaattggcgccagtcggcatttgatgaaatgccgagtgatctgctctccttgcaagccttgttctttgagttttaacatgcgatccaacaattccaaggcttgggcagcttcatctccgattggaagagagttccaagtatcttggtacaccgggggaagacaagagtattcgggaagagcaggctcaggattctgaacataaaaccagttcgcatgccatcctttgtttgaagtcttgaagggcattgagaagtatttctggctcagagttcccctcagctgaaatccagcccctccgactacacatggcttactcttgtttggttggggtttaagaaagaagattcggcggaacagggcgaagtggggtttgattcctaagaaggcttcacagacatggatgaaattggcaatgtggactatggaattcgggtttaggtgatgcaagctgattccatagaagtttaatatcccgcggaaaaatttcgaggtcggaagagcgaagccgccatagaagaaatgcgagaagactacgatctcatgtgtatcaggggtcggaaaagcctcaccgcacgctggccgccacccgatgatctccttggctgggagaacgccgtgcgccaccatctccttcaggttctcttccgttgcgtcggacggcgcccattggccttcgaagctttccttctcttccgccatcgattttatccgaatgcgctgatttgattcgagggatggctagggagaaatgagggattaaggcggtggatcacgggaaggattttgatgcacttttcgaaggtggatttgagtggagtggtgaaccctagttcgccggcgcagttctgcactgtagcaaggagtggggaaaatggcgagagttccggcggggaagacgaagcgtcgcttggatctcgggatttattgttaagggtatcggaggtgcaaatgggcctaggcctgaacagtacttcagcccaatacttttaacagcgtggcccattgtgttccttagggacttaggcatattttgctttggcaatattatgcgcacaatagtgttgcccaatgctgataaaatcctttttatgcggtcatataattctttggaattattgcaatgcaaattaaaaggtgcccgacagaaaggtgttatactgctttttgttagctttattaggctacagaagctgtctgggttaatttggaatgacttgtttttatcatagtcacttccttggtatgttatatacctattttcattatggtaaatagtcatagcctaggctattagacttattcattaccataatttttataatacttggtgggtaatctttagagttttatattcggatgcctgtccagtgtgttcattcgtgaaccttttagagtgtaaaccactcggactcttttcattatggctaaaaagcagtcggctggcatgcctatctaggcgccgtgtatgcttttgtcatatgatgcacaattgtgttattattttgtttctcaactatatgtttagttcgttaactaatcacatagttgggggctacacctaattaggtgcatctattcgatgcaccatatttttatcttttcgccctttacagtcttcgtcttcgctactcggcaggccttggcatgataagttttgaagcactcggattattatctttgagaaggctctgatggttgactgcaaaggtctcgggggctactgtggagattatggatatcccatatctacacggcgacggtatttggactgggtacaggatacctaatgtagatagaatatcttatctgtatctcgggtttgtttcttaacttgtgtatcaaggaaacaccctgagacttagtcggttacgactatatttcatctgtatttgcatattccgttagggatatagattatcttttgtaacacggactccttcccatatataaggggggtccgggcgcctctaggggcggatgttgattttctctaaatcatacaatcaataacacactcggcggattcatccccggacaggagtagggtattacttcttttataagaaggcctgaacctgtataaaccctttgtcttcaaacccatacactttcctagcttgatagccacccccttttattattgccgaaatctagtttcgacaggaagaagaaccaatccaataacagagagaaaggagttttagccgatggggacatacctcaacatatttcgcggttgacgcgctcagagggctggcagaggacgacatgatcgcgaacagaagttgatgcttgcgagaattgcctctagatcaccggaaagctcgaaatcgtcaccggagagttcgaggagaaggattggggaaagttttggctagagcgctgaaaacgggagtaacgccgtgaaaaacaagaagagcggtggttattatttaaaagggagcgcggtaacggccaaaacagagtcggtaaagaaaaccctagatcggctcggagaaggagattaagcaaatccgccacactacaaatatagcggatttggggggcatgtgttgacaaccaaatttggtaagtcatgaaccgggttcgacattaggatcgaggcggat

SEQ ID NO: 33456 - DNA, 323 bp, Oryza sativa
catttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgct

SEQ ID NO: 33457 - DNA, 819 bp, Oryza sativa
tctaagaaaggtttcttaccgatgtcacatggcattaatcttggcaagaattagtgtcctcaaacaactgatgagcgaaacaagatgagtgtgattccatatgcctcggctatcagatccatcatgtatgctatgctatgtacacgtctagatgtttcatatgcacttagtgcaacaagtcgataccaatcagatccaggtgagagtcactggatagctgtaaagaatatcctgaagtacttgagaagaactaaggatatgttcctagtctatggaggacaggaagagctcattgtaaatggttacactgacgcaagcttccaaaccaacaaagatgattttagatcgtagtctggatttgtgttctgcctgaatggaggcgctgtgagttggaagagttccaagtaagatacagtggctgattctacaacaagagccgaatacattgccgtttctgaagcagcaaaggaggctgtttggataaagaaatgtttctcaactaagtgtgatgactagtgcttctagccctatggacctctatttttgcgataatagtggtgccattgtgcaagccaaggagcctagatcgcatcaaaagtccaaatacattttacagcggtatcacctcattcgcgagatagtgggtagaggagatgtgaagatatgcaaaatacatacggatttgaatgttgcagatccgttgacaaagccattccctcagcctaagcatgaggcacacactagggcaatgggtataagatacattcatgattgactctagtgcaagtgggagactattagtgatatgccctagaggca

SEQ ID NO: 33458 - DNA, 2089 bp, Oryza sativa
  unsure (1)..(2089): unsure at all n locations
nnnnnnnnnnnnnnnnnnnnnnnnnnnnnnnnnnnnnnnnnnnnnnnnnnnnnnnnnnnnnnnnnnatcaaatatcatatgtggaacaaatatgattagatgatcagcacatgtattaattgatgatcatgtctcatggatcatggtatagagataccaaattaataatgtggatacatgttagtgaacatgttgttggatagacccaacatgagacactgtaagagccatatgtgttgtgtaatcaatgatctcatttagtgttggtattgaatccttacacctgagattatcatggttcccaacatgtgtagtagcttacttagggactgctaaacgctactctgtaattgggtagttataaaagtagttttcgggtatgctatgaaacatgtagtgggatatgaataatcaagatgagatttgcccctactatggagagatatctctgggcccctcgatgatgtagattatggaagtgcatggccatgccaaaggtgattgaggagtcaatcacaagttatataatctatcaacaggttcgagtgaatgattgagctattagaagatggcacatatctagccttgagcttaatcgatatcgtgaggcaaaggggttcatacaagtatacactagaggttcagccgatatgatctttatgtatgcccggtgggtcaatacgttctgataggggccgctgttgacgcgtggaccgaaaaggagttttcgggtcacagccgagtatacatgaacctacagtgtcgcacgcttaatgggccggaataagaggattggatggagatctaatatgagcttaattcggatagggatccgaatagtagtcctacgggccttggaggcccgagtgatggatcctatatattcgtgaggggtatgaccggcggaggtattgcatcacgtgaaaaaccctagccgtcacttccctccccgagcaaaaccctagccgcgcagatgtgctagtgctagcacatctgcgcgtggcgtttcgtccctgtacgtgtggataccggtagaggtgccactgatttgcggtgctgatcggcatgggagtacggcgaagagaacacacgaggtggagaaggtcgagccagtgcgatcgactacttcctctatatcgacgcgcgctaattcgcgagaattccttcgacttcttagcgcctttttccgctgcacagcgcgtcgagtggtaacgatctatgatctaatacttgaatggttcctggtttacgcgatagaaaattttgatttatgctatcgtagcctatgcgtatcccaacaataatcagaatgtattcttcagcatacataaataaaattctctgctttgtcgtgcagtgagtttttgatgctaagtaagatgttcatatgtgcatatatatatatatatatgtgtgtgtgatgttgcagtgacaagcctgggaaccatgacttcaatctactgattgtcgaaacatgaattcggcaataataaaacgggatagcacacgagacctaaaagtggatggatgcggagacaaagggtttagacaggttcaggccctctcgatgagaggtaataccctactcctgtttggggatttgaatccgccgggtgtagtattgatctgacgatcaggttgtgtcatgccccctagagggcctcctgcccaccttttatagggtggggggcaggattacaagatagaaaccttaaccaatacggtatcggtttcctaaatctactttacaatattatcaaaccaggactttaggctgttccgtaatatataaggaaacgtaatacccaagtcatgatctgttacatattccatacatataagttatcccctataactagtcggataaccatgccgtgtgggtatggggtacccataatctccacagtagcccctgagaccttcacagtcgaaaagataatcttctctcgaaccagattactccaaagccgagtacttcaatcatctttgccatggtctcccgagtacttttaccaaatctgaagactgtggagggctgaaaaataaagtcaggtgcatcgactagatgcacctaataggtgtagccctc

SEQ ID NO: 33459 - DNA, 12078 bp, Oryza sativa
aaagcttgtatgttgtgaataaagaaatttccaaagtattgggcatacgccatgcgcacactgctttaacagatgtgcttaagtccctagaagacacatggttccaccacacctggaaatatatggcatatgtggtataaaatccgagtaaataaactcataaaggatttaccaaccgcctgaaaaatgaccacaatatataatcagcctaagccataatattggtcaataaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgataccctttaaaggatgacgcatgtaacatgctcccgggtgatatagaccatgtgatctgagtgattatcccttatgggatactccaaaatagatataaaaattgaatcccgactggcgcaagtattcggttgataacccttacggggaataataaatagtccagtctttgagcatagaaaatagacccatgatcataaattcatgttgcatgtatccggaacaagtccaaattggagacataatacttgtgtttgaactagtaagcccctgagcatatagcttgtccttatgtcgtagtcacaattgtctattgatggtagctgacgcagttggcatagagacaagacgaccaatatagagataatattgcccagcagaggtgacaaaaatattgatggtagtgaagatagtgataccaatcaaaattactgaagtcgcatagccatggaggcgaagaaaccagtcagcgacagacagatcaaatgatgaagataacgatgtcggtgatccagtcaatagcagtgtagcaaccaatgataatgacaaagacgctcatcagcatttgcatagtaggtcaaccgtgaaggtgaaataataagtcggtgaagacataatcatccattagcaacagcggagatgtcagggccgatgaagcaaaggtgctggtgatgatgtcagtgacaataatccttcaaattaatgttatagctgttgtagatgcttcacttggagttgttgaagtagattgtctgctccgaagtaaagatgaagataatgactcctggagttgactcgttggctgattaattgattgctccatctttgacataaagcttgtcgaattttgagccatgtatttgtgtagcccccgactctttgtttagttgggaaacaactgaacatagagtcgagaattatagcttcttatcgtcgagtagtcattgcttgattgaagataagtgttgaagatgtccaagtagaaatccatgatgacaaagttgcattgccatgatgaagtgacagaagcaaactggtagtgaagacgcgcaattgtgacgataaaagcgccagtcggcggcagacgtagacagcttgcgttgaagatgatgacgcatattagcggtgacggcgacgtagccaaccgtgaagaagatagcatcagtcggcgtcataacaggccagctatgcaggcggaaacaccagtcggcggtggacgaggcggccggtcggtgaagacgtagacgcccaacaacggcggcataataggccagccgtgcaggcggaaacaccagtcggcggcagcgaaggcaagccggtcgatgaagacgtagacgcccaacaacggcggcataataggccagccgtgcaggcggaaacaccagtcggcggctgacgaggcggccggtcggtgaagacgtagacgcccaacaacggcggcataataggccagccgtgcaggcggagacaccagtcggcggcgacgaaggcaagccggtcggtgaagacgtagacgcccaacatcggtggtgtgaccaatcaaccgtataggcgaagacaccagtcggcggcgatgacggcaagccggtggtgatgttctgactgatccattcctggagcgtaagagataagcttaaagccatgaatccgtcgcaagcaatcaagataaatattatgaaaattgtttaaaaaatacaatataacatctatagcccccgactcactagtcaacggcgaaccagttgatgtagtgaggcgaaggaaaagacaaaatatcatataaagaataaaataaatgatgacttagctttgtaatattccctcggtgacagcaaaagtagccgatgtgggaacgaagcagtccatcaatggtgacaaaaacaccagtcggcgccagtggaaccaagccagtggtgtagatgatgaagcccattaacagcggcgaagtccgccaaccgtataggcaaaaacaccagtcggcagcggcgaaggccagccggtcggcgaagacgtggacgcccatgaacggtggtgtgaccaaccaaccgtataggcgaggacaccagtcggcggcgacggaggcaggccggcggtgaagtcgtagacgcccaacagcggcggcataataggctagccgtgtaggcggaggcaccactcggcggcaacggaggcaagccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcaacggaggcaagccggcggtgaagtcgtagacgcccaacagcggcggcataataggccagccgtgtaggcggaggcaccactcggcggcaacggaggcaagccggcggtgaagtcgtagacgcccaacagcagcggcataataggccagccgtgtaggcggaggcaccactcggcggcgacgaaggcaggccggcggtgaagtcgttgttgttatcagcaatggcggtggcgaagacaagccggcaaagtggactcgcggccgatcgaccggaaagctgagacgcctcgactccatgaccagcattaatcgcctcaatagtgccgcgtaattatatgcgaacaacaacaaaaaataacaagagattaatctgagattaaaaatcaatatgataaataatgataaaactaggcgtccggcgctggacgagtagttagcatgagtagatataaaaaaattgctcaatggaaaatatcacataaagaggaaaaataaaggcacttagcttttttctcagtgtcctccgtatatatgtgttaatgggtggacaggagatcatatcggcagcttgtgacagacatgcaatacatgcatgagtgctgcacttccctgtgtgaaaattgctcctattgattggctcagattccacgtcgactccaatttagattagtaattgaatatcgccaggagatttgacatcatcagatgatggactcggcatgtcaaacgatcaagttgacgactgacgtcccgtcggaatttccggcggcggcgatgcaagccgaactccagaagaaaagaaccggtccgaagatgaaggcggtgctgacggcagccataggagattgaatctgaaacttgccgcggtagattgttgtaatccctcgattgagtttccccttgactgatttggatcaagtcagagaagaggagcttgaagaagtggtcgacggaaaggaagtgaaaactcccgaagcgaaaacgaagtcggcgactcatgaagttaattccatcgcgctcgttgataggaaactcgacgcagcccctacctggcgcgccaactgtcgaaacatgaattcggcaataataaaacgggatagcgcacgagacctaaaagtggatggatgcggagacaaagggtttagacaggttcaggccctctcgatgagaggtaataccctactcctgtttggggatttgaatccgccgggtgtagtattgatctgacgatcaagttgtgtcatgccccctagagggcctcctgcccaccttatatagggtgggggggcaggattacaagatagaaaccttaacccaatacggtatcggtttcctaaatctactttacaatattatcaaaccaggactttaggctgttccgtaatatataaggaaacgtaatacccaagtcatgatctgttacatattccatacatataagttatcccctataactagtcggataaccatgccgtgtgggtatggggtacccataatctccacactgatgaagctggttcttcctgacggatcgatcccgtgagccaaacttcctgagatgcaagacgatccagtccgtcgtcggtgcggtcatcgtcgctatggcgtggacaaccatgacgttgctgagcagctgcagcgcgccgcgcagtcctcaatgacgtacgggcctctgccgctgctcgcctgctcctgcggtcgcgggtagtttgggtcacacgacggcgccatttccgattgcacgcgcgtacgcttggctgcgggcggagtcatgtgtcgtcaacttctacttctccccgccggtcgccgcatgtcgatgacgtcccggcgccactccccttccgccggccgccacgcgctgaaaatgaaaaatgaagaagtcatgctagagtcctctcagcataaatgcacgtcctctcagcgagatccatacagatattgcgtagataagtcacgcataaagtattaatcatattttatcatctaacaataatgaaaatactaattataaaaaaatttcatataagatggacagtcaaacgttggcacgaaaacccacggtttgccttaagtatgttagctactacagtactggagtagttcagtgctacagtagttgtccgtactcttttctccatttctacaaatattgtgcctctacgaatactatgctgcgccagtagtacagactactactagtacacatcgtagcggtattcggcaatttactgcactgccagtctggcgcgaattcggagcctcgacgcaggtcaagacccgatcgtgaacgtaccggacccgttaagcacagggtgcggataagcgtgcgatggtagtaggtgcagacaaaggatagtggaaggctctggagggccgtcacatcaaccaccaattattgcaggagcactcaaacaacatgagcagcagcacaagcacaactactacgcgatgcttgcttggtgattaggacaccattaatctgacaactgtctcttaatcaactctggaggaaatgattgtcattgccacaccaaggcaaagccaccggaacaacggatatagttagaactagtaccaactaacggataatactagaatcaagctgatgctcgcactagcaatacatggaaaactgcaatccaacagcaacaaaagcagatggcaattggtggtggaagttcttacagcggttttacaagggtggtcgactgaacttaaaaagccgaagcagtttgtatctctaataattactaacaccggttacacaaacaagcgaaactaaattaatcaaggtagtacatacatacatacaacaaatcccaccggtttgattaacaacagtaacggtgatgataatttaagctggaaacaacaaatcatgcacctggctgactggcaccccccaccctctctcacacacactccctcacatgcaaacgatatgaccaagtccaaccaggccagcagcagcagagcagccatggccatctaagctcagttgctggggttgctccggaaggagcccagcgccttgatggctgccgcccggaggatgtactggtgatacgccgccgccgccagcgctccgatgaacggccccgcccagaagatccactgcaattaagcatatgcaggcataagcacttggtgaaatgaacacaagaacagagtgttgcagtgagaggtgagcagcttacgtggtcgtcccatgccttcttctggttgtagatgacggcggcgccgatgctccgggcagggttgatgcccgtgccggtgatggggatggtggccaggtgcaccatgaacacggcgaacccgatgggcagcggcgcgagcacctacacaaacaagcatgtaagctacgtagtactagtaaagctggctagctgagacggaccctggagagtacaaaggtggcgtggtgtgattataaagatacgtaccgggacgtgggagtcgcgggcattgcgctttgggtcggtggcggagaagacggtgtagacgaggacgaaggtgccgatgatttcggcgccgagggcggtgccggtggagtagccgctggccaccatgttggcgccgccgccgttggcgttgtactggtgcttcatgatgcccttcacgatgcccacgcccacgatgccgcccaggcactgcgccacgatgtacatcaccgcgcgaatcaccgacaccttcctcgccagcagcagcccgaacgtcaccgcggggttaatgtgccctcctgcacgccacgcatggccaaatttagctcaacgtacgggcattgtttcaagctatttagtaacaaaagaaaacattactagtacggaccggagatgccggcggtgcagtagacgaggatgaagatcatgccaccgaaggcccaggcgatgccgagggtgccgacgccgccgcactggtcggcggacgactgcactttgtacccaatgacggtggcgacggtgatgtataggaacaggagcgtggcgatgaactccgcaatgagcgcccggtagaaggaccacagccggagctcgccgacgtcgaacagcggcgccggcggcgggtcggtgtagtccttgggccgcacgtgctccggctcctcgctcacctccttcgacattgccgctcccttcagcaagctcaacacgctactcactctgagctagcttagctctgctctctcttctctacctctctcttctctgatggatgcggagaggaggggagcgtgggactggccggttttattgagagcgcggtgctgtcattaatggaaaaaaaaccggcccaggtacaagagaagagaaggaaaggtgtgtgtgggcttgtgccatcgaagcacttcttgtctttacaacctggagtagattagcttgcttgctgttgctgttgccgttgcttctccatgattagaagccaaacttagcacttgataatgatcatgttagtgatgaagtcatggataagtttgttggttctatttaaatgattttagtgctggtataacacaacattaaatacttgacaaaattctctctatgtggaacatgcatgaaatatattcccagtatgcatgctttgcggctgtagttggtgaagctaaagcaatggggggtttataagtcgaggacaagtatcatatcttaatataaagttattctccactaaattcttaagcttaacatgcaaagatgctatatcatcatccactaacaagatgtcacatcatcatccactaattaacaagatgccacatcatcatctactaacaaccatcacatttaaacatcatgcaaacatgccatatctttatagtttttaaaacttaagagctttttcaaatatgaacatgttaaattatcattcaacataattcacataatgttttaatgtatatctttattatgttttatgatatcatttatacttatatagttcatcctcacttagttagtgcttaaatgattaatttatggtccaaattatctttctcattgtttcctctaattaagtcatatcacatcaattgtttttatcctttagatgattaatctaaggtccaaactatctcccttcatttcttcttccatgaagtcataccaccttactttttacgtttgaatcaccattctacatactatttaaatttaaattattataaaccacattaatttacttaatctgatgttatctagctattttacacattatttttttattattatcatactaaattcccacaacaatgcgcggggtttcacctagtgatgaaccctgagttcctctcgacactcaaggctgttgttggcccgatctttcggtgagttgtgataactacgatttgggagaaacgttgatgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaaccccagaaaccctgaaggggtacctaactatttatagaggtgggaggacgaccaagagggtccaagggtcgtgctccaccagattggggcgcaccccacatgggccccacatgggccagggtcccaaacaaagttacaagcccattggcccaatacaggagacgcagcaccttgcttttgtgattgcggccaaacgagatagatttccgagatgaggctggatccgttggaaggaggacttcgagagctttccatcaagtactcatgggcccaaaacggagcacgtatgtagatttggcggccgtttgaagtcagcaatgtaacacgtggccgaatcagattgcagcacatggaggacttgatcttgatgtcttcttgttgattcatgatgtgagcaatggtcgtatccatagtagccatggtcacatcatcctccccttcttcacagaaaaccgtcctcgttttttccatatggtgctcttcgcgcagtccactgaaaacaacctgtttcttgcaatcaaaacaagacaaactcgagacaatatgactagcagtaacatgtctctctagcttgcatattttatccggaactacaagatgttctaaatctgaacaaatgtaaactctatgtaccaaaaatattcctctatcattatattcgccaaagatatgaaaaatagcattagttggacatggcaaatcagatttagcaaataatttctccttcaaattatcgagctcacaaaaatcatcaaactgaacatagcccaaagtatttaaagaagatagcaattcgcgttcctctacttcattagcaatgtgaacaacatgcttagaatcagcacacaaagaaatagtagaactaacatgttcattcactagttgtggcatggatataagtgaaacattatcacacaactcttctttatcacaaggaacagcaagtaaatcaacttgtgacaaaggcaactcagtaattgattccactaatggttgctctactatagcatgaaaagtggacaagtgtagctcaccttgagaatactcaccttcatttctctcagcaccatttaatttaccttgcgaactttcttcagataatgtagctgcatcagccttctcctcattcgcgagtgatggaagtgacatctcaaacatatcgttcttctcattttggagacttttctgaacttcctgcaaaacattagtgataggaggcacaagcatatcttgttgctccattggattctccaaaattttgcgctcaacaatgcaagcaagcatgaacaattggcctatatgattatatgtcacattaacaagcccagcctgaatattgaaattaagccctctgaaaaatctagtcattgtgttctcattagattcttgtaaaccactataagtgatacaaattttaaaatcataaaagtactccctaacagttttgtcaccttgttttagatgttcccatttctcaaggagagcacgtctatagtatgaaaacacaaatctttttctcatcagtattttgcattcatcccaagtttcaagcttattccccacagtatgccaccaaaaagatgcagaaccggtacacttattactagcagccttaatcatttgagcattagaaaaatcatactcatcaaattgtttttctactgctagctcccaattaatgtatgcagcggaatcatactttccatcatagactggtaacttacatgcaacttgtgcaaaattatagtcatgtacctcatatgcatcacgtgaagaagtcgtcatatctcgtcgaaggtgtagatgttgacgttgagcatgaccatcttgtttccccttgcgcaatcctgccatggttagcagcaaacaagaaacatacacaagaatatacacgctcctatcaactactaggtactggcagctcaaatctcacacactcaagcttttaaccaagctcttacaagatcttaccaatgcaagtggaatggtgacatacaccgactcaaccaagcaccccaatgaaggttggatgtatcaatgccttggcaaacacttgcggtacggctgtaatcaaatatgtggagctctaggtaggcttaaatatgtagcaaaggaatagcaaatgctcaaatcagataatgcaaagttgaataattgttcaaagtcgagtaccgtgctggtcctaggctagaacgtactagagacgcgagcctagacacaaacgataccacaagatagcactaggaacaactcatgcacaactctgatatatgaagttcagctcaaacataacagtattttctcttttctttctttcttctttcttcttttcttttttttttctttccttttcttttctgtttttttttggtgcggctttttttttctttttttttgcacctttctgcctttttttttcactttttttttgattttttttaacaaaaactgactcaaggcccttaatgtaagattacagggactcaaacataaatataaaatttacagggactcaaatgtaaaagtctaaacccaaaattaaaattatacaaaaaatggaatgctgaatttatgccggttccgtttttccaaacagatctcgaaaccgacaccaaacaaaaattcgccaaggtgtttgacacaactcggaaccgtggaagagagggagggagtcggactcggccaaaggggcgagtgggacttggccaggaggtggagtggatggcagccgaatttggtgtatgggataaaaaggaaactgatttttaaccaatccaatctactgtatctttccaaaacaatcttgactacttccaaaatcagatatggtaattcaccttcctcctctcgtgcacgacacaggcacggccaaaacaaacacacacaaggatcggcaaactctagatgcaactcaagaactccaaaactaaccgacagaaacttctgaaaactacaaaaatagaaccgtggcagcgagccgattccgttttcgtaggtcccgacaacaacagagacacggtggcagcaacgactgtggtacaaaacgtgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcgacactcaaggctgttgttggcccgatctttcggtgagttgtgataactacgatttgggagaaacgttgatgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaagcaatctgatattgcaaataggaatttaataccaatgataagttggggttccgaagaacaagcagacggacgg

SEQ ID NO: 33460 - DNA, 13765 bp, Oryza sativa
ccgcccgccgctctcggtcccatcccaccgtcgccatcacctgcctccggtggatccgcccgggctggatccgcgacctccggccgtcgagccctctcatggctgctcccgcccacgacatacctcttctgagcccactaccgccgctctcgaccgctctcgcccaccgagggcccaggccacccaccactcgcctctcacctctcactgtcgaccagtgagagagaggagaggagttgagaaaggcagagaggatgatgaatgagagagaggatgtgggtggataagaatgagaaggtgagagatagagatagagggggataaggatgaaaattttcaaagtgttgagacagaaaagatctagagaggagggagcttatttttgcatgcggtcctcctaaacgggcgcatgcgactccttaggaggaccgcatgtgaaaatatgctatatttgcatgtggctagttaagagatccgtttgtgaaaatagtttttttacgtgggtctcttaaaaaactgtatgtgaaaatacgggtctcattcaaataattttgcctacctgttaagttacccttgctcaacaaataaggttatcacctatggaatgcgcttcgttcatgctaggcgtgcgcgcataatggtccaacggcacacatggagatggagtattgggatttgttggttcagatttcagagtaggctattattgggttaacatcagttgctttgtttattatactgtacttatatactctctgttctaaattataacatctatattttttacacaacttataatgatattgtttgaccactaatttatttcatattataccatcaataactacaatattagtgtcacctgaaagtattttaaaatataaatctaattatagaatatatatgatacttggtatatactgtatattgttagtccgaatttgaatttttaaaaaataagtgtttataatttagagccgagggagtacatttaagagtataggaaattttttcagagctcaaattgaacgagctttttgttttaaaaaaatgtagtactccgctactctctttaaaaaaaactcaacttttagagtttaaattttgtcccacgaaaaatcaatgagaagctttatccctttaataccttgatctatttatcactttcactattttttaagtgattaagggtattttagttattctcactgtccactatttttaccttacgatgttagcaatagattttttttttgacgagtgagcagatatatctgcttcattgtttttgcggagactctggacatgaaagtgatgcctatacctgaccgcctgtcagctttgtaagttactgtgctccgtagccatacagcaggactggctttcacgttccctacgggttcttttgtttgcgctggggcaagcttggtaggtagcgacaacatcataggagagagaaggatgaagatggggcaggtctgggcccgaggtacagcgaggccatgtgagtgacctggcgacgagaattggagcgggccgccgtggatataatcaaagcaatgaatgcatatggctccattggccgttgcggccgcccacccgactgtcttcttcccaggtttctcaactcacctgtcatgtttttcacacgcgctcattttaaattgctaaattatgtgtttttaaaaaaattgctatataaaagttgttttaaattatattaatttatttttttaaaaataatacttaattaatcatataatgatacgtgtttcgttttgcgtgcccaggagaaggggttcccaaacacaacccaagtggaagtggaggcgccgcgcctcgtgcgcatcggtaggaataggttcactttggttccttaaacttgatgacagtaagtgatttgtatccgtgaagcacaatatcattgtcacgtcccaaaacgactctaaaatacatcctctaaattatgtctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataacaattattaagaaataaacaaagttaaaatggttttataaaaagaaaaactctaaaaagtcccctttccctccctctccctcttgggccggctcggcccatctccctccccctccctctcctctcccgcggccccatacggcctctccccgcacgcgcgccactgacgggcgggcccgcccgccacccgagctgacgggtggggcccacccgtcatcccctttctcacgccgctcccgccgtctacacgtgcaataaagagggggaaatcactccccgtgatcccctctccctttcccccatttttccctctctctctcgcgttcaaacgggcggatttgcccccgcaaatctcgccggcgccattgatggcggccggacctcccgcgccggtttcctcccttccccggccaccctctctcgacccggctctatttaaaccctccccgctcctcctccttcagtttccgcctctcgccgcccttcctcctcgccggaatcaaggtcgcgccgtcgctctctccctccgccgtcgccatcgagctccggtccgccgccgtcgtcgtcccggatcacctcccacctcggcgccgcctccttcggctttgccgcatcctcgccgacctcgtccacccctccgtttcggtcgccgaccgccggaacgccgtcgaccccgtcgactcgagccgcgccgccgccttcctccgctccggccgcctttttcgtcgtcgccgtcgacctagggtgagccgtggaccgccgcttcttttcccccttcccttcccctctctcggccgccgctccgccgtgcctatggccgccgccggcgaccataggggcgcgggcgccgcctcccgccggccgcaccggcttggccgccctcgggcgcaccgagtggctgccgcgtggggcccggccgtcagccgcccgcgcccttaggtgcggctgacgcgtgggacccacggtgccggccggtgtgagcccgggtgcacccggtccaccgtggaccgtgaggctgccgcgtgggccccactcccgtggacccggtccgcgcgccccctcccctcggctgacgcaataaacccttttaaaattaaaatttaaatgaagaaattcgcaaatattcatttaaagagcatataaacttcaaatgaccataacttggccatttgaactcggaattggaccgttcaagtctctaatttttccttaagaagtcaagaacccatttttgtgctttgtttctacttgttatatggagtttattagagtaaaagccttttcttttccgttggtcgtgtagacgctgcagcttcggaagatccgctcttcgtggaggttgaagccgacgttttggaaagcgagcaaggcaagtcacatcatccttgaacatattgaatcccagtttagaaaattattttgatttaaattattgcattattgctttatttaaattcccgcgttatcactgttttatctagccatgcctatttacctttgttatgaccttattattgttattgttattatttccttgttcaccctagaataaacaaaaccccaactagtggacactctactcatggtactactagtatgattttaggtagatgcttcgctggttaattaggcaacattaggtggttttacaactctagactttgggatattcgtatcacctggacaatatggaatggtttgattattgtggaattggattcacacctccccctctattcaaaaccctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggaagaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaatgcaggttcgtgtgggttcacggccttgattaataatattgtatagctctaggaccatgtttacaaaatagctttgagcaactaagtgacttttaatgctgtttactgcaaaccctaaccctttatattataactcccttgtactcccttgcatttattctgcacttgtgggtgtgtcttgttgagtacggtggttgtactcagtcttgctcaatttttcccaaactcatgtcacatcctaatttttgtttcaggatttataaattatttaataaattattattagaagttatattaaatgttcattaatttacaagtgaagttaaatatgggaaataaaatttcctaaatataaagcatggatggatttaatttttattaaattctccatgattaagtatactttctgaaattttctcggatttttcggagctcaattcctaaatgatacaaagaacagttcagtaattatttgatcattaatgatctaattataattgttaagagcttttcttgtttaaaaatccttaaattataaattgttgtttaaaaggagtaattagaaatgatcttaaaagcctaaaagagaagatctaattttaatttgctaaatttcaatataaaattgggctagataaaattttgttaaatacttctcttgaatctttagttcctagatttttctgggatttatttgagccaaggaagtatttttaatcaatggaatatcatttcatgaataatttaaatagaaaaaggttttaaaatctttcttttggttttgggccgaaagtcagcccaagtctctctttccttctgcctctctcctccccggcccagtcggcccagtctgcgagccgccgctctcctctctctctctcgctgacaggtaggtcccacctgtcagtcttcgtcttcctcgcgccgccaccgccacccgaaccctagcgccgcgccgccgtcgtccccttccaaattcggccgcgcctttccttctccggtgaaatcaatagaggggaaatgatctccgggatctcctccaccttttctcttttggaatcatcatctttttcgctttggaagttcgtggattcgaggtcgaatcggatcggtctctttcctccgaaccctaacctttccttctcgtcgccggtcgccgtgggcctctgtcgccgctcgctagcccctttaaaaggacccccgagctctccgctacccgccgccaccctcgccttcatctctcgccgtcggaagcgccctagcgccgtgtaaccttgtgccgttgtcgtcgccgccgctccagccgtgcttcgccgtcgctccagtcgtcgccgtcgctcgggaaggttgccatcgtggtcgccgtcgcgtcgctgtcctcgtccgccccttcgccgtcgctgaagaccgccggagcatcgccgtcgtcgtcaagccgaaggactccgccgccttttcctcgacgccgccgccgtccgttcatcttccaccgtcgttttggtcatcggtgagttcgccgcgtcgctctctacgtccaggtgccctccgttcgcgtcctcgcgccgtcgttcgccggcgagcttgcgctcccgagccgccgccggtgatgacgtcatcgccgacgtcatcgttgccatccgtcgtagaccggtcgtggaccgttcgatctcggccgtccgttttggataggatcgatctcggccgttcgtttccttagaccgtcccgtgcacccggtccaccgcaaaccctagccgctgacgcaataattcccttttccttttcaaaaataattcattattgcgtcataattcaattaaaatccatataaatgctttaatccgatttaatctttgaaaattcataactaattcattgtaactcagtttaatgtggttcaagttgcaaaagttgtataaaataaagatctacatattaaaattatccataaattgaattaaatttatttaattctttttaaatgggatttaattagatttaatctagtaaaattcataataaattcatttgaagtcagaatgaggtcgttcaagtctcataattcatctaaaattatgatctacatgtttgtttactttttatgtattgtttatttggtttttattagtcttttccttgttttgcgtgttagcttgtcgtttccgtcgttgcgaaggttcgcgagtgcgtcggaaatgttcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgagctttatatattggttcagctagatattagctatgattgcttagccatgcttagaaacattagcacactattgggataacttatgactcactattatttaatgatggcttaataatagttcacgatggtcaatcgtgattggttaattaattacttgccaactaaaacttgataatggtgggttgtgagcacatggttttgagtgtcgtgctcatgacaattaaggaccggttcgcgagctactgttgtgaaacattaaccgtgccaaccacaagccagcgtgggcaacagctttatcttttgtacagcatgattcattgcggagcaccagactgagaagtggtggagataagcccacgggggtcgctagggagtccatgccttgtttataagggggtgattatgatccaggaaaggtgcgctgtggtggattgtgttgtgcaaggggtattgtcacagctcctttccgaggtaccgtggtggtattgaggcacatggtgacatgttgtggggctgtgtcttgtgggtacagtggtacacctctggccagagtaaaactattcgaatagccgtgcccgcggttatgggcgggttgagcaatgtttttcgtgattagtctcacacctctcacaataattatggatgttatacctagtaataatttgcttagctcctggtttggagttagatctgtacagctgggcatggttgttcaggatggttgggcctgtgcagcatgggtgtgctgttaagtgttgattaaaatttctgattaattactccactgttttacttctcttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggagaagacgtttggtttataccccagttgagctgcctgtgggagtggagccggagcttcgttagattttattttccgctgcagttttcttcatggtgaggactaagtgcctcttaagtaagtatttatcgttttagttaatttgatgaatctgtatattaaattgtcagtttgtgtacctcggctgattcctggacgaggattttatgcacaaataagttcggaaattactagtgaatttccgggcgtgacaactcataaaaggagttcctggaagatgaaggctttggtgtctagctcgtgcctgccgttaagcacctgtggtcgtcgccctagtcttccgctgtttcccgtttgtctttgtgtgtgctgggccttcgccgcccatgtaataaattagctatttacgcttccgcttgttaaactctgaactgtatcaacttttggtgtaccttgcctcctgggacaaggaataatacacgcacgtaaggaacgcccgttgggttatttccggtcgtgacaagttggtatcagagcccccttgaccctaggacgagccgtagatcccaagccttagcaatatttttaaaataaaaatcctttcttatttgtgaaaatcctttagtctctctctgtcctgctgcttcatttatcgtcaaaatctgatctttaaaatgttgcttgtctcttttgtttgtagatggccggcagcatcaatcgtcgtggtctggacctgactggcttcgttttggagctgcggggcatgtgcgttgtcctggggtatccgcatggagtggactaccagggcaagcagctcccggagcaggagggtgacgatgcagagccccacgctgcttgggaggttactgcagtgatcctcactggctcacccgagaggacttcgttggcagtcaccgcgggtggagattccttctccgccgcttgccagaacgccgcactcctcgccatcggcactcttcaccagcgctacccggacgagttgcagcactcgccctaccgctaccaccctcgccgcggaggagcccgcgactacgccaccttccgggatgctagctcggaggatgacgctaccatcatgcacctagcgcgcatggtggaggcgtacgacgcggcccgtatggacttccatcagatggtgcgccgcgggttggtcgagaacaacatgaagatcctggagctgcgtcaggagaatctgcagctgaagaaggacctagacgtagtggaggcgcagctgtgtcagctcaagatcgcccagggagaggtctgtcgccccaagcgtcgccgcgtctgccgcagcctgaagatcaccgcccgcaagagtacctccaggcccgagcttgttcgtcagtccctggcgtggacctgcttcgtcgagacccctcgtgccgagcccgcgcccgtggttcctcaggaggatggagtctccggcgttggcagcacggaggatgcgctgctgctcaccttccgccctggcccgttgcagaagtagacgagcagttagtaggcttgcgcgtgtgttcttctcgtttgtttttctgctagagtcgtttggggcatggttatgccggtgtgtggtatgactgtgtcggagcctgtctttattttatttgcttaagcaacttgaaccttaataaaccaatttaatagcaataataaattcaagaattttggtagtcgtgggtggttagttttaatagtctgttctctctcttggctggttctgtatgggatatttcagatggtgacaaccaggagaagtgctgctaccggtgatggcaaccaacccgtaggcagcaaccacaacaaccatggcagcccacctccacctcctcccccgcctccaccaccaccactagacaccaacaccatcctcacccaaatcatcgcccagcgggccaacatgatggctgctttcctccaccacatccaaaatccgccacaacataatgctccaccaccacccccacaacactctaaactcgccgagttcctccgcatccgtccacctaccttctctagctccaataaccccgtggatgctttggattggttgcatgccgtggggaaaaagttagacaccgtgcagtgcaacgatgaggagaaagtcatctttgccgctcactaactgcaggggcccgcatctctatggtgggaccacttccaggctacgtagccagaggggcagcctattacttgggcccgcttcaccgcctctttccagagaacccatgtgcccgtcggagtcatggcccttaagaaaagggaattctgagagttgaagcaaggcaaccgctccatgatggagtatttgcatgagtttaacaacctggcccggtacgccccggaggatgttcgtgaagatgaggagaagcaagagaagttcttggcaggaatggaccctgagctgtccgtgcgtctggtctccggggactatccggatttccaacgtctggtggacaagagcatccgcttggaagccaagcacaaggaactggagtcgcacaagcgtcgcttggcgaatttccgcaaccaacagggggctaaccaaagggtccgctacaccaatccctatccagggggatcctcctcgcagcagcagcagcagcagcaacctcgctccacgtcccgacctcaattcgtggtgcatgtcccacagccgcagcaacagcagagtcagcaagggactcgtgcgccccgtcctcctacgccagccgtgcagcctgttcaaggccgcagggacgctcaaggtcagcagcgtctgtgcttcaactgcttcgagcctgggcactttgcggataaatgcccaaagccgaggtgccagcaaggccaagcgcctccccgctccaacaacggtggtaaggatgtcattcggggtcgtgtgaaccacgtgacggccgagaacgtgctgacaactccagacgtcatcgttggtacgttcctcattcattccatccctgctaccatttttgtcacgtcccaaaacgactctaaaatacatcctctaaattatgcctagaataattaaaatccgtgtgaaagccttcaacaaataaaatgtgcaaagttaaaagtcaaataaggcttggaggatttttgtatatttcctagaaagcctaaaatgcgtaaataaattttagtggaattttcagagcacaaataataattattaagaaataaacaaagttaaaatggttttataaaaagaaaagctctaaaaagtcctttttccccccctccccctcttgggccagctcggcccacctctctccctctctctcctcttccccgcggcccattcggcctcctccccgcgcgcgcgccggtgacgggcgggcccgcccgcctccctcgctgacgggtggggcccacccgtcatccccttcctcccgccgctcccaccgcctcgcccgcgccctagcgccgccgccgccgcgaatcccgccgcctcccgccgtctccgcgtgcaataaagagggggaaatcactccctttgatccccggtgcctttccccccatttttccctctctctctcgcgttcaaacgggcggatttgcccccgcaaatctcgccggcgccattgatggcggccggacctcccgcgccggtttcctcccttccccggccaccctctctcgacccggctctatttaaaccctccccgctcctcctccttccgtttccgcctctcgccgcccttcctcctcgccggaatcaaggtcgcgccgtcgctctctccctccgccgtcgccatcgagctccggtccgccgccgtcgtcgccccggaccacctcccacctcggggccgcctccttcggctttgccgcatcctcgccgacctcgtccacccctccgtttcggtcgccgaccgccggagcaccgtcgaccccgtccacccgagccgcgccgccgccttcctccgctccggtcgccgtttccgtcgtcgccgtcgacccggggtgagccgtggaccgccgcttcgtttccccctttccctcccctctctcggccgccgctccgccgtgcctatgtgtcacgaccggaaataacccaacgggcgttccttacgtgcgtgcattattccttgtcccaggaggcaaggtacaccaaaagttgatacagttcggagttcaacaagcggaagcgtaaatagttaatttattacatgggcagcgaaggcccagcacacacaaagacaaacgagaaacagcggaagactagggcgacgaccacaggcgcttgacggcaggcacgagctagacaccaaaatcttcatcttccggagactcctcttctgggtttgggaaaaattgagcaagactgagtacaaccaccgtactcaacaagacacacccacaagtgcataataaatgcaagggagtacaagggagttataatataaagggttagggttgcagtaaacagcattaaaagacacttagttgctcaaagctattttgtaaacacgattctagaactatacaatattatttatcaaggccgtgaacccacacgaacctgccttaacccaaggcctacgatgattcagaccgaaccggcaccccgaccctgggtcccagctcgtcccaagccaacccaggccaaccattccccattttagttgttaagcaggttttaagaatttaaaacacttacctgggtacattgctcggcttgcccataaccgagggcgcggctattcgaataggttatactctgatcagaggtgtacatctttacccacaagacacatcttcctcacgtgtaaccacgtgccacataccaccacggtaaacagacggaagacgtgacatagtttccaacccatcctagccatagacaagagtaccgacccaatcccacctacggccggacccccgggataggtaggcaggactgagcccctagcagcaggacaccggccctgtgccatgacatctcgactaccgggctgcagctcgtgtagccttcatttgtcctagagatgtccatcgacccccgacttcttccatctccatccatgtacttttgtttataaccagactgagccacaaactaagccttacccactagacatgtggaagtacggtagtgctttgcaacagaggcccgaagaccggtccttatatggccgaggtgctactatgaaaaccatacaccccgagcccagcctaaaaccattttggggattttgaatagaaggagcggtgtgaagccaattccacaataaccaaaccattccatagtgtccaggtgatatgaatattcccaaagtctagagttgaaaaaccacctaatgttacctaattaaatagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcgataatgcaataatttaaagcaacataattttataaactgggattcaatatgttcaaagatgatgtgacttgccttgctcgctttcccaaacgtcggcttcaacctccacgaagagcggatcttccgaagctgcagcgtctatacgaccaatagaaaagaaaaggcttttactctaataaactccatataacaagctgaaacaaagcacaaaaatgggtttttgacttcttaaggaaaaattagagacttgaacggtccaattccgagttcaaatggccaagttatggccatttgaagtttatatgctctttaaatgaatatttgcgaatttcttcatttaaattttaatt

SEQ ID NO: 33461 - DNA, 2177 bp, Oryza sativa
atttttccctctctctctctccctcggattcgtttggaactttccccctaaccttgccggcgccattaatgacggccgggactcccgcgcccgtttccccctcctccggccaccccttccctctcttaaccctatataaaccctccccgtgcctccctccaccgtttccgccgctcgccaatctctctccccgccggaatcgagctcgcgccgtcgctctctctccgccgtcgccgccgagctccggtccgccgccgttgtcgccccggaccacctcccacctcggcgccgcctcctttggcttcgccgcatcctcgccgacctcgtccacctctccgtttcggtcgccgaccaccggagccccgtcgaccccgtccacccgagccgcgccgccgccttcctccgctccggtcgccgttcccgtcgtcgccgtcgacccggggtgagccgtggaccgccgattcgtttcctccttccctcccctctctcggccgccgctccgccgtacctatggccgccgtcggcgaccataggggcgcgggcgcgccgcctcccgtcggctgtgccggcgtggccgccttcgggcgtgccccgcggctgccgtgtggggcccggctgtcagccgcccgcgcccttaggtgcggctgacgcgtgggacccatggcgccggccggtgtgagccctggtgcgcccggtccaccttggaccgtgaggctgccgcgtgggccccactcccgtggacccagtccgcgcgcccctcccctcggctgacgcaataaatccttttttttttctttaattaaaatttaaatgaagaaattcgcaaatattcatttaaagagcatataaacttcaaatggccataacttggccatttgaactcggaattggaccgttcaagtctctaaattttccttaagaagtcaagaacccatttttgtgctttgtttcagcttgttatatggagtttattagagtaaaagccttttctttttcattggtcgtgtagacgctgcagcttcggaagatccgctcttcgtggaagttgaagccggcgtttgggaaagcgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcactggttaattaggcaacattaggtggttttacaactctagactttgggatattcgtatcacctggacactatggaatggtttgattattgtggaattggattcccacctccccctctattcaaaaccctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacatggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggtccggccgtaggtgggattgggtcggtactcttgtctatggctaggatgggttggaaactatgtcacgtcttccgtctgtttaccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcatgggttggcttgggacgagctgggacccagggtcggagtgccagttcggtctgaatcatcgtaggccttgggttaaggcaggttcgtgtgggttcacggccttgataaataataatgtatagttctagaatcgtgttta

SEQ ID NO: 33462 - DNA, 675 bp, Oryza sativa
ccgatataaacgagtgggaagctccagagtcgaacaaaatggtagcagggatggaatgaatgaggaacgtaccaatgatgacgtctggagttgtcagcacgtcctcggccgtcacgtggttcacacgaccccgaatgacatccttaccaccgttgttggagcggggaggcgcttggccttgctggcgcctcggcttcgggcatttatccgcaaagtgcccgggctcgaagcagttgaagcacagacactgcggaccttgaacgtccctgcggccttgaccaggctgcatggctggcataggaggacggggcgcacgagtcccttgttgactctgctgttgctgcggctgtgggacgcgcaccacgaattgaggtcggggcgcggagcgaggttgttgctgctgttgctgctgcgatgacgatccccctggatagggattgtgatgcgaacccgctagggtttgtggcccgatctttcgatgagaggtaagggataactcgattagatgaagtcgacgttcacggcccgactacaactgtccaaagacgctgcgccttagcaaccgatacaccgtctccaatggtcgccgcgaacttgtggtgcgcgtcaacccggccacgagggcactcgtcctgcaagcaatcgaagaacaagcaagaacaagtaggacaagca

SEQ ID NO: 33463 - DNA, 1194 bp, Oryza sativa
agagtttttcaatcaagcgctatgttgtggatcaattgtagctaggaaaagggtatgtaagcctataaaaaaagtgacaatgggaatcattgatctcagggaaaagaacaaagctttattacccaaacatttgtacaagttcaattacaaatgcccttatccttcggtgaatttgatttggactacatattactcctcttcagttccacatgctgccagattatgtggtcgaatttggtggaaagatataacgcaatttgatatcattttcaaaggcatgactaaacctattgtggacacagtaagggtatgtttgctactcagggttcccaacccttctccctcgttttccgtgcgcacgcttttcaaactgctaaacggtgtgttatttgcaaaaagttcctatacgaaagttgctaaaaaatcaaattaattcattttttttaaaaaataactaatacttaatttatcacgcgttaatggaccactccgtttttcgtgcggaggggaagagttcccctccagatctccaaacgcagcataagttctgttttgttctgggtggacttgtgggaaggccaagttagggcacaagcatatccaaaaatgttttcctttgtgagacataaagatgattctatccagcagttcatgacaagacaggttcaagaccaattcctctatctgtgcaggctcatgatgaatacaataacatgaattgggaattggtaccattcactttgtccagcaaagatgctatatggacttatataagctctaaagtgtgagttctacaagctctaaagtgagttctacaaactcagtaattatgaaaataaaggttttcacatatatggttattgttgatggacataatcaattaatactagggagtagggacctactacctgataagaagaaatgtaagcctccaaatgtaactattaattgctccttttgtgccagcctgatactagatagaccggataacacctcttttttttttagtgagttcagtcagaactgttggacaaagattagttttcattggaacctaaaccaggagatccatgggatggttcaacagcgaaaaaaaaatctcttttggaggttcatattttatggatgtttttcggcttgctgcatggaatattgggaagcaacacaataagaatatcttcaataatgtccaac

SEQ ID NO: 33464 - DNA, 1633 bp, Oryza sativa
gatgcataaggttccctacatatggatggttgttcaaaataacaagttcagttgaaaataaaatatatataagattaatcataggaagaatttcatcggttggaaattttatcttttcaattatgcttgaaccaaatattttctgaattcccagctcctgtactatacaatggtggcgatattcaggcagtggacgtgctcacctgcttacatgtgaaaactgggagtgattggggcaaggggttcggccgaacccttctggtgcccaatcactgcaattttcttcagagtttagtgcacatcaggtgttcagatattcagtcacagttttagaatttgcacgtcagaaagctgaggtatctcccccacacttattttgaatgctaaactttattaatcatcaaaagacaaaattggcgatcattggggttaaaaccaatgagccacattatttgacaataggtgcttacaatgataaaaataaaataaaataaaataaagaaactaagaacctattagctacattattaatggaagaggagacatctaatattctaatttgcataatatttgttctcctttctcatctctacaaatgcacgcttgatcttagcgcaaaaaccgcgactaagggtatcgaaattgcctctaagctcagcaagctctacctagttccgtgttgcgatccctaagctcaatattctccttgcgaagcttcttcacatggcttactagcttatggaccgagggcgcgggctattttacttcttcttcttggaatttgcccgggtgccgtaatgataggagggggcgtcaaatgacgcttccaattcataagtggagggctacgggactccgttgccccctccttctccgatggtgtcaagggcaggagcaagcacttaccatacccaccgccgggagttcgcactccccgaatgcaaaaagggtccccattaggggttgatggagtggcggtgggcgtggtgtacttgtggagcacctcatctcttgcctttgtatagagcgtgcccatatattgctcggtgggcagcggagcggcctttacttgctcttggaagagccgccttgtcgtcaacggattgagctctccagttgtcggctgtcgcgcagtcgaattcccccaaattttggttttggtcacatggcgaggggagagggatcgcgctgctgaacggggggccgattggggccgtgatgggttcggccgaacacctagttcggctgaaccatggtgctcgccgactggatgcaaaattgctagggagccagacaccatcgcaagaggctgcgtccacacaacgtttacctcttccatcgtgtaatcttcaatggggatgagttggttcaccggagtcggctctgcgttgaggttgcaagtggaattggaggaggagccaatgtagggcatgaaggacttgctagccatgggtggtttgagtagggggaccaaggaattgagttgagatggagaggagagctttcttagtggaaagaatgaagaggaaaggttttggtaatattgacggtcgaaactgatcgataacgaccgtcaacaaaaccccccaggcttgaacccttgctcgtcccgagtgaaggatgaaagggaaca

SEQ ID NO: 33465 - DNA, 12607 bp, Oryza sativa
ctttggcacagtggcttactcttacccctgattcccacgagacactgcttctctttgctttgggctgttgaaagacagaacagtaattagagcaccaatcacccgatctttattcaactcttgttccggaagttttcaaatgattttagaaatgaaaaccaagttcctcaattgattcactcaatctctctaagtgtatcattttgaattcctcaccaagagatgcctttttgattcctagtctaaggtttatatgtggagctcggtatagataaaacatggcatacttgcattcacatttattactaagttaaaaacttagactagagcagattactaaacatactcaagatcaagatcgtgcataatgtgtgtgtggtatatagtggaaatggtatatgaggaaaaataaaacaaaaaatgcttctcctttgtgcttactttcttctcccaaaaatccttcttttatttattaggagagggcatgattacatttttttttcaatatcacactcatgcttgatggagcataactttattttttttcataaccatgcctttccctcgtctctttttttttcaaaaggatatatttttttctttaggagaagaaagcacatgaaagcatggagaatttattttggtggtaatatggaaatggagtggaatattgcttagctcccagtgtaggagtttagcatgtgcataaatgcggttgtatgatcttaatcatagagcatgagaagtatctacacaagtcacaagagtttgacaaagttcaatggaatggcaagcaaccaaaatgtatatggtttaatcatgatagcacatttttggctctggtaggaatttataccaaatgaggaactttcaattttattattttgaaaaacaaaacatctggaattcaagccaaactagtatcaaggtcatagctactcatatttactatctcgtatctcgcaacaacctagacttagattaggaagtgcagcccatttacctccggttcctggataattgttggctactcatatttaacctttgatagagtatataaaagatataaaacagagcaactattcatcatttcaacaaagagaactagcttgtcttacctagcatgactcaaacctatcctatttttttggtattttctattttgcaaatttttatgttgttttgaagttttataagatgcaattggaaatcaaatatgcaattggaaagggaaatatgcaatgtgatacaagttacctcattggagggagcgatgtctccccccaagcttggctttcgctcagggtccttgataaggattgaacccctgaaagcggaagtacgcctgaaggtcatcatgctgttgttgcatcatgttgttgatgttggtgaactgagcatcagcagattgttgccatcttgcgtttgtgctatgtgttccgtgaggtcgtactagatctcccccgtctgcatctcaagggtgtccatcctcctagtgatttcacccaagtcccaacgagaggaactcgagcgccattcacttggagctggaggcacaccacttgatctggagggttggttgtcccccctagtggatgtcatgaggcgcatgccaccggtcctcactggcgcttgcccaagttgagactccgatgctatggcgtggagcttgggtccatctgggtgcatccccagttggtgcccaacctgcctcatacatctgcacaagtgtcgaggatgatgaacttccttgttcgttccttgtcatgttgcgcgtctccctgtatgttccacctgcacgagattcttctatggtctgcaggggaatggttagttcatggcagttgtacaaatgataccccgcatttggcaatgggatttcatttgtacaaccggggaaaaagtataccaaagatccatctactccacgtttcaaaatatgcctttgcactagataggcctcatcaatacgcggacgagcggctgagataaaagcaatttggtcactaacgatccctagcccttttgttatccgagtaatcagagaagtgcactcaacaggagcagtgaactttgtactttctaaccattgtcttattatacatttcacaggagaaattttgatctttctaaccatggcaaacatgataattaattcatctcccctaatgggtctcagatcacttctaggaaacaaagtcatagcaatccatttgtgcatgagcctaagtgtaggattatggatatcattcgttctaggtatcttgcaaattggagcaccagaaatatcttcccaaaacctatttttctcgaacccagaaattcctttctggagatcgattttacaggaatcatgaaaaccaagaagtgtacttaagcctttccatgtgagcgtgaactccttacggaaaaagcgaaatgaaatatcatcttctatttctttcaaagtgtacagaaattgcaaagtaagcaaacaagaactgggctactctaccacagcaaatctctgccaaccaacagctttccaaatagaacgaaattcaacatccatacctattttttcagcaactccggtgagtattctcgcgtgtgagcatactcccggtcgctcagcatgtagtaggcttgtctctcccgatcgctgacaaggtcaaggtcagcgtcgctcaggagttgtcgcggagcgtcggcgtcttctatcgagacatcagctgaggaacgagtgctagactcgtcatgacgactttatggagagcttgaccccttgaacagacgagacagtcgcctcctcatactacacaatggagaaagaacaggctaacttggctggggttagaaatgacaagagtttcacccgccggttagtttcaccaaagcaacttgtatgtatgcaactaaagatttgaactagaggaaaattatcaaagcatgaatgaacttgagagcaaactttggagagggaatgaaaatgtgttgaaatggggtgaagtcccttctcccagccggttggcttaagttgtgcacccacaacggtcaaaactaacctgtggggcccactagtcgttgcctcaaaaagtgaggcagctgaccgttgcctggccggttcggccgaaccagggtgttcggccaaacccttggtgggaccaaccagccccactttcggccgttggattccaacggtcagtgtggtcatggcacaatgaattttcgttgaaaattttactttggtttgctctgaaaaattcaattgaagaatttcctccaaattcaataaccctaaaagcaattttgaaattcaaacatgtggtgatgcaaaaattcaaattgttgacagcaaatatgcggatacataccaatttacctgttggcgaaggtcgtgtcatttaaaatccgacgtgcaagaccgtacctcctttcgatttagttcgtggattttccacccatttccggaggtgatggagcgggcgtttttggcttcttcctccacaccttctttgatttcggtgcggaagatggcttcgtctgagccggctgttctagcttcttggctggtgcaggtgattttaccagcgtcctccaataacggttcctgggcattgttgtttccttttctaggaagttctacataaaccttaccaggctatccgtcttgggtggctccacatcgacaacttggatattctgtgggtttggcctgtactttattctgaccatggtgcattgttccatcctcggttgaaactcaaacttttcctccttcccgttggtatggaaacggatactccccgttcccacgtcaatgttggctcctgcggtgctaaggaacggacggcctaggatgagcggcgtctctttccctgtatccatgtccagcaccacaaaatcaaccgggatgaagaaatcccgtatcttggctggcacatcctccgctatccctaccgggtaatggactgacgagtcagccagttggaggcgcatcggtgtcggtgctaacaccgtgaagttgagcttgtcaaagacgtcttttggcatgacgctgacgctggctccaaggtcgcacaaggcctggtcgaattgttgtgccccgatcgaacaggtgatcgtgggacaccccggatctttcttcttctctgggagtttgtgcagtatcaggttgctacagtgttccgtcagcttgaccacctccgttgttgggagtggtctcttgttgttgagtatgtccttaaggtaacgggcgtacgttggcacttgcatagcgtccaacaacggcacgttgatgtggatcttttggattacttcaacaaaacaagcgaactgcttgtccactgacggtttcctactctgttgaggaaatggcagcagccgtgtgtcgcagtactcctgcggcactgttttgtctggctggatctccttgtcatccgagtcagtagatggcgtttcttttgacatcccattagttcctgcagggttaggatacggcggatcacgagtggacttacctccccttgttgtgatcgccttaacattttcaatggaggagtcgggttgccccggaatcctcccggactcatttgcagggactaaagatgccaactgagctaactgggtttctatcatcttattaaagctcagctggttttgaaatgcagaagcgaagccatctagcttgacatttatgttctctaagatcttatcattggcagcaagcttttttcttagtgcatcagtggttttagcttgcgcaaaaacaagatccatcaaggagggctggttagagaagttaccgttattgttgcctcctggataatatgggcgtggttgattccacccctcacctccttgtggacgatactcgttgtttttgcccatgtacatcgcctcctcatgggtttccaggcagtcgttcccagaatgacccgtgcctccgcagacttcacacgtgacgtgtgagtccaaggccttgacggtgccttgtggccgtttctcgtggtcgtccaagcatttcatgaggaggtccagcttggcagcaagtaactccgtctccttgacggtgtgcatgcctcgctgacgggtctggagtcgttccttactccaacccgtattggagaccatcttctctatgagttcaacggctccttgaaccgttttagagaagaaggctcctccagctgccgcgtccaggtgatcgcgggacattagggtgagcccattgtaaaagttctgcaggatcaaccagtcgtccatcccatgatgaggacaggcggccacgtactcctgtagtcgttcccatgcttcaggaatggactcgtcccttgtctgctggaatctggaaattcgtccacgaagggcgttggttttgcctatcgggaagaacttcgagaggaatgacgtcgagcatttatcccaggtgttgatagcagcacaattggcatagaaccactgcttcgctctcctgaggagggagaacggaaacagccgcagcctgacagcgtcaggactaacgcccttgatggtgtacatgctacatatctccaggaattgtagcagatgagcgttggcatcctcattaggcttgccacagaacgggctagcctatgccatcgtaatgaggttggacttcaggtcgaaatccacatctcctatgttgatttgtggcccgacggccacattcagcagagggagcagcgaactcgcgaagagtcttgctggccataatcttgaaggtctgtggcgctggtacggctggtttctctgtcggtagagttttctgcggagcaacgactcgcggcctgacgcttcggaagaaagcttttggattttctttgaagttttccggcaagttgaaaccagccatgcactaccctgttttcacaacaaaaagtgaaaacaaccaaggttagcctgcaaaggaaattgactatacaaaggtaaatataaagtattagttttaagtaatctctattatgaatcttccccggcaatggcgccagaaatgcttgttagtccttttatagctgaactatgacggttgtgacggttggaatggtcggtaataccctccaaccgtcattggggcttcatctcaaccgtccagccaaaacctggatccaacagaggcgagggaggttcgacagaatcaccaggttcgaccgaacctggtgctggcccaatccagcccaatttcggctggcggcctcctctgctgcttcacttcgtagacttgtgaattttggcctgattcttcgtgtcaagtctgtgttcttggcccattcatacacaagtctggttctcgacatcgtccgattgatttattgtctgagttgatgttgattctccttcactttattgtcattctctacaaaaggttagtagacttaatactagtggaatattattattcttgcatatttatgcattgcaagcatcactagttctctcttgttttggtaatattgacggttgaaactgatggataacgaccgtcaacagttacctgagtcgttgtggagtgtgatcgccccgtgcgaagaggtgtcgatgatgtcgaattgtccttcccatttgctgcgtagttttccatggccgaagagcttaactctggagttgaacattagtaccttgtctcttggcttgaatttcttgatttttatctgtttatcatgccagcgcttcgttctttctgtgtatattttggaattgtgatacactttctctctccactcttctagctcagccaactgcatttttctccattctcctgctccatcgaaatccatgatccagtttctgatggtccaatatgctcggtgctcttgttctacggggagtcgacatgacttaccataaactatatgataaggggacattccaatgggtgtcatgaacgctgtccggtatgaccatagtgcatctggcagcttgtccttccatcctatgcccattttgttgaccgtcttctgtagaatatttttgatttgtttgtttgatgtttctgcttgaccgctggtctgaggatagtaaggtgtagcaacattgtgtttggcgcccatatctcgtaggaggtgtcggaaggtttcgtcgatgaagtgcaagcctccatcacttatgaccaatcttggggtgccaaatcttgggaagatgatttctaagaacatatttttatcatgcttcgcatccgcggcgctgcacagcttagcctcaacccacttagatacatagtcgactgccaccaagatatactcgcaattacgggactaaagaaaaggtcccataaagtcaataccccacacatcgaatatctcgacttgtaagttatatgtgaggggaattgcatcgcgagcagtgattcctccttgcctcaagcagcttgggcgccttctgacaaactcttttgaatcttcgtacattgtcagccagaagaagccgcattgccaaatctttgcctgcatgcggaatgcaccgtaatgtccatcataaggcgaggagtggcatcgttctatgatcttaagtccctctttagttgaaacacatcttcttagcagcccatcaaagcaaatccggtataggtatgggtcatctcatatatgacgatgactctcatatttcagcttcctctggttttctcccggtagtatgtattttgacaccatataattaactatattggcataccatgggctggagtcgtgcactgtcatcagcatgtcatctcttaggaagtcatttatcggctgttccagcatattagtaatttgcagcctagacaaatgatctgttacggaattttctactcccgttttatccttaatttctaataagtcaaattcttggagtagcaatatccatcgcaagagacatggtttagcatctttcttagtgagcaggtattttagagcagcatgatcagtgtgaacaatcaccctagcccccaccaagtaagatctaaacttatgaatagcaaaaacaaccgcgagcagctctttttcagtggttgcataattcagttgggctccgattagagttttgctagcatagcagattgcgtgatgcctcttgtttttggtttggcccaggaccgcaccaacagcaaaatcgctggcataacacataatttcaaagggcagcgtccaatcgggaggttgaatgattggagctaagacgagtgcctttttgagaatttcaaaggattttaggcacgcatcgtcaaactcaaaaaggcgtgtgatgatgcccattgaaccgtacgagatggcgggtcgatgatggcagcagccccgttggcggaagtggccggattcatggcgccaaagatgaccagatggtccagatcttcttggcctcggcggctatggtgccggacgtcgacagttgggggaagagcaagcgcggcgtaggtggcaatgtgggcaaacaccatgggaagaccctcgtggtagccattgacggaagagagatctgcaagcatgttccctatcgacatctcaggcgccaccgccgatcctctcccgccacatgctatcaaggtcacttatcgaatgcaccgccgttgctggtgtccatctctacctcccgtatacaccgtcagctcagcttgtccacctgatttggctcgatagcggcggcttgatcctcaatcgcgggtgctgttgatgggggatcggctgtaactctccatcgaaggcatggaaggattggcgatggcaaggccgcgagggcagcggctagggaggggatggagtcacgggcaaagagagagagagagaggggcgaccggcgaaggtggaggaggagatttgtatgggtccgagtgggagaagaacgatatggcggcggctctggcgaggacgtggcatagcgccggcagtggggccgaggagaagtccgtgaggaggacagccgtggcggtggggaagaagaaggacggccgcgggctgaggtcgatgtcggttccggcggcggagaaggggccaaagtcggctccgacggcggctccggcagctgatccgagtgggagaagcacgatctgggaagaaggaggtggggaagagcggggcgcggcggtggggaagaaggaggacggccacggcggctccggctagggcgcggcgtagcggcggcagcggggagcaggagcagcgagtgaggaggacggccgcagcggcagcggggagtcgctcctgcgaggacacttggaggagtgagcgaggaagagaggcgcgcggtctccgcagctgcgggtggaggaggagtgatgtcttcgcgcgtggaatcctcggctgtgaaatcatgtggtggaggaagagaagcacgcggatggacggttcagattagtccggatgatttgacctgtagcattggaggggggcaactcctcctttttatattagtatagatgaagggtagcggaaaatgatccattttttagccttgttaagcttcctgtagtccatgcacatgctccgtccggttacagttcgttgtggaatgagttcattttgggcatttataacgaccgtcatccctcctttcttcggcaccacctggaatggactaacccactcactgtacggtacgggataaataatcccggtgtgtaggacttctagaacctctttctttacgacctcacgcatcgcattattgagccgtcgttgaggctccctggaggaagtactctcgggctcaatatgcatgcgatgagtgcaaagggcaggattaattcctttgacatcctggagggaatagccaagaacagagtgatgtttctctaacacagctagaagacgctgagtctcgtccttagaaagcttcctcagaaagcttgtcacttatgatgacaggagcttccttatcgccgtgcagaaaagcataacgtaggccttggggtagaggttttagctcaatcggaggtcgaggcggtggttctatgcttggaagctcgagagtctcacctggttctgcttcatattccactagtattcatgttagaataataatattccactagtatttggttcactaaccttttgcagagaataaccataaagtggaggagaatcgacatcaaactagacgataaatcaatcggacggtgtcgaggatcagacttatgtatgaatgagccaagaactaagaattgacacgatgaactgagccaaaattcaaaagtctgcatatgagaacaataaaggaggccatctaccgattttggaccatggcggcccagcccatggttcggccgaaccgcctgcagcgccattagatctaggtttctcctggatggctgagatgactccccaatgacggttggtgggtattaccgacctttccaaccgtcacaaccgtcgttctcaagctataaaaggagctctcctcctcacttcactcacacacctcaagcaaagctctctcatattctctcaagtttagtctagtgttttcaagctagtggagtaagaatagagtagaaatcggagtccggaagccttcggaagagttcgggtatggctctagtagctttcctttcctcttttgtaggctttatacttttattagaatactcttctttatacatttatggtattgaaatactttccgagtatatgaatgccaactttactttatattcatattatactgattatactgctagcttatctgggagatgcatcggtatgggtatagtgtttgcttatgcaattactctatgtcatgacgatgatattagagtagtatctggtagtttaggcgtggtgtctagattacggaatatcattatttgaggttatatgctgcggatgagagatgggccgctgatggtgacagcttagtatgggtattcctccgcgcgtgtatatagtcctaagttaatttcctggggagggtactcctccgtatttagccccggctgtatagtcatgacgggctgtcgtaaggaactcgacagtcaggggtgtcttgtcgaagtaccaagagggcattggaaagagggtattagctagttaatcatataactagaatgtatgtatactaggagtataggaatagattatcgtttctattttcttttcacttagcttagacattttagtatgagaatgagtagctccctgcttgtgtgtcactctaccctcggattattttaacccctgcttagactctgattattacaagtaacatataaattattagtccggttctctctactatgatcttcccacgagattaaataaatacgatacccttggaatactctcgggtgaaatgctacaatggtatatccgtgcgcttgcagatgacctctgtaaccataatgtaccaggattatttctgcaccattgctggaaattatatttctagtaatgacgttaagaaataccaacaacggtcaaggcgaaatttgctcgagaaaaaggaactgaaaatttgttccctcccaaaactatttcggggctatctaatcggggtgtatttacgaggagctgttctattgggtgcctgattagaatgttgaagtcttggatttcaaagacatgaagatccaagatcgcctccctgtcttcatagtagacatgcacgtcttgcacaatcccaaatccttcaatgatatttccattgggatgcttgaagaatttgtttgtcgggattattgctttatcgcttagataagctaatgcaaaggactcgaaaatgagattaaccccgacagttggattatagagaataccaacgttgttcccttctaaatgacatggaataactcagggatcggtatttatccgaattacgtcagatgaaagctctgcctcccttagccattcgtcacccattatggttgtcagctcccgaacagtttcccttaggaacccaagttccatagtatcgggaggtggcaaaggaacaagcggccactttttactgaaataattcagggtgtcgccgtaatcttcatcaaggccatccctgaatagaactggagcacgatccggagtctgaatttcttctttcgcaatggatgacggctcgggaactacttcgtcagtcgaataagttgaattagaaagttcaggttctgattcgactgttgaaggctcctttatcttagacacaaatgcctccaatgggggttcattgtattgtgccatgaagaaagtgttttccagaatgtgatctagaattacttttccttctgacggtgttttatgcatgaatgatcccccgacagttatgtccagataaaatgcagactcctaatctaggcccgtatcaaaatgttgcaaaagcacatattcgggtatagacaaggttggtccggattgcacaagattagtgaatctggaccaggctacacctattgattcgttgttaatctgttgaaaactaagaatttctactcgaagggcggtaatacgagtaaccgggaaaaaggcaagacagaacctgtcttgtaacttttccaaactaccgtttacacatcctacggtagatgtgtatcattgcttcatgccacgaatctgaaggcatgagcaaacttgctagaagtctcgcagatgatagtaggggttttcctgatcaagaccagaaaaaggattttccctaaccatactga

SEQ ID NO: 33466 - DNA, 3541 bp, Oryza sativa
attcgtcatcaatgatgggtttgttttcagagctaacaagctatgcattgcagctagctccgttcgcttgttgttgttgcaggaagcgcatggaggcggtttgatgggacattttggtgccaagaagacacatgacatccttgctagtcatttcttttggccacagatgcgaagagatgttggcaggttcgttgctcgctgcgctacatgtcaaaaggctaagtcacgcttacatccacatggtttgtatatgcctcttcctgttcctactgttccttgggaagatatttcaatggattttgtgttaggattgcctaggaccaagagggggcgtgatagcatttttgtggttgtggatcgattttctaaaatggcacatttcataccatgtcataaaactgatgatgcttctcatattgctgatttgttctttcgagaaattgttcgcttgcatggtgtgccaaacacaattgtttctgatcgtgacacaaaatttcttagccatttttggagaactttgtgggctaaattggggactaaacttttgttttctactacttgtcatcccaatactgatggacaaactgaagtggtgaatagaaccttgtctactatgcttagggctgttttgaagaaaaatatcaagatgtgggaagaatgcttgcctcatattgaatttgcttataatcgttccttgcattctactacaaaaatgtgcccatttcagattgtgtatggtttgttgcctcgtgctccaattgatttgatgcctttaccatcttctgaaaaactgaattttgatgctaagcaacgtgctgagttgatgttaaaactgcatgagacaactaaagaaaacatagagcgcatgaatgctaagtataagtttgctggtgacaaaggtagaagggaattgaattttgaacctggagatttggtttggttgcatttgcgaaaagaacgatttgctgatttgagaaagtctaaattgatgcctagagctgatggaccatttaaagtgttagcaaagattaatgagaatgcatataagattgatttgcctgcagatttcggggttagtcccacatttaacgttgcagatttgaagccgtatttgggagaagaagatgagcttgagtcgaggacgactcaaatgcaagaaggggaggatgatgaggacatcaacaccatcgatacatccacgtccccccatatacagcatgatggtcctattacccgcgctcgtgcacgtcaactaaattatcaggtgagttctttcttgagttcatattcctcgtctttatacctcggagacgcgtgcactcgtgttttactcaggaacgatggagaggatccaaagggaagaggatacgcgcggggtggattcggactgcagggcagcgccaacttctgatggccgcaacgacttcatgtgaactccgatttgggcgtgcaagtacttcatggaaagcttatcaagtcgactttcaaatggattcagccacatgtccatatctattctggagcggccgcaattgtcattttactcccgactgttttctgtccatggtgctgcgtcacctcttttggcccaatgggctgtgtatccaagttgggcctattaggggcgcgtcctagggttggagcacgaccctatggttgttcttctcctcttcttatacctctagtagccgccaagaacactcgggttttgatgatagagatagctacttgctaccggctcgcagcgcgcgtgttggctaaaccgcccgtctgcctgtaatcggaaccccaccatattgtgttttgatagtgaaactttcttctttatctagcaatttcggtgcttgttctacctgttcttgcttgttcttcgattgcttgcaggacgagtaccctcgtggccgggttgacgcgcaccacaagttcgcggcgaccattggagacggtgtatcggttgctaaggcgcagcgtttttggacggttgtagtcaggccgtgaacgtcgtcttcatccaatcgagttatcccttacctctcatcgaaagatcgggccacaaaccctagcgggttcgcatcaggtggtattagagcgtggttcattagtgagagattttacccttcccttcgtcattaattttttttcctatagtccagaaaaggccaacaaaaaaaaaatagtagattagttttcccgtgatcctatagaccattgtgcctttttactagtactgcttagttaagacttgttgagttttcgattgcatcggttgtgttaatttgctggtcttagtgttaggcgattagagtttcgagttcttgccacaaccgcacatcgccaccttcatcaattttgccgtcatcaccaccgtcaccgccatcgcagtcacccaccaaatcactttctatttgtgtttgatctgttgccgatagcatttgtgagttgccttgtatcctgccgccactagaaaggaaatagaaccctgattcgagtgaccttccttaaaacagtcatatccttttcatacggactcaaaattaggcttataatatatccacggacatctacaaaaaaagatacatccgattctgccccactttgccaggttcggcaaatttaaaatcgccgaattcctcttgcaaaattttgtttttgtggcgagaagctttgggacctagtcgcatagaactttgaaaaattctacaagcttcatactttgtccgtttaaggtaagattttctgtggttggttgcagtgtgctcctggttgtgaaaaaaatatcaaaaaaataaaataaaaataaaaataaaaagtcgtgtctctctcctcagcactagagagagaaagcaaaaaaaaaagggatccagcgagcacaccccaccattccctctttgtcaccacctttcaccaccgtttcttgttttcgttgctgtttgggtttgtgttttgtggcgtcctttgtggttaggctcgcgtctctacttcaactagtctaggaccagcactgtacactatacccttgagcgattattcaacttgctttggttaacgtggtttctagttttctcttgagcattgctttcagcccaccgacagctccaccacaaacccgactacaacttgacaggtcttgttgctacagcaccgatacacctcgttccacggttgctaacttgtgggttgctgtccccctcctgtgggcaaggtaagaacttgtcacatcctgattttcgtttcaggatttataaattatttaataaattaataatagaatttatattaaatgttcattaatttacaagtaaagttaaatgtgggaaataaaatttcctaaatataaagcatggttggatttaatttttattaaattctccatggttaattatactctctggaatattctcggatttttcggagctcaattcctaattttaatcatacaaagagcatttcagtaattacccacatattaaattaatcattaaatggtctaattgtaatttgttaagtactttgagtgtccaagtattttcaggattttctt

SEQ ID NO: 33467 - DNA, 4319 bp, Oryza sativa
aaggatgagctgtcagttatgttgatctctcatgactatgttgattttcagcagctggttgacaaagcaattcgacttgaagacaagaagaacaggatggataaccgtaaaaggaaaatgactgtatcccaggaggcacaaggtagtagccagaggcagcgtatcaagccactccaaattagtgaatcttcttccgctggtcaaggacaatcgcaacagttgaacatcggtggtgagatcaaatcagagactaatgaaagcaatgaagttaacatcgagcaagcaaatcagccggtgctagttcagcaggatcagtcgaataacagtagtggaagggagcagcaggtatgtttcaactgttacaagccaggccactttgcaagagagtgtccgaagccgaagcatccgcagtcgcaaggtcaagtcaacaacattgtcgtcacaggagccaatgcagtgccagttgcgtcttcaagagttgcgtcttcaagtgttacaactcagccaccagtttcaaagcggcagtagttttctttaaagccttagaataattatcggagttatggaataagatagactgcagtttacctatgcctttttctttctagccgttccgaatctcgggacgagattctttgtaaggggggtagatttgtcacatcctgattttcgtttcaggatttataaattatttaataaattaataatagaatttatattaaatgttcattaatttacaagtaaagttaaatgtgggaaataaaatttcctaaatataaagcatggttggatttaatttttattaaattctccatggttaattatactctctggaatattctcggatttttcggagctcaattcctaattttaatcatacaaagagcatttcagtaattacccacatattaaattaatcattaaatggtctaattgtaattttgttaagtactttgagtgtccaagtattttcaggattttcttgaaattatttgagcattggaagtatttttaacaattcaaaaatcatttcagtgattaatttaattggaaaagtatttaaaatccccttctccttttcgggccgaaataggaaaagttcagcttcagtcctcggcccattctcctttcctttcggctggccttatccctcctccaaagtctgctttgtgtccctctttcaatcgggccaagaagtagaagcccagccaaaagtctagtttgcctccctgctacagtgtcatcttcaatctccagccggctggagacacagccgagccgtgcatgccgagcccgagccgccccttttctccctcaaatccgcatccaatccggccctttttcttccggatttttgaggggttttgatcctctcgtcctcctctatctttcccctcaagaatcggagcaaatggttgagtatattgctcgaatcaaactcgttttcgggtttatctccaaaaccgagtttttgatttctcggatcgatttcttgcgggaggagtccgatctcttcaatccaaggctataaataggaccctctagtcctcctctttcgtttgccccttttcccgagctctctagtgccccgtagcctcgtcgccgcgtcgtccaactcgccgccgccgccggccgagcttcggcgaggtcgcgccgccgcccttgccgtcgccgccgcttgccgccgccgccaagaggtgcgccgaggagagaggaagcccggccgcccgtccttcttcgccgccggtcgccgtagctcgccgccgtcggtcaacccgagccgccgcccgttccccgtcgttgccggccgtcgtcggacgtcgtttgtcgttgtggtgagtaccgttgggttcgtctcgtcgtcctctacgtgtacatgccctccaaatccgcagccggccgctctatctccggcgaggtcgtcatcgtggttcggccgccatcatcatccttcctttttcccttttttctaatagattaaatcttcggaaaatcataactaaataaccgtagatccgtttcaggtggttcaagttgctaaattcatctaaaatcatgatctacatgtttgtttactttatatgtattgtttatttggtttttattagtctttttcttcgttttgcgtgttagcttgtcgtttccgtcgttgcgaaggttcgtgagtgcgtcaggagtgttaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggtcaatcgtgattggttaattaattacttgccaactaaaacttgataatggtgggttgtgagcacatggttttgagagtcgtgctcatgacaattaaggaccggttcgcgagctactgttgtgaaacatttatcgtgccaaccacaagtcagcgtgggcaacggctttatcttttgtatagcgtgattcattatagtgcgccagactgagaagtggcgagaagtccacgggggtcgctggggagtccatgcctctggtttttgagggggtgattatgatccaggaaaggtgcgctgtaatggattatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttatacttggtaataatttgtttagctcctggtttggagttagatctgtacagccgggtatggttgttcaggatggttgggcctgtgcagcatgggtgtgctgttcagtgttgattaaaatttctgattaattactccactattttacttctcttaaatgttttgctaaatgctgattttgcaaatgagcctatattatgccatcctttggtatccttgtgcacttgcatatttgctgtgtggcttgttgagtatgtcatatgctcattcttgcaataatcaatcaacctcagttgaagataaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgcacaaataaagttcagaaattactagtgaatttccgggcgtgacaagttggtatcagagccatcttgactgtaggataagccaaatggtcaaaccttaaggactaattttccgaaaacataatttgtgaaaattttcctttctttcttatctagaattctttgcaaatcgttttgtcattcttcccccttcctctttcaacttgagtagtcgttaatcttgatggagaaactcgaagacgtcgatgttgtcaacttctgcaagtcaagtggatcgaggaataagaagatgatagtcgaatcttaagtgttcagatagagtgaagtttggaacctatcttagaacctatgccgccaaagtgtctttgaagaatagttagtagggtagaacgtttgttgtttgctttgtgtgtaggtatggttgcattcccatcattagagaagttcattgatgagtgtgtgactatactaggttgcttgcttaatcaacttgaacaatataatggtctacacacatcagatcagtgttaacctggttaaggtcttgtctttagtgtaacccctctccttctaccttttctaatctgcatcagaatggtgggatcatttccggatgaacagagcagaacgacaaccaatcacttgggaagagtttaccgaaggattcaagaagacacacgtacctgtaggagttgttgctttgaagaagcgtgagtttagggctttgaagcacaaggatcgtaccgtggcagagtatcttcatgagttcaat

SEQ ID NO: 33468 - DNA, 17509 bp, Oryza sativa
  unsure (1)..(17509): unsure at all n locations
caaatgagcctatattatgccatcctttggtatccttgtgcacttgcatatttgctgtgtggcttgttgagtatgtcatatgctcattcttgcaataatcaatcaacctcagttgaagataaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgcacaaataaagttcagaaattactagtgaatttccgggcgtgacaagttgaatagattacacctgtgatcagagtataatctattcgaatagccgcgccctcggttatgggcaagccgagcaatatacccaagttagtggttttaattcttaaaacctgcttaacaagtaaaatgtggaatggttggcctgggttggcttgggacgagctgggacccagggtcgggttgccagtttggtctgaatcatcgtaggccttgggttaaggcaggttcgtgtgggttcacggccttgattaataatattgtatagctctaggatcgtatttacaaaatagctttgagcaactaagtgtcttttgatgctgtttactgcaaaccctaaccctttatattataaccctcttgtactcccttgcatttattctgcacttgtgggtgtgtcttgttgagtacggtggttgtactcagtcttgctcaatttttcccaatcccagaagaggagcccctggatgatgaaggctttggtgtctagctcgtgcctgccgtcaagcgcctgtggtcgtcgccctagtcttccgctgttttccgtttgtctttgtgtgtgctgggccttcgctgcccatgtaataaattaactatttacgcttccgcttgttaaactctgaactgtatcaacttttggtgtaccttacttcctgggacaaggaataatgcacgcacgtaaggaacgcccgttgggttatttccggtcgtgacaatcactatgagagcctcattgtgcagcgtgtccttagcgcacaaatggagaaggcggagcaaaatcagcgacacacattgttccaaacaaagtgtgtcatcaaagagcattgttgccgcatgatcattgatggaggtagctgcaacaaattggctagcagcgagatggtggagaagcttgcacttagcacaaaaccgcacccacatccatactacatcccttacctctcatcttcatccaatcgagttatcgcttacctctcatcgaaagatcaggccacaaaccctagcgggttcgcatcaaggtatgacagttattggaaggagaattgtcggaaatgccccccaatcgccatcaggaacgcatctgggacgtctatgccaaaccacaggatcaacggtggagatatgggttcggctgtgtcaaggggtgaccatctctagcaggaggctgtgaggcacccctttgagagttcgaccgggggcagcgggtgagattcgaggatttggtgagcgaaactgtgtgtgatcttgatctcggaggctcctccaagacgatgagacaaaagagatttatacaggttcgagcctctatgaagcgtaataccctactcctgtgtgtatgattcttctgtgcttagaaagtccctgaatccctggtatgcaagctagggttagacaagctttagctcagggatcctccgtccgatcccccctcctcgctaggcatggtcctccttttatactctaaggggataccacatgtgctgcgagtgctacctaggtagacgacaggcctgacaggtgggccccacctgtcagcggcagcgagcgcgcgcgcgggctcggctagacttgggccgacttgggccgaggaggagagagagagggttttgggccgactttcggcccaaagccaagagaggattttaaaaacctttttcgatttaaattattcattaaatgcaattccatttattaaaaatactttcttagctcaaataaatcccagaaaaatctaggaattatagagttaagtaaagtatttaatgaaattttatctggccccattttatattggaatttattaattaaaattagatcttctcttctaggcttttaaaataaattctaataattccaattaaacaacaatttatatatttaggatttttagggtgtgacaaattacatgtcttgtgcctaagcccagaagctatctgcacgtcggttgctgcgcggggcccataaaatcatgcagggcgcccttgtcattcatcatttaacagatgaggacttctgggttctcgttcacaccagaaaaagggaacccgggttagttcagattggttggaccagctctgaccggggtaagaggctgtgaagcccctcatcattatgatgggacgggacggagcacgccgctcgccgcctgacacactgatagggcggggttacacagtcgccgtccaatcggtcattccaccggtcacagaccggtcagatgagcagcacgccgcattaaatgtggcatggcgcggttgcatagaccgctttaaatgcagttaggtgggcgttaggcgcgcccacctaaccctgtacaagtgagctgatacgtggaggggttcggggcagctcgaccccaagcgagggcggcctcctccctctagcttggagtagccgccacaacaccccgggctcgaccctcctcggggagagccacgtgggtttgagggcggcccgaccccaagctgggagggggcaaccgccacaacaccccgggctcgaccctcctcagggagagccacgtgggtttgagggcggcctcctccctctagctgggtgggggtagccaccgctccaccccgggcttgatcccccctcgtagggagccacgtgggtttggtggcggcctcctccctctagatgtgatacccccgggcccatatatccgacagtagcccccggcgttagccctgaccaaaaccttcccccggtggccagggttgacgccactctcctagtctaacgatgtgggcccggtctcttctccattctttgttggcactagggcccatgcgcctttttcgccccaacttgagggagactcgctgtcccgtaccttaggttgtgaacttattttttgtatatattcagcaaacgttgttagattctctcgggcccgcgacatcatgctacgcacctcacttgcccctgccttttgttaacctctgttcatgttctacttcatctattcaaacgattatttttgcgtgagtgtgaggactgaaccttccatagccagcaatcctcacccgcgatcaagccaagctgggtgccatagccagccggcggggccaaagccagctgctacgggagagccagcacagggggcgtcgatggcgtccagagctcgacacggggctaggatagagctaggaatcatagcccccacacttttagcaaagaatcatttgaatgggtgaagtgaatacaaactttttgttaccaaggggggcaaacgagcgtgcgacacgtgggaatcatgggaccgcgaggaagagatgggtgagagataaatataagccatgataattttgctaataagcatgaataaaaaagatatgtacttaaaggaagtattacaaatgttgtgctcaaaaagagtacccgggcaacgctgagctttcccagagtggtttgctttggtccgggtattgtaacacctcctttgttaccgttgtttatccttatttacatgtcgcgacctttcaaacctttggctcgaagagggctccccaccctgggtttcgaaccctttagggaagcctgcgaccacttagaaaacgaggtcaagctcccatgagcctgcgccctaacactacatattttgttcgctctttcctttcggtggcctccttccaatctctcttccttcttcatggacgattactttcgcacgagtttgagagccgaaaaattctagagccagcaatccccgtccacatttgtgccgggccgagtaccgtagccagccggcgggtccaaagccagccgctacggaagagccagcacagggggtcccgggcttcgacggctcccggagctcaacttaaggctaggataagactagaagacttagcccccacacttagcgaagaatcgttcatgaagatgggagagaggttgggctcttaccaccgaggggccaaacaagtgcgcaacacgcgagcgtcgtaggtccatgagaatagaatggggggaaattaaatataagattttaagctaatgaattgaaaaattgaaaatacttgaagcttgaaaggacgatcagttgagccagcccgggcactgtagccagccggcaggactaaagccagccgctacagaagagccagcacaggggtcccgggcttcgacggcacccggagctcaaaactgcaagagtcctcccaagagtgaaccgaggtggcagcaggttcatgggctaaccccgcgcttggcccctgagggccatggggaagacgttcgccatgacccggtaaccacttcccgccgcctctatgatcgccgtgcagatctggagggactcggaggggtcagcgccatcgtcgtacttctcggtgaggcagggctggagctttgggggtcctcagacattccgaagacacgccataaagacctggtagccaagcttacctggtggggatgtgggggaccttgcccccagcctggggtggcgcgacactcctgaggatgctgtgccttccgccgtagcggcggcgcgacactcaccacgccggcgctcaaaagaacctcaaaaattacgaacgcgccccctacctggcgcgccagctgtcgaggggtgaccctctctagcgggaggctgtgaggcccccctttgagaattcgaccgggggcagcgggtgagattcgaggatttggtgagcgaaactgtgtgtgatcttgatctcggaggctcctccaagacgatgagacaaaagaggtttatacaggttcgggccgctatgaagcgtaataccctactcctttgtgtatgattcttctgtgcttagaaagtccctgaatccctggtatgcaagctagggttagacaagctttggctcagggatcctccgtccgatcccgcctcctcactaggcatggtcctccttttatactctaaggggataccacatgtgctgcgagtgctacctagggagaagggaaaatattctctatatcaattacatgtcttgtgccttagcccagaagctatctgcacatcggttgctgcgcagggcccatcaaatcatgcagggcacccttgtcattcgccatttaatggatgaggacttccgggttctcattcacaccagaaaacgggaactcgggtcagttcagagtggttggaccagctctgaccggggtaagaggctgtgaagcccctcatcattatgatgggacgggacggagcacgccgctcgccgcatgacacactgacagggcgggggtacacagtcgccgtcccatcggtcattcaaccggtcacagaccggtcagatgcgcatcacgccgcattaaatgtggcatggcgcgattgcatagaccgctttaaatgcagttaggtgggcgttaggcaagcccacctaaccctgtacaagtgggctgatacgtggagggtgtcggggcaactcgaccccaagcgagggcggcctcctccctctagcttggaggggacactcgccacgccaccccgggctctacccccctcggggggagccacgtgggtttgggggtggcccgaccccaagctaggaaggggcagccgccgcaacccccgggctcgacccccctcggggagaggtacgtgggtttgagggtggcctcctccctctagctgggagggggtagccaccgctccacgccgggcttgatcccccctcgcggggagccacgtgggtttgggggtagcccgaccccaagctaggagggagtagccgccacaacaccccgggctcgaccctccttggggagagccacgtgggtttgagggcggcctcctccctctagctaggagggggtagcgaccgctcgacgccaggctttatgccccctcgcgaggagccacgtgggtttgggggcggcccgaccccaagctgggagggggcagccgccacaacaccccgggctcaaccctcctcagggagagccacgtgggtttgagggcggcctcctccctctagctgggtgggggtagccaccgctccaccccgggcttgatcccccctcgtggggagccacgtagatttgggggcggcctcctccctctaggcctgatacccccgagaccatatcaccgacagtagcccctagcgttagccctgaccaaaaccatcccctggtggccagggttgacgccactctcctagtctaacgatttgggcccgatctcttctccattctttgctggcactagggcccatgcgcctttttcgccccaacttgagggcgactcgccgtcccgtaccttaggttgtgaacttattttttgtatatattcatcaaacattgttagattctctcgggcccgcgacttcatgctgcgcacctcgcttgcccctgccttttgttaacctctgttcatgttctacttcatctattcaaacgattatttttgcgtgagtgtgaggactgaactttcatagccatcaatcctcacccgcgatcaagccaagctgggtgccatagccagccggcagggccaaagccagctgctacgggagagccagcacaaggggccctgggcgtcgatggcatccagagctcgacacagggctaggatagagctaggaatcgtagcccccacacttttagcaaagaatcatttgaatgggtgaagtgaatacaaactttttgttaccgaggggggcaaacgagcgtgcgacacgtgggaatcgttggaccgcgaggaagagatgggtgagagataaaaataagccatgataattttgctgataagcatgaataaagaagatatatacttaaaggaagtattacaaatgctatgctcaaaaagagtccccggccaacgctgagctttcccagagtggtttgctttggtccgggtattgtaacacctcctttgttacctttgtttatccttgtttacacgtcgcgacctttcaaacctttggctcgaagagggctccccaccctgggcttcgaaccctttagggaagcctgcgaccacttagcaaacaaggtcaagctccaatgagcctgcgccccaatgctacacattttgttcgctctttcgtttcggtggcctccttcctatctctcttccttcttcatggacgattactttcgcacgaatttgagagccgaaaatttctagagccagcaatccccgttcacaattgatccgggccgggcaccgtagccagccggcgggtccaaagccagctgctacagaacagccagcacagggggtcccaggcttcgacggctcccggagctcaacttaaggctaggataaggctagaagacttaggccccacacttagcgaagaatcgttcatgtagatgggagagaggttgggctcttaccactgaggggccaaacaaatgcgcaacacgcgagcgtcgcagggccatgagaatagagtggagggaaattaaatataagattttaagctaatgaattgaaaaattgaaaatacttgaagcttgaaaagacgattagttgagccaggccgggcactgtagccagccggcgggaccaaagccagccgctacagaagagccagcacaggggtccctagcttcgatggcacccggagcttaaaactgcaagagtcctcccaggagtgaaccgaggcggcagcaggttcatgggccaaccccgcgcttcgcccctgagggccgtggggaagacgttcgccatgacccggtcgccaccccccgccgtctctatgatcgccgtgcaaataaatgatgaactttgttgaacatcttaaaattattgtgcaagacatgtgattatgtaacactgatgtttatatttatgtatatatttgttatgcttatgtaaaaaattgctaaatatataattgttccaagtaactcggttttgctggttatgattcttaccacttgaatatgttatgtgaaatatgtgaataatatgaatgttatgtgcatggatgtgtaaaatatgtgaatggcatatgtgtatgtgaatgaggatactggggatgtgtatgtgctgggggatgctggggaatatatctatttctgtctttatgcagcgggcatggctagcaaaggcccgaggctagccaaaaagaaaaaaaatattttttttgtgggatatactcatcggtgacgggctttaacttatagcctgattgagttataatcattcgtgacgggcataagtcaaagcccgattgagttatagtcatccgtgacgggctttggttaaagcccagttgagattaaagtcatcagtgacgggcgctagttgaggcctgattaagattagatcttccatgacgggcccttgtttgactggtcgtctgggtcaaagctatcggtgaagggctttagtttaggcccaattgagataacttcatccatgatggccatatgcccgatagagatgatttctcacattagtaacctttacgccgtgacgggcaccatacccgacacagatgggggttgacgcctgattgagatgtgggtgaccgttgtagtgctagcactaggatttgctcatgatcgagctgccccggtgctcatgaacgagtccaggttgttggtccccaatgtctatgctaccatttggccctatagaggattaattcatctctagttagagtttcaactttcaagtggagttgatccagcttgcttctcagctcaatggtgaccatgtactcaacacctacccagatattggcaggactatgactgtggatgaagcaaaccgctatgcagagtatgctgttgctagatttttggaagctagcaggatttctctaagagctcgtgcaaatgaatctgctttggtcaccatgaggcctgcactcaccagcagagcctcaccatcctctgatttatcatctgaactctgatggattgttctgagatttaaccacaattctgcataatgatttgcaccgcatcagcttttggtcgataagaactcatataatgtgctaagcaaacataggtaggttggtgtactacaaagtgtgctagcattatgtaattgttagatcttaaacatggcattatacatagacatcatggtacttcatatctcaagcttttacttcagctgtccactgataaggctgagatatcagctcagaagtatctgataatacctacgtcgcagtacaccttagctgctccgccgccagacaatggcggtacccgaccattctcatctcgccatagctgcttgaaaatgccaagtgcgacatcgtctggccaaccaacttctccaacaccattagcctctccaatggcggcggcagcggcacaacggacagatggaggagcacggtggtgcttggttgccgggttgaaggagcacacgcagacgggttccatcctacttaccgtccgccaccggtctctagggccgccaccaccgctctgccttgaaggttgtcctccaatacacgttggaggcgccagccaatgctccgcttgaggccgtgttgtcgctctgccatgaggtcaggccatcgcacaagccggggagggagagagataggtgaagagaggtaagggtcactgataagtaggccccaccatatgccacgtcaacgaaaccgggggaaattttggtccatactgccaagggacttactatgcatggtttctaataattgaggggtagagattgctggtattggggattagggatgtaatacatactcgatgtaaagttgagagatgtcagatgaacttattccgtttataaatgtgttgattgcaaataaagttgcattctaattataaaatgcgtaccaacttgattgtgaaacaccttgaaattgttattcatattccttgttgcctgagtttattctttattgcgtggtcaattattgacattgcttaacattgcttatttagatgattttacacttgacatttggtatatggatgtgaatacaatgatcactaattgtgagtgattgtcggaggacggctggagacatgagcgccatccgcaacaaaaaaaaatcattattgtaaccaaaaacttaataaaacaaaataattttgattggggcggtatggatagaatatgggtggttctatgaaacgacaagccttcgaccaaggtcagttaaggactgagtcaagaagctatgcaggaaatgaaccaagtacgaccacatttctagaatgggtatagacccggtggactaagtaacccgagtaggggggcacctttcatggtagttctacagttattactgttgtgcggaagatgtgttggaaaaattaaacatcatgaagatatattatgtaatccccatagtacctcagaaacgccaagtagggttgggcgctagggtgcaatggggatccaatagtccttggagagggtgccgcaatgcgagggtgaccgaaaaactgggacgtgacaagtctcatgtgttgggtgcgtcacgaagggattaaaagcatacatccactacagtgtgagtaaacaaatatatccgaatcgccatgctcgtggttaattgagcgttgggtcttgtactactcttgactagcctcatatgttttaatcttgcttagaataggattgagagggaatgtgtgaccttgctcgatgtgcgggaaggtcggattgatcaagaatgtggaaaactggatgcgagggtaaaccggaccaaacgacaacctcaacttaaagttgttttcaattaaaactgctaagccacaagtttgtgaaatgaattgtgaagtgtcgctttatgaaaataaaccaagccatccttgaaaccctgtgtacactaatgcattatgtagtagtggcttgctgagtacgttggtactcacttttgcttaattaattcctttagaagaaggtgttggagtcgacccatacctgtgccatgctaacgagcaggtgccgaagacggtgaagtagggacctaggttcaccagtcgctgcctgtggaataagatgggccgtcgctgtttcgtttccgctaccttatctacctcttttgatatttggtattgtaattgaccatgcttggtctatttaggtcccactctggctacccttgtattattaatgtattgtaaaacttttataacgatgtcagctatgtgacatgtaactttgtcatgtgtgtatcatctattgatcaagagaatggtattgtaaacacatggggattctgatgtataaaaccgagggcccacaaaattgcaatacacgctgaacgacttagaaggggttggtagacaagctaaaactcgattgtttgggacatataatttcatatagtttatctatgcgacttcttaactctcttatgttgggtatatgcgtcacgaatggtttgtgttggtatgtgtctcacgaatcaaaaaccgatggttcagttccttttccattaataaagttgctttctcctcccgctgcaatgtcttccttctccttgcattctttctactccatcttcctacgttttccctccaactagcattcaggtttgtagcgacgttcaaattgctctcagtacgacgtcaaccgatggtgcattatgaggcaaaattgtaggaaagacacaaaaccaacaagggcaatgaaaataatgaaaaaatattcctaacaatatcgatcttccatcaaaagtattcaattcttacccccatttttcaaactttttaataaacaaaactcacgcagctacgggtaataaatcgccctaccataaggcaggccatataaattgtcctacggtaaggtgatttaaactcatctaaccactgtccactgctcgatgttgcattagccatgttcgtgttatttttctctacttctattcaaatctcaataaattttggaagcacaacatgtccatctcgattatgatatagttcgcacattctgttgctcgctgttgctgctctcgttgatgtgttgcttagtggcaaaacagaaatgcgaatttacctttatatgcaactgtttacaccaaaaggggaaaaaaacgggtaccttgcaaaaaggagtataactttgcagtttcaagtcccacttcaactacaacccaatctgcattacaggatgggagtctaaaacgactgcagtttcagcgtttttgaggcctgcagagacactgggctcgcgttgcagcaaaagattaggcggcggcgcccacggtggcgccggcggtgagcctcgacgagccgtagagagtctcctcgaaccggatgatctcgttcttggaaccgtaggccacttgagtccgctcgtcgaggttgttgatcaccttgtccagcaccgactgtttgccgtcgctgctgtacccgccggctttctctatcaagaaacccaacggcgccacctcgaacaggagcctcagcttggccttggctgtcggagacgtcacgttggtgaagatgcccttctccttaactatgatctgcatcataaaagatcccatcaaggtaggcatctcatatttctcgtagcaattctgcattcaatttaccggattttgtgacagttctgaactaattaatgacatggctttaggagttccatattagtgggttttgtatgctgatgtcttaaagccaggatgacgtaaacgtttattttattttttttggcagagatttaatatagtaattaggcacatttttggtttaacacatggttctgacagttgcagattttgtggtaagtacctggttgacatcaggaaccattcctccagtgtaacgcaatgtgtacttctccttgacatagtagttgatgagctgagaaggtacattttgcagtcattagacccatgaaaagcaaaaacttcttgacaaatatgatgagaccagtaccaaaagagttgtaccttgtcatattcaggattatcaaatgtagccctcaggttaccaggagagaacattttcccctctccaatggttgtggtgtccttgacatgctgccattttcctgcaatattggttggaagtctgaatacaggttgtatacttagaataacttaattggtagttccaattgttggaacgcggagcaaccttcatcaagaagaaggaattcatgagttccaggacaatctttgagagcgataatgtaagtagtgcgagggccatagatgcccatggcagcagcaacttggtctccaccggtgacgcctgtcagcttgtcaccaggccagacaccaaatatggttccaactgtgaagttcgtgtcgacaatgctggacccatcaagagggtcgaatgctacactgaaaccacctgcaagatgacagcaagacagaaaattcagaggacacgaatctgcagaaggcaaatttttggtatcctttaaatgttttgtaacaccagtttaaacacattttagcaaaattgaattgcaagataaagtgcttaaaacttggggaaggtggtgatgtggtgagttttccccttgctctgcattaagtatataatctctaatagaattgtgcttcattgaaatattatattatttgcacagataaataatcgttcatatatatccaacattgttttcggtttgtgggggaggatggattaccatcgactggtccacccatgtcttgcagctccgggacttcctcggagcacgcatacttgcagacatgagagtattccagagcctacatggagtggtacgttgtacaaataagtcaagtgcaaaagcatgatgcgatatatgcgtcatatagcatacccggatgaatgaatgaataaccattgcaaacttctaagcacctcgaagaggagcttgtcggcgagcatatcgacggcgagctgctcgtcaccgaaggagttgacgcaggcggtgccgccgcacgacgccgtcctgaccttgaacgagatcgtcctcatcgcctcccccatgcagatgagcagcctgatgaggttcttatccggcgtcgccttggtcaggaactcctcctagcaccatagtcagttagtcacacacacatcagcgtaatcttcacatggcatgtgacacacacagttgcacaacttgtatacgcgtgcacgcaccaggctgtccccgatctcgcaccgggtgctgagcgccgcccggctcgccgccttggactgcctcccagacggcagcgacctcgccgtgttaacccgcagcgactcgccgtagaacgtgctcggcggtctagcggccttccatggcattgcaaacacatacgattaatttatgtcaccgcgttgctacatgcaaagtgcaggctatggcaagtggccggccgtgtttccataccttgggcctgtaggactgcgagaaggacatggcggcgcagcacgctggcgagcgcgtcgccgccccgcgggtgtagctggccgcggccaccgtctccatggccggcctagctagttagttaattcgcaggggtgacgccgccggacgagaaaacttaatggcgagggaaagagaggggcaggcagttgctgagcttgatagtgtacaagtttccgtagtacgtttttacgttgccaggcaaagctgctgcggggtgcaccaagcccgggctcgcggatttgggaggacactgggactggaccagataagtcgtgcgacggggtgaagccatgtggcgctggagaagatagagcgtcatggatgcaccacgaccatccgtggtttgtgtggccctgcggggaggatcgctcaaccgctcaggtctgatcacaagttcagcaactgtaaactggactactatctattgggttcgtccgtagcatcagcaacacagtgccatttgcagtttaggtcgggggatgggtacacttcacacactgtgctgtgtaggggtgtgttaattcgcaagtgcaggatttgaacccatcctcctgcacgcaaaacggagcagccttttaacacatgattaattaagtattagctatttatttttcaagaatagattaatttgattttttaagcaactttcgtataaatttttttttgcaaaaaccacgccgtttaatagtttgaaaagcatacgcgtggaaaatgagggagaggggttgggaacatggggttgcaaacacaaccacatgtgaagcagcagacagtcgggcccgcatgttagatccgcacttggactggagagcagagcatcgcacacaaccgccaacgcagccgtcagcgagctcggccaggagcagaccatcgctgacgagttcgatccgtaccatgccagctgtagaccccgattcggagcttgttgccacagacagaccaagagcacgccgtcgacattctccatgagcaaatcgaagaagcaggtccgctgtgagggagatggaaagagagggatcagttccgctgtgtcgttgccgacctggaagtggaaccggcgtcctcgattcagagcactctactgccgtcgagcttctgtgtctggtggagtggtggatacctcatcgccgttgctgctttttcattgaacaatcagagatctgctgtttcgttgaacagacagcattcacaattttggagattgaactgtataggggtagagattattttttttatgaacatatatcattaggatgtactatgagttggatttttcataaaccatacagaatgagttgaacatagcagcctgaatgagtataagacacactatgacacaaactaaccactcatttatttttaccacctaacttcctcttacttggaaggcatggaaagtttcacatgccagatggcattatagtttcaagggacgttcatgaggatgagatgctggggaccggacattcataacaaactaaagaaaccttggcaagcgaataagacaggggttgtggagcaaggcagctgcaatgggcggaatctccaaatgtgggaggaggaggagctgcatcagcaactgttggctcaaaatccagggcaaacctaggtgcgtgcgatgaatggtgtcccaactaggagtgtccagcactggatcgaacaaacgggattagtaagagatggagccaggcatgggtgcgacgaaatcggcgatcaattgcttcaaatgtagccgtgatggccaccaccactcaacatgccctagcccacccctttgctatacatgtcacaatactgggcatctcattacactgtctgatgaaaatatgatgaaaagagatgttaaacagtgtggatttgggattcctcgtcaaggtttctatagtttgcacattgatattttagaggttgagttagctagaacttgagtgagggggatcctaatagtgaatcatggtgaggcttctatccagaaggtggttacatatctgagacacttatttgttggtttgaattgggatatgcaaggtgaaggtgaaccagtatccttattggaattggtctcattaatttcccttctgatgaggtgaggagtaagatttcagcatgtatgagctttcatttggagagtttttcaatcaaggtcaatgtagtggatcacttgtagcttgggaaaaggtttgtaagcctatgaaaaaagttacaatgggaatcattgatctcagggtacagaacaaagctttattacccaaacatttgtacaagttcaattacaaatgcccttatccttcggtgaatttgatttggactacatattactcctcttcagttccacatgctgccagattatgtggtcgaatttggtggaaagatataacgcaatttgatatcattttcaaaggcatgactaaacctattgtggacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33469 - DNA, 3565 bp, Oryza sativa
  unsure (1)..(3565): unsure at all n locations
ctactacctgataagaagaaatgtaagcctccaaatgtaactattaattgctccttttgtgccagcctgatactagatagaccggataacacctcttttttttttagtgagttcagtcagaactgttggacaaagattagttttcattggaacctaaaccaggagatccatgggatggttcaacagcgaaaaaaaaatctcttttggaggttcatattttatggatgtttttcggcttgctgcatggaatatttggaagcaacacaataagtatattttcaataatgtccaacactctataaagttgtagaagcgtgcactaaaggatgacctaagtctatatttaattatgcttagagtagttgatagatcttttattcaatcatggattgagaactttagggcatcagcaatttttaagaccctcttgtatcacaaggtggaaccaagtgggcccattctttatataatagcacttgttgtagtgtatgtgtgacaaaggtgatattgcacctaaataaaaaattcgttccactactcaactaccacatcccttcaatccccttatggtgcttttttattttgcctcaaatcccctctgatccccttccgtgtgagcgaatccaatcactgcaacgatgcttgtgagaggagcaggtgatggcggtgaccatcgtgggaggagcaggagatggcagcaacgctccgtggtgctggtggggagatcttctggcaacgacggcagtgctcgcgagcacgcgtggattcgacgagggtggctgcggcgacgctcgcggacgcattgggggtgacagcagcactcgcgggcacatccaacaatggtgacggatctgcaacagcggctgcgacagcactcaccgacagatctggtgggcatcatcacaagggtcttatcttcttcgagagatagcatgagagggaattgtgattatttttttatttcttatggatggttcttatgcataaggataactcatcctaagaacatctattaggactactcccatagtatataatgcccactttagaggtctaagatcctcccctgcgactacattaattgtaggtgccctaagattcacataccagaggggcttcccatactttttttaaggtaaaacaaaggccagtgtattgaaaactgggatggttgaagaagctgtagatgaacttgcggctatttaggtgaagatatatggcatcccgaaattggctagaactgaagatgcagtcaaatcaactgttgaattagtgggagaatttgaggatttatactgggccagcttgcgatgtaatggtccagtaagcgtgagggttgcttgtaaacatcccagggagctgcacttctcaaactatgttgtatatcaactgggttggttacttgattagattgtagaaagagctaccctacatatgagaatagacaaaaccaacctgttgatggcgatgacatggatgataaaaaggatgatggagaggaagacataatgtggagaggaatacaaagagcaaagtgctccaaggtggaggcaacctgaaaagagtgatgtccggtaggtgatggtaattcttatgatcatagagaaaatccgcaagcgcacggatatatcgatgtagcacttcccttacggagtattccaaagggtatcgaatccaagggaacgtgtgtggtcagatcttcctctggttcatccaaggacaccaagcaaaggataagccaggatagagaagatttacaggtgagaaacagtgtctagggaaagcttaagtttaatcctaacacaatacttcaggcactggcaacctgctgttcccaaatgtcgctctactgcatacccggacaaggaggacttaagtgatctcgagggctatcatcacctctacatctacctcaaacgtactatgggatacgcaacaattatttgataacaattacctaaacaccatgtctaagcaattaatatctactttagtgtttataactcaccaaatcaatcactatattttagttgattatagtgaacaataatcccgtaagctatttaggaactaacaaagagataattctcacaagataaatctaaattactcgggaagaatattatattgaaatcagagtaataaacagaataaaaaaatgatagaagattactgacaactctggaattcatccgacatcttctactctactctcttcctattctagtattcaatatagtacaatagagcctcttataattcagctcaagcttggaagtgtgtgtgtgaagtgagggagtgaagtctatttatagggcagttatgacggttgcgagaaggggaactgtccgaactgctccacaaccgtcatgaggagagcatctggagcatccacgccaaaccctaggatcaacggtgattggaggggtttggccgaacctgggctgggccctcccgacctggccttcggcctgtggactcccctaactctcctctgtccatttctcggaattttgggctgagtctttgatattttgatgacgttcacaacccatccttgtatggatacatgtttcttctcactttagtctagatttcctcccaactttgggggtcatcacttgcatacaaatgtacaccaacacttgtggaatatgtgagatttaacacctatcactatgttggatgttttattatctggactttatgcaaatgttggcggtatagaatcggcatttagcagccgccaacaaaaccccccacacttagctctttactcgtccctgagtaaaggttagtgtagaatgaatttctccaagatataattcaggcatataaatcattcacaaccatacctgcacctgtgaactttattagtagctacttaccatcttgagtaattgataaatggaacgatcttgattccagtccttcttgcttctcctgtcagactcatgggattttatgaattttcgcagaccaactcttttactcatattgactttctctcttatctctcaaagatatatattttcttgtggatgctcaccaaggcgaagtgtgccagagctaatccctattctaaggctgatatatggagctcggtagggataaatagtgatatacctacatcatatttattgcaaagccaaaaatatggactcaagaagatcatcagtcatactcctagatcaagggtgtttatttgtggtggaaaatggaaaagtaaaatattttgtggaatgatgaataaagaaatggctctccctttttcgtatactttctccattttttttctttgcataaatatggaagctttatttcttttttttctttcttcaatagccatgccttttccttcttttctcattttctttatgccaagggattttctaggagaagaaagcatagtctaaagtaggaatttatttgaatggattttttgtgggaagccaacttccggtgtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33470 - DNA, 710 bp, Oryza sativa
  unsure (1)..(710): unsure at all n locations
nnnnnnnnnnnnnnnnnnnnnnnnnnnnnnnnnnnctgatcctaagcatagttggtcgtggattcttggctacgttggaagccaagcctaccttgctcgatcaaatccgcgaggctcagaagaatgatccggatatgcgtggactcctcaagaatatgaaacagggtaaagccgctggtttcacagaggatgaacacggaaccctatggaacggaaatcgggtatgcgttccagacgacaaggaacttaaacagctaatacttcaggaagctcacgaaagtccttattccatccaccctggcagtacgaagatgtacttagacttgaaagagaaatactggtgggttagtatgaagcgggaaattgcagagttagtggccctttgtgatgtgtgccagcgtgtcaaggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33471 - DNA, 833 bp, Oryza sativa
tttggatcctctccatcgttcctgagtaaaacacgagtgcacgcgtctccggggtataaagaagaggaatatgaactcaagaaagaactcacctggtaatttagttgacgtgcacgagcgcgggtaataggaccatcatgctgtacttggggggacgtggatgtatcgatggtgttgatgtcctcatcatacctgccctttaaatagacttcacttccatcaattcacacacttccaatcttgagttgaattacaagatgctgtattgtactatttgtatactagaattaggaagagagtagagtagaagaagtcggtggaattctggagctgtcggtaatcctttcctgtttcttttattctgtttattactctaatattaataagaattatctttctgagtaatatagatttatcttgtgagaattacctcttggttagttcctaattagtatacgggattattgtttactataatcaactaatatatagtgattattttttttgaaagaaccacagtaggggaagcccccaccattaagattttatactaataaaggagaaaaaattacaacaaatttaaccactgtaacaatgtatctctctcagaatttttgattttatattaatagtgattattttagtgagttataaacactgaagtagatactaattccttagacatggtgtttaggtagttaatatctagtaattgcagcgtatcccagcgtatcccacagtacgtttgaggtgggtgtagaggtggtgacagccctcgagagcacttaagtcctccctgttcgggtacgtagtagagcgacatctaggaacag

SEQ ID NO: 33472 - DNA, 566 bp, Oryza sativa
tgttactcggtagaatgctcgcaaggtcggctagaaattggcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaaggcgtggcaagccaacgttaagctgttgagtcgttttaagtgtaattcggggcagaattggtaaagagagtcgtgtaaaatatcgagttcgcacattttgttgtctgattattgatttttggcgaaaccatttgatcatatgacaagatgtgtatctaccttaacttaatgattttgataaaaatcattaggggattcatcag

SEQ ID NO: 33473 - DNA, 490 bp, Oryza sativa
acattccaatgggtgtcatgaacgctgtccggtatgaccatagtgcatctggcagcttgtccttccatcctatgcccattttgttgaccgtcttctgtagaatatttttgatttgtttgtttgatgtttctgcttgaccgctggtctgaggatagtaaggtgtagcaacattgtgtttggcgcccatatctcgtaggaggtgtcggaaggtttcgtcgatgaagtgcaagcctccatcacttatgaccaatcttggggtgccaaatcttgggaagatgatttctaagaacatatttttatcatgcttcgcatccgcggcgctgcacagcttagcctcaacccacttagatacatagtcgactgccaccaagatatactcgcaattacgggactaaagaaaaggtcccataaagtcaataccccacacatcgaatatctcgacttgtaagttatatgtgaggggaattgcatcgcgagcagtgattcctcg

SEQ ID NO: 33474 - DNA, 1043 bp, Oryza sativa
catgcggtcctcctaaggagtcgcatgcgcccgtttaggaggaccgcatgcaaaaataagctccctcctctctagatcttttctgtctcaacactttgaaaattttcatccttatccccctctatctctatctctcaccttctcattcttatccacccacatcctctctctcattcatcatcctctctgcctttctcaactcctctcctctctctcactggtcgacagtgagaggtgagaggcgagtggtgggtggcctgggccctcggtgggcgagagcggtcgagagcggcggtagtgggctcagaagaggtatgtcgtgggcgggagcagccatgagagggctcgacggccggaggtcgcggatccagcccgggcggatccaccggaggcaggtgatggcgacggtgggatgggaccgagagcggcgggcgggagcggccagcgacgatggcatggatctagcgctgacggcccatccctacgcggatccggcatcaggggccctctctcacgaggatccggcactggcgacgttggagggtggtctgcgaggcggatctggcgcagaggacaaagtgacgtggggtggcaacgacgccgccccacgcggatctggctgacggcggcaggctagggttcggccggcggcggtctattgtccgcctgggtttttttcgaaaattagatttttgcatgtggttggctggccacatgaaaaatccgattttcgtagacttttttgtgcatgtggttgtgcatgtggtcgggatggctgcatgcaaatatcacttttgaccgcttgtaaaaatgatttttttagcagtgcacccttaaggccttaataatgacaaagaatcccggtgacacatcaacttcgattgtaaggctggaaacataagtatactaggtgatgtgaccatggctactatggatacgaccattgctcacatcatgaatcaacaagaagacatcaagatcaagtcctccatgtgctgcaatctgattcggccacgtgttacattgctgacttcaaacggccg

SEQ ID NO: 33475 - DNA, 719 bp, Oryza sativa
agggcgaattcgagctcggtacccgttttggcatggacatcccagatcactccctgatggcggttgcggggcagttcggacatttgcaatatcagattgcttttatcttgttcttgcttgtttcttcgatttgcttgcaggaatagggttgatctgcaccggcaagatcagcaacccacggagaggtgtatcgatcgctaaggcgcaacacaacgtctcgtacggttgtagtcggatcatcaacgtttctcccaaatcgtagttatcacaactcaccgaaagatcgggccaacaacagccttgagtgtcgagaggaactcagggttcatcactaggtgaaaccccgcgcattgttgtgggaatttagtatgataataataaaaaaataatgtgtaaaatagctagataacatcagattaagtaaataatgtggtttataataatttaaatttaaatagtatgtagaatggtgattcaaacgtaaaaagtaaggtggtatgacttcatggaagaagaaatgaagggagatagtttggaccttagattaatcatctaaaggataaaaacaattgatgtgatatgacttaattagaggaaacaatgagaaagataatttggaccataaattaatcatttaagcactactaagtgaggatgaactatataagtataaatgatatcataaaacataataaagatatacattaaaacattatgtg

SEQ ID NO: 33476 - DNA, 716 bp, Oryza sativa
  unsure (1)..(716): unsure at all n locations
nnnnnnnnnnnnnnnnnnnnnnnnnnnnnnnnnnnnnnnnnnnnnnnnnnnnnnnntgcggctttttttttctttttttttgcacctttctgcctttttttttcactttttttttgattttttttaacaaaaactgactcaaggcccttaatgtaagattacagggactcaaacataaatataaaatttacagggactcaaatgtaaaagtctaaacccaaaattaaaattatacaaaaaatggaatgctgaatttatgccggttccgtttttccaaacagatctcgaaaccgacaccaaacaaaaattcgccaaggtgtttgacacaactcggaaccgtggaagagagggagggagtcggactcggccaaaggggcgagtgggacttggccaggaggtggagtggatggcagccgaatttggtgtatgggataaaaaggaaactgatttttaaccaatccaatctactgtatctttccaaaacaatcttgactacttccaaaatcagatatggtaattcaccttcctcctctcgtgcacgacacaggcacggccaaaacaaacacacacaaggatcggcaaactctagatgcaactcaagaactccaaaactaaccgacagaaacttctggaaactacaaaaatagaaccgtggcagcgagccgattccgttttcgtaggtcccgacaacaacagagacacggtggcagcaacga

SEQ ID NO: 33477 - DNA, 572 bp, Oryza sativa
ttatacaccgactgtacctcataaagatactactcaagatgcggacactcatgacgtagctctggttgaagccgactggcgagagcccttcatacgatttttaacttctcaagagctccctcaagataaagatgaagccgagcggatttcaaggcggagcaaactttatgctatgcatgaagctgagttatataagaaaagcccttcaggaattctgcaacgctgcgtatctttagaggaagggagacaattgctgaaagacatacattctgggatatgcggaaaccatgctgctgcacgcaccattgtcggcaaagcttaccggcagggtttcttttggcctactgcagtgtccgacgccgacaaaattgtgcgcacgtgcgaaggttgccaatttttcgccagacaaattcacttaccagctcaagagttgcaaactatcccgctgtcttggccgtttgcggtttgggggctcgacatggttggcccgtttaaaaaggcagtcggcggttacacgcatctctttgtggccattgataagttttccaagtggattgaagctaacccggttg

SEQ ID NO: 33478 - DNA, 5876 bp, Oryza sativa
atcttagagttagagtttgttagagataagcgtcgtgtccggcaaggacatatcttgtattttgggtataaatatgacccaaacccatgtaatcaattaacaatcgttcaatacaatctcggcgcatcgccacccttttactttcgtttatttcgatgagttcttgctttcgggttgagctgcatcaaatcgatcttcaactagagataaagcttgttatggcggcttacgttctcggggttaatgcttccatctttatgacactttaaccctgtttatgtaatccgtcgagttatcatatacatgttgcaatctatgttagttgccctatataacttgttatcggctggttcttattgttaggaagcaatcggtagagttatgttttattgttaatctagattgtgtcgtgtatctaccatctcttatagattttcacatcttgcttagatctcatagttgtctttatgcttaatgctacatcggttgagttcgatctattgagtagtatttataattatgatatctggctggttttatgatcatctagagagatagtatcggggtttcagccgatcttacctgatttagtcttatgacttacatgcttaattgatatgctaaatagcttgtttttctataaaacccatcttgatttggccttttggctggatcgagatggttggcgactccatatcactgcaagacatttaggtgttgcgattgtgcttgtcgacctgtaaaaaaattgccaacacgatttttggtgactctgctgaggaagatatctattcggctttagaatagccgaatttgcaatctatctgtcagtgtttcgtcaagacgactgtgcggccgaaatcaatctgtacaaattatccactgctgttgcatattttcatcggatcaatttgtttggcggcagtactattcggtcgtcaagtgaaaatcaatataccacactaaatgttgctattgcttcatcgatttctcttctaatcaagtgtttcggccatatagccgaaatcgatctatattgttgcgtggaaacagcaacaagcggccggcagcatctttgctgtacacggtcagaaaattggaatctcaattctattcggtttgctgtgtacaaatttctaaaaaaaaaaaaagaagcaaaaaagatcaggctataccagagccgatctgttcagagtaggcaaaaccgagtctgtttccattagtgcatacattaggcaactgtgttacccaaaaaaaaaagaaagaaaaatcaaagccgatttacatcggctgtgaaaagttccaaatttttgctgctacacaaaattccttctgttacgtgtacacatcaagtataccaaggaaatttagagaccgtacattaatctattcggtcaacgattttggctatgagctatatggctaaaattaatcaagaaatttcttcatcaaccatgatgagcgggaacgagatcgataattaaggttacatcggaggatcttgatgaggagcaacgtcaagtcatggaggagcggatcaaggtgattacacaagagatgttgatgagatcatgcattaggacccgtcaaggtgtggttctcaagcctagtcctcctctcaaatttaaggtaacctccaattcacccaacccatctattgctattcaaaatgttaatgatcgttgtgtagatgcatctgctacttctagttttgcttctgtacagtatgcctataatgctatggagggatcaatgggtgtttatacaaccgattgcacaggaatcggctataagcagaacctatatgatggtgtaactggtcgtaacaccggtgtaaccgcatcctacgacggtcaggctgtgtctaccatggccggtcagactgtgtactaccatagccagtcagaccatgccctatcctggccagatcgggcctcctgtggccggtctgaccgtaccactgaccaccggtcagaccggaccatgggccgatcagacagggtgctcggctggtcagaacggactatctatagccggtcagaccggttccctggaaatttctccaggttttcataccacgactaccaatacttactttaattattactcatcacatgttagtactgttagtcatgctgctccacatatccataatgtttacaatgatcctaataggggatatcctcctgacactaggtatggccaatataatcatattgcgccgcaacaaccacctcttaggccactaaactcaccaccaaatccacataggcctgaaaatatggagaagttgattagtatcattattagggataaatttgggattaaagcaaggaatcgtgttagggtgtaccaaaagctgtatcctgattattatgacaatatctcgtatcctcgtggttatagagttcccaaatttaccaagtttagtggtgaggatagtaggaccacatgggagcatgtaggccaatttttagcgcaatgtagtgaggctagtagtacggatacatataaattgtgcttattttctttatctttgtccggtactgcttttacatggtttacttctttaccggcaaattctatttatacttgggctcaattagaacaaaaatttcatgattatttttgcactagtagaactgagcttaggttgtctgatttaacatcagttaggcacaaatacaattaatctattgctgattatattgagaggtttagagatattaaaagccgatgttatagtttgaatataactaaaaaggatttggcggacattgcatatgatgaattgcttgattctattcaagagagattgaatggccagatatttcttaatgttgatcatgtgttgcatgaagctctagctcaggaaagctgagtggatgacaatagcttaaatgctagtttagatgatagtgcagtatcatgcatagccgaaccaagcgatggtttggattgtgttaataatttgtgcaatgatgccgtaacgagtatagccgaactaagtgttggttcggattgtattgctggtttagacaatgacaccattgagagtataaccgaactaaatgacggtttggattgtatcacaagcgaaagtgaaatagcattgtcacctaataccgaatcacaaatcgatcatgtggatgttggaaaagatgatgacagtgtcttgcgggacagtagtgaaatagaatccaaagtacctatgcatacatatcaaaggccgtatcctgaacatgtagatttggtcccatacctgcaaggatttgaggtgcccaacttcacaaaattcacatgtgagaatgctatgactacaatggagcatatcggccgctttattgatcaatgtggtaaggacggtagtaatgatttgtttaagttgaagttgtttcccctttctttgtcaaactttgcatctacatggtatagtttatttgctcctaattcaatttctacatggtcacaaatgaagcatgagtttcataattatttcaaagatgcaagcttgatggagcaaagaccgattgatgattcatcggtcacttgtgaaactattccggttacacctatgcctaagaccagaattgttagtaatcctctccctattagtcctattgattctgacaacaaagaagtgttgattcggcctagtcaagccgaatccacgaaagggaaaaatgttattattagggatcctcggcccgagacaattaggatcaatgatgctaaggccaaagattgtagagttacaaaagataaatcatctagttcccaaaagactaaaaagccgaagctcacttttgagatgcttatggctaagtacgagaaaggattagcgagtcaacgatttcataatcaaattagtgattcaaaaagaccaagatcatctcgcaggaagagatttggtcaatcaccaaagcaatcgaagccatcaattataccaactccatacaaacttccggttgtgatgccatcgtatccatatccaatctcactatatggttatccttttatgtattacatgccgtggatgcatcaaccacctatgcagtattatcaagagtggaaggaatcacctaggtcagtaccaactaattcatctaattcaagacaagaccgtttctcacaaaagaatcggtccggtggatcaaaggtgaaaaaagggaagaaggtatgggtgaggaaagaagccaaagctccggaggtcgtttctatcaaggaagagtttcaagatgttgaagtacgtactggagatgcggtggaaaccatacaagcaaaggagattgaagccaacaccgtgattgtcaaaagcggaggtctgaccgaggcgtctggccggtctgaccgccaacctatggtcagtctggccgaccctactggccggtctgaccgggcctagaggccggtctgactggggggcattggagaagagtgggaaaattgagagcaacacaggagctcccacttcgattaaaaatatcaagaatcatcatttgactcttggaagacaaccacagccgaagtggataccttccggattatctcgctctcaaaagaggaggctacagtgtcttcgagccatagttcaaaaagaaaaggaggccatagatgtagagaacaaaacatgtaacaatttagagcctcgaaagacacttaagtgagtatggagacctaaagaagtaaaagttaaaagaccggtgatttcccatagtagtgataaatccaatttcatgagagaagaatcatcgatcattagagataagtctccttcacatgatgctatgggtctaagtgcggtatccatcttgccttcgaaatcacgcaatctagaaagccgattttgcttggggggtaagacattaatatgctcatgaagaaatcaagagagatgaacggcgatggatacaacatcacatctttgagccgtcgttcgttggatgctaaggcaaggtatgggtttatggtgttcatcgttatattatatgcctatgccatgttagaacattgcttgatatttagcacatgtgtgtttttctcttatcaaattgatattatgcatacatgttgcaaatacctgttctaagtagtggaattgctaagtctgcatataatttgttcaaaatatgatttaggtcttgagtctttgatatttatttaaagccaaatcacatgtgtttttatggatcaccatataatatatagatttcatatttattgcaccatgaaggttttgcttattagtaattcggcaaatgtcaatggtcaatttgatgatttgttctagagttgttttctttagggacattggccttgttaatattttgcatacatgctcaagtcgattacttccatttgtagtttattggaatctatgcatgtgtcacatatgactttggtcattcattattgatcatatttcaattgggtaagtgttttgatgccatgttgattattgtttcaaaagccacttgaattagtattcatctagacatatccgttggatgttgtaatttttcatatgtctagaaagaataaattttggtccaataatttgatacaccaagcatctgggtgtaatatgaagaaaggagtatttttgatactagaaaagtcggtgcttgattttaaatctttgggcaacattggcagaatcacagaccaagggcgatctgaccggcattgcacggccggtctgaccggctctgcatggccggtctgaccaggcagatggggcagtctgaccggcattgcatggccggtctgaccaatcctagacagaaagctggggggcacaaaacaattgatttagaggccgaatttgttgtaaattcggacatttgtgcccaagagttagaagaaagcgggtgaat

SEQ ID NO: 33479 - DNA, 2003 bp, Oryza sativa
attgcttaggagagcggggtttcattggccgaaaataattgatgattgtttctagtgctacagagggagtgaagcttgtcaacggatcggcaatgttcaattggcgcatgccgctgtattgaatcctatcatcaaaccatagccgttccgaggttgggctttggatttcattggtcaaatttatccttcatcatcaaaaggtcattggttcgtgctagttgcaatggattacttcactaagttggccgaagccatgctgctcgagaatattacttgcacggaggtaattgactttattctgaagcatgttgttcatagattcggtattccttaaactttgatcaagaagcttcttttatgtccaaagaggtgagaagttttgccgaattttatgatattaagttgttgagttcttctccttactacgctcaggctaatggataagctgagtctagtaataagatattgttgaaattagtcaagagggagattgaagaacactcaaataagtggcatgaggtgctttctgaagcattatggactcattggatatctaaacatggtgctaccaaagtcactccttttgagttggtttatggacaaaaggctgttctatcaattgaggtaaatcttggctctcttcggtatttcaagcaagacgatttgttggttgaagattacaagaccttgatgggaggcaattattaagacgtcatcgacaagcgtttgaagattttgaaagagatggaggcacttcaagacggtgttttcagagagtaatccatgggagatacatgaaaacaaatactttcctagcgtttggcaagatggttaggaggtcctatggcaggtaattggattttcgccctaagacaacatgttctatgcttttagattcacgatgttcatcaaaaaggcagaagggcagtgtttacacccaaatttggtacctatggacgaaatagaggaaaattgccaaagtttggaaagtgtcgggttcccttcacagggccggtcagaccacaggtatgtgggcggtctgaccggctagtagggccggtctaaccgcaggtatggggccggtcagaccgtcagggtccgagtctgagtttgttttcgttgggtctcgggtttccttactcgggaaggcatgtttcgggtttcttttggtttctatcccgagttggatgtagagaagggcctgtagagggtaagaccaacccctatttaagggacaatgccggttcattgtaatcccccgaatataatctacttgaatcattcttttaccatgttttctattttaccctagttttagtccatctttgtcgatttgcgctgaaaatcgtctgccgctactgtgagagtgtcacacctctttgttggtttgtcctaaaaaccttccgttttgcccacgagatgggtagttatcctcatatcgatttaaattggcctagaggctgattttgatttctaaatcggctccgctagccggtttagcttgtttttctacaaaacctatcttgatttggccttttggctagatcgaggtggttggcgactccatatcaccgcaaggcgtttaggtgttgcgatcgtgcttgtcgacttgtcacaaaaagttgccaactacgctacgcccacccactttctctagcaccaacagccccgtggatgccctggactggttgcatgcaagaaagaagttggataccgttcagtgcacggatgaagagaaagttgcctttgccggtcatcagcttcaggggcgcatcggagtggtgggacgacttcctggccacccaaccagccggacagtctatctcttgtgctcattttaccacagcattccgaaggactcatggagttttgggagctgaggcatggcaatcgctccatcgtggagtatgttgatatttcttaacaacattactagaaatataattctcagcaatgacgtagaaatattcatggtatatttatggtcgcagatatgatccgca

SEQ ID NO: 33480 - DNA, 2996 bp, Oryza sativa
acgtagaaatattcatggtatatttatggtcgcagatatgatccgcaagcgcgcggatataccattgtagcatttcacccaggagtattccaaggtatcgtattattttaatcccaagggaagatatgataagagagtactatgctaatagtttatatattacttgtatacatgaaagtctatgtaggggttaagtgattcaaaggataggtgacacacaaaagaaagaacaaagatactctcactaatataaatactaagctaagtggagaaagaataagaaaagaattcattgctatacctctagtatacatacacacatttagtctacacttgctaatatacagtcatgcaaccaataccccctaacagtgtcatcctggtgtttcaagagaccacccctggttgcctagttccttacgacaacctgtcatggccatccaacctgggcaaaatacggaggagtaccctccccaagaaattgcacttaggattatatatacgcgcggaggaatacccgtactgagctgtcatcatcagttgcctacctcgacgtatccgcagcatataaccccaattaatgatacttaagaatctagacaccatgtctacattattaaatactactctacatccatgcatccgacatagagcaaccgaatactcggacactaaacccacaccattacacctctctggtaagctagttacacaactatatcgatacaagtataaagtaaagtcggtactaagaaaatataaatggaataacataccgaagatgtataaagaagaatattctattaatttaataagtcataccaaagaagagagaaaagctactagagccatacccgaattctcctgaagactcgaggactaagattgctattctaattcctactccactagcactagtgtacaactaaacttgagagagggagagagctctttttctttagtatgtgtgggaatgaatgagaggaggggtatttataggctatgaggtgccctgggagagtggagatgctcaaggtatccaacgagcatctttgctctcctcatgacaagtggcatgctcaagcatccaaagagcatctttcaccctcctcttcacaagtgtccacttccatgacggtttctaccggtagaattgctcccaaccgtcataagatacccgtagataattgccggtgaaaaataggctagattgggccagctaggggttcggccgaacccctggttggctcccctggcccacagccttcttcaggatgctgacatgtgggccccactttatggtacaccatgttttggctcagaatgattgctcattttatatgttgtagctcaaaaccaagtgggtccattagtgcaaaatatattcacattcttcatgttcattctctcccaactttgatggttgatcacctctcgatggcttccgattgattgttcgttttttttttccgtcgattctcctccatttatgcgtgcttctcctgcatacatgttagtagcatagcacatagtggaagtagatattttatttggaaattatgcattgcaagcataactagtcttcattaattgggtaatattgacgatcgaaactggtcgataacgaccgtcagcaagcttgttccactctagatcggtcatcaaccatcttgtagtcatagaactgttccatgacatacaactcgctggcagcatcggagagtcaaaagttagcctcaagagcatcccacatgtcgttccctgaatgcatgtgtatgtacacgtccactatgttgtcagctagtatactgatcaattttccacggaacaggcaacccacagcctcgaacttagcctccttctcaggagagaaaggtggtttgctcggtttgccctatgaaacaaagaagcaccgcatagccgtcaaccacagtagtgcacgtgctttccatcttttatagtttgaaccatactcggagaacactccagtgctggatgaggctttttcggtgttgttgtctccgttggtgtggtcgttctcacttctaatcccgctgccggtacgtcctctgttgacgcgtcctcaagtcaacatggtgtagtggaagcagatgtagcagtgcagaaccgttgtcgatgcagaggaagcagatgtgtcgcagagcagtcgcaccggaagacgctctcaaaaacttaatcacctgcatacccgtgtaggtacacaagcggatggagtttcggaggcatgcttgtcccaaatatattttttaattctaatgctacaaaagcactccatcaatactaggtggaacgaagaccaggtcaccgtgatataattgccacgtcagtgaaaccgtcctccaaaaccatcgagtgaatcaaattgcatcggctttaaaagttatggtgttaagatatatgattgtcacgaccggaaataacctaacgggcgttccttacgtgcgtgcattattccttgtcccaggaggcaaggtacaccaaaagttgatacagttcagagtttaacaagcggaagcgtaaatagctaatttattacatggacggcgaaggcccagcacacacaaagacaaacgggaaacagcggaagactagggcgacgaccacaggcgcttgacggcaggcacgagctagacaccaaagccttcatcttccaggaactcctcttctgagtttgggaaaaattgagcaagactgagtacaaccaccgtactcaacaagacacacccacaagtgcagaataaatgcaagggagtacaagggagttataatataaagggttagggtttgcagtaaacagcattaaaagtcacttagttgctcaaagctattttgtaaacacggtcctagagctatacaatattattaatcaaggccatgaacccacacgaacctgccttaacccaggcctacgatgattcagaccgaactggcaacccgaccctgggccagctcgtcccagccaaccaggccaacca

SEQ ID NO: 33481 - DNA, 4766 bp, Oryza sativa
gcgaagtccgctcgggagagccagagaggatcactgcagtgacctcccaaccagcgtggggctctgcatcgtcaccctcctgctccggaagcggcctggcctggtagtccactccatgtggataccctaggaccacgcacatgccccgcagctccaagacgaagccagtcatgtccaaaccacgacgggtgacgctgccggccatctacaaacaaaaaaacagaaagaaaaaccacattttaaaggtcagattttggcgataaatgaagcagcaagacagagagagactagacagttttcacaaataacaaaggatttttatttttgaaaatattgctaaggcttgggatctacggctcgtcctagggtcaagggggctctgataccaacttgtcacgaccggaaataacccaacgggcgttccttacgtgcgtgcattaatccttgtcccaggaggcaaggtgcaccaaaagttgatacaattcagagtttaacaagcggaagcgtaaataattaatttattacacgggcagcgaaggcccagcacacacaaagacaaacgagaaacagcggaagactagggcgacgaccacaggcacttgacggcaggcacgagctagacaccgaagccttcatcctccaggaactcctcttctgagtttgggaaaaattgagcaagactgagtacaaccaccatactcaacaagacacacccacaagtgcagaataaatgcaagggagtacaaaggagttatactataaagggttagggttgcagtaaacagcatttaaagacattagttgctcagggctattttgcaaacacgattctagtactatgcaatattattcatcaaggccatgaacccacacgaacctgccttaacccaaggcctacgatgattcagaccgaactggcaacccgaacctgggtcccagcttgtcccaagccaacccaggccaaccattacacattttagttgttaggcaggttttaagaattaaaacactaacttgggtacattgctcagcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaaccccgggacaggtaggcaggactgagcccctagcagcaggacaccggccctgtgccatgacatctcgactaccgggctgcagctcgtgtagccttcatttgtcctagagatgtccatcgacccccgacttcgtccatctccatccgtgtacttttgtttatgaccagactgagccacaaactaagccttacccactagacatgtggaagtacggtagtgctttgcaacagaggcccgaagaccggtccttatatggccgaggtgctactatcaaaaccatgcaccccgagtccagcctaaaaccatttttaggattttgaatagagggggaggtgtgaatccaattccacaataatccaacaattccatagtgtccaggtgatgagaatatccccaaggtctagagttgtaaaaccacctaatgttgcctaattaaccagcgaagtatctacctaaaatcatactagtggtaccatgagtagagtgtccactagttggggttttgtttaatctagggtgaacaaggtaataatatcaataacaataataataaggtcataacaaaggtaaataggcatggctaaataaaacagtgataacgcgggaatttaaataaagcggtaatgcaataatttaaatcaaaataattttataaactgggattcaatatgttcaaggatgatgtgacttgccttgctcgctttcccaaacgtcggcttcaacctccacgaagagctgatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattccgagttcaaatggccaagttatggtcatttgaagtttatatgctctttaaatgaatatttgcgaatttcttcatttaaattttaatttaaaatggatttattgcgtcagccgaggggaggggcgcgcggaccgggtccacgggagtggggcccacgcggcagcctcacggtccacggtggaccgggcgcacccgggctcgcaccggccggcgccgtgagtcccacgcgtcagccgcacctaagggcgcgggcggctgacagccgggccccacacggcagccgcggggcgcgcccgaaggcggccacgccggacagccgacgggaggcggcgcgcccacgcccctatggtcgccggcggcggccataggtacggcggagcggcggccgagagaggggagggaagggggaaacgaatcggcggtccacggctcaccccgggtcgacggcgacgacgggaacggcgaccggagcggaggaaggcggcggcgcggctcgggtggacggggtcgacggcgctccggcggtcggcgaccaaaacggagaggtggacgaggtcggcgaggatgcggcgaagccaaagcaggcggcgccgaggtgggaggtggtccggggcgacaacggcggcggaccggagctcggcggcgacggcggagagagagcgacggcgcgagctcgattccggcaaggagagagggcggcgagaggcggaaactgacggaggaggagcggggagggtttaaatagagccgggtcgagagagggtggccggggaagggaggaaaccggcgcgggaggtccggccgccatcaatggcgccggcgagatttgcgggggcaaatccgcccgtttgaacgcgagagagagaggggaaaatggggggaaagggagaggggatcacggggagtgatttccccctctttattgcacgtggaggcggtgggagcggcgggaggaaggggatgacgggtgggccccacccgtcagcgagggtggcgggcgggcccgcccgtcagtggcgcgcgcgcggggagaggccggatgggccgcggggagaggagagggagggggagggagatgggccgagccggcccaagagggagagggagggaaaggggactttttatagtttttctttttataaaaccattttaactttgtttatttcttaataattgttatttgtgctctgaaaattccactaaaatttatttacgcattttaggcttttaggaaatatacaaaaatcctccaagccttatttgacttttaactttgcacattttaattgttggaggctttcacacggattttaattattcttggcataatttagaggatgtattttagagtcgttttgggacgtgacaaacctaccccccttaaacggaatctcgaccccgagattcggaagaactgccgaagagattgggatgggctgccttcagctcgtcttcacgctcccaagtagcttcttcctcggcgtggttgctccattggaccttgcaaaaacggattacccggttcctggtcctgcgctccatggtgtccaagattctcactggtctctccacgtaggtcaagtcttcgcgaacttcaatctgctctgagtcggcctgctcgggcggcactcgaaggcatttcttgagttgcgacacatggaacacatcatgcacgttgcccaaggaggcgggcagctccaactggtaagcaacttctccgcgtacccagctcttcttggagcttcttccaaaagtgagaggtgaattggcttcccctatcagatacaattttcttaggaacgccatggagactcacgatcctagcgaagtagagctcggctagtttgttccctccataggtggtcttcacatgaataaaccgagccaccttggttagtcgatccacgactacccatatagaatcataaccgccctgggtttttggaagtccggtgatgaaatccatcccaatttcatcccatttccattctggtacttggagaggttggagaagtccggccggtcgttggtgctctgccttgacacgctggcacacatcacaaagggccactaactctgcaatttcccgcttcatactaacccaccagtatttctccttcaagtctaagtacatcttcgtactgccagggtggatggaataaggactttcgtgagcttcctgtagtatcagctgtttaagttctctgttatctggaacgcatactcgatttccgttccatagggttccgtgttcatcctctgtgaaaccagcggctttaccttgtttcatattcttgaggagtccatgcatgtccggatcattcttctgagcctcgcggatttgatcgagcaaggtaggcttggcttccaacgcagccaagaatccgcgaccaactatgcttaggttcagggcttccatctgttgactaagttcgagtggaatgccacggacgttaagagtgttgcaatggctttttcgacttagagcgtcggcgaccacgttggccttaccaggatgatagtgaattcccacatcataatccttgatgagttctaaccatctcctttgccgaagattcaggtcggactgagtgaagatgtatttcaaactcttatgatcagtatatatttcacagcgattcccaatgaga

SEQ ID NO: 33482 - DNA, 1085 bp, Oryza sativa
aaagagatgggccgagccggcccaagagggggaggggggggggaaaaaggactttttagagcttttctttttataaaaccattttaactttgtttatttcttaataattattatttgtgctctgaaaattccactaaaatttatttacgcattttaggcttttaggaaatatacaaaagccctcgaagccttatttgacttttaactttgcacattttaattgttggaggctttcacatggattttaattattctaggcataatttcgaggatgtattttagagtcgttttgagacgcgacaaacctaccccccttaaacggaatctcgaccccgagattcggaaaaactggcgaagagatcgggatgggctgccttcagctcgtcttcacgctcccaggtagcttcttcctcggcgtggttgctccattggaccttgcaaaaacggattacccggttcctggtcctgcgctccatggtgtccaggattttcactggcctctccacgtaggtcaagtcttcgcgaacttcaatttgctctgagtcggtctgctcggacggcacccgaagacatttcttgagttgtgacacatggaacacatcatgcacgttgcccaaggaggcggacagctccaactggtaagcgacttctccgcgtcgggtaatgatactgaaaggacccacaaaccgaggtgcgagcttcccttttgtctgaaacctgtgtacacctcgcaatggcgtgactcgaaggtacacaaaatcgtccactgcgaattccaggttacggcgacggttatctgcataacttttctgccgggactgtgccacctttagattatcccgaatggttctgaccttcgcttcagcttctctcaggatatcagtcccgaacacttgactttccccaacttggtcccacaagagcggtgtccggcatttgcgcccatacaacgcttcataaggtgccatttgtatactggcttggtagctgttattgtaggagaactcggcataggggagactcttatcccaggtcttcccgaaatctaggacacatgcgcgaagcatatcttctaggatctaatt

SEQ ID NO: 33483 - DNA, 1529 bp, Oryza sativa
  unsure (1)..(1529): unsure at all n locations
nnnnnnnnnnnnnnnnnnnnnnnnnnnnnnnnnnnnnnnnnnnnnnnnnnnnntggcttccaacgcagccaagaatccgcgaccaactatgcttaggttcagggcttccatctgttgactaagttcgagtggaatgccacggacgttaagagtgttgcaatggctttttcgacttagagcgtcggcgaccacgttggccttaccaggatgatagtgaattcccacatcataatccttgatgagttctaaccatctcctttgccgaagattcaggtcggactgagtgaagatgtatttcaaactcttatgatcagtatatatttcacagcgattcccaatgagatagtgccgccagatttttagagcatgaaccaccgcggctaactccaaatcatgggtagggtagttgccttcatgaggccgtagctggcgtgaggcataggccaccacatgaccatcctgcatgagcacgcaccccaatccttggcgcgaagcatcacaatacaccatgaagtccttgcgagtatccggcaagattaacactggcgaggaaaccagcttttctttgagagtttggaacgccttctcgcattgcgggctccacacaaatttctcttctttcttcaacaactgtgtcatgggtcgagcgattttggagaagttctcgatgaacctccggtagtatcctgccaaacctaagaaactgcgaatttgagtgactgtcttgggttgcttccaatcagtgacggcggtcactgtttcggggtccacagcgactcctttagcagatatcacgtgccctaagaatttgacttcggacaaccagaactcacacttgctaagtttggcatacaattgatgttcccgcaactttcccaacaccagacggagatggtgctgatggtcttcctctgattgtgagtataccagaatgtcatcaatgaaaaccacaacaaacttatccaagtattccatgaacactttgttcattaagttcatgaagaaggcaggtgcgttggttaaaccgaatgacatcactgtgaattcatacagtccgtatcgcgtggtgaatgcggtcttcggaatatcttcttcacgaatacgtaattggtgatatccggaacgaagatcaatcttggagaatacagtggcacctttaagctgatcgaacagatcatcgatccggggaagagggtacttgtttttgatggtgacttcattgagagctctgtagtcaacgcacatcctcttcgtcttgtctttcttctccacaaaaatcacaggagcaccccagggggaagtactcggacgtatataccccttttctttcaactcttccaactgtttcttgacttcggccagttcatttgctgccatacggtagggtcgcttgtacagaggagtggttcctggagcaagatctatccggaactcaatctctcgtttgggcggcataccgggtagttcttccggaaacacgtctccgaactctctgacagatgggatttctgacagtcctatctgatgaa

SEQ ID NO: 33484 - DNA, 1502 bp, Oryza sativa
aaaaaggaatcccctgaatttctatagggacggcaggactataatactttgctgtcataacccctccaggggtggtgatgaccagagggttcctaagcctttctacccccaactgatttctccccacgaatggcacagatataaacgagtgggatgctccagagtcgaacagaatggtagcagggatggaatgaatgaggaacgtaccaacgatgacgtctggagttgtcagcacgtcctcggccgtcacgtggttcacccgaccccgaatgacatccttcccaccgttgttggagcggggaggcgcttggccttgctgacgcctcggctttgggcatttatccgcaaagtgcccgggctcgaagcagttgaagcacagacgctgcggaccttgagcgtccctgcggccttgaccaggctgcacagttggcgtaggaggacggggcgcacgagtcccttgttgattctgctgctgctgcggctgtgggacgcgcaccacgaattgaggtcgaggcgcggagcgaggttgctgctgctgttgttgctgttgcgaggaggatccccctggatagggattggtgtagcggaccctttggttagcaccctgttgattgcggaaattcgccaagcggcgcttgtgcgactccagttccttgtgcttggcttccaagcggatgctcttgtccactagacgttggaaatccggatagtccccggagactagacggacggacagctcagggtccattcctgccaagaacttctcttgcttctcctcatcttcccgcacatcctccggggcgtaacgggccaggttgttgaactcatgcaaatactccatcacggagcggttgccttgcttcaactctcggaattctcttttcttaagggccacgactccggcgggcacatgggttctccggaaagcggcggtgaaacgggcccaagtaataggttgcccttctggctgcgtagcctggaaatggtcccaccatagagatgcgggtccctgcagctggtgggcggcgaagatgactttctcctcatcgctgcactgcacagtgtctagctttttccccacagcatgcaaccaatccaacgcgtccacggggttgttggagctagagaaggtaggtgggcggatgcggaggaactcggcgagtttagagtgttgtgggggtggtggtggagcattatgttgtggcggattttggaggtggtggaggaaagcagtcatcatgttggcctgctgggcgaggatttgggtgagaatggcgttggtgtctggtggtggtggtggaggcggaggaggaggtggaggtgggctgccctggtggtggtggttgctgccttcaggttggttgccatcaccggggttagcacttctcctggtcatcaccatctgaaacccccacacaagaaccagcatacagagagagctgacaatttaagcttaaccacccacgactaccataattcttgaatttattactgctattaaa

SEQ ID NO: 33485 - DNA, 6981 bp, Oryza sativa
gtatcctgccaaacctaagaaactgcgaatttgagtgactgtcttgggttgcttccaatcagtgacggcggtcactgtttcggggtccacagcaactcctttagcagatatcacgtgccctaagaatttgacttcggacaaccagaactcacacttgctaagtttggcatacaattgatgttcccgcaacttccccaacaccagacggagatggtgctgatggtcttcctctgattgtgagtataccagaatgtcatcaatgaaaaccacaacaaacttatccaagtattccatgaacatttgttcattaagttcatgaagaaagcaggagcattggttaaaccgaatgacatcatggtgaattcatacagtccgtatcgcgtggtgaatgcagtcttcggaatatctttttcacggatgcgcaactggtgatatccggaacgaagatcaatcttggagaataccgtggcacctttaagctgatcgaacagatcatcgatccggggaagagggtacttgtttttgatggtgacttcattgagagctctgtagtcaacgcacatcctcttcgtcttgtctttcttctccacaaaaatcacaggagcaccccagggggaagtactcggacgtatataccccttttctttcaactcttccaactgtttcttaacttcggccagttcatttgctgccatatggtagggtcgcttgtacagaggagtggttcctggagcaagatctatccggaactcaatctctcgtttgggcggcataccgggtagttcttccggaaacacgtctccgaactctctgacgatggggatttctgacagtcctatctgatgaagttctgaactactgacagaggttgggggtgcaaagaaaacaaccggttgttccggccctcggtacagagtgacagtgcgtcttgcacaatccactactccttggaattgagccaaccaattcatcccaaggatcacatccaagttcttggtgtctagaagaatcagatccgagggaaaaggaatcccctgaatttctatagggacagcagggctataatactttgctgtcataacccctccaggggtggtgatgagcagagggttcctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacgtcctcggccgtcacgtggttcacacgaccccgattgacatccttaccaccgttgttggggcggggaggcgcttggccttgctggcgcctcggctttgggcatttatccgcaaagtgcccaggctcgaagtagttgaagcacagacgctgcggacctggagcgtccctgcggccttgaccaggctgcacagctggcgtaggaggacggggcgcacgagtcccttgctgactctgctgttgctgcggctgtgggacgcgcaccacgaattgaggtcggggcgcggagcggggttgctgctgctgttgctgctgctgtgaggaggatccccctggatagggattggtgtagcggaccctttggttagccccctgttggttgcggaaactcgccaagcgacgcttgtgcgactctagttccttgtgcttggcttccaagcggatgctcttgtccaccagacgttggaaatcctgatagtccccggagactagacgcacggacagctcagggtccatacctgccaagaacttctcttgcttctcctcatcttcacgaacatcctccggggcgtactgggccaagttgttaaactcatgcaaatactccatcacgaagcggttgccttgcttcaactctcggaattcccttttcttaagggccatgactccggcgggcacatgggtcctccggaaggcggcggtgaagcgggcccaagtaataggctgcccctctggctgcgtagcctggaaatggtcccaccatagagatgcgggcccctgcagttggtgggcggcgaagacgactttctcctcatcgctgcactgcacggtgtctagctttttccccacggcatgcaaccaatccaacgcatccacggggttgttggagctagagaaggtaagtggacggatgcggaggaactcggcgagtttagagtgttgtgggggtggtggtggagcattctgttgtggcggattttggaggtggtggaggaaagcagtcatcatgttggcctgctgggcgaggatttgggtgagaatggcgttggtgtctggttgtggtggaggcggaggaggaggtggaggtgggctgccatcgttgttgtggttgctgcctttgggttggttgccatcaccggtggcagcacttctcctggtcgtcaccatctgaaaaccccacacagaaccagcaaacagagagagctgacaattaaagctaaccacccacgactaccataattcttgaatttattactgctattaaattggttcattaaagttcaagttgcttaagcaaataaaataaagacaggctccgacacagttacaccacagaccggcataaccgtgccccacacaacccaacaagaagacaaacgagaaagaacacacgcgcaagcctactaactgctcgtctaccgctgcgacgggccaggacggaaggtgagcaacagcgcatcctccgtgctaccaacgccggaggcttccccctcctggggaaccacgggcgcgggctcggcacgaggggtctcgacgaagcaagtccacgccagggactgacgaacaagctcgggcctggaggtgctcttgcgggcggtgatcttctggctgcggcagacacggcggcgcttggggcggcagacctctccctgggcgatcttgagctgatgcagctgcgcctccaccacgtctaggtccttcttcagctgcagattctcctgacgcagctccaggatcttcatgttgttcttgaccatcccacggcgcaccatctgatggaagtcgatacgggccgcgtcgtacgcctccaccatgcgcgccaggtgcatgatggtagcgtcatcctccgagctagcatcccggaagatggcgtaatcgcgggctcctccgcggcgagggtggtagcggtagggcgagtgctgcaactcgtccgggtagcgctggtgaagtgtgccgatggcgaggagtgcggcgttctggcaagcggcggagaaagaatctccacctgcggtgactgccaacgaagtcctctcgggtgagccagtgaggatcactgcagtaacctcccaagcagcgtggcgctctgcatcgtcaccctcctgctccgggagctgcctgccctggtagtccactccatgcggataccccaggacaacgcacatgccccgcagctccaaaacgaagccagtcaggtccagaccacggcggttgatgctgccggccatctacaaacaaaaacaaaaagaaaagcaacattttaaaggtcagattttgacgataaatgaagcagcaggacagagagagactagaggattttcacaaataacaaaagatttttatttcgaaaatattgctaaggcttgggatctaaggctcgtcctagggtcaagggggctctgataccaacttgtcacgaccagaattaacccaacgggcgttccttacgtgcgtgtattattccttgtcccaggaggcaaggtacaccaaaagttgatacatttcagagtttatcaagcggaagcgtaaatagttaatttattacatgggcgacgaaggcccagcacacacaaagacaaacgggaaacagcggaagactagggcgacgaccacaggcgcttgacggcaggcacgagctagacaccaaaaccttcatcttccagaggctcctcttctgggtttgggaaaaattgagcaagactgagtacaaccaccgtactcaacaagacacacccacaagtgcagaataaatgcaagggagtacaagggaattataatataaaggattagggtttgcagtaaacagcattaaaagacattttgttgctcaaagctgttttgtaaacacgattctagaactatacattattatttatcaaggccgtgaacccacacgaacctgccttaacccaaggcctacgatgattcagaccgaactggcactccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggataggtaggcaggactgagcccctagcagcaggacaccggccctgtgccatgacatctcgactaccgggctgcagctcgtgtagccttcatttgtcctagagatgtccatcgacccccgacttcttccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacaataaccaaaccattccatagtgtccaggtgatatgaatattcccaaagtctagagttgtaaaatcgcctaaggttacctaattaaaagcgaagcatccacctaaaatcatactagtgataccatgagtagagtgtccactagttggggttttgtttattctagggtgaacaaggtaataacaacaataacaataataaggtcataacaaaggtaaataggcatggctaaataaaacagtgataacgcgggaatttaaataaagcgataatgcaataagttaaatcaatataattttacaaactgggattcaatatgttcaaagatgatgtgacttgcctttctcgctttcccaaacgccggcttcaacttccacgaagagcggatcttccgaagctgcagcgtctacacgaccaacggaaaagaaacggcttttactctactaaactccatataacaagcagaaacaaagcacaaaaatgggttcttggcttcttaaggaaaaattagagacttgaacggtccaattccgagttcaaatggccaagttatggccatttgaagcttatatgctctttaaatggatatttacgaatttcttcatttaaattttgatttaaaatcggatttattgcgttagccgaggggaggggcgcgcggaccgggtccacgggagtggggcccacgcggcagcctcacggtccacggtggaccgggtgcacgcggcttacgccgggcggcgccgtgggtcccacgtgtcagccgtacccgcgggcgcgggcggctgacggccgggccccacatggcagccgcggggcgcgcccgaaggcggcctcgccggcacagccgacgggaggcgacgcgcccgcgccccgatggtcgccgccggcgaccaccggcgcggcggagcggcgcccgagagaggggagggaagggggaagcgaaacggcggtccacggctcaccccgggtcgacggcgacaacggaaacggcgaccgaagcggagagaggcggcggcgcggctcgggtcgacggggacggcggcgttccggcggtcggcgggcgaaacggaggggtggacgaggtcggcgaggtcgcggcggagccgaaggaggcgacgccgaggcgggagaaagtccgaggcgacgacggcggcggaccggagctcggcggcgacggcggagagagggaacgacggcgcgagctcgattccgacggggagaaagagcggcgagtggcggaaacggtggagggaggcacggggagcgtttatatagtgttgggagggggagagaacggccggatgagggggaatcggccgcggaagatccggccgccattgatgcgccggcgaagtttgcgggagagtttccaaacgaatccgagggagagagagagggaaaagtggggggaaagggagagggaatcacggggagtgatttccccctctttattgcgcgcgggggcggcgggatgcggcggaatccgcggcggcggcggcgctagggcacgggcgaggcggcgggtgcggcgcgaggtaggggatgacgggtgggccccacccgtcagcgagggtggcgggcgggcccgcccgtcagcggcgcgcgcgcgggggaagccggatgggccgcgggggagaggagagagagggagggagctgggccgagccggcccaagaaggagaggggggggaaaaaagactttttagggtttttctttttataaaacctttttaactttgtttatttcttcttaattattatttgtgctctgaaaattccactaaaatttatttacgcattttaggcttttaggaaatatacaaaaatcctccaagccttattcgacttttaactttgcacattttaattgttggaggctttcacatggattttacttattctatgcacaattttgaggatgtattttagagtcgttttgggacgcgacagaatccgttaagacatcgttgaaaaatagtttttcaatgaaggacttaggggaagcagtacatattctgggcataaggatctatagagatagatcaaagaggctaattggattaagctgagtacatacattgacaaggtgttgaagaggttcaacatgcaagattctaagaaagg

SEQ ID NO: 33486 - DNA, 2556 bp, Oryza sativa
atcgtccactgcgaattccaggtcacggcgacggttatctgcataacttttctgccgggactgtgccacctttagattatcccgaatggttctgactttagcttcagcttctctcaggatatcagtcccgaacacttggctttccccaacttgatcccacaagagcggtgtccggcatttgcgcccatacaacgcttcataaggtgccatttgtatgctggcttgatagctgttattgtaggagaactcggcataggggagactcttatcccaggtcttcccgaaatccaggacacacgcgcgaagcatatcttctaggatctgatttagacgctcggtctgcccatctgtctgcgggtggtatgcggtgctgaagtttaaccgggtacccagctcttcttgaagcttcttccaaaagtgagaggtgaattggcttcccctatcagatacgattttcttgggaacgccatggagactcacgatcctagcgaagtagagctcggctagtttgttccctccataggtggtcttcacaggaataaatcgagctaccttggttaatcgatccacaactacccatatagaatcatatccaccttgggtctttcgaagtccggtgatgaaatccatcccaatttcatcccatttccattcaggtacttggagaggttggagaagtccggccggtcgttggtgctctgccttgacacgctggcacacatcacaaagggccacgaactctgcaatttcccgcttcatactaacccaccagtatttctccttcaagtctaagtacatcttcgtactgccagggtggatggaataaggactttcgtgagtttcctgaagaatcagttgtttaagttctctgttatctggaacgcatacccgatttccgttccatagggttccgtgttcatcctctgtgaaaccagcggctttaccctgtttcatattcttgaggagtccatgcatgtccggatcgttcttctgagcctcgcggatttgatcgagcaaggtgggcttggcttccaacgcagccaagaatccacgacccactatgcttaggatcagggcttccatctgttggttaagttcgggtggaatgccacggacgttaagagtgttgcaatggcttttttgacttagagcgtcggcgaccacgttggccttaccaggatgatagtgaattcccacatcataatccttgatgagttctagccatctcctctgccgaagattcagatccgactgggtgaagatgtatttcaaactcttatgatcagtatatatttcacagcgattcccaatgagatagtgccgccagatttttagagcatgaaccaccgcggctaactccaaatcatgggtagggtagttgccttcatgaggccatagctggcgtgaggcataggccaccacatgaccgtcctgcatgagcacgcaccccaatccttggcgcgaagcgtcacaatacaccatgaagtccttgcgagtatccggcaagattaacactggcgaggaaaccagcttttctttgagagtttggaacgccttctcgcattgcgggctccacacaaatttctcttctttcttcaacaactgtgtcatgggtcgagcgattttggagaagttctcgatgaacctccggtagtatcctgccaaacctaagaaactgcggacttgagtgactgtcttgggttgcttccaatcagtgacggcggtcactgtttcggggtccacagcgactcctttagcagatatcacgtgccctaagaatttgacttcggacaaccagaactcacacttgctaagtttggcatacaattgatgttcccgcaactttcccaacaccagactgagatggtgctgatgttcttcctctgattgtgagtacaccagaatgtcatcaatgaaaaccacaacaaacttatccaagtattccatgaacactttgttcattaagttcatgaagaaggcaggagcattggttaaaccgaatgacatcaccgtgaattcatacagtccgtatcgcgtggtgaatgcggtcttagggatatcttcttcacgaatacgtaattggtgatatccggaacgaagatcaatcttggagaatacagtggcagctttaagctgatcgaacatatcatcgatccggggaagagggtacttgtttttgatagtgacttcattgagagctctgtagtcaacgcacatcctcttcgtcttgtctttcttctccacgaaaatcacaggagcaccccagggggaggtactcggccgtatataccccttttctttcaactcttccaactgtttcttaacttcggccagttcatttgctgccatacggtagggtcgcttgtactgaggggtggttcctggagcaagatctatccggaactcaatctctcgcttcggcggcataccgggtagttcttccggaaacacgtctccgaactctctgacgatggggatttctgacagtcctatctgatgaagttctgaactgcctacagagggtgggggtgcaaagaaaacaaccggtgttccggc

SEQ ID NO: 33487 - DNA, 771 bp, Oryza sativa
agcggttgccttgcttaaactctcggaattcccttttcttaagggccatgactccggcgggcacatgggtcctccggaaagcggcggtgaagcgggcccaagtaataggctgcccctctggctgcgtagcctggaaatggtcccaccatagagacgcgggcccctgcagttggtgggcggcgaagatgactttctcctcatcgctgcactgcacggtgtctaactttttccccacggcatgcaaccaatccaacgcatccacggggttattggagctagagaaggttggtggacggatgcggaggaactcggcgagtttagagtgttgtgggggtggtggtggagcattatgttgtggcggattttggatgtggtggaggaaagcagccatcatgttggcctgctgggctaggatttgggtgaggatggcgttggtgtctggtggtggtggaggaggcgggggaggaggtggaggtgggctgccatggttgttgtggttgctgcctttgggttgattgccatcaccggtattagcacttctcctggtcgtcaccatctgaaaaccccacacagaaccagcaaacagagagagctgacaattaaagctaaccacccacgaccaccataattcttgaatttattactgctattaaattggttcattaaagttcaagttgcttaggcaaataaaataaagacaggctccgacatagttataccacacactagcataaccatgccccacacgactccaacaagaagacaaacgag

SEQ ID NO: 33488 - DNA, 724 bp, Oryza sativa
cgccgcgaatcccgccgcccccgtccgcccagcgtgcaatcaataggggggaattattccccgggatcccctccctctttccccccatttttccctccctctctccctcggattcgtttggaaacccctcccctaacctcgccggcgccattaatggcggccgggtcttccgcgcccgtttccccctcctccggccgccctctctcacccccaaccctatataaaccctccccgagctccccaccaccgtttccgccactcaccgccctctctccccgccggaatcgagctcgcgccgtcgctctctctctccgccgtcgccgccgagctccggtctgccaccgtcgtcgccccggaccacctcccacctcggcgccgcctccttcggcttcgccgcatcctcgccgacctcgtccacctctccgtttcggtcgccgaccgccggagcaccgtcgaccccgtccacccgagccgcgccgccgccttcctccgctccggtcgccgtttccgtcgtcgccgtcgacccggggtgagccgtggaccgccgcttcgtttccccctttccctcccctctctcggccgccgctccgccgtgcctatgtgtcacgaccggaaataacccaacgggcgttccttacgtgcgtgcattattccttgtcccaggaggcaaggtacaccaaaagttgatacagttcggagttcaacaagcggaagcgtaaatagt

SEQ ID NO: 33489 - DNA, 1592 bp, Oryza sativa
attgatcccccaccaatctaagtacaccaataaactccatgtaactatcaatccatcaatccctccatggaccacccaagatcgcattccatgcctacctgcccctgcccagaaggagaaacggcaagcagatcgagtcctcacctttcaaacgaacaccggcgccgcaagaacagcggtggggggattctgcggccacggagcgaagaagaaacacgaggatagccgccgattttgttgcgaggttggggagaagaggggaaaaaaagaaaaagaagagaaaaacaagtcaatggaaaccacgaggtgaccgtagaccggccgacctcgtcgggagcgcaggcgcggatctagatgctggagagtcaacgcggggagagcccgcggcgcacgcgatctgggggattgaggaggagggagggaggggatcgcgcaccggcgcacgcgagagagattacgctgcggatcgaaatatttggaaatggcgccttgctatctcatcaaccctcgcgagcgggcgatcggccgccattcgggacgcgccgccgcgggtcgcgggtcgcgacgcgagatgccgagatgcggatgcgatgggaagaggagaggaaaacccgtggacccatatccacgggattatcacgcgggccgcacgttcccggggggctcgcagaagatgggccgcgggatgcccaaagccgaagcaggccgcagcgtcagcccatgtaggccgagtgaaaaacgcgggactcgatcggctcgtgtaacgctgtgggtggctcgtgggattgtgaccggagtgacaggcctgtgcgggtttcccagacccagcacgcgcggtcccaataatgcgggcggggatgcagagccagcacgcgcgggcggaagacgacgacgactgggctgagcagccgccgtgccgtcacggcagctcatatcgcaggcggcgatgcaaggtgtgatttgatgacgcgagaacgccggacttgttggtgcgagatgcgattcatcacccttggtggcagtagtttggtggggataaaactaattttcttgcggtgcttcgatctgcatctgaaaactctttgcttgcagacttgcacgcgcgcgctggccggcagccggcagcggactgtgggctagatagagtgtaggatgccaaccccctccaaagatgggccttcttaactctctctgggctagctagcactgctctccgtgctaactggcctcatcagggagtttaactaatagtagtatttaattagagcgtagtacttctgtactggagtacgtggtagtgtgtgctagtagcttgcatgtgctcaattagggctggggaagttgggagatgaggatatagacacacacaggtcaactgatggatcaaattagttttattcaccacgcaaaaaaaaagttttattcagctcagtttaagaatacttgcatgtatatatatcacaaacacatgcaatctcagggatacacatgaattttcttcttcttcttcttcttcttcttctttgtatgtggcaagggttaaggacaaatcactactggggtaaccgtttttactcccggttgggaactag

SEQ ID NO: 33490 - DNA, 2737 bp, Oryza sativa
ttagagggtggctcgcacgcacatataggtgctcggtaggggaggtttcatggcatgcacgaccatcggggctaggccgcacttgtgcaaaaagcgctcctaagccaggcctgcgagttgcgagcttcatttgttccatctccacatgcatgttgttgtcgtctctccattggtcgttcagatctagcttggatccgatcgacttgggttttcttcatcgactggatttggccggcagcaaccgtcatcgctttcgcctccaccttttcgccgacggccacccccaactagatctgccatcctcgtccttctttgctagatgccacgcccctagccatctccaccatcatcgctggctacacctacaaatccgacgatggagaacccccaaccagcggattggttctatgatggtggtgagcaattgggcagtgagtgggtctggctcagcggcggcgagcccacgaagttgccccttgtttttcctcccccaccccctccccctagcccttttcctcttccttaatttttcttttcaccaatcaagtagtcatgtacatatgtgatgatggttttgctgttcatggatatatggatatgaattcaatttttattttaaaaaaacaatgaatttatttgacttagctgcatttatatctgaaatgtgtgtattttataataatttagagtatcttgcacttggtaatatttctatttatgggtagtagggataatcttaccatccacatagaaagatgagtatactcaaggttcatttatccaaccaaacgaataccatgcatacaagttttcacatatcgatccaaccaatgaaacaacacctcatataaaaccaggttaaactaatacatgcaaccaaacaaccactattacaccttgctaaccacaccaaggtcagcctgaatgatgcacatatgtaaggcaagctgagagtatttgagcaaccggccccggccctatgaaacgcaagatagaaaaaacacaagaaaaggaaaaaaatgcagaaattgtgtagttgcatgtttctttaatcgtacaaaaaaagcgcaggaaagatgaaaaggagctcttcgctagcattgtaggaactaacaaaggaaagcaaagtttccaagagatttgacctcttgcttatttttcccctataaaattgaaccatagcagtgcaatcctttatgaaaaatttcctatccttcctatgaatcaaagggctctataggaaaatttttccttaattaggaaattgaatcctccaaattacttatggcaaacattcatttcaaagtggtatggtgctatcttcagtaaaatatctcctttatctgaaaaataaatttacagataattgtatttcacatatatagagatagatctgcactgactactgattgcgtgtttatatatgtgaaaacctgcaaacatgcgtattttacatatgataattaattatatcagttgtcaactatagtagaaacttgaacacatgacatatactttgcacacgatttataagatgacaaatatatatatatatatatatagcatacgtacgtatatcgtacggtagcagcagctgggtcttatagggggtacatactccatgcaacaacaaattaacaagatcaaacataattaactaataaacacaaaacgagcacagatatatgctaaaggggaacgatgagcatgcatgcatgagctgagctgacgacggtgataataagggggatctgaaatttggtactctccccagtggccggcctgcaggctagctagcttcatacgagcttcaccgccgatatagatcgccgccggctccggccgccgccgccgccctagccgctgcgctccatctgcttgaagatgtcgaagctctcgaccacctgctcgttggccctctcctgatataacatcaataatatagcacataattaaagaacaattccacggtgagatcatatcacacaagaactatctaaaatcataatcgttttgtggtggccatgcatcaaataaatcaaatcatatagagaaactgccttaattatactctcattttgtgtgtatgtatatatgatcggtgtctctgttgctatggcaagttaattatcgtcaatatgatcatcacctgatgaggaatgggagcagctactactctgggctcggggttgctgttggaggtggaaaccgtcgatgagcagcgggggtcgcacttcgcccactgcataaatgcagagctgatcatcagacacttgcatctccatcggtgcaagtaattaatattattgtactagtaattgatgtgtaagcaaggtgcgagagatctagagaccgatggatcggttgattatagctaataactgtcacaattatcacatgcaaattgggggccgggagatattggggatgagtagagcttacgttcttggcagccatgctgaaggcctccctgtgagggatatctggcttggcagctttgatacgctgtatttcctccctgcatcatcatatattaattataattaattgatccgctaaaatatccatgtgcagatttatttctgagaagagagtgtagtacgtacgtaggtacatgcaatgcatatatgcatatggttgtgtcgattagatataaactggcattgtctacatatatatcccagtttagttgtcccatgcatattttattccctttggttaattacttcatcgatga

SEQ ID NO: 33491 - DNA, 721 bp, Oryza sativa; identical to SEQ ID NO: 13562

SEQ ID NO: 33492 - DNA, 738 bp, Oryza sativa
gtcaaacatgtggggccgggtcgcggcgggagctgattggtgtgcaggcacgcgatcgatgcgcattcaccggcctggacggcctgcagctagcagcacgcgagctaggggtacgtacacacgcaaacactggagctagcttgcaaattgccagcatatgcagcaagcgagagggggatcgatcagccggagcagcaggtcacggtggtggtggtgggcgtccgtccgtccgtcgcgctcccggtgtcgccatccgccttgatcaagcttttgccgcgcatgaatggcgccgctagctgatgcgcagcgcggcgttccgatcgatcagattcgtgtgtgctcccgtgtgcgttctgatctcagtggtgatgacagtcagtactcgtaatcaatcctctgtgatgtctgtgtgtgactgtctctctctcttgatttcgatcaaactgctggccaaagtgcacacatggctgatgagatattgagatctctctcaatcgatcgagctctcgctggtgagcctgagatagatctaggttggaaatgtcgctagctgcatgcatgcggctcgagcagcgagagagcctttgatgatgagggagagatcagctactacagagatctaattgtgatcaatatgctggcatgcatgcttgcatcagtggatggccccagctgcatgctatgctgcgtgtaacacaacccatcgctagcgagagccactagtgttgctctcatgca

SEQ ID NO: 33493 - DNA, 744 bp, Oryza sativa; identical to SEQ ID NO: 13563

SEQ ID NO: 33494 - DNA, 739 bp, Oryza sativa
tggtaattggtttgtgagtttcagtgtcatgttgtaatatacactattaattgaataaaccgggtttatttagctattgaataaatttgaaagcacaagtactttcaagattgaaacattctgattctggtgtatgattttttttagtatatgcatataactctacagttgaaggatcccctgagccaatcctctgagccaatctgtttcttttattcagggctatgttgacaaatatgtgaagctatagttggatcagtaaatgggactatgaactggagcaatcaggacagtgtccttttcctgttgcagaaatcgtgatgggactatggactatgaacagctcacacgaatctgagctatgctatggtatttggatcatcaatttgcagtctttcagcagtaagggattccgggtaatagttctgcagaaatggatgtatttatcagaaaatcacgagtttacattggaacaattgctgcctagtcttcatagccttgtaagatgtatctttgctccactgtttctttttttcttttcttttgagtagtttgctctactatttcaccatcattaggcaagtgatagtagaacgttctttaatactgactgcatgaacgcattgctgaaaagaattatatttcttcaaggtaaatgtaaatgatttaatcttattgctacttcaatagttcaatgaacgtgttcatgtctgattaacccaaagatttccttaagacc

SEQ ID NO: 33495 - DNA, 750 bp, Oryza sativa
tgcagggccgtgtatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaac

SEQ ID NO: 33496 - DNA, 744 bp, Oryza sativa
  unsure (1)..(744): unsure at all n locations
ccctatcaatggcaatgccagctaattaaaatacatcacaatgtattttgaggataacttaaggggccgtnanncgacaannaatttttggtacctcaatnnccagagaatggcananngcagtgtcttctttggactggatagaangatctgcatatnngttccagctcgtcagtattcaccagctatcagggcagacatcacatcatgaaaaacttgctgagactgtatattccccatgaaattttctcatcaatcaagaaattccagaccggtagctgttggtgtcaggccatggttagccaaatattggtcattgaagaacttacttagatgcctcatcccactgtcacagagaattgtcacaattgtatgtcctggacctaaatcttgagcaactcttacagcaccaacacaattcatggctgaagaactcccaacgaacagcccatcatttttcaacaagaacctaagttaatatttacaagtagattgaggttagataattgaaatacatttttagcttttcttgaattatcttaagataagagaataaacaactatgagcttcctgctaactatgacacagaagactgattcttttcatcctttttgcttcagtacttgtttattacaagcgaaatgtgcagaactttgattaatgcttatgatgatttgtactaaacaataacagttcttgcatggaaatttcagattgtaactcctaagagtcagcgaaagcac

SEQ ID NO: 33497 - DNA, 788 bp, Oryza sativa
agactgtgaaaagagttttagtaaaactaaacatacaggagcataagcaattacaggctttctgatgttgaaatactgtttgtactttggaacaatcttaacagaagcatctagcatagtttagttcagctagccatgaaaaaaatggataactcaagtagcaatcacagatactacaccatggagtatgttataagaattatgaacagtatgtgacttactaccttctcaatggcagcatcatcaggaataacaacatgacatttgcagccataagcaggagcaacaatggccaagctaatagctgtgcttccagcactcccctctgttactgtaccaccacagagaagatcaccagattccagagcctggtaatgacaagagttccaggatcaaatataaaggatatgatatacggttgttagtatataacaacatcataggaaccgaaattaccaaacaacatgacacggagcaaactatctcatgaatccatgattcatctggtgaaatttgaaacaaaagaatttagataaaatcctattacctgtttgtttcaatccaataatactagaaataaaaccgcataatgtttttcccatgagtgctttttttcagaactgcaattctaaaattgttgggtcactgacaacatagttttacaggttccaaaagatgatggaaaaatcttgataccaccctgttatcgacttccaccttacaattgctttttgaaggatagacaactacaggctagagttaatacaagtaagcatttatcaccacat

SEQ ID NO: 33498 - DNA, 1104 bp, Oryza sativa
cttacattcaggaaaaaggaataaaatacgatggtggaacttacatgtcagacaaaaaaaaaactacccttctcttccccctctcccactaacacgtcctgacagtgtgctcctgtccctctatctccttccgctgccccaccacttagccacctgtggcgacaaacagagagagctcgcgcatgcaaggaagtatcatcgtcttcgcccatcatgttggtatccgcaacattcgttggagcaggggggaccagcctcgttccttgtcatgctcgctgtcgtgttggctgtagtgtgtgtgtgggcggcgtcggggataggcaggaggacgacaggcagtgcttcgtcacaatcaacacgctcaccatggccatcgtgttgtacctcctcgttggcgacctcatcggtgtcggcgttgtcaataatggcagggttgtctcgaacaccttcgtgggcatgctcctagtactagtgctctctctctctctctctctctctctctctctctctctctcttcgtcgatgttgtaggaggctcaccgaggggcaggacaagctgtcctccccggcgtccctccccctccctgcgctcaaagcctccgttgaaatccaccgccgccgcagaaccccttttaccccaaactggtcatgtggcggctgccgcgtgtttggacgaaggtgccatccacatcattgtggtggaaacaaaggaaaattcgatccaagaggttggggagtgggggggtggggagagagagagagagagcatgggtttggggatggaattttcgagcttagctctcctcccgtcaatcgctgtccttctccctgctagccaccatcctaccttggagtccatagaaatgggaatagaggggagaagtgagagataagggcccctaacatgtagggcccatgctgattcagcgttgttgatttcgatcaattagccacgtcggacaaaaccagccgctatattatcatgggacctcctttacattggttggttttgtaagttaaggaagatgttatatctggtattgcagtttaagaacaaaatttgaactaggtgtcaagataaggacctaaagtgaactaaggggg

SEQ ID NO: 33499 - DNA, 2110 bp, Oryza sativa
caggcgtctctgcctcaacggacaacagggtggtatgcacttttccaacccaggcgtccaaccgctcgcgcaacgccttcacctgtggaattccaagtactctaggctggacccatgacacgtgaactgtgctgtccacctcatcaattatcccctctataagatgaacctgcaaaatgggggaatcattaataattctctcatattccaatttacttttaaattgtatggcaattgatggcctcatggaaatacagcacccaggctccattagcaactaaatagaaaacatcagcatggagcttttgtaagaagctgatagcagtggcattctatcttggctacctatatattctgcctttcaggggcagcattattatatactataatgtactaactgatgtagaaaagaactgtaatggaagaaaaagatgagaacatcaactaggaatactagttgatacattgtgcaaacactgaagccgtataaggtaaaagcaatagtagcatgtaacaaggagagacacaggtttgctgtgatcaacaaacacaaatatatgaatcacatgtctagtttaactgacaacgcacacccataactcacaactaaagattcacaaaacaaaccatcagcaattaaaaaaaaagacaagttcacaaaggggaggaattgaaggcagtaattatcaaataatcactatccatatacagctgccacattaaaatgacagaagcattagaagcattctaatgtctaatcttaaaaaacaatttatgcacaacaaaactagatgtttatgaatggcattcatgcattgtctatcccaacaatgaattaacatgatattggcatattgcaaataatatcttatgaaagatcgaatgtaagaaatgcaattaccgagaggctcttcataagaagatattccacatcactgatagaaagcttagtgcgctcggctataacacttaatgggatagttctgtcttctgacgcccggctacaacatgaaaaagaacacagggcttagaaggaataaaggaaaaggggcaagacatttgtggtggcatagaaaagcaagtagcaaagttgtacctaaagattatctccatcagacatagaatgttgatcttctctagcagtttccgttcattctgcaccaaagctggctgagcactgagagcagcattgtggaccctacatagttcttggtagagagctaggttgccggtgttgaatgcttgtaacatatgatagacccactccaccttggttccaataagactgttgatctaaggatataaaaatataaacaacttcagacagagatgtaccaaatgacaaccatatatgccgatatatagatttaggggccattcaatatttcaatcccataaaggctaccttgtgtctggaatttttttgtttggtatccacaagtcaatattgatttttccatgcacaaaaaagatggtttgccattaattcatgcaaacttaagtttatgctatttcaattcaagaaaatacgaagtttacataattataatatagtggttcacaattacatcattcaacattcagcaaaaaaggatcaggcataggatatttcatcattttgatatgctttacacaatcggtagcattttattgtgtcaatgttaactgcatacattcaactcatgaaatttctgctaccgatttggcaatagatgtaagttactgtgtacaaaactccgaaacttaactaccataacatacacaggtaccttggacgccttgcagttctagcaagcatcagataaaaacaactaataaataattatcagaactggcagttgtgagtaccaagaaaagccacatgtaatgtttatataggcaagcagagttaattttaatcaagcaatcaagaaacacaaaaaagtatggataaaacaaaggtggtactactaactagtggcaacaaaagaaatcatgcgtaagcaaagtccaacttacaatcgggtgagctaacaattccccaaagttgtagatgttatcaccaagcaaggctgcaagggagagatcaaatgccaaatcctgacacaagacagcatcaaagggtaaacat

SEQ ID NO: 33500 - DNA, 805 bp, Oryza sativa
ttataggccgaatagtttgttaagtctgtttttattgagtgatcttttttaagatcatgtttattaggttcgcaacttgtatttaaaggttgttttgggaatttctacttggtaatttcaacttatatttgaaaattttcaattcaaattttttaaaaaaaatcaaatccacccaaaatttgaaaacttcgtatattaccatcgtgacaaagtgaatctcaatgctccctgccatgttgtttgaagtgatcttacgctgaatttctttttcattttcccaacctatctcacttgtttttcacgccaagtttttcaaactactaaacaatatgtttttttaaaaaaaatctatacgaaagttactttaaaaatcatattaatttatttttcaagttttttagattaatacttaattaatcatgcactaatgtgtaatatcgtttttcatgtagagaggcaggggcggagctagaacgaaatggaggagggtcctcttgcttaatttactctaatttagatcaagttttaagctgatatgtgtatgcctaagtttgtattaaggagggtgcacacatggtgaaaatcggtgagttataactaaaaatttttttttgaccggattcttgggcaccccttccatactctacctccgccccatcagggaggtggagttaacacagtcttaaggtggagcccaagtggcgtgcagaagtttctctagatttgcaagtgtttgggaaatgcacatatgtgggctctacattttcctaaaagtaaagaaaaatagaattccaaaacaacctgt

SEQ ID NO: 33501 - DNA, 1361 bp, Oryza sativa
gtttgatgaattctgaaacagctggaaagcaagtttgctggcaaggtagtatagggatattccacccgggctagagcatcgcattcgcatatatcggcgctagacgccttcaccatcgtagcgtgacaccagcaaattccgcagccagcagccagcagccagcagatccgcagaagtccccaatccgtccaagctccaacaacgctggggagtgtggccccgcctggcccccaccagctccaccaaccgaggcacacgctgcggctgcgcgagcagggcccaggtgacggccgcccgcacgcacacgacacgacaccaacgacgcgacgcttcccctttcccccctcatcagccgtttgcctccaccccccacccactccacagtccccgctctccccccattgccgccgccgcctgcgacgaccgcgagctcatcccgagacgacgtctctagctagcatcgagcgttctttctctcctcgggctctcgttggtaagccctcgattccggtttcctcctgcttctcctcctacctgcccctcggattagtcgccagtgttgttcgctcgtctagttgcttgcagtaattatagtgctaagctccggttgtccgtcggcaatacgccggtagtccatgcaccagtctcgttttcatgggttttgttgtttgcagcaggcatacccctgtttcgctagctcaatcaatcatttcattgctactattttttttgttttactttgtatttaacgagtattgcatctatgaaacaaacttcacacaaatttgatgctcatcaggttcttagttccaccttcttttgtgttttttttgttcagttgagataaggcaaatcaagagagcaaaattttggtggtacatgtggtgattctatgtcgacaaggcgtcatcttgcagtatttaccactgcaagcctcccatggatgacaggaacggccatcaacccgttgttccgggcggcctatcttgcaaaggatggggatagggaggtcaccttggtaatcccctggctttctctgagggaccaagaattggtttacccgaataagattgtgttcggttcgcctttggagcatgaggcctatgttcgtcgctggattgaggagaggatcagtttcagaccttccttcagcatcaaattctaccctgcgaaggtacattgatatattaacgcaaagagttcattaaccatttaaccctggaattctctattctttgtgagattttcttttaggtggttctgtcacttgatatatcaagctctctatactttggggattttcttttaagtacattgatttatcaagttctctacaatactattggcttctattttacttg

SEQ ID NO: 33502 - DNA, 28990 bp, Oryza sativa
  unsure (1)..(28990): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcacgtttagttttcacaggcgcggaagaacaaccaaacagacaagtgttcaggctgcctgagcaggtaaaatttatcatcctatcagatagctctcaggcacctaaatttttcaggcatgttagtgagggcatcaaccaaacaggccctaaaaacgtatcagcggcaagcgtttcatttcatttcaattacgtatagcacagtgtccaagctcgcgaaaggtaaccttgcgcgagcgggcggcttgttggctcggctcgcggcggatggttggagcgaaggccactaggggcatgcaatgcaagatagagacgtttctctttctctttttacctttttaattttaaaaataaacatttcgactatttaatttttaagatatgaaacttttggctagtctaaatagaccgtcgtagtaaaataacaaggtcacgcccgtctaaataacgtgataacattatttgatcacatcgatctgactgtaacaacgttgtaacagcgtagtactgtcatgccactgtagcataacaaaattatcacgtccgctgtgggtggggtaacaatgttattttaccatattaggtggggctcgtgtgaccagaaattttggaactttgaattgtgaaaataagttttactggtgtttatttttaaaataaattatttaaaaaaaataaaaggggataaaattcgccgtgtcgtgcgcttctgtttggagaaagatttctactccaattatttgtggagcgtagctgagagcatagtggacgtattttagcgtgtcatcaccagttatccttagccactcctttgtagagattatatagaatcgcttagttctaaagaaggttgtagttttgaattgttcagatttcatgcttacacacgaaataatcagtgcatgaataatttaacaacattgtattattgttagttggtagtatttcagatcgcagataatatgtttttctagggccgcccttttcactttttaggatactactagacacactttattttcttattaaaaatgattgtttccttctacaaaattagagtacattattatgagttggtacatatatagctagattctacctacgaagatgaagctagttatgccttatcacatcgtgcccacgccattttctgctttcgaagatgcaaacatatcttctacacacctacacagctatgcacgcaaatgactgaaacggagaaaagatgtaaggcgcgtatataatactccctccgtttcacgatgtaaatcattctaacattttccatatttatattgatgttaatgaatctctaatgaatatctatctagattcattaacatcaatataaatgtagaaaatgctagaatgacttacattgtgaaacgaatgaagtagaatacacgagacaatgcaacatttcccatattcatattgatatatctatctagattcatatgaatctagatatatatatatctatctaaattcattaacatcaatataaatatagaaaatgatagaatgacttacatggtttcaattcagtttggtggctgttagaggatatcatcataaagaccaattgaggggagtattgtttttcttcccctcaatttcgaggcatgaaagctatcggtattaacatcatctgcagttctgcacatcagtttgactcaacgtgtacgtttatctgaagaagggatggccccgaaatattgccccgtatttgtaataaatagtccaaaataataagggatatattctctccgttttatattataagtcattttaatttttctctagttactttttaaaagtttgatcaagttaatagaaaaacataataatattttttaacacaaaacaaatatattatcaaaatatatattaaatgtttgatttaataaaataaatttggtattttagatgttgttaatttttttatgtaaacttggtcgaacttaaaaaaatttaaaagaaaaggataaaacaacttataatctgaaaatgacatatcttttgagagaggcgttgtcatgagaaaaaacaatgtagcagcaccatttgggtactcatgggtatgctaaggctgtgttcttcccacacctttttcaagtcacatccctcgtattcggcacacgcgtttttcaaactattaaacttttcaaaagatttatatacgaaaattgctttaaaaaatcatattaatcataagaaaatgtgtcgctctgttttacttgcgcgggagatgagtttccagcctaattttgtcttgtgtttaatcgcaagaaatttggtattaaataattctatcacatttgattttattatatttttctcacactaagatttacgttggatcattagtatgagaaatagataatacggtcattttagaataaatattgccagttaactgacgaaatatgtatacaagatggatataagcatatagataagaccaaaacaaaacctcagggcatgtaggggtgaggtaaaattcagggcctggaaaggattgaggtaaaattcagggcatgcaatgaattttctcgggttctttttttctgtttagagaatttgaattctgtggatatgtgtattttcaaatggtgttagccaaacttcatagagaagtcatctcgaacttgattctactccataatttccacatctttgccagggattagattcttacaaaaaaaaaagaaggcgtggtaacgttgcaaagcaaatcagaaatgtagctttgctaagcatttaattcatatttcatagacgagcgcacaaaacatgtgttttttttaaaaaagaatcaatgtgttgaagcagttggtgcgatattccatcagtgtggtgatgctttcgcaaggactagagaatagtgcttgatattctgccgttccattttagccatgcgatttctgccgacacaaagaagctgtaacagaacatcatctctctcttactaaaggagggcatccatctgcctataatttgctgaggagtaactgttacagagatggtgggctaacattaatcgctaatggttgtttcatgaccagattcaacagtagaatatagtaaatggatgttaaaattaacgttctggggacatcgcagcatcctgccaactttcagctccactgattagttggcggttactggcgagaatctaattaagtttggtgtacaatccaatcagtgagcggagctctctgctccaatgttttggcatttggccaacaattaattcatgcagcgagcaatccatttcagctcgacaaatgccaacacagagataggcacgtccatgctcgtcacatgtggacttcgtttgtcaaaatggcgtgttgccaagagtgtacgtatcagtgcactccgttgcttgtaaacaactaggagaaaatactggtccatccaaaaagcagaagaaaaggaagaaacgagataaggttcatgatatatacaaggatactgttggtggtgcatgatttgcatatacctgtacaataacagtacagtacagtgggaggagagggctagtctgtaaagcgacgcccacgcagaaatgcagaatacaaaacgaaatacgtagaggaaagggcattgccgcatcaacatcacgggaagaattttgttacggccctttcaatcacggtacacaccaattaatgagatctggttcgaaccaataggctggacaaggacagcaccccgaccacttcgctttcaggggatccctgcgttaagttcttttttttttctttggcccttttggtaggctacacgcttccatgtgtctcagaaccgtgagctgtgactggctctctccggtttccctttttctttcccacccagacacccagtcccgttttttcccttccttccagtacttatccctgcgagttttgtcccatgaggccacatggacacgcaccgcatggacgcatggtcccccaaccccgaccgcgtccgatcgttcggcgtcccttcgcacacgacctggctacggttctccgttgcttggttgcttgcctcctagcgcgcgcgcgccccgtcaccgtcacgccgcgcaccacctgccaaaaaggcgtcccaccacgtcgtcctcctcctcgtaatagccggccgttgctgcgcgcgcctgcgcgccggtgcgtctctcgtgtggagaggggccgcggccgctgcgacgtgcggcacgggcggctttttctccgcaacgggtgggcgtggacggggttgggttgatgatgatgatgagtggtttctccgcgcgccggtgcggacgcattgaaggcgagcgtgagacgcgagccggcgcgcgcggtggcggaggcagccaaccaccccacccagcgcccggtgtaaatgtggtcgaatcgcgatagtcagagctgcgttcctgtgaccaccaccgccacgtcccacccagtgcagtgcatgagcccagcccatcgcacttttgcacagatggatggatggatggatggtgaggccacacagccatatcccgttcggggtcagacgcacacatgcctccattcaaagtgccaaactgaccaggcagctcgtgatggacgcgatacacgccacgaataaataccagatgagatgagatattgagatggcagttaaactaaactactgctactgctgctacacgcactggcccagcttcttcactccacgtggggcaggggaaaacagagcatggtactacagtaggagtagtacgctttgtacatctcgcagtgtataaaggacgtacggttagtgggcacggggcacgaatctagaagaattcaatgggccaatggggagtgttaccatctgaatgtgattactgttgccggagactttaaactaaatgatctcaaggcatcgtccagccacggctgctgaggcaagggtatcttgagatgcatcacgcatatggtggcatgatggatttgagctagagatcatatggggggtgtcactagtttaatccgtgggctctgcgagcaactgaattgtttttctagcgcccagtgatgactgatgactactggtcttaaccgaaagcatgtagttggtactaacaccgggactttttttacagtagctttgcaactgtgtttgttaattccacatgagcttatcaggctatgttattaaattgtgatggtataagaggagcctagcaatccacgatgccttttttttttgccttatctaaagctcacatccactggtcttgtgcgatagtttaacaaaagccagccttctctgccaaccactgcccacaatggaggacaattataccaccctttatttgctcagcaccacaagtatatttgcgagttaatcacaagcaacaggcttcgtgtattttcgtgtaatgatgttgtaggctacttgtggtgcccacataaccaatcattacactcgcctggtttttcacttctggaaattggagggcaaagagagcaacggtgctactaacatgagtaatctaatgttatttcttccacgatctcctttccacccgttttggagatcacaggtgtccatggtaagaaaaggggagaacataaaaggtgagatcaaaatagtcggtaggtagcattgcaaattttgacagaaaacaacggtttcgtaacgaagcgtgtgatgccaaaagagtctctcaaaccttaaaggtggacattcggtctgaccaaaaatttctgtcttggccttcggtctttcggtcatttcagtatttgaagagtgaagaccgaattccaacacaaaaatatcaggaccgataaattcagtctcggtctcagtcctgaccgaaattcagcaacattttcatatatgtaaagaaataatagaaattttcaacacaaaaatcacaaaaaaaattcataagcaagtatgaataaagactcttattaggttgcatgcctataagagtagggatgtgaaaattagagtttaatcctattgaacttagtgggttgtaggttgcatttagaccttttttttttaatttggtcttttcggtttattcgtttaaccgaggagactaacagaattgactgaacaaaatttggtctttcactgcccaggaccaaattgatgaccagttttctcggtctcggtctcggtcttgtcggttcggtctttttctgcccatccctacttaaaccaacgccctcttttttgagtgataattaaggatggtaagcgttgcggggccgggttgggctggaacggccccgcccccgaccccccgacttcaccacccggccccggccccgaccatggatgcgggtgaaaaatcccacccgcctccgacccctgcggggccccgcaacccgaccggggacccgcagcaagtagcatcttcatccaatcaacatagaaaattcaagacaattatcaactcagtgcatcacatggattatctcctaagagaccaactcaccaacccatgcatttgggcacactttcattcacaaggcacagttggagacttggagtattggagatggagcaatacctcgcatgtgaatcgcctagagtatttgggagtattggagacgtgaatcgccggccgccgccacgcctgtgcgctgcaacctcgccggctgcgcccgtcgcctcgccacgcccttgcatgtctcgccggccgccgcaacctcgccgcgtgcccttgcctgtctcgcctccccactgcgccctgccgccctatgcgctgccgccgcgccctgtgtgtcgccgccgccctgagctggagccgtggaggggatgggagacgtgaggccggacgccggaggggagattggagaggaggggaggggagatggtggctggcgagtggcgacgccgagatgtggccggcgagtgaaatgttccccccgtcccctccccggccaaatgcggggccccgaccccagcgcacccgcgggtgaaaaatcccacccgcccctgcctccgtaggggcgggtccccgcagaggacccggccccgcgggggaaattgccatccctagtgataatacccaatagtgtttacatgaaacaggtgattaacgacctatcgcctatgaatgggaggacgccagaagaggacagtttcctaattaagcccacaatcgagttaagacgatgtgatagaatttagttagtttcgaggtgtaatgcattcatggcctgagcggcacaagctagctaccttccgtttttattcccctccttttcttcctttccatggtgtcatggcgacgcttagcagcatcgtcttggagaggaaaacctgtaatggcctccatgactcatgagacgagatgagctagcttgtgaacaggtctcaagcagccaatcaatgtgttggcgccggccggcaaagtggcttttttgcgtctccgacatgtgaaagcgcccgttggcccccgtcaatccaggcttgacagccgtttcctttgatggtgtcatggattcggcctggaacagcatcactagcgtttgtctgacgagaagggaagaaaaaaacggacgtaaaagttcaggaataatgcagtttcctaatcctaccgtaacatcgatccattaatttcaacatggaaattttggtttttcaaatgtttaatttgaccctatacctgtgacatggaaatttctttttaaccgtttaccatggaattttctgcagattgtttgatctctgaatgggttcatgcacgcatggcgttgaattaggtttgagagaacacgcattggtcacaactttgcatatataggtagagtagcaaaggacaaaaagagaggatggttcaactacatagcgatcaaagacggctgaactgattagaagttaatagtgacaaaagcttatgtaaagtaatcttgggtaggatgagaactctatggcggggaagtttcctaatgaccactgggttaagcttttccaacctagagagagtagagtgttgtttagctctgtctttaggcgtggattcacgcagagagacgctttgccccaatctaatgcctaagcgcgtcaagctgatctcatctacccgtcaacgtgggtcaaaccagacgacttggatgccattttacacaaggttatgtgaacgcccagattctactccgtagcagtagcaccatgctggcatgcttcatgtaaacttgactacatataagctgattagcatgatggccttggctaggaaaccaaataccaaaagacttgaggacagatccgtaactgcagggtttttttactcgttttagaacataaccttgttataaactcatggaaactcgtacaggaagctctctgtggactttaggcactagtatttgagaaggcagctaatgccaagctagccggtgagcagggtttaccattccgacgaaatccggtcggatttcgcaaaatttcgacgtttcgacgagtctcgaaagtagaaatcatctaagatttcgagaagtttcatccaaatttaaatttgaattgataaaaaaaagaaaaaatcaaataaaatcttataaatactatgatattcatagaacctattgggatataaattttcgaaaaaaatgatatattatgtgtatttaaacttacatcagagaagaaaagaataaaaaaataaaaaaaggaaaacacttacatgggccggattaccgatcgaaatttcgatgatttcgatcggaatttcgcctaaaccgaccggttttcaagaatttatcggcaaactcagagaatttgtattcaaattttggtttgtgaaatttattcggaatttaccggttttccaccggatttcacgaaattctgaattccgccagtgcccaaaatggaagtgcatgtcggaatcgtaaaccctgccgtgagtgtttaagaaaagttattaagaacccaatttccagtttctaatttatttattttaattctatcaatatgaggatttttttaattattttttagaattttatttttttaaaattttattaatagacatttctgaaaattatttctaaatctgaaccttttgtcatggcgtggccaaatcactttgtcacgccacgcgtagctggcgtggcagtgttgtcttgccacaccaccgtggcaggcgtggcaaaacaacgctgccacgccaaatattttttggaaattaataaaactttttaaaaataaaaaaaatccactatgagttctaagaatttgcccgaggaaattgtttggaagcaatagattttgaaagataatacaacagttagaagtttcacaatcacaaacaaggcctaaggtacacatgcagtttgatattgatagagacatggttcgcttttcttttcaactcattgaaaacttgcatgcaacttttgaagattattcgttgaattaatgtaatgaattatctacataatttctaaaataaactttcagaaataacttagaataagttatcaaaattaaggttctaggaaacacatttttagaagcgtataacaaataatctacgaatattttagtgaaataaactgtaaagaaagtactctaacgggaatttccaagcacaccttagattgtgagccaatgattttttttaagatttatcaacgatttttgtgctacgaatgttttttgcaatgcaattcctccgtctcaaaatataaaaaattttagagttaaacacgttactagaagtgaatggtggagggttgtgattggatgattagtggagaggtaggtggaaaaagtgaatgatggagggttatgattggtgaggaagagaatgttggtggagaaattattatatttagaataaatcctgatggctaaagttgttatattttgggacggaggaagtacatcttacctctacgagtatttgaaggttgattaagcatatcagaaccatttcactattgacgggtatattgctaatagtgaaaaataattaatgtaaatacaagtcccatgttaagtttataatttaaactcgagtgtggccatgttttactaccacggacataactagccgagctaagctcagttcgtacttcgaagtgctacaaacactctggcaaaagtaggagatttattctactgtatagtctgttatactatcatattggaagccattaaatttgcaccggtttattttagggaaagttgcttatttgaccctctttcgaagcctaattatcaatatgaccctacttttttttagtttgcttatttgatcctactttttaaaaacgaatactccgtttgaccctgtttctttagcaccgttaagatttcatttaaaaaaataaaagaaataaatttattttccataatgaccaaaatgccctccaagcctatgcacatctaaccctatcctgtgtgcttgggcagcgacgcacggaggggtagcggcggcgggcctctgagggagggaatccgcgccggcgccggctcgcggagggaggacggcgacgccggctgcgggtggaggtagcgtctgtgggtgggccgcggcgatgcgttgaggaggaggggccgctgcgacggctcgacgaggagcggcggctcatggagggcggcggcgggcctccgagggagggaatccgcgctggcgccagctcgcggagggaggatggcgacaccagctgcgggtggaggtagcggcggtgggtgggccgcagcggcgcgtcgaggaggggccgctgccgtggctcgacgaggggcggcggcggcgggccacgaagggagggagggaggacggctgcgtcgaggcgtgaagggatttgccgtggtggcggttgcgggtggagggccgcggcggtgcgacgaagagcggcgtcggacaagggcctagaggacgacgactgtggcgttgctcctcctcgatctgaacaggacgagcggtggcgctgctcctccttgactagaacagggaggacggcggcgacgggcgattagcggtagtgcacaggggaagggaccgccggcggtggtggtgcggagaggagggagcaccgacggtggcagcgcaccatgtgacatgtttttctttttcggtggacacaaatttgcacgagaaactgggttaaattgacaagggtataattggaatttttgtcttgagttaacaccgtcacgttgccttcacggaatagggccaaacctcatcttcgtttaaaaaaaagaaggttaaatgagtaaagtcgaaaaaacagagttagtcttaaaattagggtaaaaaaacaattgtccctttattttaataaagcccagtttgatttggttacaaactaggacgaatatacgccaattttggcatgcataattctccattaacttcttctattccagtccattatcttctttgccaccattgatatatgcctaacaattctcaccgactacgctaatcaccgtgagcccatccccaaatctgggcccttgacgtacacgagattggccccgcggggcggcaaaaatgggcaaaaatcggtgaagaacttcgcttccactccggtctcccccgtctctccccgtttgtttcctgtatataacgcgctcctgctgcctcacacccccttggccgcgagctctgcacagcgagagagagagagagagagtagagagagaggagtgagagagccggtggcacccagctaacccactcggccgccaccaactgcggccatttccgacgacgccgacgccggggcgcgcccgtcggtgctcccaagtccgccttctctgcgggtgcgtgtgctgctgcatccagcatcctcctccccttcttcctcaccgtgtggcatctgcgtgcctcctgttcttgtgttgctcctgggctcttcttgatctggtttgcgtttgatgcgttgccggtgggagttgctcgatccgggcttggtgcttctgggttttttttttccgatggcgatgtggcgccaccatttgctcgattcggtgtccgggttctctctttttttgcgcggcagcagctagcagatttatttttctgttgccttgctcctagccagtggcgatgttggattttgcagctcccttctacttcgcatttttatcaattatttactcttttttttggtgtgtgtgtgtagttgttctcctgggctttgctctcactatgatgctgttcttctcgggaaaatttcagttctttgcctgctactctctctctctcttccttcgtcctctgtggccgcattggattgttttcttttgcctcggtgaactccatgctcacacgaatcctcccttgtttcttgctccgatttcagatgagaagctgctccaccgcggcggcgacagtgtggtcggccaccgcctgagaccggagagccatagctgacggctcgggggaagattcaggtgggctcgcagagaacgaaagagagtccccatgggttctttggagacgacgaacacgcggtaccggccggccggagcagcgtaagatctccctaccaccacgctgtcccgatctgaagaaaggctccacctttgcgtgcctctcttccactgttcttctctctctctctctctctctctctctctctctctctctctctctttagctggtttacatgctttgatgtatgtgctcgcttgctaacccggctactgtggtgcgttgctttgccatgtgctatcatgtgttgcatgtcgagttcgattgactcaaaaactaattacttctacttcttggtcgatgcgtggcgcccggcgccggccatatcgtcgtggtattcttgcaggaggtggtagtggtgatggtgtactggtttttagtacgctgtacaagatgccgttgttctccttttggtctccgttcatcatgctctcctccttaacttccctcatattgtaggtggtgtggtgggtggtagttgtgcagcttttatggcatccatccttccatttttttccatcctcccccttgttgatgctgctgctgattacagctaagagagaatcagagaacagcagaaacgtgctatctctgcatgttttactctctcttttctagtgtgctgctgctcctgatgcgagttggtttgatgctgatgtgtggagaaaatggatgtctgtttttgcggattttcctttatctccagacggaaagttggttttacttttgtggccatctgatcccctttttagcggctgcaatttggttaaattggatgtgctgtgatgtggagccaggcgtcggtggtcatgtgttttcactgccaatttgaccccaatgactgcaccttgcatcgccggtgccattaaaattgctacacacattagttccatgtgcagtcctcagtggtcaccagtctttaggcacgttgaagcgtaagctacagttgttttgtgcctgtgtggcccatcagcgccaaatgggcgagcttagcgtgtgtatagaatgctgggttttggctagttggatgcttcgatgcacgctagtctagtgggttcagtagtcaggggccggctccgttgttttgaatcaaacttcttgacaaagctttggtgttcacagctgggattacccatgagtgcagcttttcgtttcatgtttaacgttatttaaatcgctaagcgcacttttaaatttgagaccaataacatggggttaggtactggagtatctttgtgattagtgatgcttttctttcctaaaagatgtggtgtgactaataaaggaagaatggaggaaaatgaattggcaccacttctttttgctaatctttttctttaattctcagtgcggagaaccttgctattttgttctctttagccttttttctttgatagctaatcaactttactatgatcgcttttccatactaccgtatgagagattaagtactcctttgaaaagatgtgctatattttttttatagatttagtgttactagggctgtttgtccatataggccagccagatcaaatacacacaagactagtgcaaacttctaggaaaacaaaacatgatcaccaagaaaaatgttttctaagctatctttttgggattaactaatgggaacaatggggccttacaattgatatggaccttggctagcaatttttattacttccatgtgctttcgataaaacagtacaacaatgtaagctgttttttggggaaaatatatcatacttatttattcagtagttctttcatatacaatttcttcttcagacagaattcccccttgtgtcttcatacctggtgcaaattccaaagttttgtttcatcttgctgactatcctacattcaggggttgctttctgaattgttctttaccaattattatttgatgcccaaataattactgtaagaagtcgctgtctgactgtttcttctataccttctttcagggatgacacagctaagagaaggacccagaaaagcaaaagtttcaaagaggtcgaaaaatttgatgtctttgtcctagagaaaagctctggttgcaagttccggtccttacaacttctgctcttcgcgatcatgtctgctgcatttctgacactattgtacactccatctgtgtacgaccatcaaatgcagtctagttctcggtgagtagacctatcaaaaggaaacttattacaatattctgtcagcagtagaatatccagtggaaactagaacaccaattcctgctcgcatcacagtggttatgttggagttatatataataagaaattgcgcattaccctttttgaccatacctttcatatgctttacaggtttgtcagtgggtggatatgggacaagaccattcctgatccacgatatgtatcttcgcttggtgttcagtgggaggatgtatataaaaccgtcgaaaatctgaatgatggtgaacggaagctcaaagttggactattaaattttaacagcactgaaattggctcatggacacaattgctcccggatagtgatttttcgatcattaggctagagcatgccaaggaaagcatcacctggcagactctttaccctgaatggattgatgaggaggaagaaacagagataccatcgtgtccatcgcttccagatcctatttttccaagagggacacactttgatgttgttgctgtgaaacttccctgtacccgagctggtggatggtcaagagacgttgcacgtctgcatttgcaactatctgctgcaaaagtggcagtgactgctcaagaggcaatcgtggtatccatgtgctgtttgtgacggattgcttccctattccaaatctcttctcttgcaagaaccttgtgaaacatgaaggcaatgcttggatgtacaagcctgacttgaaggcactaagggagaagctcagacttccagttggatcctgtgaacttgctgttccactcaaagcaaaaggtatgtcttactgccttcatttttaaatggcttcccatttcatgccacttaatccctatgatatataacaagagagccaaatatgaagtagttaaaatatcgatgttgctgtaagtaagcttttagaatctaccattgcatttctttttcgggaatgagcaagagtggttgctttatcgcagatgtatcagtaatgttttggtgattttgtccggaaatgttagaacatacttttgcaccttctagttttattttcctgcgtggcattgaaatttccactagataacatctttcatctcctttacagcacgactttactcggtagacagacggagggaagcatatgctactattctgcattcagcaagtgaatatgtctgtggtgcaatcacagctgcccaaagcattcgccaagccggatcaactagggattttgttattcttgttgacgagaccataagtaaccaccaccggaagggcttggaagctgctgggtggaaggttagaataatccaaaggatccggaatccgaaagctgagcgtgatgcatataatgagtggaactacagcaaattccgtctatggcagctcacagattacgacaagattatatttattgatgctgatctcctcattctgagaaatgtcgattttctgttcgcaatgccagaaatcactgcaaccggcaacaatgcgacactgttcaactctggagtaatggttattgagccttcaaactgcacattccagttgttgatggaccacatcaatgagataacatcctacaatggtggtgaccaaggatacctgaatgagatattcacatggtggcatcgaattccgaagcacatgaacttcttaaaacatttctgggagggggatgaagaggaagtgaaagtgaagaagactcggttgtttggtgctgacccaccaatcctctatgtccttcactatttgggtctcaaaccatggctgtgcttccgggattacgactgtaactggaataacccgatactgcgggagtttgccagtgatgttgcacatgcccgttggtggaaggtacatgacaagatgccaaagaaacttcagcactattgtcttttgagatcaaggcaaaaggctgggttggagtgggatcggaggcaggctgagaaagcaaacttcaccgatggacattggcggaggaacataactgatcctaggctgaaaacttgctttgagaagttctgcttctgggagagcatgttatggcactggggtgaatccaagaactcaacgaaggaaaaccctgtgccggccacacctaccgcgagcctcacaagttcatgagatgtgtagatagccctataccagatacaaacttctaagctccatacatacatagcaacagcttgtaaaggtagctatgcttaggtttctcgacaaaactataccttgtgtttgctatcatggcttcggctccactctggctgctttgatagctcacaatttttttggttttttggccaataattcatcagtataggtaaattttctgttcatgaattgtttggtcagtctggggttggttgttgctcggctgcaatagcctagttcgatgtatggtggttgaactgtttcggtgataaaatctggagtgacgcaacatgagattgctgaccagcaaacactgcctcattttgacatgaaatacagtattgttttaaaattgagttggattaatacggtcacggctgacatccacagatggttggacgttggagcagctggggccattttgcactggaagtccctgaagcacacgaggttgtatgtatgctttgcttatatttggcatacttagttaaggcttaagagatgggaatctttgtttttctcatagcaattaattgcgggacttgcaatcaaacatgcattcaaaactcaagtgatgagccccattcgtggggcactgatgcacagctgcacaggcagagaggcagtgccaacctaacaatgcagcattgaaacgcactgctgctcactgcaggtgtggaacatgggcacaaccagatttctgaagagatctggtggcaatgccatgctgccaaagaagaacaacatcataatttcccagtatcaattatttagccatgcttccgttccttcgagatgcagcctttcgggggtagctcatgctgctgcccttttccaacggcaacgcaccgactaaagcagaagtgttaggctgtacaatttctagcagcgtcgttcgccaaagatactcctaatctctctttctagtagtacttcccttgtccttcaagatgggagtagttggaggattgcatcacaagtgattgactagtttacttctcaagaactagtagtggtataatgcatttatgcatctactggtactttactacatactggtactgttcatccacgagcttggcattgggggcagtacacagctaacggagtacatgagcaaattttgtgagagaagtaacttgcaaatgcagtgagccagaagctgaaacatgaggaaaatgtgaattgcgtgagcatccctagctaaatctacaggagtcgtagtaaacgaaacgggtcagctactaaggtttcatcaagctgttgtttatgaggttgctggacttgttacgacttagcacgaacataaacaaattcccagtgggctgcgagacatttcacgcgaatatcgtggaaatcctaccaacccagccgtccagagagagagagagagagagagagagagagagagagaggcgtacggggtaggagtacacacgtggtggtgttggagtccgggtgtcccttgtccgggcgagcacgagagtgtggcgcggccaccgagtgtagtatgtcatcttccgcggccctgcgccacaggcagcacccaccagcgttgtcaggcaaagcgagcggtcgtcgcgcatggtagggcatggaccgactccactccagtgcccactgccctaggcagggagggacccttcccgcgacacgcgtcctctcgtcgtacctggtgccaggccagacgccagctttcgtgctttgaccggctaaagaaaacgggagggcgaagggattaccctactacagtcttgtgcaagccgtcgccgtcgacgcggaggagggccggccggtcctcacgctgggacgtaccgcgtacgtgacggcgtgtgcggggatgccatctgccatgccggtggcagcggcagcggatcgggggcggctagtcagattggcatggggacttcgccgagttcggctgcgggggcttcgaatcggagaagttttcgctcagaaatagcggatcggggcagctcccggccggtgcacccggtggggttggcgtgctgctcggtagccggatggtcgatgggttggcacggatgccacgggccggacgtattggactattcggttggtttcttgctcgtgttttgcgtagtggatatggtggccctcgtaaaggttctcgtgttcgtgttcgagtagtggatatggtgggcctcgtgagggctcagtagtgggcatgtggtcatccggtacagaaggaaagaagcccacaaggagaacgtgtacaaaggatgaaccgaactcaaaggaaaaagttcaatcagagttcctaaaaaatatagatcggatattattcgtacaaccataaaaccagttaagaacgactccctctactattaatacaggttcaaatttacctccacatgtgatttggacaatggtttttgtcttatgtgccggcacactaacctagtctttatcctacgtggcacatctatctattatatatattattaaaggaatagaaaaatgagtctttacgtttgctctcatggtctagaaattttcacattaatcggagaaaaagaaaaaacagagttcatatagaaatacaatttagaaatagctgaaattcggaattaaaaaaaaggaatattagaataggagactagagtccatatagaaatacaattagaaaataactgaaattcgaaattaaaaataaggaatattagaagtaaagtataaagtccatatagaaatacaattagaaaataatagaaattcgaaattaaaaataagaaatattagaagtagagtatagagtctatatagaaatacaatttaagaaaaaaatagaaattcggaattaaaaaataaggaatattagaagtagagtacagagtctatatagaaatacaattaagaaaaaaatagaaattcggaattaaaataataaggaatattagaagaagagtatagagtgaatttaaaactaactaaaattcagaacaaacataataaaattaaaagtagtgtttagagtccgtataaaaatacaatttacaaataactaaaatttgagattaagaaaaatatgggaagaagagtttaaagtcaatataggaatgcaatttagaagtaactgaaattcgaaattaaaaattaaagaatactgaaagatgagtttagagtacacatagaaatacaattaaaaataataaaaatgcagaaataaaaaaataatattataataagagcatagagtctatatagaaatacaatttacagaaaattcggaattaaaaaaataaatattaaaagacgagtctagagcccatatacgaatatatatatatatataatttacaaataattaaaatttgatattaaaaataattaataactaacacgtatataaaatacaatatgaatattacccattagtagtttcgtaaagttattgcaaaatttaaaattatatcattttaatatatttgaataatatattgagaaaacatatatattattattatatgagagaaaatataatgatactagccgcgcaagctgcgcaggccaccatactagttttttttaaatagtggacccacatgtaagtccatgtctcatattcttcatcacgtctccctctctctctttcctcttccttctcttcactcttcctcccatcacacttccaacaaacagtagagacagagagcccgagaggggtggaggtggcgatgaaccggagccaggagggcaccggtgactattcccctcttcctttcgtcctctctcctaggattggggtgccatggtcgtcagaagcaggaagggcgtggaaggcggtggtggttccagcagctccctacgagttgattgacttattattttttaatcatttacatgtgggatatatatatatatatatatatatatatatatatatatatatgttttaaatttctttgatgattgggctatcacatgaatgtcacattagtaaaaacgaccatcaacattgtcaaggagtttttttgcacgggtttagtggttgctaaataagatcggacctatattggggaccttttcaaaattctaatctgcttctatctaaaatgataagttggttaagttgggcttgaaggtcgaactcaagggtccaaagaaggcctctctgaacaagttgggctgggcccgtaaattctgtgtcgcatttgataatctcattcaaaaggcagtcaacaccctttgtccatgttccttactacaatcctacagtcgaatagatggtcgtttgccaggttcgaagtggattagcatcgacgatccacaaacatcttggcgcttctgtttacttgacattgactggtgcgtcacggcgcattcgttgtccagtgcacttccgaagtgggtaggcggaggcgcagagcacaactccgaagttggttggtcttggttcagtacttctgctcgttgggtcgtagggccggttgcgcacatctgcatatggggcggtgaagagggcggtggtcggtggacgctacggcggaaaaaaggttgctgcgagtgatggcctgatggaccaccactacgagtgaggcgagatgataatgttctggcgacgcctcagtcatgctaattgcggatagcgcacgcggcacgccgaacctatctgcttgtctgcatccgcactcggccgactcaaaattggaaatttcagctgtttcttttcatagatttagccttcacgttcacggtcggctagcactagatcatacatcctcattgatcaaggaaaaggctttggccaccctttcattaaacattatgcacggcacaatgcgtttgcacagttaaatggctatacgccgttggcagtttggcaccatctcattcgaggggatcacacaatggaccaccatttacttctttttatgctgctctaactaatgtattttgggtatccacttgtcaccctgtatgaagctggcgacgctgtacacgtcgacgtggtccctgggcacctggctgctccacccgatcctgctcccgctggcgccgtcgccgccggggccggcgctctcgtactcgccgtagtagagcgtcttgagcgcgaagtcgccgttccacgccatccacccgcgcggctgcacgatctcggagagcgtgcagccgacgtacaccgtgcgcgagtactccttccagggccggcccaggtagacgtggtgcacgtcgggcttctccctgtacagcgccatgtagtcgtcgctgccgttgacgacgcagccgcggagcacgatccccgtgggctgcgccgggtcggtgcgcccctgcgcggtgacggcgtcgttctcgcccttctccgggcggagctgcctcgggaggacgatgagggcggtgtcgcggaggacggtggccgagttgccgaagacgaagtcgacggtgccagagacgcggcaccgggtgtagaactgccgcatggcgtgcgcgtacagcgtgtcctggtggcccaggagctccaccgtgtccagcaccgtgcggtcgcccgtcgaccggaacgccaccgcctggtgcgcgtcgggcccggccgtgttggagatcgtcaggtcgcgcgccatgaagccgtccgcgagcacgcctggaaacagataagagattaagatcaccaaacacattacagccggattaggattactgtgagcacgagtacgatcacgtctcgtgacagatagtacatctcagggtaaagttaaaactgagagttgtgactagccgaacgaaccatgccaggtctagtcggcagtccacgcctagtttggctatctgtttggcagggaccaacaaaagggaaaggcacgaaaaggtacaatcttttactttgcctatgagtagagaggctcgtgatgctgggacgcattgtcgcttccggccacactaattggatggcctaagaacgaataaaaaagaacgaatgtttcattgcgcgataagccgattgattaatcatttgcaagggggaaaacacaacaagtatttatcacatcccactatcccagatggtttgtactctctttctcctccaaaggtctggagacagagcctaattctgaagaaaaagattgttttagttcagtgccaaatcttgcccttctaaattttgtagtctaaatagtactacctgtgtggtgtttggggttaaatgtaatacttgctacatcaatagaattctctatcaaaatattggtagggccaaaacttacctaaaatttagggctaccaggaaattggtgggccatgtacctaaagatttggaatcatctttgtagtgtatagaaatttcatatctgtccaattgtccaatgaattactctagcacttcaatggcaattagcagccattaactgcatgcggtactaccacaagtttttttttttataaaaaaaatatcaacaccaactaaacacagcataaccagggtttccaaaccgttggggccgggactaccgcgcctcggcggtaagcacggttaccacgcagtaaccgtgaaaaaacccgtacgaaaccatgcaaaatttatcaaaaatttaaattattttttaaatttatttgaatttaaggaggttaccgcggtttttctattaccgtaccctgcggtaaccgcgtggttaccgacggtaatgtaaaccctgaacataaccagacatgcacacaaatatatttgtacatcaaaatttgaactaacgtaggtagagtcatatatacacgactcaccatcacacaaatggcgttcccctactaaacagatgtcctaaaagcgtgaagtcaaaccttgaaaccttacatgcttaattaattaaaaaatatttagatttcacacaaaaccatattgatagattttcatgaaaaacactgcaagaaacttatattttaatatatggtattttttttacaaatatacatagttagataaatagcgataaaaaatgcatcagggattgcgttgatctccatgtaagactagggtagggtagtgtctgactaattatcatggacagtggaaaagagatattgggggtacaattttcacattctcatggttaaataacttcctaatatagacgtagtcaagtagggttcacatcatctattataatgacattcttgttacagacattgacacgtagaacgatagaagggtgagatccatatatcaggccatccacaatgggtgtccctgggtcgtctccctaggaacggccgtctgccctccgttagcttttcagtcggaccttctccactgccaggcgcgcggctcctcgctaggggtcgcattccttagcaacttttagctgagacaccgagccgggagacgcattgcagagggcgtggctaggtgagtgtcccatggacaccgctaccaccccacattttaccgttccacccctcgccctcgtcgttgggagtaggtgacgaccggcgacgaccccgcgaaggcgacgggcggaggaaaaggggtggcggcgcggcacacggcctccggccgaccccgtgacgcgcgagagagagagagagagagagagagagagaaatggatccgacggcgcagcacgcgacctccggcggcgacgagggatccacgcgccactcgccaccaccggcgccgtgcctgccaccgccggcgcctcccaaatctggccgcggggggcccagatccgcccactacggcgccggatctggcgcccccaaccggcgacggcgcgaggcggaggatgccggggaagacaacgacgagcggcgacgggagagagggagagagaggggcggcggtggatgccggcgacaggagaggcggccctcctcatcgtcctcgtggccgccagcgaagggagaggggagcggcggcggcggcgaaaaaagaggagggggcggtggcgacactggcgagagagagagggcggcgaaaaaaagagggggcgggagagagattaggggtagggtagtaaaaataaacatgggactttgtgggctgggatacccattgtgggttggagtgtctctattaagtttcttcagattttgaggagcacatccaggggtgtcctctattgcaagctaagtttccttatgagtgtttttagttagtgaagatactctatgagtgtctcacaagctaagtttccttatgagtgtctttagttagtgaagatactctatgagtgtctcacatctaggagtgtctcacatcgtggatgctctcaataactgtaatggtagtatgtcagaggatcctcacgcatgccgaacgcaatgttcacaaaagccaacaattaatggccgacgtcacaaattcacagaaaggcattttaggtgcagacaaagtgctaaattggctggtcacgagcagcagctaatgacaccgcattgattcatgcacgtaccacgtgtaccaccgtagagaaaaaacgtacgctgtgccagctaccgtatacgtacaaagacaagatagcgttgaaagaaggggaaaaaattacgggtatacgcacctacggtggccgtgttgaacgtggagacgcccggcgtgtcggcgttgaggtcgccggtgatgaccgtcttccccatgccgtccccgacgaccaccacgttcgtcttctccaacggcacgttcaccgtctccttgtacaccccctccttcacgtgcaccacgaacatctcgtcgccgtagtccggcgccgccgccaccgcctcccccaccgtcttgtagtggcaccccgcgccgcacaccgtcacgttgggggggagccccttgggcacgccgagcgcgtcctcgtcggcggcggaccccgccgccgcgggcggccagtagccgtcgcgctcggtctgcggcggggcccaccggaaggtgtcgtcgccgtagcgctgcagcgcggcgagcatggagatgtagttgctgttgacggcgatggtgtcgtcgaggtaggccatggcgtcggagatggtgcgggagaagttgacgtacttgtaggcggaccagcagtcgtagaggtggaggagcgcggtggaggcggagaggagcgacggcgacgacgtcgagggcggcggcgagaggcggtgggtggagaaggagaggaacgtgaggcagttggtggcggcgttggtgaggttgacgttggaggaggcggcgaggacggaccgcgccgtggagacggccggcgggatgcgggccctgagcgcggagagcgtggcggcgaggaggtccggagtggacgcgtcggcggaggcgttggagagcgtggagacgcaggcgggctggaaccgcgtggcgttgcaagcgaggaggacggcgagcggcgccgcgtaggaggccggcgccggcttggacggcgacggggcgtggtggtggtggcgcgaggagagggaggaggggaggtggagcaggaggaggaagaggaggaggcgaagcggcggcggcgacattggagacaatgtctggatggagtcgagtgggaaatggagtggagtgtgtagtggtggttagactggttggttatatcggcgacggtattaggcgggggcagctgaggcttggttgggcaaatgggcaagggaggaaagaaatgaagaggatggattttgatgggtgcagcagtaatggaaagtactccccattgcagataaggcattgatgtgtgtaaatttgctggtaacagttgaaattctgctgttggttttgctaaccatttatgttgttggattgtgtgttccatttctaagcattgcacccccaagatggaacggaatcagatctcacctgcggaagttccgctagtgcaagaccggtgatacaatgtctctccgcaaaccacagtcttcgtttttactggcagaaagtaatataatgcagataatttcattccactgcattcccttccccacgaaacactgtcatgatcatcgcacgatttggagtttgatagcattcctcacctctacatgctctgccctggtttgcctcgtgaagccgacatgatagacatcttttgaagctacgctaaggatacttgaaattgcccaaccgtgcacggcagacacttccctcttgggttgcatccccgtccgggtgaatctaaagagttcgtttagccatgccatctgccggtcccagcgaacacgaagccatcagtccatcacgatgccgggcaaacatgcacagtttttgtacatcagcatacgttaatcatggaaaactaaacaacctgttgtcagtttgtcacatattcacaatgtagccatgtgacattgtcgttctgtgattttgtcaccacagctcgctccccacaggatgatgtcgcggccgtcgaatagagatgggtggttttttcacatcctcttccacgtagcctactggttccctggacatgatcacgggaatcacagtgcacacaggtgacaggtcggcatctggcggatcagtgtccacttagactgtagagtgtacagtactcgccagttaggcacagccgcatagatgcaaatccggaaatgctgcgatatccttcacaatagatttagcatgaattcaataccactgcagcacaaaaataaatagagcaaacagattatcttatggaaaactgttgattgcattctatgtacgactagcacaaaagaaaaaaatagaccaaacagatttcatgcatgagaaatgactttccaaaacttgcaaatgaattggtgtttacatacaggttgccgattgtgatgttctgtctaaaacgcaaaatagacaatgatacaaaatctgtaaccccggaggcgtgtataaggagcacttgaggaaaaggaaaaaccaagatgaagacatgctgctgtagtgctgtctaagaaaaaaaaatcatggtccgctacttgatagcagacgaagcagaagcagcagaaaaacaaaaaagaaaaagaaaaagaaaaacaaagtataatgtcagcagtcagtcagccagccaaatttcgccaacctgcaaaattgcacgtgaggaaagatcagatcaatatatcaccatttatctccatcaattcaaagacagcagcgcatgcagtggaaatcatcgtcaacagattgaattctgcatatactagctaaatgcccatgcgttgcaacgaaattaaaaataaattatgtcattacttttcccaatgttaattgaaaaaaaaatcatattttctttgaaattcgatgtgaatggattatgctggttcatatggctcaccttttgatgtagagtggtagatgatggattcactgatttgaatttcaagcacaaccgtggttacactgacagcatgaacccacataagtgcataggtatggtggcagattcaccaccaccaccattgaggtcttttaaaggagtatagatactattttttctatcacattcaaagtatattcgggataagattaccataaattatttgacaagtggagtataggtaagttggaagtattcctgtgttcaggtaagttctctcccacccaatttcaacattgagcaatcatcatgtttagtccttggttttacacaaagctagtacaaagttcagttttttaattatgaaccgaacaatcttaccaggttttgatgtcaaagaaaaaataacaaggggggacaataggtaccaagtaatacatggcatattttgcactatatataaaaaaactggagggttccaggttagcttgcaacaaaaaataacttaagagaagaaaatttttgtgggattattactacacaatactttacaggaatagtgttataaataatagagtaaagtgcattggcgatccttaaacttgtagggttgtgtcatataggtccgtaaactatcaaaacgcatatccaggtcctagaacttgtcaaagtgtatcatttaagtcccaaatcgacacatcccctctaggatcctacgtggcgctgatgtggcatgccacatagacgtgacgtgtcattttctt

SEQ ID NO: 33503 - DNA, 50056 bp, Oryza sativa
  unsure (1)..(50056): unsure at all n locations
agaaaggagacgaaacgggaaaaaaagagaagaaaaaaggaaaaggaaaaaaattaaatgggttccatttgtcagtcaaaatgatgccacatcatgtccatgtggcatgccacatcaacgccacgtaggatgctgaaggggttatggcgatttgggacctagatgacacactatgacaagttctaggacttgaatatgcattttgagagtttagagacctagatgacacacccctataagtttaagggccatcagtacactttactctaaataatatgttaaaagaatgataatgtaaaggatctcaccatttgtcaaaaggtgggaaattactagttcattccaagcatctgggactccaggaaggcaccaatgactgcaatcaagtatggttgaaggatgactccatataccgatatgagcatcacttctgaaggcccccatcaaagtcacattcaagatagttgcaggaacgctcatgttcaccacaaccccagcgagtatatctccaaattcacttctgtcatctcctttggcctcagctgtaggaaattctgttacttcacataccttttgatttgaaccactgtaagtatgcaaaaagggaaaaaaatacaaatgagtgtatgtctttcgcaaatcatttacactttcttcaaaccacaacagtagcagtcttgttttcattaggtgcctttataacacaatacaagaagaacaatacactggaaaagatccgatgtatgtgagaaaacacacctccaatgagatggctcatacgtgcggaaaaagacatgtgttcgttttaaatccaccttttccttcacccatgaagcccatgtttcaagtgccattttgaaagcagaattaatggatgtacctagtttaagcaaacctccagcctcaaaatagcagcccctgttaaaaacacaaaacaataattacccattagtgaaacagggaaatgacaatttagtagattgttcgtaaattgtaacaatttgcaataataggaatccacattagtagaaacacttctgaggaatatgcacaaacataacttaatagcataattgaaacacaatgcaattatcgacagtgtatatttcctaactacgactattctggtgaaggacggaatgcaccaacatcagccatcaggcaattttgacaggagaaacaaaaacactggtacttgtgttgctttgacctcaagtaacttcactaagattgcaaggcaacccatcacttgtttttgtcaatttgttactatcaatacttttgatcagtccacttcatgattcctgaacaggataaattgtgttgagctcttaaaaaaaatactgtctagcacccctttgatctaggggttgcttagaagtcacatactaaataacagatatctttcaaagcgacactgtgctacctatatgccaaaccattggcatgcacagaacatctatccaaggatttttcgcaaaaacaaatgtattggagcaaacatatattaggttcatgatttttaagttaactgcagtagatatgacaacaattctaagaacaaattggtgttgctaagtacaagtacaataagaaaactcacatatcaaataatttgctgggagtccaccaatgccctgagttgaaaataagcacatcagcattctcccatttccggctgatattatccatcttatcaagcttgagaattgctcggaccctttttgggctactgcgaggtgcagggctctgttgtacaagaaacaccgaccggaagaactctacattcaggttgaatgacgcaaatctcactcctaaaaaccggatagtctttgagatctgattgccattaacctcataaacagtcttgggattctccacccctgccatgagcatgcagatgaaagattcccactgtgtccggctcatggagtcccccacaaacacaaccctcttccccctcagccgttccaacacatccctggcactgaaccgcggcaagtcgcatccccttggcttccaccgccatttcaggtagccggtgtccttcctcccatttgccaggcaattgaatcccctctccacaaacgggcaatcggagctattgtacaaagggtacctcctgtccggcacccagcttccgtcgaacacgtcgcaggactctaggttgtcgccggcgaactcggcgaccgcatggccgcggccctggtaccggaagagatacagatacagcgcgcaggcgagcacgagcgcgacggaggaaaggaagaaggccaaggcagcgcactcgaacgacggccccgagggcgcccaccaccaccacttgcggtgcgcggccgccgccgccgacacccgcgggctcccgacgccgcccctcgctgtgagccgcgccgacgtgctcctgctaaagctcccggtcaccatctcgccgccgcatccgccgccgcctgatctcccatcacacaaacccccagcagccaaatctgctcgaacaaatccaccggcgcggcttcctatcccaatacgccgcgttcgaatccctccgccaaatcgggccggatcgaaccttgggggggccacctaaccccagtcccgcgcacagctctccagatcacggagcaccaaaatctcttgctgcccaccacggaagaggaaggaaggatttccacgacgaccgggatcagggccggctactcaccagattccaaccacccttcttctccggcgatcgccggagcggccgcacccagccccctgagcaggctccggaactgctcgatatcttagtgggcgcgtcgcccggcgacctacggctacgtcagcgctggcgcggcgcgaggaggaggaggagggccaagtccgaggagtagaggaggaagacgacggctccgcgcagaggaggagggcggtggctgaggaacgcgtgcgatttaaataccagagcttccagataccaggaggaaggaggtttctaggctcactgacctgtggggccagtatatgacctggcccacctggcattgagttgcagccgctctgcgctacgtgacgtgacgctttgctttttgactttggcggtgtcgagaggagggtggtggttctctggtcgtgcgcggtggtgaggtgaggtgaaacgagtggtctaagaaaaaatttaaaatttgttatatcgtgggaccgagggagtatcaccctaccggtaacatcaacggccatacggagggtcaagtgttcatcggtacgaccgtactcgcccatgatctgtccacatcacgaaggttaggggaggtctgcaacttttctgccattctcagctcagagttaaatgtgaggagaaccggagatgggctgatggattgggaggccttctaaacgaacacaacgccggatctaggccagctttcatgtgcggcgcgttagtgttccatggcctgatctaagaggccgaaaccttcgggcaatcctttataggcccaactacaacagcccacacgtccgtggggatcccgttaggccgtttccgacccaacagctacggaccgcacgttctcaaagtccggcctgggcacatctgttgcacgtaggaaaggaataagtttactttgtgaccctcaaaagtgatcgaaatctaatccgtaaccctaaaccacaaaaccggatacctcgacccctcaactcttaaaacaagtgcaattcggtggttttggaggacggtttcgctgacgtggtgcctacgtggcattctagtcatcaaataaattaaaaaaataaagtggggcccacctgtcagtgagtcctctcctacgttctctctttcttcattgccagcagcggcgggaggacggggtgagcggcggcggctggcggcatcggggcgcagcgcagtcggcggctaggacggcggcggctcggccgcggaggctcgcgatagtgggaggacgaggggaacggcggcggcggcggcccaatatgctgctcgtcatcctcgcccttgcggttaccggcgcggtctccgacggctcgcgagtcgctggaccacatctccatcaactgcatcggcgtcgggggacatgtccggctgccgctccgtccactcgcgcccgttcagcaccgatgaggagggcgaggctcctcgtccccgctcagccgcggctcttcttggatagtcccgactggaggcagtcggcggcggggagggagtgggaacgggagcgggacgatggcgacgagagaagaggaagctggctcgcgtcgggatcttggtggttcgtcggcgatgatgccgtgtgcgctgatgtgcaatcttgagctttttaatttctgttttgcatgcatatagtggctggggctgaagtctggcttgttctttccagttatgcatgtaacgaactgctgatggagatgaataaatagagaagaaaacagagaagctgcggtgactggtgagacttaagcagcacaaaaaccactctgttcagaactctgttcttcggtttttcagtttactgttcacagtcttacaatcttcagagtttcagagattcagtgaggttgagcgtgtgagttgtgagcgaattgcaagtttcctgacgacggtggtggtctccccctctcccccgccgtaggcgacgacgcgatggtggagagcgcatccagcgcgccgttcccgagcgacaggagcgtcacgccggcgatcgtcgggagaggcggagcagccacgagaggcccttgaggctggagcagaagtacaccgccgccgtgtcaccgagcaggtagaacagcacggcgagccaagccgccatcacgccgtagccaagaacccgccgctccacaccgaacacgcagtcgaacaggtacaggtagtcgacgtagccacgcgggaatcgccggcgatcatggccatcctcctcggcgacgtgctcgcacctctccccatagctctcaacctggaatacgccgccgccatcgcgacgcccccggatcccgccctccttggacgacgataccacctccggcggtgtgccgccgcgcggcaagatgatgaagaagaaggcgagcaggagcaagaaggccacggtgacgctggcaccgatcagcacccttgtcgccggctagtgcggagaacagacgacgaccccatctcgccgagagctggcctcgccatcgtcgactcctccactgcggggaccgcttcagctcccgccgggtggcgccacaccgcagcccatgccctgccgccggccgaaggggaagaaggggagagaaaaagagagagaagggagagagggaggaggaaggaggactgacatgtgggtcccacagttagtgggccccacattttttctgtgtgtgaatgacaaacgggtcccacgtaaattttttaactttaatgccacgtaagtgccacgtcaaacgccacgtggatcaaaggcttggtcaatattgccacgtaggtgccacgtggcgccacgtcagcaaaaccgctctccaaaaccaccaagggagtcaaattgcaccggttttaagagtttggggggtcgagatatccggttttgtggtttagggttacggattagatttcgatcactctttaagggtcatgaagtgaacttattcctgtaggaaactatgttggaaaaagtacaccgaaggtccctcaacttgtcaacgagttacaaaatcgtcccctaaccgcaaaaccagatatccaacgtcccttaactaaccaaaaccggtcacaaatggtccttccgtggttttcaccccggttttgtcctatgtggcggctgagtcagcgtgggacccatgtggactccatatatcaggctgccacatcaacgttgaacaccatgattagcacggccatcaccaggtgtggccggtacttgcaacgaagaagccgccacaacgcgcccgactcgtacctccggtcctccnnnnnnnnnnnnnnnnnnnncttgagctcggcgtcgacgtcggcggtggccgccccggccctgcggatgcgccacagcaagtcgcgggcctcgttgagcctcccacgcagcgtgaagctgttaggcgtgtccgggatggacgcggcgcccacgatgacgatgacggccgagacgatgtcggcgccgagtgagagtggaagtggcggcgagacaaccaccaccttattgggcttcggcgtgggaggagacggaagtcagcggcggcggtgcagcgcttagtgggggagctaaggacagcgagacgggcaaagagcttgaggaggcggcggtggcagccatgggggtcagagaagggagagagagagagataaggaagggagagaagaggggaaggaaaagagagagaggaggctgatgtggcagtctgacatatggggcccactcagccgctacgtaggacaaaaccggggtcaaaaccaccagagaaccatttgtgactggttttggttagttaagggacgttggatatctggttttgcggttgggggatgattttataactcgatgacaagttgagggaccttcggtgtactttttccaactctgttcgcaccgggaaaaaggtctattctacctcatagtctgatttctctatctcaatcgttaaaccaaacattaagcctatctcaactatcaattcattttaccaatatgacacctacatgaatttttttaaaaaaatactgtagaaatcacgtgtaatttttccaccctcaccttataaattacaattaacgaagaaaaaaaaatcaggacccacgtgtaggtggcccattcgattgagaagtaggagcccgagcttgtccaccccgccactggtgcggatttgaagcatgaggagagaccagctagaggcaaggcgtataataacgtgctatcatcaacagtagtggcagagagtatcaacgatggtggtggtggtgagaggattgaaggagcactccggcactagtgcttggaggtggtggcctcgtcgttggatcggtgcaaccatgatccaaggtaataagtatctagatactaccgtaggatcgtaagactatcagattttagaaattacataattttatataagatatataatatgttgtataaattaaaatatataatattgattttgataaatttaattggtttttatgtaaacttgagcatatttattcacattattttcaatccaccttattaaataatatttggtaggatcgtagagatcgtaatatcgggatactatccaagatttcgtaggatcgtgtggaaataaatagtaagatcgagtaactatgaaaattacgatattagatgagatcgatatcgttttgaattcgtagcatactatcctagtatcgtaaaatattatacagtttggggtactgacaaccttgaattgcatgtgccccagcggatccaaccgctgacacactcaatggcaaaaggagggattaggctatcagtgcacttgacgaagatgaaggatggccgatgtgtgagaagataggggagtggggagtggggaggagagagaggatgacatatggactaattgctttattattattattattattattattattattattattattattattattattattattattattattattattattattattattattattattattaactacgtcaatatcgacgcttatgtgtatactgactcatcacgtgtggaccaggtgaatacgccacgtcggttgaaaccgctgagcaaaccatcaaaggagttcactcctcattttatttgttaagccagggtagacagaaaaaaaccgaaccaaaaagaccggaactaggactgaaaaagctgagaaatttgatcagtatcaggtgttaaaggaccgaatttcattcggtcaattcagttagtaccttcgattaactaaataaactgcacaaatcaaattttggctcaataagactattaaggtccagcaacccaattaaatcgaattttggcctctagcatgcttcgatatatggcccgtgatagcgaagagagtcaatttgtgttttgtgggtgtgtgtttatgtgtatggtttttttaatctggaacttagacttgccctgattattttagaacttttgatatttcagtcatgatcgagatcgagactgattttcttgatcttcattattttcctaaattaattggtttctatttttagataaccgaaacttgtagaagatcaaagatcgagaccggattttttggtttgaccaaacgtccaaccctagttcaaggagtcttaatgttacggtgagaaaatgaatcggacttaaactatagttgaggaaaggcaatataaactttttccttacaacatggtggaagtgcaaaacttccggtgatgtgcttgtgagttgtgatgcgatcactcctttcttatctctacttacccaactcacctctttcgttttccacgcgtacgtttttcatactgctaaacggtgtattttttatgaaaaattttttatataaaagttattttttaaaaaaatcatattaatatatttatatttattttagctaatacttaattaatcatacgttttattttacgtgctagggagtgacggttcccaaccctcgttccgaacatagtatcttcgtcgcttcggtgaagcgaaccagggagtcaccgagtcggcgtgataacgaagaagaacggcttccagaacgtctcgtcaacccaatgacaaagaatggaattaaatttaaaaatatactgttgatttgtttttccttagaaatattcgtggcgtaaaatttagaaatattcgtggcataaaatttttagcagaaatataccatcaatctcgcacaaccgttgtgcaaagaagcgtgacgacgcacaccgcgcagtatcgcgagaccgaacgtcttgtccagcggttctacttaattagtgatcaattatcctaattatcgaataataactagtgattaattatcctaattagtgattaattaacaattaatcaatcactaattaacaattttcaaccgtcgtaatcgctcactgattgagagagactgctcggtctcgcggtttggccgcgcgagaccgtgtggtctgacgccgtctgcacgcacgtcctcgatttcgtcgtttggtgtcacggtttcattgtacggggccgacacctgttatagatgctatttgcgtcgtcacgtccacgtcacttatgcgaaacggttgcgcgagatcgacagtatatttctgctaacaaatttacatcccgagtatttatgaaaaaaaaacgaatcaatagtatatttttaaatttaattccaaggaatggcgagttcgtgctgagcacggacgctaacttgcacgggacgtggaggcggatctccggttaaatgcttggccatacgaaaccgcttggtgagcgagtgggtttacatacggttttggtttgaatctgtcgcaggtcgcggcgccagacggccaggggcaggccagcctggtctcgattgtttcctcgcgagcagcgcgcggtggcggcgcctggtgggctcggggaatccctctgcagccagcgcgtccgcgaaatgcatgccacttgtatatggaccagcgctgcacatgcacaagccgcacgtgccgttccgcttggtagtgaaatccaggggcggaccacggtgtttaccataaccagcctgcttatctcacacaacagaacaaaaacgaaccacccatttcaacaaagttggtcaccttgttctccacagttgacagtaaaaattctcgccgtagctcgtttttcccaacatggccacgtcactgccggccagattacttgtcccatgcagctggacaaagtaccgtttgaccccggtcccttttgtgatggcgacatcgtatcgagagggacagccagatctccggtatggaaaattggaaactggaaagcaacggacgtgttcactacgatctgtggacccgatacactggccaaaaatggagacaagccatgagcctcagacaccgtggaggctagccgtgcacccagctgtgagcgtggctaaaacggccgcgagcacccacaggattcgctctcccacaccatcggctcgttcgcacaaaaccactgcaccacccaccggtttcggtttcgcccaccattggaggcgaatcccctcccttcatataccacgccgcggcagctcggcgatcccagaaaggcagaagaaatcaagaaaccaaccaccaactagctactgtagttgactgacagtgatagtggcagtcatgcaggtcgtgggaaccgtgcgtgtcagtggctgcggcgcggtggtggcgccctcgcgccggcagtgccgcgtgtccgcggcggtgctgacggccgcggagacggcgacggcgacgcggcgccgcgtgacgcactcgatgccgccggagaaggcggaggtgttccggtcgctggaagggtgggcgaggtcgtcgctgctgccgctgctcaagcccgtggaggagtgctggcagccgacggacttcctgccggactcgtcgtcggagatgttcgagcaccaggtccacgagctccgcgcgcgcgccgcggggctccccgacgagtacttcgtcgtgctggtcggggacatgattaccgaggaggcgctgccgacgtaccagaccatgatcaacacgctcgacggcgtccgcgacgagaccggcgccagcgcctgcccctgggccgtctggacgcgcacctggaccgccgaggagaaccgccacggcgacatcctcggcaagtacatgtacctctccggccgcgtcgacatgcgcatggtcgagaagaccgtccagtacctcatcggctccggcatggtacgaatctctcgaaatgttgatgccatttctctgcttggtttcaatcttttttttgcttagcattgttgctgaatccatggcaggatccggggacggagaacaacccgtacctggggttcgtgtacaccagcttccaggagcgcgcgacggccgtgtcgcacgggaacacggcgcgcctcgccagggcgcacggggacgacgtcctggcgcgcacctgcggcaccatcgccgccgacgagaagcggcacgagacggcgtacgggcgcatcgtggagcagctgctgcggctcgacccggacggcgccatgctcgccatcgccgacatgatgcacaagcggatcaccatgcccgcgcacctcatgcacgacggccgcgacatgaacctgttcgaccacttcgccgccgtggcgcagcgcctcaacgtctacaccgcgcgcgactacgccgacatcgtcgagttcctcgtcaagcggtggaagctggagaccctggagactgggctctccggcgagggccggagggcccgggacttcgtgtgcgggctcgcgaagaggatgcggcgggccgcggagcgggctgaggacagggctaagaaggatgagcagaggaaggtcaagttcagctggatctatgatagggaagtgattgtctagtttaacttgtcttggttgaattctgaattcccagtcctagatgatcatgccatttcgttatcatctctgttcttgtgttctctttgcaatgcagtaaattggtaatagttaatggtgctttgatcttggaaatttggcgttgatgtattttctggtatcattagtgaagatagtttggtttcttttcacatttgatgatttgaaccctcaaatattaatgttgaaatacagaatttcacatttcacatttcagttgtgcctgcacactgacattattcgcatataaaattgacatgaccgtttttttattgagggaattgcacagttgccagcatcgtgtccagttgataaacggatgcagcagattataaatttcccttgtacagtcatctatgtacaagaagcatactagttgatagaaaatcccttttcttttcaagccaattgtgaaaccgcttcgccagaacatttgagacaagcaaaattgcagttaatgtagttgggataacgtaccactgcctgcgtgtacttggtgttcagaaatgtcaagctcaaccgaactgcaccctgaagtcgttttggtgcctttgatcttggaaatttggcagaaatgtattttctgatatcgttagtgaagatttttcttttaacatttcaaccacaaaaattgatgttcaaatacataattcaattgtgcctgttgactgatattagcatataaaattgacacgaagtgtgtagttatttctatgccagcaccagttgataaagggatgcaacagaacagataattcccttgtctaataatctaatgtccttgtctaatcatctatgtataagaagtacagttaatagaatatccagcacatgaggggcttttcttttctgggcaacttgtgaaaacactttcggaagaacatttgggacatgcaaaaaatgcagtcagtgtagctgggataacgtaccactgcctgcacatacttggtgttcagtaatctcgagctccactgaactgcaccctggggtcttcccaactccatggagcgccatctttctcctcatgcgttcagcctgctcccacctctccgacgaggccatgatatttgacagcaagatgtactctgcatcgttggttgacacacgacgggagtgcaattggtggatctcacttgatacgagttcagacatctctgcatcgccatgcaccctgcaagctccgagcagggagccccagatcacctcattgggttcaacaagcatgttcttgacaatctcataagcttccctcaatcttccagaacggcccaagagatcaaccaggcagccgtaatgctctactgcagcagcaaccccgtaaatatcgaatttgctgaagattcttagtccttcatctacaaatcctccgtgtgtgcaagctccgagtacggcaagaagtgtgatctcattaggcttctgctccgaacactccatcttggagaacaaccgaatagcctcaatgctctgtccatggctggaaagtgcagagatcatcgagttccagcattcggtgttcctccattgcatgttgtcgaagatatttcgtgcgaaagcgaggtcaccgcacttggcgaacatgtcaaccaggccattcataacgaactggttcttccggatacggtgctggatgatgaaattgtgaacctttctcgcttgctctagcgaaccgagctgtgcgcaggcagagagaacacctgccatggtgaactcgtccggcttgatcttgtcctttagcatggagtgaaatgcttccagtgccttctcgcagcatcccattttggcataccctgctattagtgcgttccagttcaccaagttgcgcacggggattttgtcgaacaccgcttgcgcttcgtcggcattgccagccttgaagttcccggtgaccatcgacgaccacacaaacgcgttccgcgcaggcatcttgttgaacagctccctcgcggtctccatgtcccccgcggcaacgtaggcctgcacggccacggtccacgtgacgacgttctgcatgcccagcggcatggcctcaaaccaccgccgcgtttccgccatgtcgcccttccccgcgaacccccggatcagcgttgcccacgtgacgggagtccgtgagcccatgccggcgaacagcgcctccgcgctcaccatgtctcccgccgccgcgtacccggcgagcatggcgttgcacgtcacggcgttccggtccagcattccgtcgaacaccctgcgcgcgtcggccaggaggccgcacttgcagtacacggacaccagcgtcgtccccacgaggcggtcgtgggcgttggcggatttcacggcctccgcgtggagggccctgccgaggacgggatccgcgcgggaggcggttgccttgaggaggacgatgacaaggggcaggtggtgagtacgatggggcagtagtttcgagtagatgatagcggcctcccggaggaaggagttggaggcgtagaccttggcgaggttggcccacatgtctgggtcacggcatcctctcgtcaggtagagagcgtggagttgcctcgctcggctagccgccatggcgagcgctcgtccgccctaacaacggcgggggcggcggcggctcccgggcttatataacgtcggggtgtcaaacaaaaattttctgctattctggcagtgaacttacggtttcgtaggaaacaatattactctgtcgcaaatggncgatatgacgccgacagaaatactaatcccacaaatcacaagcagcaaagtgattccaagacagattatacgctagccattccaagaccagtgcagcaaggacgctgtctaatggatttccatcaagcatcatcaggtttctgcataggtggtacagttcaacacccaaaatagctacatcgacctcctcacttgtaacttcaacctttaaatatatactgctcctatccaaaagcttccttctatttccatcccttcactaaaaaggcaagggtcccaaaaggcaaagacgcaaacagaaagtaagaaacagagttgtacacctaatctgcatcaatgtccggtactgtaactatttgcagctgcagagcgctgtcagtttcatcatcggaggacgaactgctgaattcggaagtcgacgaaccttccggggcatacatatcatcactgtcttcattctcaacctcgtcagcgtagttcacgactttcctttgcctcttcccacggccgagatcaaccttgggagtagcaggcttgagaactttcagatcctcaacctttggggaagaaggtgcttcatcctcgacgccatgagcaaagctcacaatgctgccaagataaccgttatcatccgacgagcatttctcaccagtggaagggtctaacttgaggagattctcaatggcttcattgtcataatggatggatgttgcactgatcttcctgtccacaattgtctttgctccatggagtaatatagactgcaactcatcagcacttggcttcttggaagagttcatcaacatattttcgatggccaacttctgctttgacttctgcagtatcttttcctcgacagaacactttgtaatgagttggtaaacaaccactggtcttgtctgcccgatccgatgagcccgagattgtgcttgcaagtccataaatggattgaagtcaggatctggaaataggaaggccaaatcagtgcaagtatccacttgcaaattatataattagcagtgaatgaaaacatttaaaaccacttaccgtatataattaccctatctgcaccaggctgcaaattataatgatgtttgtcagtccagaggcataatcatactattgcagttgctggttaagagcttgccctacaggctaacagtttcaactgaaagaactaagttgatatgataatacattaccaggtcaactcccatgccaccagcacgagttgacatcaagaaaataaatgtttcactatcaatgtttttgtactcttctatgctctcctgcctagcagagagtgatgtctgcccatcgatgctgccaagtgttaacacagccatgaaatggccaaaagaagtgtcattcaattactagatatacaaggaaaagagcagcgaaagtctgaagcatataatttagagaattgatagaaggtagacgaatgaagcataccgtgcatatttgtatcccagggaacaaagaaaatcctcaagaatgtcaagcatcctggtcatctgcgagaaaatcagtacacgatttcccctttctttcaatcttgggagcaactgcaatttagcaattgagcagtgttatttctagcagtttaaacttcaggtgcagtgctaagatatgatagcaatataaggtccaatatgaagtctcgaaagaaccttatgaagaagttgaagtttgcctgatgaagcaataagtgataaaaacacatcttcagttgcttgctgtccaacttcaagtcctggaaatagatactgaaaggcaaaatcttagcatcttaggacagcagaaaaatttaacatgcacaacaaacagcacatctacttaaaaagggctctttgttgtgagcttgtgggtgatcggagggagcaaggcctggtctagtggtccttgtatagaaggcaggattgtaagaatggagtttaacaaactgatacattaaagccaattttaagcttctcgtttgctacaaattttctgtaaccactgcacacaaatcactgtcaaaatgagagactcggaaaagcaaaaacacccaattcctacatctaagagaaaagagaccaagttctgcatctgatcaacaaaacagaaagtaaaacctactggatgattgcagcattttctgagttccataagtatgttgttcagagaaagttttctgcctgcaaaagtacaaacaagactaacagtgttatttccatacgtaattaaagggatttgaaaaacctcatattcccatacgtaattcatagggacaaatatgcttttacaaagtgaatctgacttaaaattttaccagagcatgaaaaaagagcagaacgcttaactcaccattccgaatggcactgttaagctttgagtaattcctctctaaaatattaatgtaaagttctctctgggaatctgcaagtgcacatggaacttcaacccacttctttactggcatagaatctgttagaacatcagatttcattctccgcaacatcctagcaaaaacaagaaacttaagatccgtgttcaattgtttttaatacccttctttaataatgaaattggtcgaccaaaccttccggccaacccggcaaaaaaatatccgtgtccaagatattaaacatatatagtacttatttcagagtattcacctgggctttaaaatattgtgaatcctagcaactttttcatccattgtcaaatcccttccagattcaattggtgagaacaatccatcagcctttggatcagagaactcatccggatcaatataatgaagcaaagaaaacagttccatgatgttattttgtaacggtgttccctgtacagtgaaaggaagaggaaccaggatcagaacatagttcttttaaagaaagggcaattgtaaagcacttcgtaagaattactacgctgacagccaaggagaaagaatcggctatatatgatatctgtaaaaagggctaaccagatctctctatgttatataggctctagcggctatatagcacttgattaggctctagcacaggattaagttgcttcagaaagaccacagaagcgaaccattttcagataatggatttaaaatcctagtccccaaatcatacgatgcatggagcagtaggagcgagccatgcctcagctacagtaatgcacaccccttttaaagtattatgggcactcactatggttgaatgctggctataccaggcatctcactttcaaaacctcatgcccagatgactactaataatcaaactagtgacaaggaacaaaccaattctaaaattccaagaaataattaaggacaagaaattacaggtcaagtaggcagtacataccgtaaggagcaaccgaaattcagagcagtatcgttttaggcaagctgcaaggttgcagtcaagcttcttcattctgtgagcctcgtcaactgaagtgaaagtggggaaatgctcaagtgttacaagaaaagaacagagacaatacactaatgccggcaagtgaacaccaaataatgggggacttcatctaagaaaaaacttactgacaattgtagaccacttgaatttctgtagaactgccttgtcaatttggacaaactcataactcgtcactagagcatcaaataaaggtttcccatcagaagagtacatttcatggacttggatacactttcgagagtctctgtctccttgataaacaataacattaagatcactagcccactggcaaaattcctagagcacaaaacatgcatccaaaaaataggattaatgcaacatatttgatgtaaactgaaatgcaatatcaaaaaaaggattcagggtaaaattttaaattcatttatataatatacagtataatatggcagaatatcacataactatatacaaaccttttcccattgcaggaggatgctctttggagcaaggatcaatgctggggatgcagtcaaactttccttaataatgtggtacagaaagcaaacaacttgaacggttttcccaagacccatttcatctgccaatagagcagaacataccccattatcatagttttgtcatgaaataagagttgtacaagctatttttccatcaagacaatgccaaacaaataaagaaaacatcaaagagacgctacataattatacagttcacaagcatcatgataaatcagattatctcaaaacaacaaaataaaaactgatcagcataattctttacatgtgtattattggtgcattataatttggtaaggtacaactgtacaagtgcatcatggattatgtatttagagtttatgtacataccagcaagaataacgcttctcctagttttgaagttatctattaaccattgtaaaccttgaagttgatagtcatatagagcaccacagtgcacctcttctatttttgatccatctagacatgtttggctgatgttaactctttttgaagcatttttatgcctcctgacaagcatagaaacagcctgttgcacaccatcggtacaacatggctcccatgtagcttcacagtaatcaaggcccttccatttcacaaggaactcatacccgtcgaaatcttggttatcctggaaagtagccaagacatcacataaaccttcatgatggaacttcctccgacatgcaatggcatgatctacttcaaaccactcaagcttcctttgatcctctgaataaacttccttaggcaagctgttgcaatgttcacaaacaagaacaaaaataagcactatggtgcactagagaacacagctggtaagattataaacaaacaagattgttttaaaaatggcaaacatcaacatggtgttcaaccagaatagctcagtaatgattaatgaaaaaaaaggtagaaaattagtaggggctcatattattaatttgctaatgatatgaacaacgattactcaggtacgagattatgtgcaactagtatatccaagaaaaaatttagcaacattgacgaacacaaaaaaaattataaaagataaatacatgtaacaagaaaataacacaagaaactttacactggaggcggtagacagaaaaacatgaaactgagaagatttaccagttcttgtttagatagctctgtactcgtaaaggatcagatacatgaagccattcaagcggaacctacagagagtagataattaagtgtctagggaacaatatttgcatggtccacatcaagtatagcaattacataataaatattaggcaaagtgtggcaggatacaattctaacatcataaacaaacattaggaagatgccgtttttttttttgtgaatacgccaaatatgtgtatgtttgcattaaaatagaaatcaaagtgtagcagctgcagcatgacatttttttagttgtagcagcaagggctaatacaaagtttcatgacttgaaagaaatgaaatatacaatgcaaggtaccagttcaaagaaactcaatataatgtactgctacaaacaagaaaggtgttggtagagggaggttccctagcaagtatgccttacagaaaaaggaaaagtcaaacacctattgccttacagaaaaagaaaaaaaaagacagcaaagataagtcattcaaaaagacaccaaatatagattgagcaagaaggttaacatacccagcagtcatgatgatgagaaagagattgccatttcacgaggaattgatactggaaatctgcctcctgaagaattcgtctgtggccaacaagtctttggattttttttgatgttaacacttctgtcaccttgactgctggtgctgcattgcttttgcaccaagaacattcccaggtgcctataatctcttgcaaaggaggatcaagacaaaaggtgtggaagctacgagaacaagtggaattcttgcatttgatgaggaaagagcaggcaattccaatctgcaaaaaaaatcagttaggatttcatgtaaagattgggggggggtagaaaattaataaatcagaactgctgacaaaccttacagatcgaacaactaggtccacccgaattacgtctgccaggttttatagaattgtgcaataattcatcatctgaaagacacaagtcattagcgaaacatgcacgacgtaatatcaactttacgacaagcattctgaggttccacacaaatcattaagaagcacagaaggaatggttgtcaattcatgcgatattatagatgcaagcaacaacaaatgcattgaataaaggtgatcaacaatattgaatgtgtttagatgtgactctggatcattgatgcttcgcacttccatgtataacaggtaggagtaaaaaacaaaatatttcctaggtattttacatatttgtacggtgatattaattaattgtgcacaatgcaagattgcaataatctcttgaccacaaaatcatattaaattataaagtaggtgatacatttatcgatcataaaatgattagttattacctgatgaagaagaagtcgacaacatgcaagacgaagcttcagtgtaactctcctgaaaaggttcgatgagatatttattacttcatgaagaacagtaggtcgagttcttttgttagttaacttacctctgaaacatcatgagctttccgcttctcctgtaggcgctttgacgttctcctgcatgggacaatcttcttgcgatctgtggtaatttcagtagttaatgtaacatgcttaaacaaggttatgttatttgtatattagctatacagaagggaataaattcaactgttaggtcctaatctttctgctcgtgtaaataggaaaggtgcaagtttcacatagtgcacaaatcaatgaagatatatattgaaaaagaatgcattgaggaaaatagatagtttcttccattccgtaaaaaaactctattcacattgttttaaatgcatccttggttaaacaatatttcaaagtattttttaattatgtcaattaagactttctagcagaagagaaactacaagttatccaatttcccaaataaactggattgaagttaattacaaaatcacatgatctgcaaacaaaagggtcaattatgtcaagccataacaaagggtgcccacttactatcatcggtgtcgctatcatcatcagcatatgaaatatttctggggcccagtctgttccgaaggcgttttgatcctcggcggggagccgaacaattttcatctacataatgcaaattttacatttgtagtagcagactggcagcatatcagaaatcatgcaatagttgagaattgtaacaataccataatcatcagagctacttcccagggtgtctgtcttcacccacatcaccatcaaaataatcagatgtaagcctctccctgagacgctttgatcttctagaagctaacttcccggcgtctgtaaaatatcaatctggaataaatcttcaaccaaacaaatttattaggatcagcaagacagaatatattgtaaataacactgttaccatcctgggaactgctcgagctatttgcaaatacatcatcttcactctccttgccacccaaatccctcttcccagttggtttggacctcttcctagttggtttgcaccttaggcgcttggaccttctgcatggagccaactcttggcaacttgctgtggcaagaacatcaaactctaaatcaacaggtcaaaacaaacaataataatgactagctatacaacattctagactaatattgcaaataccaacatctggagttttatatagtgttcattttgccaaaacaaatcaaaactgagcacaaccaaggtgaacacaatgcaaacaaccgtactacacattaacaggacaagcggcacccgtaattccgagaaattgtcagctaagcaaactccgtcactcaccttcatcgtcactctctgccccatgctcctcagcggctgcggaatcgatcgtgatcgtcttccgaagacgcttcaggttcctagtggaacctggcttcccctcatctgcataaatcgaaaccgggattaagccgaaacgataagggtataacaaattaccaaccccgtgccgtccgagaagtttgaactttcaatctcaccttcctccggggcaccaagcgggctagcctcagaggtctccacctcgcaaacctccgcgcttgttatttcttcgttaggtgacttcgtctgtggatctaccttcgcatcatctgccaaatatgtggggatcagaatgttacggagtttcgaacgccttgatcaaaaatgtatttcatacttccgccacagaatatagcgctctcctccaaatacgcgaagagcacacaaatggaggggggaaaccgttcccagcctcatcaagaaccgatcggaggacgtaaaaacagcaatgctacttccttacaatcctgaacccaaaaaaaatccaccagaaatcccctaataaaatccgaatccccaacggtttgattttacaaactctcgaaccaaccaaacgcacagtaacaaaaacccccaaaacccccagatcgatcactagcccgaacaaaatcccccaaaaccgatcgcgtccagaacccagatccagcctactcaccatcaccgagcttgatcggctcgacgtctacgacgttctcgcctcgcgccctagaggcggcgcctccgcgtccacctcgcctacctcgccccctcccacgcctcccgcctctcgccggcggcatcccgactcggcggccgcgcagtgactagggtcttcccgaattcgaagcgacacagaagacaacggcccggagcgtggcttcgcgagtacggagagaggagaggccgcgagtatgtgaacttgtgaaggtttcgggggacaaaggcgtggggagagtgtgtgatgggggagacggggtttaatagctcgcggtgggtgggagaggcgggaaggtccacgagctcagcttcctcacgtggaaccggtgtttgacgcgtgaggaaaccgaccggtgggccccatacggtgagcttggttctggttttcggtggaactggttcacggaaatggtgcgagggcgggaagtcgaaggggctgggttgcggggagcgggaggaaaaagtttttttggtgcggatgagcgcacggggagcctgtgcggtgaggtggtatccaccgtccgattgagagatgtcagggtgatgtgcggctgctgtgttttatctgggttgatttttcgtggctacttttttgggaggtttcacgctggatttcgggatgcatccccgtaattatccattagccctgtgcccctctgtcagtggtaggtgagttttttttttgttaaaaaaggtggggtgaattttgatggaaacattatgaacatttatttccatcccaatattagccagtagaagattagatattttataaaactataggcttcatctttttcttatccttatccttattagccaaaattttaattttcaaccttaaatttggagctaattttttaggctttttcatcgaattatttttcagtttttttagatcgctaagaacacgtatataaaaaatttattcgaaaattatttttcgtttgcaaatataccgtttcatttattccgcaaaataagcgagacgttggcttatgtatgaatctaaacgggaaagaattatgaatctaatagtatcttatgtccaaattgataggacgtaactcatgtctagattcataatcctgttaaatatcttatcttacacactctctttaaataaaccacctcgtattaggagattgatttattttgataaggagggagtactaattagcaacattttaaaacataggtactaattaaatctggataaggacaacagctatagcataaaacagtcaatttcgccacaaaattgaacttaggcacgcttcggctcaaccaaacgagtgcatcacttgatttggttccaactcgggcacaaaattatggtgcaaaatcagcttcatttagcgtgtatcatagttagcattgaaatttctcatcgctctaaaacattaatttcgttttttacgatcttacaacaatgaactgtaactccaggccgccatttgttgcgtctcgaactgctgccacatcatctgctcgttcgcaagaagccgctgcctcgcctgcatgtccatcatctgaacgtacgtcggcggaggcacggccagcgacgccgcgaacgggtccgcgacctcgccgccggtggccccaggtggcggtggcagtgcaagcaccgtcgcgctctgggtggcggcgaacttgctcgccgactgcacaagcgccgtctcccagtcatcgcattggtcgtcgtcaaacgtctcccacttcggcgccggcgtcgctgggtcatcgccgaacagggacagtgtcagatcccggtcttgctcctccgtcgacaatggcgtcgattcttccccaaggttcaggaagtcggccatgtggtcgtcgaccacgacgagtgcgcctgccggcgccggctcagctggcgatgccttgctgctattgtcgccattgctggcaatgggggcaagcgggctggacggcgccggcggcgtgcacctccaccaccgagacgacgccggttgtctatcgcggatgaactcgtccatgaggtccagcttcttctgcgcgacgcgctcgacctcggggatttcggacgggcggcagatcgtggcggatctgcaccacgagtagaactcgtcgagctcgtcgaacagcttggcgatgctggtgaagatggagtgtacgcgcacgcagcagggggtctccagctcggcgaagcggtcggcgagcatggccatcacctcggtgagctcgcggtacatcaccgcgctctccttcaccagcctgtgcagcgccgccgccaccaccttgttcgtcctcgccttccccgtcgggcggcacccgatgaaccgctggagtatgtgcttcagatgctgcgccttggagacgagctcctcggtcgtcgtcgtccccgtcgccggcgtgtccctcggcaccagcgcccagacctcggctaccgcttcgcccacctcgtaactcccgtcggtgatgtcggggaagccgtcgcggcgaccgtcggagcaccatttgccctggctggccacgcggcccttcatccggtgcttgagcctgtcgtcgaggtaagcggcgtaggcgcgcacgaacccgtggaagtcccacgtcgcgcgggagcgcgacgatcggtgcgggaaccggtgcgacacgtcgagcatgcgcctcccgcgccgcgtggcgaggaacacctcctgctcgtacgccgggtcgccgtcggcgagcaggcggtgcaccagcgccagcgccttgaccgccacggcccacgcccgcgtccgcccgagccgccgcgacacggcggacacgcaggcggccacccgcgcacgggagtagcacgtcagcgtgaggatctcctggacgtggcgctcgtcgccaggcacgctctccccgtgcgccgtcgccttgacgatggccacggcgaggtccgcggccacctcgtcggcgccgcccacccttgcgagcccgacgctcgtcctgtccttgaccgcgcccagcgccgcccggagcttgctcggcgccatcgatcagagcttctcacgaattagggcttgttcgattaatcccaatacagagggattggaggggattgaagaggaataatttcacaccacgataggtgtgaaataaatcccctccaaatccccttcaattctctccgtgagagggattaaacgaacgaggcctttgagagtaggaggagacggagggagaggaagaaatatgtagacgcgcgcgggaagtctttggcggttgatgggcgcggacgagcggttgagggggatgccggccgtttgggccgcgtgtttctctcggtgtttctgttggggcctgaacttaactgacgaaacggtgtttcctcgtctgtttgacgcggctttggaggcttaatttagtattccagctgactggtgactgctccgtcatgaggtgtttcctgtgggattgcagctcaagcttatgcagagagcattacctatttacagtcttgtcgttttgttatgcttatacttactccctccatctttaaaaaaaaaaagacaaatcctgaatttacgtgtctaacgtttgaccatccgtcttatttaaaaaaaatatggaaaaaaattaaaaagacaagtcacgcataaaatattaatcatgttttatcatctaacaacaataaaaatactaattataaaaaaaattatataagacgggaagtcaaacgttggacacggaaacccagggtttgtattttttttttagaacggagggagtataagctagtgaaatttaaattttaaaattttattttacagttgattttgtgagttttttttattgtagtttactctataacatttgcttttgaattgttaaatacatgcatatacgagttttatctgtaaattatttttttaataagcaatacagataagcatgtatgagcataagccaaacgatgaaactgttagttatcttaagagtattagggtagtaactgaattactgttagctattctcaacaaattatggttggtgctaacacttaaaattcaccttgtatcctctgttgaacaaattatgcagtgtgttccttctgaaagatagaacattttgtaggggggaaaaggcccacatagacataactaggcccactgctgcagtgggtctattgggcttgaccaggctggttaactctgaaaaagctagtgggctttgacggtttgacccatgattttttttcatagccaggccctggctaattttgcttgctttcttcatctgtcaccccttcaaattaaacacttcgacttcgagagcaaagataaccgtcaggtctgtatcattcacgcgattacgttatgtcattctaggctagtcctctctccgtttcagaatgtatatataaaaagacatagcaacacttataataccaacttagggcagttttgaattgctaccaaaatttgccataccaatattttggtagcataaatagtatccaccatttgtttggattggtgtcaacattttagtaatgcccatctcaaatttggtagcaatctagaactttcttcactatgatatcacaatttggctagattttggtagcaagccaaataagatgaatacaaatttattctaccaaataattggtagtgccaaaacttgcctatgttttggcactaccaaaaaattggtagggcacctatccaaacaagcccttaatctcattaaatacaccattaaatatattttataatatatttgtttggcatagaagtattactacattattctataaacttgattaaacataaaaggaagtttgatttataatgaaatcgaaacaccttatgctgaaccagagggagtaggggtctagaactgctaatctaaagagaagaatcaggtcacagtcgccttgtgatgtgtctagcatcggatgtttcaggaggtaatcaagaatctgaaccgttgtaacactgtcatcttcagcacccctgaaaacgtgcaaaagatgctatgtttgaagttagaccgaagcaatcagcagtaggattcagaatactccagttcttctggtttcacaaactttgctgcgcgacatactgcagtcttgaatcgcatgcgcctatttattttgggttaaaccgggtttcttgacaggataatactcctactagcaccaattattgatgaacacagccagattcacgatatgatgaaaacagacggataaaacaaaaataaacgatgaagagaactagagaaggcagaaagtatattttaatgcggtgatagtgtactctgtacactcatcagtagcaaatttgaagttttcctgagcttggctgtatgttgcccttcattctctgcccctgaaacgcggatgagtcgacaaggcaagaaaaccagaatcatatgtagatgcactcatgcacaatggttttttcagaataaatagcggtgtactactatttatgacgaagcaatcaaggacaagaataatagtatcaagaaagtaactaatccagctcatacagctgggaaagaagtgtgtgtcccctcgaatactgcccggccgggatgcaatctactccatatattgttatcaattgctcatcatcaattgcatcaattgtatataaattcgttcgggcgatgaatttcaagcagagaacgtgaatcctcaaaatctgatcatgttaaactgaaggaaataatgagatccattgatgaacggcaatgctcaattgcacaacaatgatttgagaaatgagatcctagcgaaacaccgcccttcgtttcagggagcgtttatatttgtcacggtcacacacaggcagatcaaaactgctataggctttttcttcagcttgcatgatcgatcggcagaaggccatgcgatcttctttcctgccattgattcatcataattcagagagaacgctataggctttctgcaatgacctgcaccaattagtcatcttcaagctgaaggccataccaccattaagtcgcgtaacaacagaagatctttctcttattttccgaaacggtcacatcaagagatagcctagcctgttgcgatccggccatcaattagaaccgtgcacccaaaattaaagttgacacatcgctatccaaatcaccatatcaccagcccatgtattgatcagcgtagagagagagacgcagtgccagaacctgacccaagaacagcatgagcaacatgccgaactccatgaaagaaccagacatatacatgcactaacatattgagaacttgttgttgtgtgagatggaagctatactagctttcatgattgatcaatgatcaggtaccacagtctgaacataagtttctcagaaaaattgagtgtagtctggaccatgaaaaactgaaaatgcaaaagcacagacttctcctttctaacaggatgacgggaatgctagtgcacggtcgctgccccggcaatcagccgaattgcacgaaatgatgaaagatccaagaactcttgcccaaaaaccagctttttttttttgttcccatcgcgtcgggtactcggggtcacctgtcacgtatccgcccgtgggccaggaatcatgttggcgcgtagagccagccaatttctgcgtgcacttttccacctttaatttgctcgcagctcactcccccacaactccacaaggccaaaagctctttgtcgtgctgctatacttagagaaggtacaataacaggctataaaccagctataaatatattttaaaggataagaaaagagagagaatagtagtgggctacatatatgtaaccagctgcatcacggactccaagacgtaataagagtatgacagggtgggaccagatattaatagcatagtaagcaactatggtacgaattggctattatgttggctatatataatttagagttattagtgggctatactattaaacttgctcttagagcaggtacaatagcaggttataaaccagctgcaaatatattttaagaagataaatgagaagagagaagaggagcgggctacagatttatagccagctgtagcacggactctaaaacacagtgtgtgtatgataagtgggaccatgtattaatattgtagtatgtaactattgtataaatgagctattaaattggatatagatgaattagagtaagtagttggctatactattaaacttgctcttaactctcccatactcgaattttgttacacgttcttcaaactactaacaacacatttcatattaaaatctttttatataaatgttattttaaaatattagataaattatttttaaaaagatcgaaacttaattaattataaaccgatgggtgttttttctttttttatgtgcgtacttaggccccatttagttccctaaaattttttttcctaaaaacatcacatcgaatctttggacatatgcatgaagcattagatgtagataaataaaaaaaactaattacacgggaggaaatcacgaaacgaatcttttgagtctaattagtccatgattagctataagtgctacagtaacccacatgtgctaatgccgggttaattaggctcaaaagattcgtctcgcggtttccaagcgagttatgaaattagttttttcattcgtgtccgaaaaccccttccgacatccggtcaaacgtccgatgtgacatccaaaaattttcatttcctcaactaaacacacccttaatcgaacttaaacagggcttgcccatttgtattatcatctcctgtgatcaacaatgatatggcagcaaaatgcaggcaggcaggtagagacgaacagatgacgctgtattccgaattccgatcgctttcttgcagcttcttgtgccaactttttcgagtcgctacaagtctagaaattcagtagcatgtggcaaggtgtaggtttattagccagtgggacagtgccgttcaaggatcgttcgctttgtttgcttgcatttgcaactttgcacatatggtcatatacgagtggtgtccgtgggcagtccaaagttagtaggtgtgatttaggattccgtttgccggacgcgcgcatcgtcgtcgcatgcatatgcaacaacaacaaacgtacgtatgctgtatctggtgagtcagtatctcgatccattgtcgtccattcctaacaaaacacaagctgaatttgctgaaagtaaccacgctactactgtccgtatggtgtactctactcaagagcatacgaagaattggttgaagtccgtgacaagaactcgagaaactggatatatggcatacacgacggacacgccgaaaggtcgatctgatcttctctcgggacaatgattggattgtacatactctattcgtaaaaaaaagaaaaccaacctaattaagatactccctccgtttcacaatgcaagttattctaacattttccacattcatattgttgctaatgaatctagacatatatatctatttagattcattaacatcaatatgaatgtagaaaatgctagaatgacttacattgtaaaacggaggaagtagaacattttataggacaatgatgtacagatttattgtcatagaaaacgttccatcctcgactaaattatatatgtacagatttattgcattagaaaatggtcatctttaattcggttggttttttttttacgaagaaagcacctaattaggtgattgaaggatggcatcgagtgagacgcatctgggtcggtcaggcagggacaatgccgacccacatgcattacacgcatcgtccatgactaatcagatcatgagaagctctggtatatcgattatggagtatatcagtttaccgagtacaggtaagcctgccggggtatggaacgctttgcccgggcacgtacatgtaccagtacggttgaacacaactccacaatatcatccgggttcgtgtttaactttaattgctgaaccagagacaaatgacagatctaccgtaggagcggaggaggctcgaaccccactatcatttttttctatatacttcctccgtttcataaaaaaccaatatagtattggatgtgacatattctaagactataaatctctagtcgtagattttttttttttggaacggaggaagtattcatgagaaagaatggtaaaagctttgtcagtttgttcggtcttcactgttatttttactctaggatccgcctgggataatactgctgccctcacatataggacgcaaaatacgaacgcatttacacccataaacagagagtctacgaatagtacggctactactacttctctgttgcgtggcgacactgtccgtgaccggatcagccacgcttctagttctactactggtgggcaacagcgtcgttcacagttcgacgtaaactccacagtgggaccgggtcgtcttgttgttgacgcagccgtatggagttgatgccgactttgaccggtatcccgaggcttcttcctatacgtcgtcgcttggataaggacgtacacatatacgtatacgcagtgacggatatagaaattattaaaaagtaaggttaacatagagcttaactaatgagctatttagttttccctaaatttaatgatgatttgagagtatttaactataattttagaagctgaaaccagcgagacatccctaatcttactaaagttctattaaaagtctatttacttgtaaattcattagaatttataaaattgaccccactaaattatgaagtaatggtattcgactagggatgaatttatgcataaactatagggttggcttaccctatagctttttaaaaaacacttctatagaatttgatttttatataataaataaataatttcatttaaatacaaactagtagtaattaatccacgggattaaattcttaactctgtcactgatatgatcgaatcaatcacgaatatgatgtagtacgaccacaacagcatctgccagaagaaatatctacccggcatttcattttcagtacgttctccccacatcatgagcataaagtttttgtaagatatgctcaacgacaaggcctttaatttccagagaatatgtgcaacgtacaaagccaaaccaaaaagtttacctcattttctggaccctgcaaaagcagctcggctagtatatatgcatcgcatgtgaaggataagacggacgtcgaatcattgggctgcgaattttgtcaccggtatatcggttcggatcagctggccgtgcactatgcagcgtccctggtttagctgcatgtagccaacacagagcgccatcagatggacaccttggcgaggtccacacgtaatgcaaggtacttatcgctgttttctttatttttctcccctttttaagattcgcgtttgttgcatgattaattcatcatactttgcattgcacaatttgtgtttcaaataaaccaaaggatatatataatccagtacagtgtacatatatcatagtactaccttttgtacgtcagcattttaaatgatggtgaaccgcgtagtcaatgacaaaatttttcttggtcagtttgccgtcagtgcaagactctggtcacatacagtagatgggttcaaattgctgccatatcttatctgccagattaaggacgacaaactggaccgacggatcatcatctcatacgtgatacatcataatcaggatcacggcgtgatttgtgacttgcaggtctcccctagtcatacactgattgagctagcaaacacatcgatctagagatatgtatgaattggagctaatatacagtttctggtttggacgctacattcagcagaaaaggaaaggaacttagggcctgtttagttagtgaaaaaaaatttaggtgtcatatcggatgtttgatcggatattggaaggatttttcggacacgaatgacaaaattaattttataacttgactggaaaccgtgagacgaatcttttgagcctaattgtagcacatatggctaatcatggactgattaggctcaaaagattcgtctcacgatttcctccctaattatataattagtttttttaatttatatttaatgctttatgcatgtgtccaaagattcgatatgatgtttttagaaaaaaaaaataggaactaaattaggccttgatgggcgatgatacattgacacccaaatctgttgatatatcctgtgtgctttcattctttaacacgcgaccgaatttgaaccatctttgaaaaaaaggacgtggacctgtcgaggaaacagaccggctttgattaggtgggctaaacattctccatttttgtgggggaaatatcgatgttcgagcaggcagagagcatcaagggcatggctcacaccgtactaccgtaggacaaaagggcacgcaccggataaattccgtgtaggggagcacatacgcattgcgatgtgctccaacttttgccgcggatggcagcagagcagagaactgcagaaaattatcattatcaggcagaagaatgcaatagctggtgcatgcagaattattgcggatttcaagagtccacacaattccagcgtggcctctgttctacccagacctgttgtcaaatactctgggtctctggctcctgggtcctggcctctcggtcacatgtgtacatgcatggcattgaccgtgttaatccgattaaaatttcaagtttagagtccaactccatctgttccataatataagagattttaacattttgtttacactgttcgactacttgtcttatttaaaaaattgtgcttaaagtactttaaataataaagtaagtaaaaaaataatacgaacggagtatcattatacgaacggtcaaataatacgaacggagtatcatgattttttaaataagacgaatggtcaaatagtataaacaaaaagtcaaaatacgaacggagtatcattattagtagctgtcaaatggaggattcaaccttatgaactgctataaaatataagcatttatatattgtttagcaaaaattaagattaaaaagtggattttagtgtaaaaaataaaggatgagtggagatgagagagtacgtggaggtaaaatgggggaaaaacaaatgaaaggtgattgatagaacaaatgatgcactaaacatcaacaatatttaaatgttaaaaatccttatattttgaaattgaggaaatagctgctacgccatataagattttaggcccggtgaaaaaacctataacaaggctttctatttagaaaactttcactacgtctgtgtttaagaagacacaaatagagaatatacataaaacgagataatctattgatgcctaattaagtaagtattaattatttgaaacttaaaatatggattaatatggtttttaaagatattgtttagtggttcaggaagtgtgtgcgcaaaagaaatgattttttttcttctctttgagcttctctcaaacgcagccaagtagattgcatgtcatcgagaaagcttaccgatcattcacataacaactgtttgttcttatgtttaggagaagcgttgcgtctagattcagtgattcagttttttcagaaattgttaaaaataaatctatagcatttggaacgcatattcacatcatgattacgagctacagatctttgatgtggctgtaattatcatccaacatttgttacagccaagaaaaatatgcccattattctagccagatcaatgaacgagaagaggggaacttgaaagaaaaaattggactttataaactccgtgcggttgttcactctctgaacgtgcccatcagtaggggaggggtacagtcacttgtggctgtggtttactccagctctgccgctgattctagtggactagccgagtaaactggctatgtacatgttggtctcgtgaaatagcacggaacttctggtgcagaggagtcgaggagcagagacctgcagtttcgccatgccggggcagtgcggggccgcgcgcacgacaacaatattaatgtccccaaaacgacacgctcgtccacgcaaatttcgctggttccaccgccgaaggatttggctggtacgtatgtgtgctactacgtagcttttctctgttgtctgaattctcaagccgcggacagtgcggaccgactgcagccggagaaggggtgtgcactagtacagtagtactggtggaggtggcattgagttggaggtggatggtgattgcggaggaaagtaggagagctgaggttttacttgagtagatcatcttggtattcagtttctgaaaatctggagaagctgctaaactcagcttttagtttattttctagattatacaaccggactattagaacataggcgatgatctgaattgtttgggggaaaacttataattattagataagttacagctgccagaagcttttataaataaacgtgtagataagaaagacaacatattgtttacaggttggtcagatgaacattcatccaatagccattcccttcattttctttttactttttaatttattttgccttttgcgattagttctcaccgtctctagacatggacactgtcaataacgtatatcgccaaccatcacttctataaatgaaatatttatgagtatctttctacaaaaagaacaattatacgattaaagagtaaattacactactgatatatgaacttccaaggtaggtccgatttaatatatgaacctgtaaatcgctcacttcggtcacgaagttatctagtgtgtacaaactaaagctaaccaacgtgtcgtaactaattttaataagttggatgttgcttgggatgttatgtagacttgtatgtcaagacatataatatacatatgtccaatcaaacatataataagccatgttaattatacatattaaaaaaaatataataaaataataaaataaatattatgtataaaggttaattatttacacatgcgacatatctcacgtcctcatgtgtgcgtgcagacattttactaattcaatatgattagtcacaatatatcgttttgtactagttcttatgcactagacaaatatgtgtatcataatgagcattttacaaatcttataatacgaattccatgcaaacaattgaaagaagaattgtgccacgtggcaacgccggtttcgcgggacggctcgatcctgctaattgcgcgcgtgcaggctatgtgatttctcgcgttgccgccgtacggctggcaaagctcaggcagctattgcttcctcctaccaccggatattgaggattaaagaagtaatgatacatactttggttagagactaaaagaggattaacaggatgtaatcaaatcacccactataattcctacgttgcaaacatccattcttttacagttattgtgtttccttattttgtatccgtattcatgtgatttatattatttctttcctgtgttttcctctatagaaatcatataaccttttctctttggggcaatttcattcttacccctactttgatgtttaatattgatgttgcccagtattttagggttttgtttttgcccatggttttttgaaataaagataaatttagtccctacttttgatggacagattaacgatgttaaatctttagcgagaaggcattcaatacccttactcatgttgcaaacttcccctgtttttgttcatgattgagaatttgcccacatttagcacatgaacattgcaaattcgataaacttttaccaatatgataattttaacataaatatcaacaaaaatttgcttcaaagtttgacatcttgagaaaaacaaacaagtcaagcaaatctattgcctacctgtgccaagctgtcgtcgtcgcctcctctcataaaccgccgccaccgttgttgcctcctcttcccaccgagccgccaccacgtcctccccacgtcgagccgccaccatcacctcctcgcgctaagccgccgctgttgcctcatcttatcatcaagccaccaccaccgtcgttgacctgttgtcctcctccccgtcgcctcctcgacacgtcgagcagccgcacctcctccctacgctgagctacagcagccgccattgtcctcctctctaccatggcctcttgtacaatgcctagcctcctcctacacgctgcaactgggttaggtggcctgcacttgctcgggtcgtccccgttgcctggccggcccacggacactgccgccactgtttcacaacggggattcgggttcaggaagggaagagttgatgccaagtgcccaagcctggagggacaccaagcggtacatggatattttctaggggtaaaagggtcaatcaataatttaaaaaatcgttatctctttctttctctaattctttaccgcactaagtccaatcccactcacttccatcaaaaacaggggtaaacgcctcatttattgaaaaaaatagggcaaaaaacaacaaccctaaaatgtagggtaaaatcggtattgacatcaaagtaggggtacaattgtacaaacaaaattgtccctttctctgttctccctcggtccaatgcaacctatatatgtcttgtgagggctactttgaaacgaagattgagggatgaatagggaaaacataaaattctgacaaaaaatcaagcgcaaaacaaagaattataaaacacataaaaatatatgaaataatcgtttgattggaccgtatgaaaaatgcaagaattagatgagagagataaactcataagagacttcgcatgatattgaacctcatgttaaaaatactccaaaacttgtatgaatttgggcattccttagaaatttgataagactcaatagttttcaataatcctttggttcaaagaatcatatagaaaaaattcctatagcaaagtttatcgtttctatacagaataaaagttcctatatttttctttcaagtaaaggggccctaattagttactccactaaagtcgaatgagctaggttcactttaccatgcgtggcgaagccacacggtttttctagtatgtgtactaaatcatagttatctaacaagtttgtatgtcatcaacgcaatttactcatgattaaggctttattcagaggcacttactgttgtagccgctgcggctgcggtagttcaaactggctgctaccacagcctagcccagctgaacacaggctaaaaagtaacaatttgttacaactttgtcgagctattacggaaaatgacaataatttatttgaaaatcgtaactccatcctctacgtgtgtatgacataataaacccgacatgcaacaacacgagtattgcatatgtgtatggcgtgtgggctcaaatatattggacatataaagttgcatctttctgtttaaatcatgttatcatcgatgcagtttctatgaaattgcatagctaaagttgtactagtgtactgatagttttcacaaaatagttgtggcttcctacatctactctatatttatgctcctacagaactactaaaaacacaatgaaataaaagtaccgacaaatttactgatatctgtcttcacatagattaggagcaaaatttatcgtcgtacgtatttcaaacaacatctgtttaagcttggcaacgaacttcctactaacgaaaatcaaagattaggcaagccttttggctttagcaggagctaagcggttgcgtgagttaatcccgcactatgtatagtgtacagctatagtggttctccgttttccttttacccctaggggtttgtattttctcctgccctgttcaatgaaaagtcactctagtgctgtttttcgttaaaaaaaaaaagcttggcatatttctctacacaccagtgttgctctgtatatctccactcccttatataagcacacacacagaggcaccgcattggtagaagtagctccgtgttgtagtgttgtgtagcagtagtccaccgctgagaagctagcaaagccagccatccattcagcgcagtactctcgggagagctagaagcgatctattctagccacaaggaggagagataaacgtatcgaaatggagcacatcgcgaggttcttctttggagtttccggtgagtgtgccgccatggctagctgcagcttgttcttaatttcctatctgtctatatgtgcatgtagtatttgtttctcccatcttcgaacactcgaagaaatgaaggtgtatgggtgctcctagagctacctactttgctggttaatttttggtgaagttttacactactgtgaattcgttctaagttttttgttggctccgttttccaggcaatgtcatcgctctcttcctgttcctttcgccagtgtaagtttctgattccttgctgcctagccttatcgtcaatcttatcccaatttgtgaggtcttgtaacgtgtgagcagaggtgggaagaaggaaaaaaaaacaagtgaaaagggaagaagaaacaaaagatacctgtaactcatagtctctgtgtctggaaaaaaaaaaggagctaacatagtagagtgtctttgttcatggagagtgtcagcttgctctgctccttagtttcatctaccatgatatttggtcaacctttttcgcaaaagaagttatcaaagttaaaaaatcttgcaatttttcccctgcttgcttgtttgccggcctcaccggcagctacccatgcgttgatgcgtgtgcatcggtcgcacgaatgccgcttgtttcttctgaccggtgagaaaattttgatggctctttttcattttacagtgtcaccttctggaggatcatcaagaagagatcaacggaggacttctccggcgtgccttacaacatgacacttctcaactgcctgctatctgcttggtaactaactgaaacctcacactcctctccacaccatctgcatttctccccccacaacattacactacgttttctctcagaagtttcgtgtgattctcgatagacacacactactccacaacatgagcaagtttagtgaacctagtaattgactcatcagtaatagtactactgattactgaaagttaacttgatgtttactcctattgccgtaattcatccggaaacactggatgatactgttgatgggaaccacagtggttggctcctagtgtagcctctgtccaatttgcctcgtcgatggaaagctactcctggacccacctgccatcgctgtgacagtgactcctgcgaaggaacttgtacacacactgtatcactggtgtgtgtgcagcagcagctatagcccttgctgccggcatggccaggatggctgtgacatgtgggcccaagaggccgttgtgcaagcacatgcagcctcacgttcgagtgtttgtagctcgaaaaagtgggtgagcttttttgggccagtatgattttaggtgtgtgtgtgtgtgtgtttggcaggtgagaaacactatccgcgagtcgattcttcgcaggttagtgttagtaccaaaatatcaaggcaaagcacaatatcataaaagttgtagagaccatatcgcaccagctctgaaaatctccttcttttccgctcttgtgtgtgcatgcccacatgctttcttctgggagtcaaaacttttctttccagatggagttttgttgacaagatacagtctgaaatctaccgatctataactataactgaaacttatatatatatatctttttaaagaaaaccagaattacagcattgctgttggtttgtgatgaacgatgaatggtggttgaaggtacgggctgccgttcgtgtcaccgaacaacatcctggtgacgacgatcaacgggacggggtcggtgatcgaggccatctacgtggtgatcttcctcatcttcgcggagaggaaggccaggctgaagatgatgggtctcctgggcctcgtcacctccatcttcaccatggtggtgctcgtctccctcctggccctgcacggccagggccgcaagctcttctgcggcctcgccgccaccatcttctccatctgcatgtacgcctcgcctctctccatcatggtaagacagtacacaccacacaaatgatctagtatagtacttctttcgtttcacaatgtaagtcattctagcatttttcacatttatattgatattaatgaatctaaatagatatatatgtttagatttattaacatcgctatggacgtgggaaatgttagaatgacttacattgtgaaacggagggagtaataactaacaaaattaaccataatctgattcgctgatcaattgactccggtgtgcagaggctggtgatcaagacgaagagcgtggagttcatgccgttcctgctctccctgtccgtgttcctgtgcggcacctcctggttcatctacggcctgctcggccgcgaccctttcatcgcggtaatttactcatcgtctttcttttcgctgtcaattgctgcaagcctacaagcaacctgtcgacgttgattacagaaagatacgtaacctgacgacgagacatatgatccaatccgatcgatgcctttttgtgtttttgtttggatctcgattgatcgtactgtctgatgggcacatgcaaaccgctgcaaaagcacagcactgcactgcacaagcaacgctgtttgcaactcaatgccgcgaaatggccggcggcgtcggttatcctttcggtgtctcgtccaacttggcgcgcacatgttgggcgtacgtacgtactcccttcattccatgaaaaacaaatatagaaccagatatgacgcatcgtagattcgtgatactatgaatctggatatatatatatccagatctgtagtattaggatatgccacatattcatttttcatgagacggagggagcataggagtagcagctatagccgtgcacacgaatggcacgcaaagagtttaactgacgaaattgcatcgttgtgttgtacgacgtgcagatccccaatggatgcgggagctttctgggcttgatgcagctgatcctctacgcgatctaccggaaccacaagggggccacgccggcggcggcggccgggaagggggacgccgccgacgaggtggaggacgcgaagaaggcggccgccgcggtggagatggccgacgccaagaccaacaaggtcgtcgccgacgacgccgacgccgacgccgatggcaagtcggcggacgacaaggtcgccagccaggtgtgacgcgttcggggccccgcacggcgcccggccgacacgcacggaagaatgcagcttaaagcattgttgctgctgctggattgattagtggttaagcagattattgctgtcgcctttcttgatttttctttttactgatctctgtctctcgtgcccgatcgagagagtatgatactgtatttcccgttctgttcttgcaagcgtgaagccatttcccatttttttttctaccgtacgatactgtatgccccccaggcccccataatgaagaagaatccgagcagaaatgcataaaaagaagaaaaaaaatctagtttaattgggctgcatctttatggatctcacattgcattgtcgtactgttattgggccgaaagtgtatcaagccaccggtttgtgaaggcccataccaacgcttgggcccatcaaaatcagactggtactacttattagcgggtcatggatggatgtaaaaaaataaaacccgttatcatccattagcccgttagcctttcttcctctggaaggcgccacttcccgcgggtatataaacgggcacaactaactcaacccgatggccccaccaaacgaggcggcgaggttcaggggagcggaggactgaactgtaatttcggaaagttctcgggaggatgccgatagagatgccgcggcggctccccttcgccgtcgacacgtggggcccctcctcccgccgccgccgccaccgcttcctcacccacgcgcaccgggaccacctcgtcgccgccggcggcgccgccgactccggggaatgccccggcgccgtctacgcgacgcggctcaccctcgacctcgccctccgccattttccccgggtaaaactgcccccccgactcgcggaagccgattctgttcccgtgtggtggtggtgggtgccgtgctaatcgaatggtcgctcgtggtgtcgcagcttgagcggggggagttcgtggagatggaggtggggaagacggtggtggtggacgaccccgccggggccttctccgtcacggcgtacgacgccaatcactgccctggtaattctggttccgcttcttcagttctgcataccgtcgtgttacagcttaccgtgctatatataagttgataatttgctggtagaaatagtagattacttagttgtcagggatcagggtgtgatggtgggagtgattgttcaattcagcggccgattttttttaacagatccatgggaattgtagtttttgctccgctgttcaggcggagtgattcatcgttctatgaggccattttcagcgcaacattattgaatttgtatattgagaaatgggaagggttgaccacggctaatgcttgcgtgttctgtgataccaggggcggttatgttcttgttcgagggtcaattcggtagcattctgcacacgggggactgtcggctgacgccagattgtgtacataatttgccactgaagtacatagcaaagaaagggaaagaaaacatttgccgtttagactttgtgttcctggactgcacattttccaaatgcttcctcaagctaccaagcaaggagtcagctattcagcaggttttcctctccgcttagattaaatgtgcttgttggtaactgtaggagtgtgcatatgacaacatggatggtcaccattgagaaatgtttcagtgattgcaggttatagcttgcatatggaagcatcctcatgctccatttgtctatcttgcatgtgatcttcttggtcacgaagagatcctaattgaggtgtcaaggacatttggatcaaagatttatgttgacaagagaaggaactcggactgttttcgagctctatctctcatagccccagaaatcatcactgaagatccatcttgtcgattccaggtatggtaggctagtccaagtaataaattccattgtaatttttttacactccactagcttccattatctccattttggaaccctgcatgtgaagggaaagatggcttatagtttatactgcatggactatctacatgtagtgatgagcgtgggtacccagtttcgacagcatcctgtcgatgttgtaactgtttcaatcttgcctaatccttcggccaacccggcaaaaatgagtgtgggtacccagtttcacatatgaccccaagtggtcgtccccaagccctactttactacctttcttgcgatttagagggatcttgggacagctgctgtttcgtcaaaaaatattgatagaagtctggcaaggataaagggcaagtagtgaataatcttgtgcgcatgcacttaagtattttcttggaaaggaactaaacaattggttggcccagtctgatccaatccctaactatgagtacatagtctatgctcatggtagtacacactgtatgtgacctttgtcctattgttgttctgaagcaaaattagttgctgccaggcctattgaacaatcatatgacagagcacactctccagtctccttgcaaaaaggaaagaaaccgataaagtcaattccagcctctctatctacatttcatactaaaattgtttgctagaacagaacagtacattcaggattataatcaaccttggctagtacaggatctaagaggttcattttagtctggtctgtgctatgttttgcatggagaggttcattttattctttttcatttgcaactttcttactttgtagattcttggattccaaaacttgtatgacaaagcatgtacaaagattgaagaggcaagggctagccttcagcctgaacctctatttatccgtccctcaacacagtggtatgcgcactgtgctcaaagccagaaacctagcctaacagaagctgtgctggatggttgtggggtctggcacatttgtttctccatccattcctctcgtgatgagttagaacaggccttggaacttctccagcctcaatgggtaatttcaacaacaccaccatgctttgccatggaattgagctatgtaaagaaaaaatgtttcaagacctgcttaactgctgatgatccactgtggaagatattcaagaatcctctccgaaagtcagtgtcctccccttctacattgctggattccgacacgcacacaaatgaagatcactcgatttctgtcgatgatgatcatgatcattcagcctctcctagtggtgaagaatgtacagactttgatatctgcacgcttgaactgaagttcatgccatcccctccagttcaggaaccagatattacactgtttggaagagcaagatttggctctgaagaaattgacataatgagagaagaactgtgcaatcagcgcattgctgttgaagaagccagggcatattcaacagcatatttgatctgtgatggtagcagtgaagttgaaacatgtccaaattcacggactgattttgtcatagtgcaagcatcgaagtcccaacagagttattcaggatatgaagatgaggacccgtcttgtcagtgtgctgcatccccaaggcaattagaaagtcgctcaatcctgtctttacctattggtgagtgcagtttgtcaccggtggttgataaccctaaaaagtctgaagttgttatagagtcagaatcaacaaatcatgctgaaagttcaaacctttgcatggtcagaaggggttattcaggatctgaagatgattgtcagcgtgctgcatccccaaggcaattagaaaaactctcaatccggtcttcacctattggtgagtgcagtttgtcaccggtggctgataaacctgaaaagtctgaagttgttatagagtcagaatcaacaaatcttgctgaaagttcaaacctttgcatggtcagaggagaagaaacaacagattgtgaaaggggtaccttgtgcgttactggatcatcgaaatgcttgaatgcaagtttgaagaggctgtacagatcaaggaatgtccctgtcccacgacctctcccgtcccttgttggacttttggaatccactaaacgcatgaaaacgcaacctggcagtgatggtagttcgttgaatacatggcacaccttacctagcagataagattgtgctttccactgaagataagattgacatgcacatatcatgtatagcatattgtgttcacgattcatactctcagaaactaccagagtctggtcacccagattacatgttattttacaattttcaaaatgatgtagagaaaatcgatgtattgtccctccaggaaaaaaaaatcgatgtattgtcttttaagcttatacaagttactagcattgtacaattttcaaatgttgtagagaaaattgatgtattttacaggatcggtctgttcgataaacaaatgatttcttctgccattctggtatatataaatatttccattgatctatgtaagcaacacttgtgagcttgctttctttttcatgactggatttatgataagattttgcgatcgatttgtcataacacaggctcaaataccatttaggctcccaagatgataaatatggcatattctagcaacacataattttatacatgaagcagagtcgacaagataattctaccccagaatacaacacgatcatgtgccaattctctaatacaacatagttcaactaactcgattattctgacaagcagacatctacgattaggtaagatcagttgacaagttcagtggttcacattntttacagtctctgcatcagatgctcctaaataacagcaagactaatgccaactcattctgtaagctctattgccatgcggaggagacgattagagttttctctccccagccgaagtgaagtcccccatggtcctcctcgaacttgtatctgtcacagtacgacttcagtaacgatcttatcccgctgatgacattgctactaaatgggcatggtgtgaagccagccattgtcattcttgcccttcattttccagcaacttcatatctgcagcataaataagttcacggtcagctatttgggagttgcaggttgggcatgttttcagggaaaaaaaaagaagagagtggactgtataagtagaaaatagcactgggaactaccttttcacacgatcaggaccttcgcaagccaagatgttgacaatttcacgagcaagacattgccgctccacattcattctatccggactttcccttggaagtgtcgcgtccagtgaatcaaaaagtgcagcataataatcataaacctcacggaacctaccaaaggtgaaatgtttcagatgtttgatgctatcatgattcataaggagtcagtagttggcgatgaaagtacattcacaggttggtagacaaaatataaaaggtaagctttggctggaacattctaaagtggatctaaagaattaagaagatattttacatcactaaccttgtctgaaatggagcagtattggtattggcatcctgctcaaccagtgtgacgagctttggttgcagacccttcaccattcgaaggagttggtccctttcattcataattgaaacgctctcgtcaggaaggtggtgcagctggaatgcaaaattgacaactagtgcttccccaggacaacaatctagcattgcaggtgtaacatccccaatgttagcaccaactgccctgaactcaaaagatatcccacagtcctctgcaagtttctctagacgttgaccaatgaccttcaaaccgccaacggtcctctgtaccgtttcaggatcatccacaccagttattctcaaatgacgtggcttatttgcattatttttcagaaactgtatcagtgtaatgtactggctgccctgattaatgtcaaagtctataatgtgcactctatcttcacctttgcaggcttcaagtatagcataattagcagccatgaaaccaaatcggaagcacgggcagatttcaaagaggatttgcattgccgaaagctgataaagagtcgggggctctttgcacgacaaggccttgtatatgcctttccctgaagctactattcttgctgcaagaccttccactagataggctgcaatcctctgagaagggtccccttggattgagaccatctgccggaggtccgttatgattgcctgtgcttcatctacattataatcagataatgccattgcacagtcaaagagcaactgctttggggtccgtggttctccattgttgctaccagcacaactgatgcttgattccgattcttttggtgagttagggagtatgacattcttcattggatcagcccattcatcgttaatgctacctgcctgggaaatctcatacaagatgtcatcactatcatcaagtaaagcatgctccagctcctgaagcttcatcctgatatcatcttcatcaaactctacttcaagttcagaactctgattgtctgatatagactgagaattctgctgagatacattggacaccaatggtgagtcttttgccacatctgagcaggaattgtctgcagaagatggagaatggccatcagctgttaccatgtacggcattggtgaggcctgttgattgtaaaaggagttctcaggattgtatggttcaggcccataacggaacagctgtgtgtcggacgcatatcttcgtgcagcgaaatttgaatttggagtgccaaatttatgtatgtaaagattatctgcgtaagtggttgacgggtctgctcgcctgataaaagacattacttttctgtagtgcttctaaacctactaggctaaatactcaaactcaaggcacagcttcctctgattatggatattgaacaaatacctgaaataaaacaatatacatcaatatgttgagtgaaacaccattatcattgcattcgaaacacatggagctatttaacaaactcaatcggcttcttttgattgttcttctgatgcaaactaatag

SEQ ID NO: 33504 - DNA, 37710 bp, Oryza sativa
aaaattcataaatttttcaaataatacagacggttaaattttagacacacaaatataaaaattaatttattttgagacggatgtagtagaaagtaaggaacatttggtacttctagttacttttgacatgctgttatttttttattataaaaacattaactacttagtatccgtactaccgtataaataaaagtaaatttatttcaaggcaaagggagaatcttctatgggtctatgacgtgtattatttagcctcttgttttttgcttgatggcttatgaagggtagctaaaataggttatctataaattattcttttttattcattcattctattaaaacttattgggatagtagtaaaggagtatgttatttgtgcatgtggtaagtaatagatttatttgtggattgacattcaattgaaatttacataaaattttccaatattagaatttgtggtatgtttatttcaagttcgtaatatgagtaatatttggctagtgatattatggtcatttaaagagtggaatcaatatttcatctttcaaaaaaaaaggtataaatacagagatatgtaattaatgcatgtgactatgacctcatgaatgagcagaaagtaaaagagaaatagtatgcttgagatgaattttccaaatgtagtgtttagtagtttccatatgatggtgagattaataatattaatatccacaccaacaaaaatctagaacatgaggtctagtaccaaatagtcaaaagtcattatcggaatatgaaaaatgtgtaattatcatcgacttccttatccgttggaaaatgacgttgtctctcctacttgccagctttctttggatcagattatcctagaaggaaacaaaatatagaggcaatctatcatttattctgatgatgttctatgcatggaccaaacacgcatgcctaaatatttttgcaggtaataggaggaccattccacatgaggaacttgaggtaggagtgttcttttctatcaaagacgatgtggaccagtgaaagcgttgcaaactttaagctaaactagaattttctccaatgatatgttgtcaatttcacttactagtaatatcgtctctagtatctaattttgttcgctggcatcggttggatggagctttggtgaatgctgtaaacttactatttcttttctatctttgattttttttaaaaaaaaaacaaagcaaagctccttcttccatttcaaatatgtaattttgcaggtcaactcccccaagtgcttatttgcaatatatgtcaaattttctcaaatagtcttgatgatatttcacattgactattgagtactcagtcttacagatagccacaaaacgttgaatggagatgcttgcttacacaggatcctatccatttggtgtggagtacgttttggcattttcggcttcaccgcgtccctaccaaaccaaaccaaagcagctgatcatttcacagcttgaccgttgaaaactatggaaaagtttattttaagtgcgcataaaccatagtggagaaaataacctaatagaaatagacaagtagctgtacaaattagtgggtccatgaatgttaatttctacgaaattgccgtcgccttcttgttgaaggcttgatctaccgtattgtcttggtctaaaaggtttgatccaacagaaacttctacaggtatcagcttaccgtacttgatgttgcaaagctatcatccactttttccgtaatcctaaacccttaccttttctggtcatcttaagtgctaatccaaagtaatttttctggtcatctagtaatccgtaatataagctcatacaattctaacttaattaacgcatgcttcacatatcatcatctgaacatatcagcatatcattaccagttcatcaaagtcaccaccggcccatgcctgactttttgaccgggattaatttatcaccacgtttatttgtttgtgatccacagttccgaaatgctggaggtacatacttaggataagattgtttttacctgctttggataattattcatgtaaaaataaactctcagattaattaaggtccttaagctccaactaatccgtgttcattttctcaggtagtcactctctccccccagtgtaaaaggcggtttttttcttgggattcccgtgggctgaagaagccagcaaaaccatttctctgtcaatcctgcgtgcaatgctttccagcaaacttaaaaaagcttttttttaggcgattaaataagggtaaataaagtacgtgtgctgctaacaaatgtcatgcaagattggattagattaggcacgcctggaggtgtcgtttcgtgctgggccttttgactccttgccctcctatagtcctatttgcttgcagctggtagtccactagagtagtgagatatttttttcatggccaagcaagcaatgttgttgtcgtgtgatcatgttagtcaaattgcagacgtgtgcatacatgcaacatatcaccaatcattcagaaactttaagttctactctctctctattccagtttaatcatcctctaaataaataataccaaaactaaggacactaaaatgtatatcattcttaaattaatcctcatcggttaaggtgcttttactacagtactatagtattttttttcctttttcttttacttcatcaaaacatctctgttttcgccttgcagccttgagagtttttgagtccctgatttgttctgcttgttgctggtgactgctgagcaatttggtgcaatacactgaatctgatatccgacattgaatccagaaagcatgcgtgcaacttgctctggctggctaggcatgggcgtctgtgttatccgtgcccggtttgcgatctgtgtgtgtccctctgcatgcgacgaaacggcacgcatgttggtttgcatctatcagacattcagacatagaggagaatctttcgtacaagaatggtggtgcccatgcgtgcgaccgtgcggaagctgcaacagcccgtgacacacgcacacccccacgcctcgtcgacgacagcatctcagtattggaatcgtacagtaaaacaatcttaatacatacaagtggcagccaatctgataatacactaaacctttttttgatctttgttactactgtaacaaggagcagaggtcatcttctccttaccgtgccggcccataaaatttatggcctgggcctggaaagaccatggcaggtgttgggctggtgtcgcttgcaatgggcccgaaacgaacgtgagcccattgggctggcaccgatcgagagcttcgcgatccatcgactgcacagcaggccggtgtccagttcccgtgcgatctcctcaatccggcccgttcccgatgcccatggccgtctgctgcttctgcctccgtgaggcctctaatcacgaatggaagtagatcatgatcatgcataggaataagttcacttgatgaccctcaaaagtgatcggaatctaatccatgaccctaaatcgcaaaaccggatatctcgaccctcaaactattaaaaccggtgcaattttactcccttggcggttttggagtgcggtttcgctgacgtggcggtattgacctaatctgtgtgctgacgtggcgcttacatggcatttcaattaaaaagatacacgtggataggaaggatagctatactaatttggtatactcaaaatacacctttggtacaaaattgacaatctcacaaggatgaaatatcagtaattttctatttactggttgatcccatcttttacggaatcaattccttttttgaatgtacaaaaatttggggagctcagcatgtctggaagcacgggagaacgttcttttgctgatattattaccagtattcgatactgggttattcatagcattactataccttccctattcattgcgggttggttatttgtcagtacgggtttagcttatgacgtgtttggaagtcctcggccaaacgagtatttcacagaaagccgacaaggaattccgttaataaccgaccgttttgattctttagaacaactcgatgaatttagtagatccttttaggaggccctcaatgaccatagatcgaacctatcctatttttacagtgcgatggctggctgttcacggactagctgtacctactgtttttttcttgggatcaatatcagcaatgcagttcatccaacgataaaccaaattccaactatagaactatgacacaatcaaacccgaatgaacaaaatgttgaattgaatcgtaccagtctatactggggtttattactcatttttgtacttgctgttttattttccaattacttcttcaattgagagaaagaaagagagtagtaagaattctcttatccccatttggaaggataccatccttataactatccatgactgtttttgtctctagcatgaccacttgataaaatgtggaggaaagtaggggaaatggccgatactactggaagaattcctctttggctgataggtactgtaaccggtattgctgtgattggtttaataggtgttttcttttacggttcatattctggattgggttcatctctatagtaattggagggaccaggttgtaaacatgaaaaaataggaacttagcgggtccttacccccttttatctgattagagcggaaaggacccgcggaattcttactcttataacccgacttttttaatctattccataacctacaaacgggtttcctattttgatttgtaaaaataacaaagagaaagcctttgctctgatggtcagaatccctctatttattcgttttgtttgttaattttgtttgttaataatgttagtgaagtaatccatcagttgatttataaccccctcgccaatgaaattaattcacttttatgaagcgaggagaaagaaaggatcaatcgaggatccaatattttattccccggaggaagtctcttgtaaatcattgatttaatttagagtaataaactaataaaaccttaattaaaactactcaactagcctaaaaataaaaaacagccttcaatggaagagtatccgttttttttgcaaaatttctgtaagttctaaattgaacttaattgaacaagtcaagcaattctatttggtcacaaaaaatttgtcccacgccatattttctttccctctttttgtccactacatcgcctgaacctaagcaaaagaggttcaagagacagacccaaataaagaagaaatagtaatctttgccgaataggaagaaaaaagattcatatttcgatacaagaagaatcgacacaagaaaaaggcaaaaaagcctttttcttgtgcccaatagaggattaagaagaccagcaatccctcctaaaaggatttgttccttttattgttctcgcccttgccttgcattctcctcgttttgcatgagatgatagaaataaggaattgcagacaagacatctcgcaaacaaaaaatagtctaaacaaaaaaaagatttccaaaatggatcatagagaattctagcaatcgccaataaatcgcggctttttaccaacttgatggtaagaaatcccgggacctagaaattcatttcgtacaattgaaccttttcaaactgtttctttttgagaaccaaaaaaacttgtgccaaaataacggatgcgaagaagaacaaaaggccttgaacgcgtaatggatcctgaagcactatttctgcatccccctgaccaaaccctcccacattaggattacttgttaatggttgatcaagcttgatcgattccccctctgaaacaagaagttctggaccgggaggtataagatcaatcacttggcgtccatccgatgcatcgactatggatatttcatatccccccttttctttacgcagtatttttcttactacacctgttgacgttgcattatagaccgtattgttactcttgctaccatcaggatagatctgtccccttcctcggtttccccccacatatatgggatattttaagaaatgaacgtctttcttcatagcagggtcgggggaaagaatgggaaagacgatttcactatatttcttaccgggaacagggcctatcacaagaatattttttttattgggacgataactctgaaaagagagatttcctatcttttctttcaactcaggagaaatacggtcgggcggcgctaattcgaatccctcgggcaaaataagaacagcacccacattcaaccctccctttttcccattagcaagaacttgtttcagttgcatatcataaggaattcgaagaactgcttcaaatacagtatcgggaagcactgcttggggaacttcaatatccacaggcttattcgctaaatggcaattggcacatacaattcgtccagttgcttctcgtgggttttcataaccttgctgcgcaaaaatgggatatgcatttgaaatagatgtccgagttattacgtatatcatgatcgatacagaaatcgatcgagtcatctgttcctttacccaagaaaaagtatttctattttccatgtccaatcacagatcccggaatttctacaataaattagataggtagctaagctaatctagttccctatacacgaatctgttgtcattctactgcaacagttgtactggaatgatgaataccttgagcaggtagaaatagaaaaaaagaattttgctaaaatggaaaaaggctttctttctaaaggaaaaaggatgctaattttgattaatatcaggagatcaaatgagtttatgcttcactaattgaatgataaatgactacaagcgaaggagataggcggtttaaacaaaaaaagacccaaaatttcaaacatgtatctagaatcacaggaaaactacaaacaaaaatagtgaaaattagctcgttaggaacccatccaagatcgttatagacccaacgaattagtagttcccaaccgcgggtggagtgaaatccaacaaaaaaatcagtaactaaaagaataaaaaaagcttttactgagtcatttaagttatagaagaattcctgaacccaagaattcaaaataacaagttcctctttacccagaaaaaaagaaccacttagaatagccaaacagattatatttgtcgagaaatgcaaaatgatatggagatgaccctcattatctattttggccaattgtattatttccttgcgtatttgtggatcccactgacatgtgggccccacatgccatcttatccgtttcttcttcctcccctccccccttctctattctctccctctcccctacagccgttcgcggggagcgagcggaggcgggcgggggctgaagcagcggcggacggcgggagctgaagcggcggcggcggaggtaggttggagtccatgtcgtgccgctgccaccaccacccgcaccacccgacggccggcatcgagatgtcgtcggcggccgagctcccctctgcgggtgtcgcggcggctggcggagactgcggcgagcggcggcggctgcacggagtcccgagcggcggaggcgcaggtgtggagcggcggcctgcgagcggcgcgacggagacgcgggtgtggcggcggcgacctgcaggtcgagcagggcgcggccgagctcgccgtaccccgccgcgtgtgcctcccgccgccgccgctgtggtctcctccatcttcgccgtggtggagctcagcccgggcaccgccgccgcccgcaggcgatcagctacaccgtccgctccgaccgcctgacgcgctcgcgctgctcctcttctcgcagcagatataccccatggtgaacgaagacgcgcagtacggcgacgagctccgggccgtgtgcccgccggatgcggaggagacggcgtgggtgcacctggaccacggcacgccgggggagctcgacagccagtgctacgtacaggaacgtgctcgccgggaaggtgctggctattcaactcggatcactgggcactgatcagcgaagcggcgacgaggcagatggtcgaggacaacgcggtgaaccagtcagccctttgcttgttggcttgccgcttgatgttagtacacacatgcactgcctgttgctaccgcttgtgcttgctagccgcagtccagccagtcctcatctgtcgccccttgccgattgcctcggcaaccagcaggagaatgctcaacgcagatgcctcccaactcgcgtgtggttgcgtcgttgtcggctggctcagcacgccgaccgcgtccatcggcggcggcggcgcctcccccgcccgcgccgctcctcccgccttcaacgccgccgccgtcgcaagtgcaggagaagccgccgccggatgctgccatcttcgaggggatgccgacgcgagtcgcggtggcgagacgcaagcggcccttacgcgttcgtgggcgcggcgggagaacggcggaggcgggtgcgtcgtggccggcagagagggcgtggagcacagtggtggatagtgcagtcacgaggccgagggtggcgaggacacggccattctcgtggcccgttttcttccttccgacggccaaccttccacggcgggctcgatctccgccgccgccgccgctccggccctcgcccgcatgccgccgtcaccgctccagtgccactcccaggactccgccgccgctggccaccgtcccacactcgcggagagaaagagagaggggagaatatgatttatgtgagccccacatgacagtgggtcccacccatacttttggtgaatgacaaatgggtcccacgtatatatttttatttctaatgccacctaagcgccatgtcaacgccacgtggacagaagaccgagtcaatactgccacgtaagcaccacatcaacaccacgtggacagaagaccgagccaatactgccacataagcgtcacgtcagcgaaaccgccctccaaaaccaccaagggagtcaaattgcaccgtttttaagagttgggggtcgagatatccggttttgtggtttagggtcacagattagatttcgatcacttttaagggtcacaaagtaaacttattcctcatgcatatactcttcagagattttgatccaaaagaaacatatgatccatgacaccatccatccacaaacacagaagcagttttccccagtccatcgtaagcaatcctggggttttaatttacatcttcctcaaatccgagctgttctagtttctacaagagggagcttgctagtaggcatggttggagaggatggccctcccatggcggtgcgggtggtgagcgcaggcgcagtggacggaggtgaggctgaggcatccgctgatgatgagggagtgccgctccgggcacgtgtggagcgccgggaaggagtcgcacaccgcctggaccgccggcggcgtcagcgccgtgcactggctgatgttcaggctggccagcccgtcggcgccggcgccggcgttcttcctcgccgccgcgtcccagctccggcctttgctcctcacccgccggctgttcgccgccagcgagtacattgcccggtcggtgatgttctggcagtagtagagccccagcgaccgcaggtgagggcagccattggcaagagcgaccacgctctcatctgcagatcaagaaattgatcagataccattttgtcaggcttcgtacagtttagagtaaatcagcatgtcaaagcaaatgttattcaaaattcaaactgaacaattttaacattctgtgaccctaccaaaattttggtaactttaatagtaaacatgctagtttagattgaagccaaacaattagtagtgcccacgctcactttggctacattctataatcttcttcactctcatactaaattttagctttatattggtattaaaccaaacatagattagctaactttgccctaccaaaaaattgatagtgccaaaatttacctagattttggtactaccaattaattggtagtgtagagaaccaaataggccctctgatcaaggaaaaaaaaacatcggagattacctgttatcagaacacagccacacaagtccagagcccgaagttcagggcaccctgatgccaagctggtcactcccttgtcagttacactatcacaccagcctaggttcaaagactgaagctgaccacagttacaggcgatggcctgcatcaaggttataaagatcagaaagaattcgatggagagcaatggcgcaactactttggtacctgcaatgctctgtcggaaactgccctcacacacccgcacagattcaggcatttcaggttcttgcactggctactgagataggccaaagcagcatcgctgaaattggaacatccactgatgttgagccttgtaagatgggggcatccatgtgccagagcatacaacgatcggtcgctaagcctaaagcttctgctaagatccaactcgcgtaaatcatgacagttatttgctacagcctccactgcactgtcctcgagctgaggtttgatttgccgtaaagaaagaacttgcagcttcgtaaatttctgagcaagtgacatcactaagtcattcatgtgagcctggcacctgaaaacaacactctccatggttaaccaacagccttattgtccacagatgcaatcaaaattttgttcagaatgacgaggttttgcagtcactaaacaatatgtctgaataaagcatactcctaaaccatattgccaatacaaagttatctgatcatgcttcttaaactctcgtatgactgtcttagtatcaaaagtttcaatcaaacaagcatttgcaccaccttgcaaaaaactagtaacacaacaaatgatgtttatgactcaatgtgaccacaaacaatactcttctcaattggtggcgcgagcaaacagatgaggcagaaaagttgcaacagaaaggactacgttcagttttcttgaccacgctttgggagatttggacggaaagaaacaatcgcattttcagagggaaggagtctacaccatcagctcttgctggcaagatcatagatgagctttatttgtgggaaatggtaggtgccaagggagtgaagtgtattatgttaagagattaggcttttgttttttctcaggagtgcaggcaggaagagttccttcacgaatgcctctcctcttctgttctgtacagtttttgtgttctctaacttcttctataatataaaaccagttcgctgggttctttcaaaaaagatgtttatgactcaatagaaaacattggaacaagccagtcagaatatttttgtcagacatcataagtggcaaacaggcaagtttctataaacactacaaaattaaaatccggagtttctttagctataaaagcatccaatttaaaagttacataactattttgtggatattatcacataacaattcttctatgtctgtaatattcaacatgtcaatactatgtgagccatctacccataaaaggtcagatagagacgacacgaagaatctaaatgtttcgtgagaatcatattcaggaatgggaggagaaggcaaattgccaaactcaccacgaaagagaaagattcgtgactccccattctaatgtatcacgccaaccggtgcaaacaccagagcccacgattaccatcctgtcgtctccagccatcgataatatccgcaggagcagctccatgggaaggtccttccaacctaacaaggtagtccctgtgccctcatgatgtgcctgtccactctcaccctctccagaaaccatgagtgcgttgaacgaattgtccaattcaccactcatcagctgctcaccgtccattctttttttttttttggataatctgaagctccgaatacagctaacctgcaagcaacagtgaagttatcagggactctgcactgatgtcaaatcccaatctgaacttgatgctaccagaatatagcaaattaatcccagaaaaactcaacaaaacagatgggagcaatcataaagtcgttttgcaactgaacaactcaaatcttcaaaagaaccgaaatagagctaagaatggagagataattcagaaagagcaaccttactatcaacaattctacaccatctagatgagaatattatcataaaaatctcctagagaaacttatagggaacacacagaaaggtacctcaaaggagctcctaaaaaagcacgtattctctgcaagtggcaatttgagcagaaaccgaacttttttttttcccttttgtataaaaaagggagctccttgtaaaggtcagaaccgcattaaacccaaatgcagatgagacggcaagcaaggaggaggcgaggcgcaagctgcccagcctttgatttggccgaaaaattcaatcccttctgtcgctaaaacaccagaggcgtggccggcaccgcaaatcccaatcaacaagaggcaagtaggcaacaaagctaggctttcagatgattccgggccacgagaagctaatccaggaaaattcaccaagaaaaagctcaaatcatttggaggcgagatgaatgagcgaatgataacggagtcaatctccaacgcagataacatccgttcaagactgatagtgacctggtctaaatatcttcaagaaagggaggaaaaagaagaaaacaactccatcgctaaggatcgcagtagctttcgcgcacagccagccacacaaacaaaacagctcctcccgaaatgcagagtaaagctcaaagattcatacagcatccaagaaaactacatgggatccaaaccacgagagatggcgatctcctcatcagcatctaccacgaatcccagacacaaaggccaagaaatcccgcaaaagaattcacccccataagacgtgaaacttcctttcttactcacctagtcctcgctcctcctccaagaacacgcgaagaaagaagaaactctagatgaggcagtcgataacccgggggagaattttgtttttggtttttgccgcagttgtgaactggcggctgggttgggaggggaggagggctcgggttcttgtaggggaggaggacgccaccggggagggcagcgacccgaggtggcgcgtggcgggtggaaggagaggacacgtgggcggtggcgtcggggggcggggcggttagggccccgggatttttatccccgttgatttgcggatgcggggacgggaaaacgggaggagttcgctgtccggactccaggcctggaagcttttgcccccgggaaggctctggaagggccgaagggagggatcgtacgccttgctctatcaggtcacgatttatttatttattttttaccgggcttggccggtagaaggcccagcagaaattttgtgcttctgcattgttttctccatcttaaaataaacgatcggaatgggatatgatacaacaaattagaatatagggttaattggatctatggctatatccgctaatctgaatttagacataatccggatttattgtattaggcgtcccaatctagattggtttatttggaatagacgtaatgcacactcctgctgtgtaaagattaatttaggtgtgtctatattctatagcactagtacccaataaaaggaaacctgaatagcaagggctagaaattttgaaaaacggttagcatgtggatttttcctcttctgtctactagctcattttcaagcagcgaagctattcgatcaagctgtaaattttggcatgttcgacagcagtggtagcatctgcagtcgcacattatgcatgctgtttataacactattctggctggatacggcgcaaccacaaccctaacagccgaataggccttatgagaaacaactaagcatcggatcttggggcttgatcagattatagccaaaataaaccttaccaagttttggcaatgcaaaaaatttagcaatacatttttggcaagtgataggatttcttatgtattgaccagatttggtaacgaactaaacgtagacatttttttagtaactttgcgaaaaaaatagtagggttgaaaattgaatcagagtgaacatgcacttgataagctaagatatcttagcttctagctactaattcattttcaagtattaaggctatctaattgagtcggaaatattaagaaatagctggtatgtatcgaattgcttctaaattctactaattcattttctgaatcctaccgttgagttttgcatactaaaaaaatgaatatagacttttcggataggcagatattcgagcagctgtgcatttgctagaaacttttcattttacattgccagttttacagaagattagagtagattatccagccagaatgccagatggccgtccagattcaatgaactaaaccaatgaacctacagtacggcatgagaccaatcatgcctccattgattgattgatcgatcccaaaagacaggcgacacaccggcctctgatcagatcaatctttgctcccttagtgggcagtgtcactcaccactctacatgctgatttgtccttgctaatgctctactgctacccactcgcttgtcgatttgcagtcgccatgaacctagccacgaatctagcccaaattggcactcatccccggagctcccaaagcagaaagcacccgacgagcaagagacagaggcaatgtggtgataagatcaacagagatgctttggcagagatcggccacgacgtagatcgatttctagagattaatttattaatagatgggttaaccaaatcgcatggcatcttctcatgcgggttgacgcaagcatgcatggaccccgttaattggcttaatttgtggtcttaatacagaggattactcagtttcagagtttctatgtgttgctcagggcaaaggttggattggatgatccggcaagcaaagtagacgcaacctttaagctataataatggccatagttatctagcctttcagtgtgtgtgatgtttacttggatgtatccttctaaactctgactgaattaccagtttaccacgcaaaggattgttaatttcatgtagagttgagtttattaaaaagaaaaacatctgaccatctcattccatgggctccttggttctgcagaagccatcagttcacaggtctttttcccgacgttgatcagttcacagtaataatcctgtgacttatgtcatctttcagcaagaaaccgcaggcagaaaaggctaaaacctagtcaagtacagtcatcaggaagagcttctccgaatactcgcagacatttcgatatgcttttatccctgaacatattcctgcttatgtgtacagtatgtttagcatttttttttgacgcaatacgcttaacatgacacacatgattcctttcctcatttaatgtacagaactatcaattcagaatatgtgttctttgctaatcccgaacgatggagaagcttggcttttaattatagttgatgtggacgcaaaaatccttgtacctgaattccttgtttctgcagtttttgatcggttgcctacaagctggaacagcaatggcgtctgctgctcatttgcttgctgatttcaacaattggctatgctatgggatatcaagaacagctttgatcaaaacactgtgtgagtcagcatctgacgagttctgatattgatagaggtggctggggtccattagtattagattaatgatgagacctgagtgtaacacaagttccttctaatccttctcttggcagattctctttgaactgttgtatcaagtaaaggaaattggaatggttccttgtcaacattaaagctgtcacaacacgatgcatgagtggagtgctactcatctttttcttgttcagagattcctaagataaaatttgtttcattaaactgacatagtacaactttagcacggtcttctaattaacatagaaaattttgccaatgatgttgtttactcgtaacttgttgtttcattagtaggaaaagcacctttcctcctagtacacaacacctttcagtttcgtaggataacgttatagtattccaggagggaagaacagcaacttttcttgcgcacacatatatgcttttgcaggttcttggcttcttgggtaatactaacattctgccctcatttattttctgaaattgcatcctgggaataggcatccaatcaaaaggcattttattccccctacgaactcaaatcgttgaaacggttcggccgcctaatgatgacccagaatttcagacttcccattcaacagaatgctggttccattgccaacttgtagaggatggaaaaggacggcagacagcaatccacaggtcaattcattccctataagcatgaatctctttttaatcagaagtttttttttttaatttcttctgtaagttagtgattggaatggccccataaactatattctgcagaaacctgttcagctgggatcaaaagcagatgtcagcattttagatggctcatatccttatctgattagtacttattttcacctaaaaacggcaacggatggagaaactgaaggaaaacagctgcctagattgcatatctttatattagcagaaactaaactgctgagttacatatatgctaataaaatggtcacaacatagcacggctcactcttctttcgtactctacagatcacactcttcacctacacagtagccccaaaatttgatgttagtaacacaaaggacaataacatgacaagatgcttttctttcatttacaaagataagacagaactatcagaaagtgaagcgctgattcctcaaacatacagcgttgtatgcatgtgaacagataacgggagagagatggaaaaagaaatcacaacagtggcagagtattattaagggtgaactcaaagcagacgatttctctctgaatactgcttcacttggtaaagtgtgggatgaattgccgggacaaatctctgatgtgttcattttctgactcaataagacgaacaacctctcccatagaaggccgctgttctgggtttatcctgacacaaagatatgcagctcttgctagatgatacagcccatacgtatcgtatgtttctgcaatgcgctcatcaattagttcatgtagtgcaagactctcgaccaaaggttcagcctgaaaattttgaggtgtcagaaatgaatggtgcaggtctactgtaagtaggttgacaaaaacaataagaaggatctactaaagtgaatacccattgtaatatatgtgtacactgccctccacattcatcaagcaccttgcgaccagatatcagctggaaaagaacaatcccaaaggcataaacatctgttctgacagaaactatgccatattcagcatattcgggagccaagtatctgacaataatgacaagaaatactggtactgttagaccttagaaaacaggagcaaaatgttagcataaattagaagataaagttttatcggtgaaataatttgagtttattccaaccctgattgccccagaatccttgtatggatagaagcattgctagccttccattttgcaagaccaaagtccccaagctgtgatggtataacatatacaatcacagtcagattgcatgaagcatttgcatcttgaaataaacagataagcagtgactgagatctagtattctccagattaccataggaacaaagtcatgtgtcaaaagtacattgcttgggcgcaaatcccgatgaataattggaccagcacgacattcttcgtgtagaaaacgcagcccttttgctataccaagggcaatagcatgcctcttgtgccattccagtaagtttgcgtccttgtctatttcatcaagtgacgagcaaagtaaattagccacccttcatcttcacaatataaattactttctgcacatcaactaagctcttaccaaataaatgccactcaagggatttgttgcatatgtactcatacaccaaaatgttgtagctttctttgcaacaatacccaagcagcatgacaatatttcggtgccgggcaaagctgagaacttgtacttcagagaagaactcagtatagccctgtgagcttgcttccttgcgtactttagctgctatgacctggccatccttgagttggcccttgtaaacatgcccaaacccaccctcacccagcaaattctcatttgagaattcagacgttgcagcttgaatctctgagaaggggaatttcatagattcctttatgtaaagaactgactttagaccacaaccagcacacagaactggtcgctctgatgaatcatagtggtagaacatgtttccttcaacacctttacctgtaaggacaacaggagcatatgtaatgtgcgcaaataggtatggtacatgggctgtataaaatcaactattggagggtaaaattgcacaattttaactctgagaaaaggttttcaaaagctctctaattctatctgtatgaaatagcagaaatacaaccaggacacagtgtttccttttctttctttacacgtttatctagtttgaaattttgagcaaagtacactagttgctaacttacgattttgctttacaaaagaaacatgccataccgttggacaaggaatcagttccgtcaatcgttgtgagagacatggcgctcattgatggtgtcaaatatgacatgctgctcccgaccacactggatgtttcatgcatctcgtgatagcttagagaggcaaaataacttacaggtgatgacttggtcaacacactatgagtgtcagtatctaatgtctccgaacgcaggtcgagtgatactgctaggtgctgcagagcctttacttcccccatgcttttgctcggtggaattgtcctaattatcttcaatggctgcaccaccaagttatcctgaaatactgccaccttgcaggcaatgtgcttttctaagtacttgaaatctctcctgaagtgcctaaaaaattacaaaataagtacctcgtcaagtattgaaccaaacaggcttaagacttgtcacacagatcctctcctgtaatgcagagaggaactgtgtggacagtaatttgtctctgctgctagaatagaaagtctgtaacaatgttaaacaagacataatgtgcatacctatctagtacaacccaagcagctttgctggatttgacttcattgataatgacaaacttggctggtgatccaggagataccttaagggtcacattaatctgaaataaaaacaacgagcatcagagtgtaacacaatttttagtgcatgttttcaatctaatcggtgaagcacttcattatccagacagaaaaaggttggacagggattactggattagagacgaaagtacttgcagttttgtttcataaaaagaagacttatttctctatgaaatactccgtaaatgcaagcattggtaccccgactttgcttagctcctccacgtcatgacggagcttgttttggtagaattcagctttcgccttaacctgatcacttagtaatcgcaagttcgtcccggcaaaagaatcaatacatgccttggtttggtatcccactaaacaaaggaaaaataaaaagaactagtaagttttcagtaaatgcaatcattactttgctaacatataacattcgaagtagcacaaacactcaaacaggaactgaatccatatttccaaacatacctgtactaagatggataagggtgcactagctaaccattatttaaaatcgaattattacagcttcagactagatatttttaaaatggaactgttatcattgacattcaatgtgaaatttcacaaaagcaggatctaaacatatcatcgtattaatgctggactatctcttgaataaatgaataggattctgtttttgaaacaagaaaagaggaattctaacagtttccttgtgatggaattagatgttcagaaatccaactttgtcttcagtgattcgctgaataaagaatgcatggatcttctttttttcttcttttattttcttttttcctcttcgtcactctgtttcccttacatgacattataggttgtcctacccaacgagatgttgccccaatattgatgaccaacagcacagaattgcagtaggcacatctatttgacatctctttcactaacaaaacaagaatgccactataaaaattctatctaaatgtacgataaaagtgctagtgtgctacaatccattcccactctagaatttgcacatgtttaggcttccacttgtactcatgtaataccacttcaattgtggagtactatgtaaatgcaaaatgcaactagacagcatttcgggtaggttaattcgtctaagtacaatttctgagctgtaggagttaacaaaagagggagttttaattcaaggagaaagagctgggagaaggtaacccgtgggaaaagaagggggagcgtggccctcactgggattggtgatggcgtggagcacgccgagcacgaggagggagtcgccgccggcgcggaggatgtccccgcgcgtgaccaccgccctgagcgccatcctgatctcctcctcccggtggtccctcgtcgcgtcgagcgccagcaccaccatctgcggcggcggaagcagcggcggcagggccgcgggctggaccgctgccccgccgcccgcagcggcgctcccatcggcagcctccgcggccaccgacgacgccggcgtggggtggtcgtccccggccgcgatgaccgagtacatcgacatgggcgtgctgaccggggtgctggtggcgctgctccggtcgtccccacgcccccgccgccgccgccttcccccatcgtggccgcccgggagcgaggctattagtaggccgaggcggcggcgcgcggcggagtatattcgcgacagcgcggagtacatcccgccgccgccgccctgcttgctgcaggcgcggggggcatctcgaaggcgccggggcgggatatatggtggggcatctcgcgggcgatggcgacgcggggggttctaccgagggcgcccgcggcggcgacccgcagcaggttgcggttgtcgcgttcgcgcgcgcgcggacggcttcggcttcgccggcggaggcgacgagacgaggcggcggagaggagcggagacgaagaacttttcccgttgccgtcggccggacacggcccagcgactttagggcccattgcgcgaagactatccgatcgctcgcgctgagcatcgtaggccgatttagcaactaagcccatcccttcgagaaaagaaagcccatgcacgaaatataataggcaacattttggtgtcctctgttatcgattatcaacgtgggagtaaatccgacaattaagtgctctaatacctcttcatttgtagagtgtgcagcgctacccatcaaacatgggtcacccaaatcacattgagatatgctctatcgtaggtttaaccggaattaaaactttagatactggtctgcacaatctaaaaaattagtctgatgggtgagaattgtttttaccttttagtcgtgcttctccatcatcctataacggtataggactaaatccaacaatttaatggaaatggaagatccgaccaaccacgaaacaccaccgacggagaatcataccaaagcaaacgagtcagatcgtaaatcactataaattatagcagcagcacgtgtggataggtgagaaattgctgcaacacggacctgacgaccagcaatcgtggccagtttctagccatttatggcctgtgattaatacagtgtgtggccgaactgattaagaggtgcagccgcctataaattcagcctacggagtactgaaacattcacgatctcgatctacgcggcatcggagagaagctgatcgatctatcggtggggcgcgcggccgcgatcgatggcgaagctggcaggccgcggcagcaacggcgccaccgacgaggcgctgcgggagtggcggcatcacggcagcaagttctacgatacgttcaccgtctctggcctccgcgtcgacgccatccagcccggccgcgtcctctgctccttcaccgtccctcctcgcctcacggtacgctactagtagctactacgtccgtctcattttaaatacagttttggttttttcgcgtccaattttaaccgtccgttttatttaaaaaacttttaaaaaaaattaaaaacataagttaggagtaaagtactatttatgctttatcatttcataacaataaaaatactaattataaaaaaatttcaaataagtcgaatgattaaaattgggcgcggaaacttatggctccacttaaaataggacgtagtgagtagtaaacactctttctgtcgcaatatacatgcatctagaattgtatataatattgcgggcatatttagattgtagcgaaaataaaccttaccaaaatttgacaaattgccaaaattttggtaggatttcttatgcatttattaaatttgacattttttgcaactttaccaaaaaaatagtatagttgaaaatagcatcaatttgaacagtcccttcataatacaatgagtttaaatggataactgtccatagtcgttttactatgaaatatcacaatcgatcctagatacgcttataataaaatggagggagtacttcctttctccccaaacaaacaacgccattaacatttttacataaggctcgactattcatttctctactacttaaaaaataaaatgtgcttccatcgtccgtaaaaaaaaataggcgaaaaaaaacaagtttgtccgataaaaaaaaccgggcgaaaaaagtgcgaaaaaaaagaaaaaccaaatatgcccgatccagaaaaaaggggggaaaaaccggggaaaaaaaccaaaattgtccgatccaaaaaaaaaaccgggccaacaaaaacgtaaaaaaaaaagaaaaaacaaaatagcgataaaaaagtccgactcggtcccgtaaaaaaatagcgataaaaataaaaaaaagcccgactcctcgttgcgattccctctcagaaacaaaaaaaaagtccaactctagatccgagtcccactcctctcggtttgagtccgagatactaggcaccgcttctctcagtttcaatctatagcgtgatatttcatacatcttggtaaaaaaaaattgatatgccggattgaagatctgtttgcaaaaatggaacctacatgtcgagagcatttcatttttatatgattttaatttttgggtttgtacatttgcatttgagtccctgtaatttttatatttacatttgagtccctataatcttgcaataaggtgcttttggtcctttttttttgaaaaaaacaataaataaaagggatagaacaaaggcagaaaggtgcataaaaaggaaaagaaaagccacacaaaaaagaaaataaacaaaaaaacaacaacaacaaaagtctatttcccctaagtggtaaaaaaactatagatgcaaacggaaaaaaaatctaatttgtataaaaggcaaaaaaaagtggcgaaaaaaacgctatatccgattcctttaaaaacggaaaaaagtctgatccctgtaaaagcgaaaaaaatctgaaaaaaatctaaaaaagtttgtccgattccctaagaaagtggcaaaaaatagttcgtaaaaaataaaaagctggttcgtataaaataaaaaatgcacgcgagaaaaacaatgaaaagggcgaaacaaagtccaatttctaatcactataaatcgctctgaaaaaactgttagaaaaaagctaaattgatggacgcttgagtcggataggatccatcgattttttaccatctactacacggtttttatttcgtcatatattctcatgtattggaaaaaagcaaaaaataatattcagaaaaaacaggcaaaaaaaccacgcgataaagtaattgttagaaaaaataggcaaaaaacacgcgagaaaagcaaaacaaaaaaggggagaaaaatatggttttcgtcatcagtaaaaaaaaggaaaaaacatgctaggaaaaaattgttagaaataaatgcgctatttctgaaaaatagtttgagaaaatcgagcaagaaaaaacaccgtttataaaaaaaacaagccgctcattaaaatacaaacattgtcattgacatgattatggatgaaaaacttatattatcattagaattttttcacccgttgtaacgcacggacattttgctagttatttaaaagttacaaaaatattattttttgtcgtaacttgttgtttatcataaaagaaactatagttttaacttatattttcatatatttatactaattttttaatagtacgaatgattacacgttatatatataaaaaaaaatcatccgctcggatattttgggacggagtagcacacatctacgcttacatgtgtatacgtatgcttacgactcgaaaaatgagtgaagaatgcaaggagcaaacgcatgcatgggggcgcggtggcgtctctggtggacctggtggggtctgccgtgttcttcgccggcggctcgccgaagacgggggtcaccgtcgagatcaccgtctcctacctcgacgcagcccgtgcaaacgtaagtacagtacccgtgatcgagcttcggctgcttcgcgatggatattgatcgatcatgcatgcgtggtcgcaggaggagatcgagatggaggcgagggttctgggcatcggcgagacgaccgggtgcgtcaccgtggaggtgaggaggaagggcgccggcgaggtgctggcgcacggccggatcaccaagtatctcgctgtctcgagtaaactgtgacgatatataataccatcctgctagctaagcttgcagcaggcaggcatgtgcgtagtgcatacatacatttgtacaattaaatagctgatgatttttccatgaaatttgatgttttactagtagtagatttaaaagttggcaatatatatccgtcccactctgctgaagggagtagacgggcgaacaggggaggctgcgagaaccgagaggtgcacgagcacgagtcgggatttttcggccgcggttgggcctaaaccacggtagcctggctggatgacggcccatcaaccttctggcccaagagagttcgggcccatgttacgatgccacgacggaactgtggatgaataagtctattctgtcttcctcatgtcttgccaccggttgaatcgtgcccctaaatcgcaaaggaaaaagtacaccgaaggtccctcaacttgtcatcgagttacaaaatcgtcccccaactgcaaaaccagatatataacatccttcaacttacaaaaccgtttactttaggtctcttggtggttttgacccgattttgtctgacgtgacggctgaatcagcatggatccatgtgagccccacatggcaggattccacatcatcatcctatctctttcctctcctctcccttcctccactctctctctctctcacttttctcctcttgggcaggccggccggtgggtggggaggaggtcgccgacagcgggatgcagtggctgcggcgcgtacctagccgtgccgccgggggcgcggtcggtgcgatgcgcgctctgccacgccgtgacgcgcgtccctcggccgcgccaaccacagcgagcttagcgcccggagccacgagaagtagtcgctaatgacgagaagcgcccgcgctgcctgcctcgtggtcaggatccggtgcatctgctggagcgtctgctacctcagcagatcagcctacacaaaaaaaaatcatcgcatcacgccatggtaataagcaatttagttcgccattgatgtttgaccgaagcttgaggaagttctccagcgtggtgagcatggccatggcgatggctatctgtcccatgtagttggtgacgttgtcggcgcctatgccgccgacgaccacggtggcggccgccgatgccaatgtgtctcccagcgtctgctgcagagcctccatcccctgcgacagcgcgtcctcgacctgctgcgaggactgctgtaggttgcagatgcccataaacaactgatccgtcagtggctcaagatggctctcaagaacctgcacaaacaacatcatcatcatcatcattcaacaatagcagtcaatggtagcttcagattctttgcttgttactgaattgagtgggtgatcactcgtgtcaaaccttgaggagctcagaggaacagaagccgccgagccacatgaagaagcgctcagcgtggctcatccacaagccggagaggacatggaacacgtcggactaggtggcgaagctcttgaggcggaacacctggtcgtagtgcatcatcacggcgtcgacaagcacgcggagctcgtcctcgctcatcagtgcgttcacgctgccgtcgccgttgacgatgtcatcggggtacacgcgggcggcggcgagctacccgcgcgtctgcggcgagaagcgcggtctcctcatcggcatcagctacgccatcacaaggcaccagcggcagcctcaccatctccagcagcggctgcggcgacatccagatcaataagaccatcgtcactgccgctctagctcccggcggcggttgctccgaccacacatggtccttggccggccgcgccgccgccacgttcgagcccgccccctctgcagcttggtgtgttgccgacgccctcctcctctcccgcgctcgccccgccggctgccctacccaaggaagagagagagaggaggaagggggagaagaggggaaagagaactggaggccaggggagaccggaggcgcatgcgcgaccggtggcatgcagcggagaagagcggcggcttgctcgctccgtcggaccacctcacccgcctcgcccggcgacctcctccccacccaccactaccagccagcctgcccaagaggagaaaagtgagagagacagagagagagagggggggaggaggaggaagggagaggaggggaaagagggagggtgataacgtggcatcctgacatgtggggtctacgtgggtcccacgctgatttggccaccacgtcagacaaaaccacggtgaaaaccactgagggacctaatgcaaacatttttgtaggttgagggatgtcatatatctggtttgtgattgggggacgttttgtaactcgacgacaaattgagggacgttcggtgtactttttccaatcgcaaaaccgggtgtaaccctgggggatcctaatgggcgatcgatcgcccggagacgggggtagcgatcgatcccctctcccctccctccctccacccctccacctggtttgcttttttggcaccgtattacttttctattttagtaaatttatacatctaaagtttatacacctcaagtttacacatctaaagtttagagaccaaaagtttataagtcaaaagtttatatatccaattcaaatttgaatttgaattcaaatacttttttatatatagtatttctatacatctaaagtttatacacctaaagtttatagacctaaagtttataagtcaaaagtttacatacccgtttcaaatttgaatttgaattatatccgattcaaatttgaatttgaattcaaatattttctatatatagtatttctatacatctaaagtttatacacctaaagtttatagaaccaaagtttataagtcaaaagtttacatacccgattcaaattcaaatttgaattcaaatattttctatatatatagtatttctatacatctaaaagtttatacacctaaagtttatagacccaaagtttataagtcaaaagtttacatacccgattcaaatttgaatttgaattcaaattttttatatatagtatttctatacatatttttttctaactttttggtttttttaaaaattttgtgtggtgtactgtaataggaagagaaaaaggggaggaggaaggagggagaggagggaggagtgcatcgtataggggagggggcgggcgggtgatcgctgggcggacgggggagcaatcacccgtccattagcattctcggtaacccctcccacatctttaaaaactcgtgcaaatcaaattcctactatggtttccaaagagtttccgtcctgtatggcgttcatgggacttcatgtaagcgagataaaaagttaaaaaaaaataacagctccatgtgttagtcatcctaattaacctccttttctttttcctcttcctctctctctttctttcccattctctctctcgcgcgcaccagtcgagtgccccactcacggccgcaatactaagatgtggggccgttttttaatcttttttctcaccgacatgtgagtcttatgagtctcacataggacaaaaccgtcttcgcaaccgctaaaaaagttgatttgcatcgattttcaaatatgcgagaagcgttatacctggttttacgattgaggaagatgattcaaccagggccaagacatgagggagataatggaacataagatagctcatgaatattacaataatgacatatgctagtaaaaccatatgagcctaatttttactccctccgtcccattttaagcacaacccatgagttttcgtgtccaactttaatcgtccgtcttatttattttttttaacaaaataaaatatataagtcacacataaagtattattcatgttttatcatataataataataataataataataataataataataataataataataataataataataataatataataataataataataatactaatactaatcataaaataaataaataagatgaacaatcaaatttggaaaaagaaactcatgattgcgcttaaaatgagacggatggaatagcatttaaagtagtacactccttctgtcccacaatatagccagttttagccctcggccgagtatcaaggagagagataaaaatactttatttgtctccttagggatgggtgaattgtcgactagttgggatcttgggatgatataaaaggccagtgatactctagtatgggtagtttagtgataaaaatttacccttacaagtattctgtcacccccaatccggcaccgccgtacaacggtacctaacaggggcgtgttgtcggaaaaacggtgagaaccgcttcctacgagaccgcgatctcagtaccaatcccaggacatagcgctggtacccacggtgacaaatataaatcattgcaatccttgaaataaataaatgacttatttaccttaactagggttgcagctcaggatagcccgagattacaaccgacgacacggacgaggcaacaccaacaacggcagcagcagcggaaacaacggactaacacccaacaccacaggcgacggctggaaaccaggacgaaaccctaatcttcgcttcacttaatcttctcttcaagatggaggaactatatatatatttttttatagagcaagggtgagtactttcgtactcagcaagtcacgggaatttaggtgtttaatgcaagcttggaagagaggcaaggttgttttgcaaatctattgttttgaaatcattttgaaatcactaagtggtctacttctttctaagtttgtgccgaaaagagacttgtgtctcgattcgacttttaagagatgtttttcaatagctcatttggtaatgtaccgacctcctgggtcagatcattacttctcggctcccagagccatttcacttgattaagcggctcccagagccttttcattttctcggactcccagagtccaactgcccagcagcacaacaatccgcttccactcgggaagcctagtctatgatgcccgtagacatcccgaatcacacagattcgtttcttgaccactcaggtcatccatctgccacataggctgattctggtaacgattcccacaccacaacaactttttacaaagcacaggcaaacacatctacgctataggaaacaccttacatccgcccatgaccgtgggcacggctgttcgaacagttagttaacctctgcagagggggtacactttacccacacgacattactaacccggatcatccaacccgtggagaacagctacgtctggtgaccttaaggctttcatgacaaggcatttcgaaagccgacacagggtcgccatatgccaacgagaggggtcccagaccgacaacaggttaggtcctagaccatactgtgccaggaagcctgaggattccacccgacaccaccccattgaatccacatgtctcttggcatcaaggcttccctggtttgctatttactcagccaggggcgtcccattgcacccgtgtggtcgcacttgttatatgctcggatgaatttcccacaggaatcgatccttatatgcgaatacgggacagtgccacacaggcacaacccccgcatcgtgagtttacacaatttattttattttcaaacacaccgacaccacatgtcgggttttcaaggcttttcaaacccatttcccaagttttcgacaaacaacgatgtatgtgggatatttggtatacgtgcttagatagcacgaataccgaggtaccacaaaggtggagtgacaaggagtcagggtagtacaacctacaggaattagtgcgactactagtaggtccctcggtttggcatgcaaaccgaggccaagcaagttaaacgggtgattctaataatgcaagttgcaaacaaaataataatgatttttcaattataggagcaattggtcaaagggtgacttgccttgctcaaggtcttcacgaatcttcacgtatcttcgagaaatcccacgattgacgaaaatccggtaaccgcaactatacgcaaacaatcgaaaacctaaacaaaagaccaaaagaaagatctatttagactaattaatagtgccattgaatagatctcaattttatggatttactggaagttgaacgaaatcaatcggatgagcggttgggaagatatggattttctaaggattatttgattttctgtctaaaggaaaaggaattattaattcccttggaaaagaaaaggaaggagggatcggatttagacttcctcgggcggcttaggcgcggcccgagggattcacaaggcttggccggccattgggccgagcgcggccatggggaggcggcccattagggcgcgcggggagagagggagggcggttcgggtggacgcggtccaccacgcgggtccctggtggggctcgcatgtcggcgacacggttcacgaagaggtgggcgcacgcaagggcggcgctggggttcgggagggggagcggtgcacggcgcggtgctcggaggactaggaggcgacgggcccacgcgcagcctcacggctcgcggtggaccgcgcgcgcgagcgggggacggagggagcagctgaccgggacaagcccatgtggcgccgaggtggcggccacgctggcgagcgagaggaggaagacggcctgcggcggggattaacggcggacggcggcgcgcgtcgacggagcggcgcgaggcgcgaagggagaaagggagaccaccggaggggaggaaaggaggcatggattccattcctcggctcagatgcggccggggctggacggaggcgacggattgcggcggcgcacgccggcggggagaagaaggggaaatcgcgccgggagggaatggggtcaattcgcggcgtcgggagcatctccgggaccaagggaactcgccatggtggtcggatggagcagagcagcgccgtggaggtccggcgacgagaggcggcctccgggagcggctgtcgacggcggcgagctcacagcgagcagcggcgacgcttgggcggtgactaggcacgttcgggaaggtctaggctagcaatcgcgcaagttaggagggagaggaagagcggggagggagaacggggctaccgcgtcgggaggtcgccgggaagagcgtccgacggcacagaagggattgcctcggcctcgggccggggaaggggagggagagagggcgaccggagtcctcttcggctccgcgcgcaagccagcttcccggcacacgcgacggcggaggaaggcgaggatggcggcagcaaggcggcgatggtggtttggcagcaacaatggcgctgcagcggtggagagtgaagcgggagggattgagaggaggggctcggctgtgggctttataggcgcggatggggctttgaagggaaggaaccgacattggggcggtcaaggggacgaggcagtcgcgggctcgcggttcctcggtgctaggcgccattggcggagcagggtgccggtctgggaagagaaaaaggaaaaggggagggaggaaagaggctcggtcccttgccattttggtgtgtgagagagagaggagggtggcactgcctctctgctttggaagttagcggtggagccatggatgacggcaaaaggcgagcgcccgggcggtcggccacgacgcgggagcgcgcgcgtggacgcaagggcgcggcgggaattcgaaaggcagcggcgggatttcaaaggcggtggcgaaaatcgattcgcggcgacggcgcatagcgtggcgagaggagagagagaaaggaaacagagagagcgtaggcatcgagacagagagagagaggaagagagacgacgctctcgctctgggcacgtgcgacgcacgcgagaaggggagcggcagaggggagatgggccaaggggaaggaaactggtccatccaaaacagagggaggcaaaatagacttcttcttagaatttgaattggagagaattggagcttggatttgaatctaaatttgaaacttgtacacaagggttcaaggagacgaggaaggaaacaaagcgggtgtttgatactttcgggaatgggaacaattatttggagaggattcaaaggaagggattgactttcggaatttgatttcggagactcgaatcggaattggaatcttgaggtggacgattttgatggcgacgagaaggacaaggagattaaattgagatccacggcacgacttagactcgcacacaaagaacgaaaaatttcgcatataagattttgccgaattagtttttttaacgcctcacgaaaagcggagcattacatattcgatagttatatttgaaacagcatctgaactctagaaattattatatttttgaggcagatacaatatatatctctttaagatgaccacttaacataaccagttataaatgcttcatttcttctgccactttaggcttgtttggtagagattcaacttctaaatttaactttaagagatgtatctagagtgaagttgtggagcagtctgaaaccacgctccatgtctttattttgtgagagtactccaacccactctaattccttttttggtggaacattggagctgaaaccgttgtttgtgctctagctgcaaaagaggtagagctagagttccgctaaaaggctctttatctgacttgttcagctatctgaaaagcatgtttgatttggcttaataatacgctttattttttttcgagagaatgcttcatttgttacgctaatatcacgtgaagataaaagtgccttcagcacttcagcttgcttgcgatccgtcttacaaatgtgagtaaactttcagtaaaaaattagtgaatttaccactggtctttaaatacgtgagcataatgttcgcatgatgttcatgagcatatttcctgtaattggtaaaaaagaagtcatccaaagcacacactggactactcgagtgtactagtaacacccgaaaatagcaggtaaagcacatccacaaaatccatctcactctgtccaaattttcacttccagcacacacgccgcacacgcgtacacccaagttgcctcgatgctaagcaagacgagtccggtgagccggtgaggtgaggcagccaaagtagtagtagcggccaagtccacaccgagacatcacacaaacatccccgtcgcgtggactcgcgaaccccaattcccctctcccctcccacccaacctcgccgtcgccgtcgccgtcgccgccgtctccgccgctcgatttctccccgccccccacgcagtccagagcggatcgaatgcgtggccctcgccgcccgtagcctaccccggcccggaacggcgagcgcagccagtccctcctcgccgcatccggatctccgcatgcgccacgtccgcggcgggatctagcggcgtcgcaccccccggaggttgtagaagggtttccgggatttgggggcgccggggggtatggcgactgaggcgtccacttcggcggccgccggtgccgggggcgggagctgggtggaggggatgtcggccgacaacatcaaggggctggtgctagcgctctcctccagcttcttcatcggcgccagcttcatcgtcaagaagaaggggctcaagaaggccggcgcctccggcgtccgcgcaggtgacctaatctcgtcctaacatcaccattttactcggtgccggacctgtgtgtagtttatgctcctttttttggttttctgatccgaaccacaatgtttggtcttcttttatacttctatacatgcgatctctccggggaagtactgcggatctgtattagggttaggagagtggtgagcctatgggtacaccatgatgaggcattttaggcatagcgagagtggattggatactaaattgattggcaacggcatggaattagatggtgaggagttggcatatgttggcgcaataatgatgcattactatttcttactcttgagtttatgcttcatgttctataattgaattgtagtttataataattgtccgaacatttgagcgtgtaaaatttttagatgacctagtccagctaagagtgggaatggcctaaattttcctgataagattgggaagaaaccataactctattgtttgaactttttaaggggttattgttggcttggctgcaagatgcataccttgttagtttggatgtacaatatagttataaacatatttgccttgttagtttgggtgtacaatatagttataacatatgtgccttgttagtttggatgggcaatagttctttttcgctgactatgtttacattggttgggttgcaggcgttggaggttactcctacttgtatgaaccattgtggtgggctggaatgattacaagtaagtcaaaatttctaaatataagtaattattcatgctaatacttatcagtgtgatattgacagtattcagtgctgttttccagtgattgttggagaagtagctaactttgcagcatatgcctttgctcctgctatcttagtaaccccacttggtgcgctaagcatcatcatcaggtaacagctagcacctacacttccctaatcttgagatctcctgctgtttatattttcatcagtctgttcattcttcatcttagcatatttcttctacagtgctgttcttgcagatattatgttgaaggagaagcttcacatatttggtatacttggttgtgtcctctgtgttgtgggttcaacaaccattgtgcttcatgcgccgcaggagcgtgaaattgattctgtagctgaagtgtgggctcttgctactgaaccaggtactgtgttgctgacaattgaatctcaaaaacattactggccacatttttatctcgtactaaggttttagcttttgccttgcagcctttctattttatgcagtcactgtgcttgctgcgacttttgtgctcatattccgctttatcccccaatatggtcagacacacattatggtgtatattggtgtttgttctcttgtagggtctctctcggtatgtgttccatgtgttaataactcttttcaattgatattcataaaatactgttgagtagttaagctgttctagtatcctctattcataaaattgtgtatattgctgcttttggcaggtcatgagtgtgaaagcacttggaatagccttgaaactgactttttcaggaatgaaccagctaatctatccacagacatggatgttcaccattgttgttgttgcatgtatactaactcagatgaactatctaaacaaggtaaccatgatttctggcctaaaagtgaactatcattatatcataatatgttttcatgtcatccaaggtccaaggaacatgaacgaaattggaacatgaacgaaattgtactggaatataacatgccataatggacactagctagctattaaaattagtatcacaacacctgattctgcctgtttagaactcaggcttgatatacatgcatgactgtacaatgtccatcactttacagttcaatatagcttgttaaatgccctaagcttactctgtttccttttacaggctcttgacacattcaatactgcagttgtttcgcctatatattatacaatgtttacatcactaaccattttggctagtgtgataatgttcaaggtaacatcttttggcttctatgaccttctgcattgatgtatgccaggcatttctttagcttaacttttaaaactgcaagtttggcataaatgaagcaaagcttgttttgactagaattttacattgaggtgcttatatatagctttcagatgctaatgtaatgtgttggttactcggagtattgtcagattatatttttcagcacaaaagtatatccttctctgcattttgtcaacagcaatatgcttttttttatttccatatttgtacataggaattatgataaataagggagataactgagtctcatcagaacaaatcagaaactaggaattgagctttaacaccttcatgtttctcatttattttcccttctttctccaatagtttgagcgtgtgacgtacaattgattcttgaaccgctctttacagtatcacctattgtcctgaacctcatcgccgttctatttgttcaacttttttgtgagatttctatcattagcattgtcgggacaaataccatgctgtaagattttgctgaagcatacactgctgaaatttattaccattctggccatctgcttctgtggccaccccataatacaagggcacatgtttctgtagaaactaagtggcatttcttgctagatgagtacagaaataccgatcctattcactctataccacattttcctagttaatatggagtatgtacttgtgtgcttagtactctgctaaggctgtaaaaaaaactcgagggcacttaacagtctttgcttaaggcttgtgagctactcgagctcagcttgttctgggcttggctcaagcctaaaacgaactgagatcaagcctaaggctcgtgctccgcattgagccaagctctaatgcatgcataaggattatgctcttctcatagcctgtcaatctctcatgctttacctgctctacattgaagttttcaattcctcaatgtcaagcccaaggctagtgcagtaatgctagctatctgcaatgcatcctagttgcatgccagtatgccaccatcatcttattcataccggtggcagccgcctgtctactctccttgctccttctctctatttctccttctgtgagctgctagtgtgaccagggcagcagggtactcccct

SEQ ID NO: 33505 - DNA, 746 bp, Oryza sativa
  unsure (1)..(746): unsure at all n locations
nnnnnnnnnnnnnnnnnnnnnnnnnnnnnnnnttctctggctggctacgaaagtacgaagggaggaataaaggtagagagataaaaatacagtactactggtactgtactgcgttttttttttctttcgaagttcaaaaagataatattttctttcaggagaaaaatatgatagtcttatccttagttgcgagaaaatgtgttcttctctacctcgattaatttatgaatcgatggtaatcacattcacatatcgttctcaccatcgaaaaaaaaacagcatacaacatactaggatgaaaacaaagctgatacaaacagatgatactcctaatgtatttgttttcgttttttttggtcggacaaaaaaataaatttgaatagctcgaatacaaaaaataaatattaattacctcaaatacaaataagaaccgaatatgctaaggcacaaatacataaacaaatatttttcagagcacgaaaaccgtcttaacttttaatagaaataagtatcatcacatataattagcttggtttatattaaggctgtatttgggaggatgggttcctccttcccagcacacaaaatgatgttcgcattaacgcgtgattaattaagtattaactgttttttttcaaaaatggattaatatgatttttttaagtaactttcgtatagaaacttttacaaaagacgcaccgtttagtagtttgaaaagcgtgcgtgcggaaaacgagggtagggaa

SEQ ID NO: 33506 - DNA, 1196 bp, Oryza sativa
aaaattggcacagctgagcgaaacacgatgaaagtgtccacattggcatggagtagaagttcactgttttgtgaagatggagatgtagaacatcaccgcagcaggcaagaacttccacatggtcctcaaattaaggccatcatgctcaataagctttagttgtccacataagagaactccaacaacactagtgaagtactgtaaagctgtcaatgctccagggtatggaaatttcatgactgcccatttgttgataatggagagcagggatgctgacaggcaataaccagcagccacaccatagactgaagcttgttgcagaagaatgttcaacgtgttactccatgctccagttttctggacagcacttgaatcatcagctgatgcagcttcttttgagggctctgatagattagacatctggcaatgtaaagaaaaaaattcaataaaaagttacctcacaaaaaccatactgaagctgccaaaaaacaaatggaacaaaccaaaatacttagaaactttaatcgatcttggtgtttgtaacatggtgaaatatttggcattgctggaacctatttgatctttagcccttatcttgctcttagagttaatagcaatgtgacaatataccatggtactggacaaagcagaggaacacttaaaaaatgtttactaacaataattatctaatttcttgatagaccccatgcacctgattccacccatggattttcacatcccaatcaaagcttcatactacaccatactcatcattttagctccactcacacagttatatagacttggcttattaaaaagatctctactttggactagaaatagtacaaaaattgttagcagaaagctaaaatgtacatcaacataatagtgctctgaacaccagctaaatatagctgtagacatatccaatactgagtgatcaatatgcttttttttatttccatatttgtacataggaattatgataaataagggagataattgagtctcatcagaacaaatcagaaactaggaattgagctttaacaccttcatgtttctcatttattttcccttctttctccaatagtttgagcgtgtgacgaacaattgattcttgaaccgctctttacagtatcacctattgtcttgaacctcatcgccgttctatttgttcaacttttttgtagatttct

SEQ ID NO: 33507 - DNA, 685 bp, Oryza sativa
gtgctttggtccacttgtcttaacctacaagcaaagaataaatagctcatgtttcatcttgaacaaaaattccaaacagaataaccattcataaatacgcatgtaaaagtaccttgcatccaatgtacttagggcttgtagatgcaaaaaaacaccacttgcaaccctcttctgctcttttgcaaatggctctaaaccttttcttgtcattcttgacagtttcaaaagcatgatcattcaagatagcatgatgggtaactgctaacttgcattgatccacatctgggaacactacaccaacatcaatacaaggatcctgaacatcatatgcaaagacaggtacatcatcatccttatcaacaatttcttgatcaggatcaaactcagggtcagaacaatcagagtcggaagattcggccaaatcagaatcatagctgctatcactatgtgccacaagtgattcattgtcagagtatatgccctcatcatcaatgcctactgcatcctcatcatttgaccccttttttatggaattcttggctctcttttttttggctccctcattagtggctctctcattccttgcactcttttttttggctccctcatttgtggcaatctcacttatgcatgctctagaccttactgaaggatgaaacctacactttgtgggtgaaaattgcaa

SEQ ID NO: 33508 - DNA, 1169 bp, Oryza sativa
agctcctcgtcgtgatgttgcaggggatcggcgattgcttaaagtaggcgatcaatagagctaccagcctgatggcatgcctgatgccactagcacctctgcaacagcatgttaccaacgcccagatttggcctcctctacaaaatcgccactctacccgggcgcacgtcttcatcgtgttctgacacctagcctcgtagatctgggccctgccacccctccaatctctggtcaggggatgtttccaccacaccgcaaggccacgattgctgacaagactccaacgcaccatccaacacagccactgcctcacctccaccaccacaccgcctcaacttcatttgatgaccgtcgtcgatacctcctctccgccagtttccttgcttgtgcgtcagacctgtcgtccatgtcccatcctccacctttgtcgcaccctctagccgaagattgtggagacaagcacccatcgccagcatcctctccaacctttgctccttacgactagggcgttgccgacctctcgccatgctctacctgggagagaaaggagagagagagaagaggagtggaaagaaagaagggatgacacatgggtcccactacaaatttattagttttttctgctaagagactcgccgactaagcgaataaaccgtggtcaacctgtcatatcagcaaaaaaaaagcttctcaatccactgaatgagttaatttacatatttttgaaagatgggggaggtgttatacttatacctggtttggtgattgagggaggtgattcaatcatgagcaagagatgtaggaggcaaaatagacttaatacaatggttaatcccggtcctggtcgagcctatgaaaaacgattttacctttcattcatttctgtaatgaaaataaattagtttattattttaacgtcatgtatgaatataacatatttagtgataattacgcctttgagcttgtatttagctataggcctgaaacaaaggtgccgtacatgtaaaccacaatggagcgacttattagatatgagtagagaatgttgcaattacactggaggggaagcagcattggagaacagcaccagagcgtggacatggtgagtcgagctgatggggaagatgattaggcacttgagcaattgggctggtagaactgtagaagta

SEQ ID NO: 33509 - DNA, 1207 bp, Oryza sativa
ccacaaatttgccgatgaaatgatgtattgggtgtactccctccgtcccaaaatataaacatttttagcatagtgacaaatcaaacatttttaactttgactattaataaaaaaataaaaatgatcaattatgtaaaattgatgttgctagatttattattaaaatactatcataatatgcaacttttttatttaaaacatgttacttttatagatattgttagtcaaaatagtatctcggagacctgatcagagtttaaaaatacttatattttgagacgagggagtaacttcttccaacaagaaaactgaaattaattatggtcgactccgactcgttaaccacatgttttgcacaatgtcacaagccattttggtggaccggatcgacctgactgaatccctaacacccaagcgccaagccaggcagctgagtcaaacatacgcggtcctcactataaccacgtcatcttgttataaaaccatatcaatttgcagagtatttaaattttcaggacccttctctgtgaccaagccacgcagcctcagtttattatgacaaactcccaaggactcgttcccgcccgtaatgtcaacttggattaatatatagtaactgggtgttacgtacgttacgttgcacctatcgcttctctgcaacttgacacaatacaacacctcaccagacacttgttctttacctacgccctcgcgccttccgggaaccgctactagttataaactgacgatttattatacgtgtccacacgtgatggaagcagctctcgtggagcgtataaaaggagggctggtgatcgatcagctcaagtgctcaaaccctctcaagtttcatcatcacccaacacaatcgcaaggggatcctcaacagggccaacccgacgaacgtgagatggcggcagccgtagaggaagccttcccgatcgggttcacgaaggggataccgtcctactggcgaagccgcaagtaccatagcgtggacagcagcgcggcgggccgcggcacgagcaacctggtgcggctcgggggcggaagcggcaacggcagcgacggcggggcgtgggccgtgcggctgggaggcatgttccgcacgcgcgtcaaggcggcggcgcccgcggcgacgacgaccgccgtggcgaaggtacccgcgcgcgtgctggggcgggtacgggacgcgtacgtggacgcc

SEQ ID NO: 33510 - DNA, 5302 bp, Oryza sativa
  unsure (1)..(5302): unsure at all n locations
gccagccgagtcccgccgccgctttctcccgccaccgaagcagcagcaacaagcgcctccacctccctcctcttcatcctcagccgtagccagcaccgccacctcccttctctccctccccagcagccgccactgacgccctcctctctctccctccgcacggcaagatacggtgttcgtggtcaacgccggcggtcaggtggtcgtcggcaaccggggcaggcggccagcagaacgcacgggcatggcgggcggcggcggccgtggcaggcggcagcgtcctttctttctttttttttgataatttgttattcatctgagatgtataatttctttttttagaatttgcgatcaattgtatggatctgagatgtatttgatttgtgtgtaatttttttaggttttgtgatgtatttgatttgtgtgtataagtaacttaggatttgtgatgtgaataatttgggatgttactttgatttggggatttggggtttgatttgaggatatgcatggtacttgattggggagaaaatacagagctctgtcaattagcaaagaaacaatgaaaaaaaaagaaaaggggaccancggggcccgcccctaccctctctttagtcccggttggtaacactgaagattcaactttactctcggttattccactctagactaaagataggcatctttagtcccggattcgtagttccggtaaacaaagggttcccaaccgagagtaaaaacagttaccccggtagtgtttttacaaatattaattcatactaaacaatctataacgataactaatatgggggactgaggctgtaacatgtaacgtctgtacgcaacggaggcggcttgcttacttcacgttggtgcttgtacactacaaatgtgccacctctctgttggttgcagctagccttcgcggtggggccaacgttggctttttcatcagcgctgaactactggtccaggtcaaacagaggtgccattgtcgatgatacaggcatggcattttcttctagtaataatagtagtactacattaagattaaaatggtactctctccgttttagaatatttgacaccgttgattttttagcacatgtttgaccgttcgtcttattcaaaaaatttgtaaaatatgtaaaactatatgtgtacatgaaagtacatttaacaatgaatcaaatgatatgaaaagaataaataattacttaaatttttttaataagacgaatggtcaaacacgtactaaaaagtcaacggtgtcaaacattttaaaacgcagcgagtacccagctctttttcttactttcagtaccagcatgcctgtgaagaaaacagctgaacatcactagttttaggaactgtatgaccatcgctgctttacattagtgtgacgcaatcttgtgaagtcatcgatgctagctgctagtatagctggcttgggcgttcaattgtcgtgtaagctaatagcatgttctttccttcaattctagacttcaacgttagcatattttttaaaggttaattagtgcatcttttgtaaaaaaaaataatatataaacttttataaaaaatcaaataaatatatttttttaatttacaatagttaatatataattatttatgtgctaataagctttcttattttaagtatgctgaaaatgtctcccaaacctagcggaacaaacgtaaccaataccacgagcttaaaattgtttttttaataatgcatagtgcctttttgggtggcctcaattttgcatgctagctcttaataatttttgtttagttcctatatttttttttcaattcacgtggaaatcctaaatttacaccctaatatctcataagaactataaatttccttccccgccctattccccacacactctccttgtcttcggctctcccccgcatttgcgacaacgtcagcctctcctgatagtctcccctctcctttgcctatattggtgacgagcttcgctacatctatatttttacaataatttgattaaacgatatgctgttttataaaatagtaaagtccatcaccggtccctaaacttataccgttgtgtcatcccggtccataaactcgcaaatcgaccgttcaggtcctcaaacttgttcgactatgtcatcccggtccctaaacttacagaccactcgtttaggtcttctatcttgcccagttgtgtcactccggtccctaaacaggaaggcctaaaaactttatatcaaaaaataattcataactttttcatgtgaactctaatgaagacaaagtttatatcaaaattgtagccctcgacgtgacctacaactttgtagttgaaaagttttggaattaaaactgtttagggtcccaaaatattgttgcatgtttatagattttgaaattttaattttaaaattacattttgggacaaaaaatgacttagaataaaaaaaattcaactgcaaagttatagatcacgtcgagggctacaagcttgatataaagtttgtcttcattagaattcacatgaaaaagttatgaattatttttaaatataaagtctttagaccgtcttatttcacccagatgatattcaaatccaagtttagggactgaggtgacacaactgaacaagttggaggacctaaatgagtgatctacaagtttagggaccgggatgacacagtcgaacaagtttgaaaacctgaacggtcgatttgcgagtttagggaccgggatgacacagcggtacaagtttagagaccggtgatagactttactctttataaaatttactccctccatcccaaggcaaatttcagccgtctcacacatataaaataaaagtaaaaaaaaagaagacgatcatcactttacactgctagagaaaaggtttttaaccctggtttgtaacccctgtagtcccggttatacaactgggactacgaatttaggactaaatatacccatctttagtcctagttgaaataaccaggattaaaaatctatttttagtctcggttggtgttaccaatcaggactaaagatggagccaagccaggatggtaggttttttttcctttttcattgtttttaacattgaatattgatttcactatatccccaaatcgtgaaatctccaaatcgatcaacacagaacaaaaggatcatctccaaatccccaaatacatcacaaattctaataaaaaaatcacaaatacatcacatattcacatcacacacagatcaaatacatgacaaattctcaaaaacaaattcatcacaaatccttaaaaatacaaatcttcctccgatccggtcgccgccacccgtccgccgcggcctccctagaccaaccgccgaccccgcccgacggctgccgctgcatctcccgcagccaaccccgccagggagggcgcgcgcagtccgccgccgccacgcgcaggcagccacctcaccagcccggccgcgccgctgtttgccctgcaccgtgccgctgccggccttgtctcatgcgaggggagggggaggacgggtgtggtggtggagggggagaaggggatcgagctagcgctggtgggagagggaggcgaggagtcgtgggtggataagatgaggagatgataagaaggagagagagcatgaggagaggataagaaggaaagagtatgaataggaagatgaggcgcttggaggataagtcctatggataccgatgtttagtagagcatgaggagaggataagaaggagaaagcaagaataggaagatgaggcgtttgggaggataagtctggtggattatatatggtataccgatttttagttccagagttcccggccccttgacagcctctaagagtaaatgatctgggactacaccaaccaggactaaagatcatctaaggccaatagagtcttaaaccggaataaaaaagccatctttagtcccggtttctattcaaaccagaactattgtggtttttggccaactcagtaagaatgatttctccaatagtgtcatcaaatcctaatgcaattattgtatttttatttttatttacttaacttttacaaacttagatgtaataataactgaaaaataaaattattttaggataaaccggatggaggagtactgcaggaaacgcaactccactgcacctttttcttaaacctcagcatcatcgagtggcccaaggcttgcattgcacgcggacctacatggaccggccggaaagtcaggcctacggcggcgtagctgtggcactgctagtagttactgctagtgcatgcactgacctagcgcctgggcgagtggccgtggtcggctcccgccgggtgactgctggtgcgtgccccgctcccgcttgcatgtattctcgcgcgatgccgctgctgctgctgcagtacgtttgcgggtgcctttacggtttttctacgtacctggctgcccatggtggcctggccgggaagtggccactccgacccatggccatggccatggctgtttgctgcatgcatcccctcctgcgcgcgctgctgcgtgctgtgctgcagcggccttccatgctgcttgttgctttcgtcggccggccggtctgctacctgcatgaagtgctatctcactgcttgaacaataatgcacgcctgtctgcagtgcctcctcctcctgcttcagctgctgctgctgggcgagcgtacaccacagccacatccacatgcaggcatgcgcttgcctccccacttgattgaatgccccggcctgcatctgcatgcatatatcttctgatgtaaccggtcactcacgtccgtccttgtcgcccctcccgtccctcgttactctagctctctcccttcgtctttctctctctctttctatttcatcctgtccataattaataaggacttctgtcgtctatgcatgactgatgctgaacatgaccggtcttgctcttttccgttggactcttggtcaacaagcatgtttgcttgccccgcccaaaaaaaaaagaagaaaaaactaaaaaaaaactgttctttcttttttttgttcagaaaaggaagtggaagaaatgaaccatactggatggctcttttaggaaattttaacaaatgttggccaaaggaggtacatgctttgcttttttataatttatagaagatactattgatgattttggcgagatactgtacagaggacaaatcgtccgtactgtacactgtagtacagcttgttgtaaagaacagaatcagatgtacatttgcacaacggaatcaatacaaatccgatctat

SEQ ID NO: 33511 - DNA, 4492 bp, Oryza sativa
tgcctgcaggtcgactctagaggatcccctactcctacatgagaaatcattgcctcctcacgcaacaaaacatacggactaggagtatacacgttaatcattgcaggaggcccaagcccatgcatagcatagagtacaccatttgcgggtccctgtaaattgcagctgtacgtgtgcaagaactcgtcgattctgtggaccaaatccacatccggagaaccatcaattatattactccatccgttgtttaaatacataatactattgatttttaaatacatatttgatcatttgtcttatttaaaaattttatataaatatataagatcagtggagccaaaaaaattttatgagccaggacaagtctattgatggatggattctctaaatttcaacaagagctagtttgctacaaataagcaaggggatccaaatccaatgcaaatcacttcattcagattatttcttacgttctgcttgtctgagtactctactcctgctagcatatcattttgcttctgcctgcataattaagtagccaagcacccaatgaagctaagctactgctgcactctgcctactgccgcgtgcgtcctgctaagcgcttgctaattaagctcattacacaaccatgtcccctgccacaagtggatgagcccgggcagttgcctagggtagccgggctgtaaatccgccccttataaaatataaatcatgcttaaagtaatatgagtgataaaaaaactcacaacaaaataaattataattacgtaaattttgttaatagtacgaatggtcaaatatatgattaaaaagtcaacgatatcatctattttaaaatagaggtaatatctttttgaaaaataaccatcaattagattgatctaaaccaacaattacagagatactccataggtttactgcagtccactatttctggccttcagccaaacgaaccttgtttcccttttaatcgtctaccgtctagctcattgcaaagccattttctctcagcaaacaaaattaaactgagaaataatgcatggtgataaaccatgctgggtatatagcagaaaaattaccgtacgtgagtaccttcgattattgatttgtaggaagaaatatgtacttctacacagttggcctcaaccctggccagcgaacactgaagtggatgaatgggtgatggcctctcgaggcttggagtgtaaaagaaactcgacacttcacgcgtgcgtgtgttctactgttctgcagagacctcaaagccgctttggtttgttttttcgtttcgtaatacatgtcccgtgccgtcttgctagtgggcatgcagctagtgcagatttcccgtttggtcaaaaaggatatgcgtgcatgtacacacgagcttacatgtaatccatgcaaaccttgatggtcgaggatcggccatgcatctacatggctcgttatgattcctgaccgtaccgcatcgatcgagtgcatgtgctcttaacactatgatgatcatgatcctttctttgcccgcattgcaagcatgcatgtgtgcttcgtggctcgtgcttgtaactacgcgttgcacgtgaacagtgccatcatctcgatccaccataggattttggtgaaattcaattcaggagccgaaactgttatgtttgtttattttctaattaggtacctctactttggtggtgtgcgttcgtttttactaaaggtgataaagttaggaaaaaaactcattagcacatgattaattaagttttaattattacaaattgaaatatggatttatttaatattttttaagcaacttatgtatagaaagttttcgcacaaaatataccattcactaatacagaaaagatttttctgtacaagagcccctgtagcttgcaagtggaccgtaagtctgtaactagtcacgcctacaaaaattggccagcattttcgtatacggctccttaaaaaacccgcatgtaccttaatcagaaaaatatgtatcttaatcactactacaaatatgtatcttaatcagaaaaaagggaccctccttgtttcggatagtattaccacggtgatatctattgctagtatttaactatcaatattattactagtatggtcattaatttataagttctacttccagtagatacatatatgcatatttgatttattgtattatcaggtatacattatgaacaatatgatccatgcattggagaaaaatatggaaggcctaaattcattttgggaattgctaaaagattgttgcaagatttttgaataaaaaacttttagatgtatctatagtatgttatagtgtaactagagcgtaattatattgtaactagtataattatagtgcaaatcgtaccataaacattgtaacttctatacaagttatatataaggtttcacataattttttaattcttatatacacgttgtataaaagttataacgtacttatagtataattacagtgtaattatatttgtcatggttattgtcacgcccagaaattcacgaaccagaatttctaagctgaatgtgtattaaacccctgtccaggaccagccagggtacacaaacgacaattgttgacatacagatccacgtcttacaaaaatataaaagattacaaatgcagcggaaaaggtaaagcgagctaagcctgaagacttgactcctgcagcgggcgattccattccacaggcaacccttgacggcagcgacgaaaccaacctcttcaagacatctccaactgagaagaacttcaactctggtgagggggaaaagagagcaagactgagtactacccactgtactcagcaagtcataccggaaaagggggggtatgatgcagggtatatccaagggaggctaaaggttcttttgcataaagccggcatttcaaagcagtagttgaaagcagtaaaacagtagtagtaattaatccatattaaccaatcactgtccaacgttacaccacgttgcaacaggcccaaaccaccacctgaactaaccagttccaaaagctaactagggtgaaactaatcacggtgaatctggtcgaccgcccataaccgcgggcacggctattcgaatagttttactctgatcagaggtgtacaactgtacccacaagacacatccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttagtcgccatgggcacgactagcaaaaccatgcacccacagcccaccatgtagtgtattttaattaaccaacaccattgcggtggcactaatctaaagctattgccaataatcaaagtctatgctttaatgtgatccccttttgtgcactagttgaactaagcatggctaagcatctcctaaaccaacatctagtcattttaatacccaagttatcaatggcgtaagggaaacaacatatagctgggtaataggaccaatcccacatgatattgtaaaacagtgcaatatttaatagaaatgcgggacatttgtaaattgggtacaatatgatcaattgcaatgtatgacttgccttgctctcgcactgatgaggccacagcaacgtcttcgagaaaccgcgaatcgacgaaacgggcgaaatctacgcgacaaacaaagcacacaagcaaaacatgctataagactactgaaacagataacaaagccatttttaatggattctacacatttttatgaatttactgagacttgaatggatttaatcggagctcggatgaattagttatgatttttagaagattatttgtgtttttactataaaagaaaaacccttaatcaatttattgcgcaataattcatcccagggctgacgtcagcacaaggaggggtggcgccgacacgcgggacccgcgggtcagtgactcaaggagagagaggggcggctggcaagcgggccccaccgagcggcggctcatggggacgaggagatgcccggtcggctcggctcggcctcaaaccggccgaccggttatggcgagggcggtggcgcgcacgcacggtcgccggcgacggcaaccggaggcgcggaaagcggcggcggatgacggcggcgcgaaggcggcggcacacagccgcagcggcggctcggcccggcacggcgctaggagggagagaaaggggaaaagagggggaggggcgcctcaccgcgagttggccggcgtggg

SEQ ID NO: 33512 - DNA, 1375 bp, Oryza sativa
accaacgatccccatacaatccaaataccatagtcacgatctcaaacgtcgacaatattataattatatactatagttatatttaaaaagttgggggaataaccaaagtggtccttcaagtttcatgcaatgatcagtttagtccttaatgtttcaatctgtccatgttagtccttcaagtttttattttaattcaaacttatccctgaacccacataaccaacaactctcttgataaatgacacttataccccctcattcgcatatataagagaaaatttgcatgcaatgaattctttttatagataatgcataacagtttatgtaaaccaaaaataaatcatgtacttgcaagtatatacgatagccattaggctcaagtttcatgtgcacatgttgaaataataggaagtacatatgcaatgttgtttatttatttgggtttttcttttttctactatatagttgtatacaaattaagggcaaaggggactttttctaatagaattgttgactagaaatagccatatttcatattaagtgggcccaaggatgattttaggccaaaacaaatatttagaggatctatgtggacaaaatgaaatatgaaggactaaattagctattcacccttaaaagtttcattaaaaaaacttgtagcatttttttaagatagtccattgaattttacctatgtaagaatcacaccccgggccgctcaaagagaaagacattgtcgataaattcctgatcccttgctaaacccttattaaaagtgtagcaagatgtacgccatcgtgggcacacgaatttcaaacctggcgaatggaataaggcatcaacaactccatcacaacaaggacttcctgaggaacatatacacacaagacacaaccattgtgtgcacaccaactaataaatataaaaaaatcaagaaaaaattatgcatataagttacagctatatgtaaagttttaacctcaaattcattatatttagcgataacaaacaaacatttagactgttttaatttaagactataaatgaaaatctgtaagattttttttctccctatgtatgatgaatttgaagatgggattttacacgtaaatataatattattgacaatatatgtacatctttttttaaaaaaatatgacatttattagttggtgtaaacggtacgtgcacatgaagacttccgtgtataggatacgttctctccatagtcacctctacttcatattcattgaataggataactggatcattctattttttttatttatgtttctatacttccgtcatttgagtccttgactactttaaaatgtttacaattcaatgaaggcacattagatgacatgagacaaca

SEQ ID NO: 33513 - DNA, 5580 bp, Oryza sativa
gcctgcaggtcgactctagaggatccccatagaatgtattttacaatttttttggcatgatttttttctttgatcttctgaatgttctcattttgtttttgaaacttttcatgcatggccatattcaccatatttgggattagaatacatatcccaactttaggtacatccctatataacattttcaaaatggtatacaaataatcctgaaataattctggccaacatcctaccgggtgactcgtgacctcatcagcgtcatgttagaactgaagttcaacagtgccacaaccaaacagtacggcgacctgtgacggtacacaacgaacttgtagtcttgtacacatggtagtgatgggcaccgcgttaggacaacatggcgtgcaacaatggtaaaagtactatatgaacccgcgaattgcagtgagagattcttgctaacagctgtattgaacttgataaagcaactgtgctaaaagtactggataaattttgaaattgaataatcaaggaccttgattgctacatatcactaaacaggtagcgtaaatttagagacttcactaccatacacaactaattttctgctatttgatactcctaattgataccgagacctaaagagttaaacagcttcatgctcactattatcagactgggaaatagacaagattaatgagttaattcatgcatatgttgatacattggtatcactagttacatgatctaatcagtgactaagtctcctatgctcggctaagaataaagtatagggtgacagtgaaatccatcgactaaaatcaggagctgaagtcaaatatatcttagctcctcgaaaaaatcaggggagagatttcaacacaacatggatcccaacaaggagccgagaaaaactgtggctacttaaatatctaattcatttatctgcccttcttaagtttagactatatctacgtgctgctatatggattgatcacctgtacagtaagagatacttatgttttcaattgagcaatcttatgcggcaccccatcagctgcttcattcatatattctgacatagattcttcctgcatacatcagggaaaaaagctgaagttagaacatttgttaccgcatcaggggagaaattaagaaattaacacgagttataaatatgaaactccgaaggatttgaaagtgctgatggatgatggataaaagtgagtttatgacaattattcgagggcagaaatgaatgaattaaaaattaaaaggttgataagttgattttagaaaggtctcttaagaaatgttgataaagaaagtttttgcaaacatcatactgtttaggagtttgggaagccatgataatccggtggccataatcataaaagacacctaaacattcagtgaatctagaagcatttttctgaaagttaggagccactaggccattgggatggtaaattggctccactgaacaaacaatttgttctaagcaaggcagccaacaaaaactgtgcaaattcatgaaggaaagttttgatgtaatgagcatgggattctgtaagttttaacagagtcggctataaagttctacatgggtatctgcttttataaccttcaactgcacttcagacaggcacattccttttataaccttgtgatttaaaaagtggtacataatcaaaccttttgacttagtaactgacaatgtacataattatgcttacgattatttgctgcatgaaatcacttacatctttttctcgcttttcttttatgacaacacactgggaagcaccgatgctttcgctcttcaggaagttacgagcacttaagagtggcttgttcagtccatctgtcactgatgagtgccccggttgctcacctacatgcaactttatgcagtaatctgcagttggatcaggttcatcaccattcctaacaactctttccctgaaacgatatgtgaaacaaattagatcaagagaaaaaagactgaaagatggaaaaggccgggaatgtaaaccattttcactatctataaaaattgtattattgaaggcagtgaattttagttgatgtctcaacaagggaagcactcttaatactcccctttgttgccatagtgcttaatgacattaatatataacgtcaaaagtgtttgtgtttgatccacctcataggcatgcagactacgtcttgttcatatagaaaagtataaaccaatgaactgtggaatttcactttagtgaaatggggcacgataggttttttctacttcagaaaagaaaattgtcttcagtagaaatatgagacagaactattgccttggtaaagaaacatgctgccttagctgcgggctagtcttgtcaccctgagcaacaccttcttctagatgagcaaattgcctcttaaaacgatccaccccactgtcaacagcatagccatcagtttatttgcaacatgtccacaatcaatagtgtgtgtgaatgaaaaaatgaagtatgataagtcacgattgattgcagtgtgtatcactatgattaaaatgaataaatgaactgcatacagtttacaaagatagtggaaactgttggtaacattatatagtgcatccgacctggggtacaaaaagtttgactgatccccaccacgaagatatttctgcatcatctgaggatggtactctaatatctaaagatagagagagagagagacaccatgcataagaaaagactattaccaaaatcctcatggtagaaaagattagcagtacctctctgtaaattaattcccggacatcatcttttgctagcttccttctctcaaactcaaactcgagttttgagatgggttgtgctatgggttcacgttccgaatttgccaatccagtaaagtatggatctgttaaggccttgacacataactataatatcagtataatggataacgaatattagaataacatttttgagcaattgctctatgctggctagtagctacattcctacctctgcagcagttggccgatccttgggatcaaaagcaagtaaccgttcaagcaaatggagagccattgggtctgcaccaggaaatttctgagaaaaaggcactcgaggcttttttctcatgttgcccaaatatcgtcgagctttctcattccgaatctacaaatagtatcaaaatttgaagtataatttctaaaggtacttcttcaattgtaaaactgattgttggaagaaaacagtggacacataatgtgttctattgactttattcggtcaatgttttagaactttgaccatcaacagctctcaaaatatttagtttgaaaacataaaaatcatatgggtagatttttctttataagtacgtttaacaatattataattttgttagatattatcattacattctaatagagaaatagtggtcaaaggacctatagagggagcttttagcaaccgcagtttctccaagaattaagagctccctaaacagtctagattgccactcagattctaagaatctgtagttgtagaattcaaaaaatgaattagaagccttaagctgggtttagcagcttccccagattctcagaagctggctaccaaccagtaaattcttagaatcttaagctcccccaaacatggccttttgaacaccaaataccgaataaagtcaacaatgtcatatatttaaatatagaggttgtatccccatcatcgaactcatcctacaattaattgatagactgattaatattaaaaatcaaggctaatgtattcaaaatgtaaatgcaatataaatttcggatttgttcttccaagcttcatcttcaccatttgtgttcttgaaaatagatatgtagttttggagagcttaacatcaaccctgagccagttttctagtataatctccaaataaactgaagcagtggaaaaaggcttataagctaaagcctcaaatgaacttaagtattggagaagccaaccatggacaaacatgccttaaaatattgaagataattcattataaactaagtaaacgcttcacatcgaatttacagtggttggtttacatttatactttatataaaggtagatgtttcaccttatgagtatttcaatattgataggggtgcagatagtttgtgtataataacaccagtacaagaaaactccatcactacattatcctagagacaagagccaagccattctcagcatttttgaaactacttatgcagcctgagtataactaagttatttccaataaatatgtgatgagtgaactgtttgatgtgtctcacgaacctcatgtgttccatacagcgcgagtagaaagtttctaggaccacagacagattcacctatgaactaattggctaaaacattgttcagaattctctacacagcttgcattgaagtaatcatcttttaggctgtcatgatagaaagtaattttgctgatatttatataaattgtaggtttaaatataacagaaatgcccgcagcccgctaatttgaacctcctaaaaatgtccgggtataagaaatgataatgaccatcagtaggaaaaaggttaaatgaaattgcatagaagacaggctccaactaattgcagatttgcagggagactgggaaagtgaaccccaccctggaaatagtttctcctgaaggagagccaagtaagtcggtcatgagatccaattgatgtaccacattctttccaggaaaaagtggctttcccataagcatttcagcaaatatacaaccgacgctccaaatatcaattgcaggagtgtactgcaaaaaacacatttgagtttagtatggtgcaagtgcatttgaaattatccaaattggtatgctaagcatatgtatcgatagttcaagagcatggcattattttgtaacataaaggatttaatgtacggcattaactcaataatctcggatggggataaagtagctctgaaacgaaatgaccaggttgtgtaaaattgagcagaaaattcaggctttagcatgacgaaaatttgcagacctttgaaaagaaagagccgcacaactctggagcgcgataccatcttgttgccacgtaatcctacgacaaaaggaccacaaaacgaattaaaattcaaactatgatgggtgcttaagggctaacacaattctcaacatatctgactgtactagtactaggattgttcttttaccgtccagaatatcgcggacggagtgtcgtcgaaggacactcgagcaaggccgaagtcacaaatcttgaccttgcaatcagcattggcaagaatgttcttgggcttgaggtcccggtggaagacgctggcggcatgaatgtacttcatcccacgaagcagctggtagaggaagaactggtggtgctcgggggtgaggtcgtcgttggccttgatgacctggtggagatcggactccatgagttcgaagataatgtaaatgtcgcgaaactcgcggcgggagggtgggagcatgatgtgcttaatctccacgatgtccgggtggcgcaggaggcggagtagcttgatctcgcgaaggatgcgggtggcgtc

SEQ ID NO: 33514 - DNA, 1833 bp, Oryza sativa
gtcatcccacgatcaccgattcactctcctagtcctagagtcctggtccatctttcttggcttcttgatatggcagaccgaccacccgccgcgcgcgcagccttacccggtccgccccggccgctgcgcggccaagcgcacacggacctcccgctccgccggcgcatccagcatcacgcgtacgactccgcgaggctcgtcggtttcctcgccctggctgtcaccctcgcggcgctccttgtcctcgcgggcgtcacgctcaccgtcgccttcgtcgcgcttgtcgtcctcagcccgctcttgctcctcaccagccctctctgggtgccgatggccgccgcggtcttcgtctccggggccgcctcgatcatcggctggtgcctccccgtgggcgcggtggcggccggcacgtgggcgtaccggtacttcacggggcggcatcgtcgacccgtgggcgcacaccgggtggactacgacgtcggcgcgggcaccgcgagcggctggatgggctactacgcgcgggagtacggcgcgcgcccccgcgtccacgtgaaggacgccgctcccggggcgtaggcggcacgcggctctccttgccgcgtgtggcgtctcgactctcgcggacgtactctcggtgtcgccgtgcgtgtctccatgccatatgttttgtagtgtcacgccttgagcgctatatatattgcaagtttgcaactataatgtggcgtgatgtggctggttagattggcgcggtctcgatcggttggggatgatccttttgacctgttcgggtctggttaattaccagcatatataattggtgtcccgtggcggctggtgaccgacacagtgctgccaacctgcattgccagactcgatgggttaactacatgctgggaaagcagcgagagtaacctgtgctcggtcgtcgcatctgtgtcctgtacactcgatcgatggacggtgctatttgttatgggcacctctgaatcgcaaacaagactgaaaaaacggagaaatagggaaaatatatgattctgataaaaatataagtataaaatagatgattgttaaatatataaaaaacataggaatgatagtttgattgagccatagaaaaaatacagaaatttgagtagagataaagactcaaataattctttctataaggttctaccttatgttaaattttctctaaaatttacgtggaaaagatattccataggaatttcgtacgattcatttcttcgattcagagggtaatatagaaaaatttttatagaaataacatcctttaaaattcgaacttcctttcaatcaaatggcctaacacttgacagcacgcagctgctgcctgctattttaaagcctggtgcagtttcggcccattaaggccagtgggctgtttttcggcctaagtttggaatatagacatggataagcctacctaagatatttactactctattttttttctcttagttaaacttttaaagtttaatcgagtttgtaaaataatatactaatatttttaataataaataaatatattattaaaatatattttatactaaatttaatgagactaatttggtgtcgtggatgttgctaatttttctaggtaaattttgctagaggacactgctaatatgtgattttagccttaacacactgcccaaacttacatttgcgggaaaacactccataaacatggtaatttaccaatggacaccgcgccgatcaaaataataatttccgattgaagaggagagagaaatcacgtgaaatgtcaagggaatgccctagggcccacatgtcagctctcttatctctctt

SEQ ID NO: 33515 - DNA, 3309 bp, Oryza sativa
cgctggaaggaggggatagagagaagagagataagagagctgacatgtgagccaagggcattacatttcacgtgatttttctctcatcttcaaccggaaattattattttaatcggcgcggtgtccactggcaaattaccacgtttgtggagtgttttcccccaaaagtgagtttggacagtgttttagggctaaagccacatattagcagtctccagtagcaaaatttgtcttttttttctattagttttggtcaaatctaatgaactttgattaagaaaaagtcaatatgaacggggagagtagtattttttaaagaggaattattagcgttcgtagatcaaagcaaaattacagtacttcatccttgttcctggtgcaaggctcctaaattccaaactatagttccgtgcttccgtttcctagtggttttgtccacaagtggaactatgcagaagtgtgaagaaaacaagcagtcaggtagcagtgtagcacttgtcttctacggcactaccacaatccatcaccagcgccaccttcccagctcccaagtcccaagtagccgcaataatggtaatcacggctctgcagcttctccctccaatccttggccttccggcgacggcgagaaatggctacgccgtcagaaggccacggatgatgactgtgacttgctgcaggcacaaccaggtaccgagtatcttggctttgccggatctctgaaattccctttccagtttccactgtttcgtttgggatgaactgcttccgttttccggaataacatcgtgggatgctgggatccaatatgcatgagctgaaccacgaaatgttctttttattagctagaggcctagaacgagtaggataggttgatagattggggaaacaggggactggaggtcatctctcatgaggatggaaagatagatctcccctgtatgcgatggggcctggatgagcagctgctactttcagaagtactttgtattaaggcaacttgcaagaatcaactgtaggttttatatgcacaagaatgtcagatatgatgaacacgcttcacttcggaaatagtactaatcagaagtagagccgggtggttcagtgatgttatattgaaaaatgctatgcctgctatgtttcatcaccaattgatgaccagtttctcttgtcatttcttggatttttaagcagtactttggtgcctacattcctacaaatatgtcaaaagctgttaatttttttctagaaaaatatgtcaaagctataggtgcatacaatatgttttattagattgattcagaacactcaggtattgaatggattattaggtgcaaaatcctgctgtatttttatgctgacaggtttaacattttttttatgtatgtattgcactgcatctatgcatattcagttattctactatatatgtccatccccttggtggtgaaaattaattaatagatgaaagttggatagttcatacttggatgattagatccaagtttgataacgaaatcctccatcatagagactattcatactaacaaaacaaaccagtaattggattttgatatgtccatgcatgtcaatctttggttatataggccctatttgattaaccgtgtcagttgggtttgtcgttttttgtcgactaacactgtataatttttcctgctctactattaatatacaaggcaaagcttttgccttccttcaaaaaaaatgtaggccctatttggttaactttgtcttccatatcttcagaaacagtgaccccttgaagctatactcctctgcttcttgtaatctaaattatcgtgttatatggattcttcttcagttctggcataaaccgctcccctgttaattagcaatttgtttcctgcaggcaaccactgtacatgaatcaaggctaacaagcagtttatcccgtagagatgcactgtcatacatgtcgtctgcgttcatagcaacgcttctggtggctggtcctgcagaagcaagaacctccaggcaagagaacaagagaaaagtaagggagaagctggagaagctccgggagaaggcactaggcccagatgataaaaatggagccatccgtaagaaggaatctttggcgaacttgttgattcctcctaaattggtcgaggctaccatttgaaaagccattgtatcgatgtgaacttatattcagacgttaaggaacaataatatggaagtctgaatatatggtgctcctctgaactgttgttgccaactcgccatcactcgtgtatgaaatatgatactagttgggatctcaatccaaattaaattatgccttttctatatcttgactcgtccccgtgtcttatgtgacgtagtagagcacccaattcgttcacatcttaaaacataggtactgcattacaccagatagcgatcaaacacatggaaaacaacacttacaagtgtgttttcactgaaaagagtacagcactgagaaaagatcagcaaccggcatttgaatagatagaattcgaaaccgtcccatacatgaatgaatttaaaagtaaaaaaccagaatcagaaagttttcattacgaacagcatgtaggagatcagatctaactcgtacgggcaaggcaacttgcacgagtcgtcccagctaaccgtctcgagcttattcaacaccctgcgttgtaggtcgagcagcagaggactgtcgccctcatccccctccaaaacgagggcgccactcccctcgcagaaccgcacgagccaccttcctctcaaccatccgtcgcgaaaatccaggccgcctgatgctattctcgcggataacgtgacgcagctcccagcggcgtgacctccctcgcgcggtggtgcggagtctgcggacccacacgagaatgcggtcgcttccgtggacgaccacgctcagcaatgctgcgttgctcgtgccgtcgtccgccgccgcggccggcgatagcgcgaggcacatgttgtgcatcccggatttgcacgactccgggaggttcactagtgaagccttcggctccccgccgtcgcctcgtcgctttaggctgaggatgctgtaacccgagtattcgcagcacaaccagtagacggcgccgcgcaagacgacaacattggagtcgccgtcgaataagcaaatcctgtagatggggcaggcaacgggagtgccccactcgcgctcgtcgaaggagaagacttgaaagatgagcgtcctggcagggctcactaacagctgcgcggcgagcaacttgaacgagtgggttccaatcgcctggtcgttgtggttga

SEQ ID NO: 33516 - DNA, 4358 bp, Oryza sativa
tgatcgtagcaggactgcttctcgcgatgatctcgaggacaagatcgtcgggaagaatttggtgcggttcgatctccatatccatatccatatcgagtacgtgacgcaccacgatcgagcgagatagactcgatcttgtaccgatgtagtacgtggatatatatacacacattcggtttgtttacggttcctgtgaacaataggattcggatgcatgtacatccgtacaggtaacgtgtgagcagttatgttaagttattactactactatatatgcactacggacgatttggtatgggaagctccatacggtcaggtatttcagtcgtatagacatctacaatgtggtataaaaataatccataaacaatgaatattccattcagccatctattactattatgcaattagttcatataaaaaaatagcaaaagatacccatatgcatatgggctacccatatggaataaattatattatctatctctactcctctctcttctactaataataccttgtatatatatgcattgcggagattaccatagggataaactatttatgtgagtcccatctatatggaccactttaccatatacattggtgatgccctaatggaactatggaagtatgctgttatacctgctctagcaacaccagtgctgcgggacaaggtgtacctagatgccacggtagcatgcgactcaaatagttataaaaaaattgaaaaaagttaataacatcgattgtgatgatatacgactatacacaaacatacgcgactaaatttgatctataactagagaaaaaaaaaataaaatcagacagtgaatagtacccgtacatcacagataaaatttgttaattttgtttctttatagtcgatcaaatttagacttgcatgtttgtatagggtcttatatcatcatagtctatcttattaaattttatgaattttttatataattgtttaaattttatgaattttttatataattgtttaaattacatgtatatatctaggtgccaattaaaatttatgaattttttatataattgtttaaattatatgcatatagctacgtgccaatattttccccgtatgattcttttccccgtccctgtcgctcccgtcgctggggcaacacgaacaccctcgaggcctcgaccgcccaccgacgccaccccctccatccttccctccggctcgccgccgcccccgcccgagcggtcgccggaaagccgggcgcggctgcaaggacggcagcggcgggtctctctcgccctccctgcgcggggttttagcagttgattctgcttaccggtaggccggccgggcgctggtcaatgatttggggccatatggcagcctcattgtgctgatttggtgggctttaacgctcaacgtaggtcatatgtactctagcagaaacaagcccacaggccacaactaattgttcaacacaacgaagtcacgatctctctgcacctgagtagccatgctggaataaccatttacattgatgagaaatattacgtacatatacatacatccacgtcgatgcttagaagttacagcatgaaccagggtttttattgaacatgtcgaaagcgtttataaaacataaacacacatttaattacgggacattcccaccggccgcctatatattgatcgcgccggtcaagtattttttttcccaccttttagcggacgccgggtcgattagatggggatcgcgcttgtgatccgcgggtagacgacgttggccgggtgccccatgatgcggcgacccttgcggtggcggaacaggtacacgaacgcgccgagcggccacttcacgacgccggccaccacgaacgccacgaaacccagcgtcgggccgagcaccttgcacctgcacgggttgctgtgcgttccgcactgcacgcacaccggcacgtaagccatctcctcgctcgcgcccgcgcacgaaaccgaagtcctccgcctcgccgcttgcttgccgatcgacgagctctactagcgcctctgcttggaatgcctgtgttgatggatcgaatgagcaagggattgcggatacacgcctccacggagtacgggcttaaataagcaggggctatgaaagcttcgcatcagccatcagggacgcgtggcggggtggaagggggctacgtacgtggggcgctgctagtgtctgtcttggtgagtttggtgtaaagggaggcgatgagtcgtccgtagaagattgccacgtttgcttggggaaggcagagcccaaatcttgagtcgacacgtgcactgttcgtaccggagctttctggaacacagattctcgtttcagagcaagagaaacggtatcgtagtattttttaaagcattgcttttcgttgcctattggagcaagtacaaagcaggagctataaatatattttaaaaagataaaaaagagagagaagagtagtgtgctatagatctgtagcacgatctttaagatgtaacgtgtgtatgataggtgagaccgggtattattaatagtatagtactccctccatttcaaaatataaggcacaaccacccttaacccaaataccaagaaataattaatatttcatggttatcatgaatcacctcaatcaatacaatacatgcaaccaatagaattaaaaatcttgtgagtataggatttaaaataataataatttagaggagagaatgtgctaattaattatatgcatgcatgcatgccttatattatgaaaccactttaaaaagtagatgtatcctatattttggaatggagagagtaaacaactattgtatgaattggctattatattggctataaatgatttggagctagtagttggctatactattaaggccgagtttagttccaaactttttcttcaaactttctaatttttcatcacatcaaaactttcctacatacacaaactttcaacttttccgttacatcgttccaatttcaactaaatttttaattttagcgtgaactaaacacaccctaaacttaactcttatgggtgtgtttagttcacgctaaaattgaaagtttggttgaaattggaacgatgtgatggaaaagttggaagtttatgtgtgtaggaaaagtttagatgtaatgaaaaagttaaaagtttgaagaaaaagtttagaactaaacaagtccaatatcgaacgatacaaggcctttggccaaaggtgggctccatcttgtctccgtacccaactctcaggccctcacttgcgtcatcgcaagttcagacttctgttagaaacgtcgtcttgactaattattgttcgaaagattatccctttctctttcaatttctttcgaatggcttacaaacataaagtgattgtaattcggctctcgttgaataatcgagaatcgcttgaaattatggttttcacttgagatatgaaaatttgataggattttcacaaaaaaaacagttcagttccttcaaactgactagaccctggaaaaagtacaccgaaggtccctcaacttgtcatcgggttacaaatcatccttcaaccacaaaaccagatacaacgcatcccccaacttacaaaaccagtgcacattgaggcagggcccgcttatattgctccaggccaagcacgcttaaccctggagttctttgaaaatcggcttccggaaaagaagttgcaacgtgtccagtgcaccactcccggtccacaccagccatgcgctatgtaacgtcttgcctctcccaagtcaggcccgcttacatctggtagcttttataggtaatagactgccctcacaggccaacacatgccttttctgcacactttgtcctcactcgtgtacacccggaaagaattcctcggtcggtcactcatcccaaattgctccaggccaagcacgcttaaccctagagttcttttgaaatcggcttccagaaaagaagttgcaacttgttgacatgagtattttattaatactattaagccctgggccgggatgtcacactaggtcccctagcggttttgactctggttttctccgacccggttttctccgacatgacagctaactcagcgtgggacccacacgtcagcctcttcttctcctctcctatccacctttcttcctctttcccctcctctctcaccccctctcttctctgtattatccgcgtcacgaagccggcgggatggagcggggcggcgatgggcggagtggggcgaccggcgacggcgaggcggagtggcggatgcgcaacgccgagagacccgcaggggtggccaacgggcgccatggccacaggcgccggcgcgagggacacccgccgctgggggc

SEQ ID NO: 33517 - DNA, 10248 bp, Oryza sativa
cgatatatgcaaaatctacccaaattgaagctcgaattttgaccatgcgcatatggatgactaattaattctcggcattaagaggttagctagctagctaacctggagacttcctcctagagggggcctttgaggacggcttcccgaaaggcgacgtccatctccgaccggatcttgagcagcgccagcgtctcctgccgtggccaccggttgcctgcccgcgacccgctccggtcgccctcctcgccacccagcagcccgttgtgctccagtagctcccgttgagctgctcctttgccgtcgcctactccggcgacgagcggctgctgatcggcgacggcgccccccactccgcctggctgcttcgctcgcctcctgcaccgccaccggctgcacgcggtcgatgagcacggagaggagcagcgacatgttctgcttcaacgtgcggagcgccgggcggatgcgggcgtcggcgacgccgccgacgtagagcccgtcgtagaacgagtggtgcgagttgagaagatgaggcggtacgcggcgacctcggcgacgtgtccgaccgcggagctcgcgatcacgcaggaggagctccccgccggcctcctccccacccgccggcggcctgcagagacaagattgagagagagagaggaggaggaagggagagaagatggtaaataaagggtgatgacgtggcacgctgatatgtggggtccacgtgagtcccatgctgactcaactgccacgtagattaaaaccaccgaataacctcgggtgatcggttttgtatagttaagggatcccgcatatttggttttgcggttcgagaatattttttatcccgatgataagttcagggatcttcggtgcactttttccactagacccttaaatgtaatctaattctaccgattcaggccagccctaaagtgaaaaccattttagcagttttgatatattgatagcttgttttatttagccagctaagattgtaagccaactacactattaatagattacgtcacctattatttatttcgtttggttacaaataaaatatccgttatgaacaaggttcaatccaaacccagatattaatacctgatgagaaaaaattgtagcagtcgataaaatagctagctagcatgcggggcgaaactagggaggggcggagggaggcctggtctcccacaaagttgcattcttgcttagcatctgctaatcgattatctaattacatgattagttagtttaagcatttttcgtttaagcttccctttattcttgacgattactgcatcctctatatcctgagctatgatcagtagaagattttacatgctagcacgttagatcaagcctacaacaagctaacacgtgcaagaaatctttaatactgatgcatgtagctaattatataccgtatgcacataaatataattttgtatggtctaaatataattatatgatttcctatccatgtaaaaaatataatacttgaaatttacatgtattgtgattattttttaatagattattgtcatttgatacatcttgtaattcgtttatcagatatatatggctaattaaaggtttcggcaaccaatgttgggttatattagcattggaagttttctttggtagttattgttgggagcttggtgctgaccaagtaaaacaacactaacatgttagactaactgaggggctggttgacagtaccatactacccattaattatagcctcctccaatatatcggtgccaacaaatcatccagtctagctagcaacgtaatcaacagtgatcatctcatgtgtgtagtgttagctctaccataaccatgtaaatcgacaatgattggcctatgtaaagtacgtcagttaacaagtcaaagcttaagcgagtcagaatggtgagccaagcctatttctccattcagctttctagcacgacttggcttgatcttagttagtcttgtgagctcagctctagtacatgataacgtatactttaacaatagttttataaaaatatttttaacaataattttattaatttttttaagttaatcatattaaataaaaaggtgaggagtatttaacattagggataattgcaaatataccactacatttcacacttaatttgaaatagccattaaaaacatgaattgtaaatttgccactgaaattgatccaccgtgcttctacgtgccattgccatctaaactggtgcaattaagaggcaaaaaataatacataaaactagattgaaaatgacataattaattttcccatcttcatttaaaaaaaaatcttcttccaacttacatagagtgccactactaatttattctttttttcttggcactttataaatataggacatgaatttgtgtttcgcatagggtctcgaattcttagggatggctatgatgtcaatgttaaagcagatttacaaagtttacagtgtcaataccacatataaatcttagcaaatttactatatccatgttataggaaaattactatgccaatgtagtaggaaattgaagatttttgttattcaaatgtactatgccttgcttttgttctctaactcctcagctagtagctaggtgaggtgggaggaccagatagtaaagaggagaagaacgaaggattaaaaccaaaagaatgaaagacttttttatagggacatgaaagaacctttctgcaatagatgtttctcgatgggaactttatgatattttgtgtagataatataacggctaaaattttgaaatactagatcgaacggtctaggttttgccatcaacgtggatgcatgttagaaaaggatcctcctttcatttaggggatgcgccatatctatagaggatcaggttgatggtaactcatattcgaaaaatgtgtgggacaggaggatggctaggagtgcctattcaacctcaataaagatagaacatttcaggactgtaactttgcaagtgcatcagtaagaaaaagatcgtcctaccctttgatcaaaggcagagtttattaactaaaagatacgcatgtatcatatggttggcatgcaccaaaacttttggttgaagcatcacacttcagctttttgcaaataaagggtggttggcaatcgaaggttctctctctgtctgctttgttcttgtgttgtaaactgaagggtctcctgtttgttcacatgcggattaattagctggctgagcttaccctacatgtctaattaattatggaatatttctccttgaaaaataattgagttcataatcgagcctggacacgccaacccactttgcccccacacatctgatttatcctatataataatttataatactggcaacttgtatattctctagaaaaaagttcttaaatatatttgtcaataaatattactgagtaattggctctgttgagaaaaacacatgtagatcatttttatattttctctggcagttactaatttttataggattatgcaaaatatttgcacatcactacatttctctactattataaaagtggagtcatcctccttccatatttcactgcatgcagcgccgtttaacatgtctaaccactggatttaatattttatctttaattattatcatgattgacggagctcgtggctcctcaccgggagaccgcgcaggcccccctttgccagttcggccgggggcttagggtgaaatctcaagctctctctctctctgtatgtggaaagatcgtccgtcagcaagaaacacgagacaccggcgatctatacaggttcgggccgctgagaagcgtaataccctactcctgtgttttggtggatctgtgtatgaatgagctacaagtgtgagctgacttctcccccgttctaagctctcaatctggaaaagaatcaaccaaccccctctctatgggcaaggtcctccttttatacttcaaggggataccacatgcacccttctctttccaaactggactgttctttttctcttgaatgggcggagatcagcacggttgctgtccgaatgacgctccgatgggacagcccacacctacctccacttccgccgggggtgagcgcgtcgtgggaacatggctgtgcgctgacgatatgatcagtgtcagaccggtcacaaatcggtcattcttgtccaccgcgtgtaatcttggcaacgtgcatgtttgcccttcttcacacaacatcttgcttgtaatggttaggatgaagcctggcatatatcgatcggggctagcgtgtcatctctgggatgtaacacgctagctccagccggggacgagtgcctagaagctctcgtcttgacaggatggggcgaagcgtgcgtctgaccgcctgtcgccacctaacccgtgatctgaccggtctgtgactggtcacagaccggataaaggaacgcgccgtactgcgctgcatgcagcgtgacacgcctgaccagactgcattaaatgctgttaggtgagcacagctgtgctcacttatcccatatatgtggcgcagacttccttaagggggtcggggtgccccggccctcggggccggggcaagcgcaacccgaccccccctcggggggaatcaggaggagggcggacacctcaccctcgggcccgacgtccccgaaggtgccaggccccgtgggcgattgtgtctgcctcaagcctctagtcatgatattcccggtcccatatcaccgacagtagcccccggcgttatgccagagcaatttcccttcccaagggaagcggtcaggtgtgacgccactcctaaagcctggtgacaggtgggaccggtctccgtagttgggcaaaatacccaacggtctcaatccatgcacatcggtattgataactttggttgtccataatgggcggtctattcaagactgccacaccacttgagcagcgcgcgaatctgggtgagcagatttgtctcgcccggagatatggtaacgccgcttcggtcggcgagcgtaattaacgcgcgcacgatacaatccgtttcgattgccacaaccgcatatccacttcatgcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgctcccttcctttcgccattgttcctcttgccttcgccgcctgagctctaactctttctctgctacgccctactttcgccacacgcgctcgttcccaatcatctcttcctccaccgccatggcacggggctctgctctgctcgacggcagtgtactgccgccttcccgcatcgtgaacgagaggcacgccggactgccgcgccgcttcatgccggagtccgccaccggtcgggagatagtgatgctgggcgaggggcgcccggtaccagattacccggggcggtccatcttcttcctccccttcgcaatggctgggctggtcccgccattttctcatttcttcatggatgtcctggagttctacgatctccagatggcgcacctcacccccaatgcggtgatgacattgcccatcttcgcacacctgtgcgagatgttcattggggtgcgcccctctcttcagctgttccggtggttcttcaccgtgcagtcggtgtcaccgccgtcggtggttggcggctgctacttccagccgcgggggccggtgttgaaccgctacatcccctgcgtcctccgcaagaagtgggacgactggaagagcgactggttctacacccccctcgccgacgaagcgcgcctccgacttccaagccagcccccggcgcaggtctccagctggcgggcgccggtagatctgggggaggagtacgacgccgtcctcgaccgcctggcgggcctgcgatcccaggggctcaccggggccatggtgttcggcgattacctccgtcgccggattgcgccgctccaacggcgcgcccggagcgcctgggagtacactgggcctgaagactacatgcggacccaccagggagccagatgggattgggctcctgaggacttcaagatcgtagtccaaagggtgctgaatcttagctccgcggaggcgtctcgccttcctcaggagatcctccccctctgcatcgatcccgaccgcgtctccattctaaccattatgctgggggtcggggcctcagaggagagagcccctaagggccacgacggcgcgggcgagcgccgccggggggaacaacctgccccaggagggggtcgtgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtgaaactgacacgctctgcatcgccggaccagatcgactgcgtcattgagagctgtcggccaataaaatccttgacgaaaggctttgccaaccagggtacgcgaggcggaatgggctccgcactcgccctcatggatatcagcaagaagctcaacgccttgtttctgaggaatgcacttcaggaggattccgttagccgcgcgccgatagagggtcccttctaccaacacgtagcgtttggaaatgcgttgtacgcgttcactcccttcgcggtcctcaggtagagtcttatctgtgaggtacgtttggatctcagagatccaagcaatcaatctaagggagctaggaacgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccttgagagttcatcggcaatcatattatcccgtctgggcacatgccgaagctctatcccgtcaaaatggcgctccatacgccgtacttggcgcacgtaggcgtccatctgtgggtcagagcaccggtactccttacagacctggttaacgactagctgggagtcgcctaataccaagaggcggcggatccccagtccagctgccactctgagtccggcaaggagtccctcgtactctgccatattgttagtcgctcgaaagtcgagacggaccaagtatctgaggacgtctccgttcggagaggtcaacgtgacccctgcaccggcgccctggagagacagagaaccgtcgaactgcatcacccagtgggcggtttgaggcagctgtgaggggtccgtgctagcctcgggtattgaggcggtctctggagccggggtccactctgccacgaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttcctcgaggccataagaatagcgtaaagcatcttctgggcctgtgggtatcgggtcttggcgtcccggagggcctcactaacaaagtagacaggccgctgcacctttcggcgaggccgatcttcttcgctaggggccgcacccccggggcgttcttcgtccgagtggcccctcggggcgcacccatcttctgcgccgatgacctcggggtcggaagacgacaggagcggccttcccacagtggcctcggggccgtcctgggggtcgggggctcctggcgtcatcggacaagcgggcaaagggccaactccggtcgtcaggggccttaggccaccgttcggctcgggggcctcttctccctgctctctcccgggtcgaatcggtacagggttagcctcggggtcagagggccataggtgcggcctccccgcagtggcctcggggccttcctgagggtcgggggcgcccagcaccgtctgacgagcggggagagggccgactccggtcatcaggggccttaggccaccgttcggctcgggggcctctcctccctgcctgctcccgggccaagtcggcacagagtgggggtgcgcagaatgaggattgtcctcatcgcgctccacaaccaacgctgcactaactacttggggggtcgctgctaaataaagtagcaggggctcatttggctccggggcgactagaaccgggggagagctgagatatgcctttaactaagtaagggcatgttcagcttcctccgtccaagtgaacggccccgagcgcttgaggagcttaaacaagggaagcgccttctctcccagccttgatatgaaacgacttagggcggccatgcaaccagtgacgcactgcacgtccctaagtttgctgggggggcggatccgctctatagctcgtatcttctcggggttggcctcaatgcctcgggcagagaccaaaaacccgagaagtttgcccgcaggtacaccaaacacgcacttatcggggttcagttttatgcgggcggagcggaggttctcaaaagtttccgctagatctgagagtaaggtctcttggttgcgcgtttttacaaccaagtcatcgacatacgcctcaacattacgtcctatttggctacccaaagaaattcgagtagtacgctgaaaagtaggacctgcattttttaacccgaaaggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgcggtcttggatgggccgtcgcccaaggcaacctccttgaccgggacctcgtcgcaagtggccatccgctgcctcggggcggtgggggcagaggggccaagcctctcgtcaccaccctcgggcttggacgcagcagcgaggcggtccgcgcgctgctccatgcaagcaagcgcgactttaaggtcgccacggacagagatggggccaccggggcccggcatcttcatctggaggtaggcgtagtggaccgccgccataaacttcaccaacgcgggtctccccaggaccgcgttgtagggcagactgaggtccgccacatcgaagctcacccgctccgtgcggaagttggcgggtccaccgaaggtgaccggtaggtcgatgtgacctaatggccacgtgtgccccggcgtcacaccgatgatcggttgagacggctggagcaccatccccggggccttgatagcatcaaaggccgcgggggaaaggatgttgagagccgctcctccatctatgaggacacgtcccaacttcacgttgtagatggtgggggaaaccaccatcgcaacctgccctccccgggcaatgcacggtgggtggtcagtctggtcgaaagtgagagcgacctccgaccaccgcgcccgacgcatcgcctcatgggtaggggccatggccagaagctctcgctggggatcctctagagtcgacctgcaggca

SEQ ID NO: 33518 - DNA, 996 bp, Oryza sativa
acccgcacccaggcgctgctgtgccgtcatgaccaagttggccacgtcttccagccatcgttgggctggagactccgggtcatggacgacaggcgggtgtcgtaggagcgcgccagcagcctgaagcgcaccctgaggtgtgctgccgtcgccgtagacgaggaggcgacgctccccatctcgccgttctcctgcatcacctgcgactggtgatgccacggatttgtcgaccctctcaagcgcctccccctgcttagggctttggcgcggaggaggtgggggagtacgagctcgacggcgcggattaggctccccgtcgtcgccgctcacactcgaagagaggtcgtgcgcttttccttgctcggccattaggctgaacaagaaaaacttggcgcacacggaagagtctgagagctcagaaaacacacgctgagccccttacctggcgcgccagatgacggagctcgtggctcctcaccgggagaccgcgcaggcccccctttgccggttcggccgggggcttagggtgaaatctcaagctctcgctctccctctgtatctggaaagatcgtctgcccgcaagacacacaagacacggcgatgtatacaggttcgggccgctgccaagcgtaataccctactcctgtgtttttgtggatttgtgtatgaatgagctacaaagtgtgagccaacttctcccccgttctaagctctaaatctggaaaagaatccaaaagaagaaccctctctctatgggcaaggtcctccttttatacttcaaggggataccacatgcaccctcccctttccaaactggacttttcttctctttatggacggagattggtatggttgctgtccgaatgacactccgatgggacagcccacacctacctccactcccggcgaagacaggcgcaacgtgggatcgtggctgcccgttgctgacgcgaccagtgccagaccggtcattcttgtccaccacgcgtcagttta

SEQ ID NO: 33519 - DNA, 482 bp, Oryza sativa
ggaaggaatctagatggagcaagcaaataaagtgggatatgcaaaacagagagggaaaaagaaaaggaagaagagaagattcagtcgtcacttgttttttaatggaagaacagaagatgcaggtactactaaattggattcttgtccagtttaaaaatgcagcctgcagctggtaacaatgaaagaaggggatataatggaagcgaaagatggaacatgacactgcgagagaaccagctgagtagaacattctaccacaaagcatcatatcaagagctatggccaatgaattttatctaagaaagaaaaagagagctagccaataaaacaccatgcaggaagacagcaagggcacatcaatcacgtgtcatgaacaatccccagtggaagtttccactagcttaacagctagctcctcaggacacagagagagcaagcaagaagcttgatttggtcccagctatctagctagctctctctca

SEQ ID NO: 33520 - DNA, 29013 bp, Oryza sativa
gatttagtatgtctgtttatcaccaaaactacatgtattttatacaatctatcacaaaactacagattgaagaacttgtttcacacaactatagatttagtgtattcgtttatcacagaactacgcatttaatgtattaatttaattatcacaaaactacatatttagtgtctccattatcacaggtttaacaatgctaaaacatgtagttttgtgataatgaagacactaaacctgtagttttatgataaatgaagatattaaatttgtagttttgtgaaacaaattcttaaatcagtagttttatgatatattatgcaaagtgcatgtagttttgtgataaacaaagacattgaatctgaagttttgtgaaataagttcttaaatctgtagttttatgataaatcgtgcaaagtatatatagttttatgaaatttactcatttttaagggaccatactaacccgaattttaggagaatatttcctgtcagagaccatcctatctcacctattctcaaacaagcacactaaaaaaataggtttaatctaacctgactcatcccaaccctttaaccaaaagtatgcctacaggatgcatgcatacataacgtaagaaccatagctttcataagcagacaagtgtaggaatgtgggccgagcgcaagagacaagccgggaccgtgagcatgcacacttccttccaactcgaagcacgcatgcctgcccgatcgatcgatcgatcatggatagatgggtacgtgaccaccacagtctggtgagtctggtcacgtacgtacgtacatacgcacgcatgctacgctcgctagttgagctccatgcgccgtgccttggcaacaagttccctgggtctagggcagcatgcatgtgtaccaacaccagtacgcgcgtgggccccgtctctcgatttgctctcaatcattgatgattctctgcccactgcgccgtgggcccccccggcgtgtacgtcctaatcgcgcggagtggcgtacgtggaccacccggccacggccactgccatcgatcgatcgatcacgctcggctcggcgcttcttctcggcgtacgtctgccaccaacaccgcgccgttatatgtctcgtgcgctccgttacgttgttcgatcgccaagttctatttccaaaccgtcggataagagttgcaacaaatggctgatcgatcgatggtacgtgttcaacgtacggtggtatatatatgcccgtgtgggttgtggcacaatgggagacagggccaccatacaataggggtgctgactggtaagggccaaatgagaggcgaacggtatgtctcaataccatggcagtttgtacgatttgagcactaacgggtggggctaggatcgagtcgttgaccgttatacaaaatgaaatgaggattgccgcgacgattggaacagccacaagagagatggctaacttggagttccgtgaaagtttggtcaatctaattgtgtcctagaaagtgatggtttttcaattcgaaacagttatgggtttctctccattttcattcaaaaaaactcaatccgtccattttgtttttatatgttttagctgtcccaccttcatttcacataacagtttgcatatattcctacttccaattagtgaattgtccaggaggtggtagaataatcctactgcaaagagtaccaaaattaagtgggtgaattggagaccccaaatcgaaaaaaaaaggtgaaaaataagtcagacaagtcaaaaagagggtaactgcgtgcatgtgaacttttacatcgattgggatagtactcattttagaacctaaaaattctctttcgaggtaggggcaattaaaattccaagcaagtgatgcagtgcccgataagtaaaaacgtagtagcagataaaggctagctggcctggcacgtagggtggtgtagtattgtgggagtagttactctggtccagaccatcgaagaggtgttacgccagcttaccgcaaatggaagaaaaatccaatggaacggtaccacctcagaagcattttatatatatatatatatatatatccaatggtctctcgatcgccacaaagcatgcaaataccagctagctctagctctctctctctctctctctctctctctctctctctctctctctcgccttattctttcactccctaaatatgaaatttttttgaggctcgattaatattgatccctatatcgagtatattgtttgtaggctttaggcttggaccatggggtagttggaagatggatcagcctagctattgaactagtagcttggaccgtagtgtgcgactgtgtgcgccacagtgaagcatttgttgagcaacgagcgatgcaagaagagaccggactaaacaatgcaatgcagttgatgctcctgcgatagatcatgcatgcatgctcacagtacaggatcccgaatcttctggcaattgagattgagtgattgcgatcgagcaatcgtggggtgagccagtctctaccacatgcatgcatgcaacaaaggaggtactctacgtaggtccagggtgagtccatctttggcactgtagttatggaagcgcctctcgcgctgggagaaaatggcacgtaggggtactctctctaagctgggcatgcaagtttgtgttttgtttggttcttcttcacccaacataagactgctcacgacgcatttgttgccacagttaaaatccgattccgtgttgtacacacacgtatgtataacgtcatccagcaggctccgtgcaccggggggattcgcggaatcgttcggtgaaaaggctattggtcactcaagagtcgagagaccctccacactcaagtgtagtactagtacttgccaagaacggcaaaggagcgacgacccttccttacgctgttacgcacgcaatctccgtgccctgctctcccctgttgcgagctactccacggagtatagagaaatggagaagaaaaagatatcatcatcgtctcaatcattcaccgttcgttgggacgtgacggggcggacagatgtaggagtacgacgtacacgcagagacgaggtgcgtggagtgcaaagacgaggaaggcgtggcgtcagccgcaggtcatctccgccggcggggcgcgcgcgatggtccacgctacatacgggcataccgctagcagctactccggccgcatgcgagcacgcaaattgcgaggcacacaaagccgtagtactagctgcatgcgctcggtggggccggtgttctgcgcttcgtcgcgtggggcgccgcggtaaggtcacgtgacaggcgggcgggcgggggcgtttttgcaccgtgcattgctgcacgtcggtcgcagcctcgcaggcgggatggcatggcatgcacgcgcgtgacgacggcagttggcaggcaggcaggcagcatactctctcgagcgccgaggccgcggcgcgagcgagcgcagaacggagaacggatggatggatcgacggctccacacaattaccgggatattccatcgcattcgcatcctctctctctccccgctcgcgtgacgagacgagcgtttcccgccgaggaacgcgtgacgggaaaggcgagccatccattcgtatgcatctaccgacctgtagtatcccctctgctcgctctctctgcgtacgcacagcctggcaaaacggatggaacgcgcagcaaggtgcagggcgcctgtgtacctttttttttttttgtttactcacagtcacagcacttacagtttacatttgggttgtctgagggagcttgggaccgttaacgttcgccactaaaggaccgattagtgtagggtccgatctagccgcattagtatcgatcggttgcgatttgcaaacatgcattgacaaatcaaagtgatcaaggcatcatatagagagccaccgcccaacgttgagatcaacgggaaatacgctccggatatctttctgctcagagtaaggctaataatacagccgacctgttggctataagattctttttatcattctctcagcctacccatataatagttagctctttacaattaatataggacccacttatctctctcacagaggttcttatgtccaagccagctgtaagtctacagtccgcttctcctctctctccttttttctctcatccgtttagacagcttatagcctgcttgctcttatatgcctccatgagccagaggcgggtacgtcgcaatctgatatcgccactctgctagctgcttcaacctccgtagggtcaagatcagcaacgtgtcgatttgacgttgcgtggacgcgggctaatgatggccccatgataggcgtggctctcccgtcgtcaaaaccggagtgaaaaagagaaaagatgccacatccacgctactacagctagctgcatgccgtgccacgccgttcatatatgcattgcatgcatgcaaatatcactcgctagacgctagcggtcgcgtcgcgtgtgcttctcgagttgtccgtcgtgcgatcgacgggcgtacgttcttcgatccccggagatccggccgatccggccatggagctgatcgacatgaggtgcttgcattgcattgactgacatcgcgcgttatgccgagccgcactggagtgtactccgtacgcgatcgtgccagtaccggagcgagactcaattttttatagttgccagtgacctcacgtacgtcgtgcacagttgccagtgacatcatgtgcaagatgcatgacgacgctgcgccgtggcagttctattcaattcatgcgtgctttggcagtactaagcagctacgaggacggcaggaagatacacaggagctatgccgatgctgcagggtacataaacgctgtagttttacatcgacttctccctgcctttaaatcgaaatgtaccgcgtcctccggagtcccgatcgagctccgattggaggagtgtgactgtaggcttaattgtctcctagtactgtctcctgtcgcaagtaggagtagcattttataacgacacagtcactaactaagatactaatttgatcattaatacgtgtatgacacacatcaattatatagtaaaattataatattcaaaaactaatttgaagataaatctagctatcattcttaaaaagttgatacgaaatattcatgcctatactaattgaatattttatagcttccacgttaaccataaatattgatataatatcgtataaatattgatacagtttatcataaaactacgatcgtgtataaaattatgggcttcttaaggtaacctgagggcctctctaaaagcccatcagtatatatatgttatgagttatgacacaagttaaaacgtataggtgcatggtagattggacagaaggtagatgtcaaaacgaatattgttggatgagcttttagaaaagctctctgtttacctctaagaagcccgtgattttatacgcaatgtacaagttttacgctcaattaaataaatgaacatatctctctcttatatattaactcctgtagtctcttttgacattgtgaatgatctcagttctgtacttttgatcttcaactcttctaacaatataatagagatttgttaggttttagacgtttcagtcacctaaacttgcattgcgaagcctgaaattgcaatgctacacaatttgcatttttttttgtttactttaactgcagtttgctactatatactccctccttccctaaatgtttgacaccgttgacttttttaaacatgtttgaccgtcgttttattcaaaaacttttgtgatatgtgtaaaactatatgtatacataaaaatatatttaccaataaatcaaatgatagaaaaagaattaacaattacttaaattttttgaataagacgaacggtcaaatatttttaaaaagtcaacggcgtcaaacattttgggatggaggtagtatatggttttactttatttatatctaagtttgagcttttttttcatgtaattttgtagtatatctttatgagctataggcttaattcatataattttgtacttttctatttgctataatttattattcaaccattagggactgataagtataagtaataagggaatggtgagaaccactagattgtcatcaagggatgagaaaagttattgaaattattaaaaatttcaggcacctgaaatcttagacactcccaacataataaatccgcaaaaagctaccgaatcataatgtttttaatcttccttatttttcatatgaatctatcatattgttactttcacatagcaataattttatggagtatttgtgaatatgtagtgtccaaacatttctaagtttagtcgtatatatattcgaaaacgacgtacaaaagaggaaataattaataaaagaaggaaagaaaaagaacgactaggatttgatccgataacctaatgacctatcagatcttgagcaaagtaaacatgcaactaccatagagatacttctaggacttcggttaatcattaggaggaagcaattagagaagattgagagggattaacttcaacctaaataagtatggaattactcctgttaaatctccttcaatcttctttgattaaccgaacaaggcctccttcaatcttcttattaaccgaaaacaaggccaagcattactaaatcttagtggacgcacataataaatagtaaagttctctaaactgttatccagatccctatactctgaaaatgctgttttagatctctaaacttgctgatctgatctaatctgcatactctgataaaaagagaaaaaggaaaaaaaatgtgggccacttatgggagagtgggaaagaagagagaggaggggaggtggcagccacattggctccacgtaagataacaaagaggacatggcaactttggatcgggatgacacatttaaaataagaacttagatctatatattttcaaagttaaaagaactagatgacacatcatgacaagtttaaggactgatggtgaacttcactcttttcccattttcttaaaagaaaaactgcattcagcaagaatacatacaaagcttattgacctttcaatagattggaatagcaattcttggaaatctatttactcaccgcgcataatattacaatgcattcacttgggatcccccaacggactataaattgagtgctttgcagagaagcacctgcagcttatttggaagataagagtgcaatacaacagacctaccaagtaggcaagtcctactgataatcaacttgctaaaatatgggtaacaagaaaaatgctgtgataactccactgaactaaaaaacaacactaggtaatgactagaaactggagggtgttggtgtttcattccttgaaatcgtctttgtcatttgctggaagccctctgttcctccaaaaaactgcaagagcactccctccaagctgttacaatagaacgccttaaattagacattcacgaactccagcactcattatataaatatgagatggtatttgctattgatgtgcatgcttgtagcattaggagaaaatagaaatgaaacgtaccgccatgcatacaacactgacagcagatggaacagctacgagtggattcgtgaagtgcttttgggcaagtaaaaatccaagtgcagaactctggaaacaggaagagacattgttaagcacaaatgtcattaaaaattacagcgctctattaaaaattactttgcatactactaaactactagtacttataacatcatcaagattcaagcttgtcaacagcctcgtttcattgctcgaagctcaatagtgtaaaactagacatattcatcctgttatcttggggccttctaatattcaccataattaaacagaggaaacatgttagcctaattaggtggcaacagaatgctgcagagtgctgaaattactgcataagtaaatgagaaactacatctaaacaacaccagcacaatagactgcatgaaacaggcatgttgacttgattatgcctttctggcatgaggcatccatagcaacgataagaaccattaaataaccaaagactgtacaaaccgcaggttctggacaataacagattatatctaagacatttcagcatttatttacctgcatcccgcattcaatagagatagtcctagaagttgattccccaaaagaggaaacttttgataaccaatacccaagtgcaaaggcagcaacatgcagcagagcaacgggaattataagttgaccaccttgagctttcaacacctctgagacttgtccgatctggaaagaaacagtaaattcaagtaaacattgtaactaagttatgtttcatctagcctcatctagccatttacaatattcaaaatgaaaatgaagagagcagcaatttactcaaaataaagaacagacgataatacatcataatcagataaatttgcaaaatttgtggagagcctaaacaatcagcaatgtatggaagtgaaacagaacacggagttgttttcagacttacaggactagcacaaagcaaagtggtgaggagaaccccaatcaatggtgttatggatataatgcgctcagtaaacttaggaaaatactcatgcgccaagactgcaaaataatggaaataaagtcagtaaatctgtcaaagataagatcccaaagtacagcacaacaggtatccattgggcttctttagtacctccgacaatagttggcagtaaaacaacctgaaaagtactgatggccaatccctggacagatgtaattttcttatactgatggacacttgataaataaaaatggattattagttggttttaaatatgaatcatggtgcccttactgcagcatcgacaggaaccagttgaccagctaggagtttagtaaggagtggtgtcatcactatagcaccaatagtcgaacaactgaaatgtaaagataatcacaattagtcagagtagaattgggagcatgacactcaggaagaaaacagagtatctagggtgtgttctatactgcactttcccaacttctactccctctttttccgcgctcacgcttcctgaattgctaaacggtgcgtatttcgcaaaaaaattctatagaaaagttgctttaaaaaatcatattaatccatttttcaagttttttttaagctaatacttaattagggtgtgttctatactcacctttcccaacttctactctctcgttctccgtgcgcatgcttcctaacctgctaaacgatgtgtttttcagaaaaaaattctttaggaaaatagttttcaaaaatcatattaatcaaatttaaagtttttttagctaatacttaattaattatgtgctaatgagtcatcccttttttcatgccggagagaggttctgaaccatcggtgtcgaacgcagccttaatcatgagctacctcattttccgtgcggggagaatgagttacgaaccagcacaattgaacacatcctaagtggtttctgtattaaaatcaaatggcacaacaaaatagcagaataatagcacataggcaaaatagcaccgtatgccctcaattccagcccttaaactatactttgtccaatcaagccatgcatattaggttgttttgcttacacgactaaacaaaattgtgtcaacattcattcagataataattacatcaaactataatagttttggaacatggtcctatcatccaaaaaaagagtttatgtatgaagcctgccatgaaaacctactagaaaaggtacaaggtagtaacattctttaaacgcttcatggctggaagcatgtcaaattgaattggcatgctaaaagcaatctgtgaactaaatctttggaatcgtaaatagtgtgtccaaatttgatgtctcaatagaaagcttgttgagtgtgtaaccatgatatgcagatattttctacgcatgcgagtacagacaatacaaaagtgttggcatcaaataaatatgccggttaaaacttgcgaaactggtaacacatacaaacaatctaaaccaatgtattcaatatttttgagactggctagcatgaaaatgtgtcttccaagaaaaaaacgggtaatttaccatgataacagaatgataagagcacaacagaaatcaattataaaggctgtcactctaattagggataaagaacctcaagaaagatgaaggtacatgtataacaagtagatcagaacaagcaccaaagaaatttcttctcaagcaaatctgaagcttacgttgtcataagaactgaaagtgcgacatttcctttggatatataagtagcaacatttgatgcttgtccaccagggcaacatgacactaaaataagaccagttgcaagaggagcagataacttcaaggtctgtaaaataaacatccatattaggttgcacctaaatatagacgtcaaatttgtgcagatatcttagtgaaaaaaaatgcactagaaggaattttaggttcaaactttttttgcaataaccaaagagaaacactataccactgaaattgtattctatggattcaaatagacagcaatggaaaacaaagaatgcagataacgggtagagtttacatttgatatgataaaattgtatcggctaccctacatagattaactttcttcacataaaaattgcaatgagatgagatatcaccttacaagggaaaaaggtaaaattaaatggaaaaacaaaagaaacttgagatacgtgacatgctcaaagtatccaagacacaggaaatgaaaggaaaaggtcctaaaaatgaaaccagagaacaatcttgaacctttaaaaaaatctttgatgttgatcttgaaccttcaaatctttaaggttgctttgtcagatcagtttattgattattgatttaatcaagacatcaacctttttaatttaattacaattaacatttgcatgaaaaatctcatgaaaagaaaccgtagcataatggcatgtgcatcttttcagggaagggcttgtcaaatcaattatttctttgagcaaggcaccaacctttcaatttaatatttcccagagtttacatgagaatctttaacaagcctgtttcgcatgaaaggaaagcctagcatagctgccatagcagcatatccaaacaaaggaataacagattgtgtttatttcatttttttgttctttcattagaaataataggaaggcatggcctagcattaccatggcaatagcaaatcccagcataggtttgatcaaatactgcgcaagaaatcccacacccacctgcaacaggcaattgcattagtaaacctatatcaagttggaggcctcaagtacagaaaaataatcactatttctttaagagaagacgttcaggagcagaaacatacagtccatggattcctcatgcatctcctgaaatcttcgaaggtcaatgttagtcccattgatagcattaggaatcctaggcccacagtgaaaagatcagtctccaaccaggtaacctgaaagttttccaagaaaactataaagtcagtttctgtggcatttgctgttgagtacagacagtaatgggtattgtcaagttagaaattttaccatcgatggcttgtagatgccaataatggtacctaatatgacctgcaaaaggtgagctctgccttagtacattttttaatatttgctttacaaaccaccaaatgtaacagaactagaagctaaaaaagggcagataaaatcctcaaatgctcccaaatcaacttacccagacagggaaaagagtggtaagcagctcaactattttctcgtactggtttgcttcactaggaatgctctctggcagattactggatatgttagcttcagccttgcacaatagttgacagcttctgaggaaacaacagatcatttcatcattaccataagtaattaaaatcagagcaacaagtgtttaataatgagattattcaagaaaggccagcaatatagttttgctgatctgtaggatcattaatcatgtggatgaaattgcactatttaaaaatataactatgtggcctgtaaggaaagcaagtatgctagctatcacgccttgaaatttttggtctaattagtagaaaatttaattgcaaaaggtactgggctttttttctcaaatataaactactgaactacagattagaaatgccataacactaaaacataaggtgcaacagaaaaatggtgaaaacaatcagattaggggattgaagaatgggtcatgattgcactaaacagaacagcaaatacttcgactgactacagagacagaacataatactatgagaagttccaatcaattcactttctatcttgttctgaggcatgcaaatatagtccagaagatactcaaaatatagaaggtaatgatgaattttcccttaaacatcgaaatgcaaagcttagaaggataggcacacatgccaccttgcttaaaagcatacaatgaagttcaacagattgcatgactaaagtaaacacaactcacacaactaatccactgagttaatctagttgggacagctgaaaatggtagagcaagaacttttggccaccgtgattacttacaaagtcactcttttaaaagttttttttttttgcatctatagcaatgtttagaggaaatttgagaattgatcagttgctagcgtataccatgtacttcaaattcaccacatgcagcatacccattctatatggttattgaatagttcatcaatttcatcccttctagtttacattttacttccttcaaaagcattactcatactaaatgactaaagccagtattttagagttgttactgtgttttcatgataacattaagatacctatacttccaaagggaagtgttcataatgaaaaaaaaactttaagttctgtgaccacatgggaccttggttggagcacatcaccagaaggatattcaggattctccttttacaataagctgcagttgttgaacccccaatcagcagcctttgcagcttcagatgggacttttggttaaagtagcagagaaaggttgcagcacctacttccaattagcacaacgtgactagtgaacactcaacaaacgcagtttgtgttgaccaagtcaaaccctgatctcttctgtaattgggtaatccacgacctaaggaaagcaattccccggacccaataaacatcgacgaggtgctcatacggcacgtacctcagagccggagcagcagtggtcgccggtgcggacgcaatggtcaatccccattcttccttctccttcctaccatagcttggcatcgaacaaacgatccccaatccgccccctgcgtacaagccaacatccagctcagagggatggaatgggaaaaaaaaaagaagcaaaagtctcctccaaacaggctccaacgagcgccgtaccgagacgagcagccgtgcggacggcggcggaggcgatagcggcgtgcggccgcgggcggagggctcgggagacggacgccatggagcgagcagggcaggtggtggacgccgccatgtggaggacgcggggcgagagagagagacgtgcgtgactgctgctggtggagttccggaggtcgcggaagtggggggcagaagggtttaaggctcggagtcggagcgagcggcggagaagcggcggtgctactggtcgttgtcgcgtcgaggaccgaggtgggggcgaggaaatcggggtgcgccgggagagccacacatcgggggcggcttggccgcggcgctcctgtggatcaggtggctccctccctccttgctccgctcctccgccggcgtgctgctgacacccctggcccgcaggaggagtgcgggcgtcgtctcggtctcagttccgacggaatcactggaatgctggatccaaaggaaattcccaaagttcccggtcctgcgggggcaggccggcagctaggatgggccggaccgtgacaggaagtgcataaaaggatcatcaaggcaatgccggtttacaacagtgtttaataacgggttctcttcgttgtcatgcaagtaaatttgatgacgtggaaaaaaaaaggaaagtatggagaaacacattgctacgcatgacaacagctcaggggtgactcttgacatttattaatagaaagtttgttgcatgagggtgtagcaaaagaaagaagtataataaaaaaaatatttatgcattaatggtttagaaattttattgtctctaatattgtaggaggatagtttttagtgacattaattaatatagaaagctgcttgtagtcgtgtttatacttttcactcttttttttaaaacacacaggttgagcactaataagattattttttttactgtttttaccctatgagcacatcgactggttggcttggcatatcttgagaaactggaaatatttcgtatcgtttttatctctaccctcttgtaaacaaacaaaaaggaaaaaatatcttggaactcctgtatatggagtaggccaatccataagcatttgaaaaaaaaaatctagcgtgagcctcaatttcttggaatttcttttagccgttcactcttcaagtaaatgtgcaattttcatacgaaacatccaaaaatgcaatcgagtaatcctatgttttatggattggttttgttgactaatcctgtattgttttttttactcctatattatcggactaaacaagttacaaacttttttgtggggaaagggatatattactcaggacttaaatcgtccaaaacaagacgagaaatacaagagcattcatgatctaaccaaaagacagacaggccctcacaacggcctttatttgctaataaatgactgactgaattttggctgcgatgaattttccggagctgaatctccctatcaccggataacagttctgtagcttctttcaccaaaaaagctacctcagacatttccctctcctttgattcgagcatctgcaccaccatcaagcagtccgtctccactacaaactgtttaagcgaccattggagtcccacgagaatgccctccttgcaagctaaaatctctgattccagagcactaccacatcgaggcaggtgtttgcagcagccgaaaattaccttcccgctccagtcccgcataaccacgccaatgcctccactcccagtttgcgcatcaaaggagccatcaacattaactttcatccacccctcacacggtttcctccatttttgatttttatcctcagaaggtcgcctggctggattggttttcccattaacaaaggaaataacatgtttccccttctctacattcgcttgaggatgttgccggatctccaacagtgactttacatagctctccaggaaacgcttggaagcttctatagggggtggttgcttcccatggacgatctcattccggacaaaccaaatcctccaaagaatcagcaggaacacagttcgctcataatccaacaggatttccagttgatcaaaaatccaacccgggtcattgcacagattacccccatttagagatatattacccgcctcacacatggccccccataggttcctggcgtcaggacatctgcacaacacatgcttggtgtcttccttttctaaaccacacactaaacatatatcagattgctccagcttccgctttgctttattctccattgtggctagacaattggtggctgctctccatgcaaaaattctgaccttttggggggcattggtctgccatataagattccacattcttttgcatcttgcggaagaagaactagaactggtctccatattaacaaggttacatgcgagcccatatgcgcttctcactgaaaatttgccatgtttatccgggtgccatgctacaaagtcatcttcttgccgtgaggagacccggatactgcatattgcttcagcatcaacaggtaagaacacctggtttactctggtttcatcccaggcaccattttctgacagcagttccgagacccattttagtctgcagttacctttacgcgtgattggccgtctggaaaaatcccttggcaaccaggggtctctccaaatgcgcactgacttcccattcccgattctccatataattccttccttaagaagtgacagcccatactcaattgctttccacaccggggaagcatttcctccaaaacttgtatccacaagggaaccatttggaaaatattttgccttgagtacccttgcacatagactgtcaggattaacaatgagccgccaggcctgccgtgctagaagtgcttggttgaagagacgaaaatctctaaaacctaggcccccattgctcttcggacgagttaaacactcccaggatttccaatgtgttttccttttccccttttctacaccccaccaaaaattccgtgttaacttggttaactcctcacatactgactccggtaggttaaagatgcccatcacatataccggaatagtctggataacggattttataagcacctccttcccgccactcgacagcaggttttcgccccagataataagccttttccagattctttcctgtaaactttggaatttccctttgcacattcttccttcaggggttgggaagcccaagtatctgtcctcaaaaccagagttagctatttgcaaggtcactctaataacatcccgagtctgcggcggagaggattccccaaacatgattgagcactttgccgggtttatgagttggcctgttgccaaagcataatcagtaatgacctctttgacagcctgggcttgaacgttatcagctttgaaaaacaaaagcgtgtcatcagcaaaaagcaggtgtgaaatccccggggcctgcctacaaatcttcactggcgagagagctccctgagccactttgtcttccaacagcaatggtagtccatcggctatgaacagaaacagaaagggggataacgggactccctgacaaagaccgcgtgatggagcaaaagtagagagcagagttccattgaatttaacagagtatctcaccgtggttatacaaactattatccatctaacccagcgatgagcgaaacccagcttatacctccaaaaaaccccagtccacccgatcataagcctttgaaatatcaagcttataagcacaagcagcgttctcaggctttctattcttttgtatggagtgaaaacattcaaaagccaaaatcgcattatctgtgatcatccgacccggaacaaacgcactttggcaaggcgaaactaactcatccaggataggtctcagtctattgacgagacatttcgatacaactttgtaaatgacgttacaaagactaatgggacgaaaatcccgaagttccataggttgctcaattttcgggataagcacgaaagtactgcgcatattcagtgatagtagctttcaaacattctcagaagtcaatactatgtttacttaataatgttacaactcgtaagtacgaatagtaaatgtttctttatcaatgtatgcattgcacttcttaatattaactctattgttttgtttaggcaaaggtttgagagatatgtgcagcttcctgatttttcatgtcggagagcattgattgaggataaagttagaagatttgtggtatgtgtcttgagtaatcatgttctagtgctataatatataattgactcattattttaattcacatcgtatattttggttgtcttcttcaaaggtaccaaccaatgttaacctggatgaaattgcttaaaaaacatacggttgtagtagaggtgcccgactgagtttggagagaaggggattgggaagatacgtaaaacaaggtgagccattagcgtataattaattgagtattaactattataaatttcaaaaatagattaatatgatttttaaagcaactttcctatagaaaatttttgtaaaaaaacacatagcaaggtttgcgacaaagctatgaacaatgcttgaaaacagagctttgctcaaaagtggagagaactggaagtttcaggttgctatatgcgactttttggaagctgtaggtgaggaagatgcgtatgtttctcctgcggatattgagctctattcaaagtggttgtctgcatgccgatcagtgtaacaattaacttgttggaattaatggatgggctaaagcccactcaaagattaatttttgaaaaatcacaaaagcccacctcatgagatggcatacatgtggagtttagtaccaccttgcttattctaggagagggggacctccttaaaagggaggaatgcctcctagccacttgaagcatgtgtggtggagagaagagggggaacacacgctcgctcgcttgcttggcttggccgtgtgtgcacgacgtacacgtcgaatggtccgcaaaattggctcctcacccttgcgcagatgcagccttcttttgcagttttgttttgctgtaggaaattcggatttgttttgttttggaaacatttcgaaaaatccggtgcgtgaaaacggcgtggagtccgaataagttacgcgcgacttatccggttcggtgtggagtccgaataagttacgcgcgacttatccggttcggttacgcggagtggagatcatgcgggcgccctgatcaagcgacctatctctatataaaccgagtcgccaccttcacgcaacagacacgaaatcaatctagagtttgcctcctactctgtactgcgccgtcgctcgtagactactccatcccgctcgccggcgtgaaccggcaatcgggagagcaggtctccggaacctctgccttcgacgtcctgcaccgggagaaggcggcaataatatttttcggaagcgcttcgcgtgactgctccctgttcgtccacgacggctcgccttcctctccgctcgcgtgccgtgcgccttcgtcgacgcccgcaaccacgagtagttcctgccgagaaactggtctttccgccacctcggtacgtgttcgacatgttgcgcatatttgatctgtttatattttactgcttagtttacatgtgtagatctaatgatgcgttcatggtagtttacatctgcaatgtcatgatttatttatagaataaattaaattattatgtgctggcgattcatctcacactttgtatactgtgattagatctgatccgtagcagacttcggtattttgtttccccgggtatgcttatggttcttcctttattttaaggatgtcaccattaattaatttgcgaagccctggcctggaaaaaaaaagatacgtggatatgtaaatacagtatttgtggtaattgaattgttgtctgctcattgcgcactgttggtatttcttaacgatattactagaaacataattctcagcaatggcgcagaaatacttctggtatattatggttacagagttcatccgcaagcgcacggatataccattgtagcatttcacctgagagtattccaagggtatcgtatttattttatcccgtgggaagatcacgtagagagaactcaactaataatttatatattacttgtgataatcatattctaagcaggggttaagataatccaagggtagagtgacacttaagcatttctactcatcctcataataaataatctaagctgggtggaaagaaaagagaaaggaaatctattcctatacttctaatatacaaattatacatacattctagttaactgatatactagctaataccctctatccgatgcccttctggtacttcgaaaagccacccctgactgccgagttccttacgatagcccgtcatgaccatccaaccggggctaaatacggaggagtaccctccccaagaaattaacttaggagtatatataggcgcggaggaatacccctattgagctgtcaccatcagcggcccacctctcatccacaatatataaccccaaataatgatatcctgtaatctagacaccacgtttaaactactagatactactctaatatcatcgtcatgacatagagtaattgcatatgcaaacactatacccgcaccaaagcatctcctagataagttagcagtatagtcagtataacatgaatataatgtaaagtaggtactcatatactcagaaagtattccaataccataaatgtatgtagaatagtattctaatcaaagtacaaagcttacaaaagagaaaaggaaagctactagagccatacccgaactcttccgaagacttccggactcctgattcctattctaattctattcacacagctagatactactaaactaacttgagaggaatgatagagctcttgcttgaggtgtgtgagtgaagtaagaaggtgaagtccttttatagcttcaaccgtcattggggcttcatctcgaccgtccagccaaaacctagatccaaccgtcattggggcttcatctcgaccgtcattggggcttcatctcgaccgtccagccaaaacttagatccaacgaagggaagggtggttcggccgaaccatcaggtttggccgaacctggggctggcccaatccagcccaatttcggctggcggcctcctctgctgcttcacttcgtagacttgtgaattttggcctgattcatcgtgtcaattctgagttcttggcccattcatacacaagtctggttctcgacatcgtccgattaatttatcgtctgagttgatgtcgattctccttccacttttattgtcattcttctgcaaaagggttagtaaaccctaattctagtggaatattattgttctaacatatttatgcatggcaagcatcactagttctcctctattttggtaatattgacggtcgaaactgatcgataacgaccgtcaacacgcaccggcctcacacgacctgatttctaagatagtttggggtgcctatgtcttttgttagttctcggacaagtgttccattggcgaactacggctatcgtatagtccgtgatagctgtccttcgctaatatacgtattatccatttacacatgtgatcccctcagcttacaactgcctatcacctatcaacctctgttcgactactcattacaatggcaagtgcatctttccatcttaggcaatgtgggagaagtgccgatcgtgggagaatcttgtgaaccccttcaggatctacacactttgggatcgtgcattacatatgcgtgcattacatcccatgtgaatgcaacaacatttctctgtcagttaaggtttgaccaagtattcgtttcctttttaatcaccaattttgttttggctagagcacatgtgtgatttttcttttcttcccatttgctaccctaacactcgcccgtgagatgcagggtagttctcccttcgcaacagaaccattcttttattaaaaatatttttttcaaacattcacaactttatacctctcccgtcctctacgagtccattctttacgaaagaaaaatattctctagaagggtgtttttttataacgtggcaagcatccgctaacatgagctaaggctctatttctttcagtttagaattattataatctaaattattgagtcagattactataagctagattgttataatctgtagtataatatacggttagttgtttctttcctagatttttagagcctagattattgggtttgcaagtctaaagagggagtggggtagcatggtgggtaatttttcacccaataatctagaaaaagctcacataaatgagcttaccatattataataagctgggctccagattataataagctattttaataagttgtatgtttctttcagcttaatcttaataatctagattataataatcccaggctgaaagaaacagggcctaagtgctgccatctagaggttggcatggccattttacaagctgctcccttgcaagttgcagcctttctaaaggaatacaatggaaaactgtccattttgcaggcctcctagagcgcttaaagggggcaccttggaaaactgtcgattgccaagatggggtgccattttgcaggcgggtttgcctacaaagtgcttagcccccgatgatcgtctaatagcacacaccaacgatcgtctaccacatcgtaaaaaaaagctttttttttcaaaataaaaccctatggggtttttgaaaaagtcctcgcagagaacatgaggggtggtatagatttgttaaagtttgaaaaaaaaacattttgtaaatattttaatataaaaattcttttgcaacacatatagagctcctaatggttgtggttcaattttttctagaagatgatggcatgaacgaagctgggtggcaggagcagcatcaaaaagagtaggaaggcggtgactagcgagacataagaactataaatatttgaacctaacaatgataaggtttgaattttgaaggtatctaccacaataaagagaagggatcataaccaaataagtgaaggggaggcaattggtgagacttctaaaatctatcaaaaggaaccccattttcatagtcgtgatgacgatgaagaggatgattgtaatgacgcgcagacgagcggaaaggggtggactggtggataacatggtagggttaacgaatagcaagtgtcataggggctcaccaaatttgacgaagatcaagataagaataaggaatcctataaaagatagtttttttaaaaaaaataatataaattcgttgctgtgctagccacataattgtgcgggttaccctgctaattttatattatactcatcataattaatatgattttgtatctatatttatggtttgccatgccataatttacgctatatccttccatgcgaattgtccttgttaatcttaagtacatgcaaccgttccaacctgcgaatggtgaagattaagtagatacacgtaaaacaagaatgtcatgagcacataattaattaagttttaattattttaaacttaaaaatagatttatcttatatttaaaagcatcttttcacatgtaatacatcatttactagattgagaaatgtgttaatagaaatcaatgtaaaatctatatcttgggtgggtggaggggcgaactggattgggggatccacgacgaatggaacagaatccagagatcgcatatcagcatccatttctggtccaagcggcacatcagccccgtcgcgtcgtggtgcatgccttcattcgcacgaaccgtcgccatctaccgcacagtgcataacaaaccctgatggcaaccggcgagcacaaatccatcctaccggcatcgccaaacgggaaaagcacccacctaaaagtccacccggttcgtttggccgtcgcggcagcgggaagaaaagaaacgcatctcgcgcacgcacccacatacttaagtgtttttctcgaatttactatagtcgacaaattttcctccaaaaatttgtcagatgtaattacagtacaatcgtagtgtaattacactgtaacttgtatataattacactgtaactataatgtaacttgtatgtaactttcaagaatctctcggtaacatgttatttcagtaaaatagaggtcgtgggaacaaatcctttcacatgtgtgtgctgtgatttttttcttccttaccagaacaaatcttgtaatagatctaacgattcaaaattatgtgaaacttacgtacaagttatactatagttacatgcaagttacagtgtaattacactacgattgtactataattacatctgtcaaattttttagtagaaaatttgtcgacaaatgtatagatggtcccgtttttctcgtttcctctcctctagctaactctctcccccggccacgcctgccggtctccaatctccaggaatgattccgacgtgccgcacaatacgacgctcctgcctgcggtaggcgaggcgatattccgaattcccggtcgagttagttaaagctgtatgcaggaagcaacacatgattgcatctatcaggtgttgctgtgtgtgtggtgtgactggtgaggtgtggtgtggttttcctaaggaaaagacgccgctgggatacagatcgatcgatcgatccgatcgacgcggggtttgttagctgagcaacctgagctcgcggacagggactgacccgtaaaagcaaagcaagctaagtttcgctagctcggatcgatcctctttgcgctgtggtgatcgagtctggtgactagcccttccaggtcagtgacagaggccaggcgcacctcacctcagtccggtgcaggggctcctcgtgtagggtggtcccaccatggttcattagttgttaagcaagtagtaataactaatctgatagtcacttatctgtctgtcttgtgccactagtgaccaccgacgtagctgcaattggtccatggaccttccctgcgtggatataatcatatatatgaacgtgtttaatggctttctgtttttttttcttttgtgaacggctttctgaataatggctttttgtaagcaaagaatatgggcgcatatctaccagctcagtgtaaccgctaattactccatataactgtacaaggaagagggccttttgtaccgttgtaccgagtacttcgcttgtaggagtacgattagttgccacgatagagcgttcctgagtcaactgaggtgtggacttgtcatctttgtcgacgtgacgacacgagacacaaaagtactacctccgccctaaaataattacaattctatattgtttagcatatattaaggtttgagaaaaaagactatggtgctcctcattaaaagatgtttatgtgagagtggaaagatggttgagggtataatagagagaaatttgaatgagagatgattgatggggcaattagtactctaaaattacaattattttgggacaaagtttaaatcatggaaatacaattattttgagacgaaaatagtagccaggtaggcatgttggtccgcatcaagggaatcgatgaagtatagttgaaggaattaatgttagagcgtacttcccgtacgtgatcttggcaggattaacgtttccagaatcagatgggaattggtaccaaatatcctgatctgaaaatgttccgcgcgtcgaattccacaacaggacaatactagacgagcgccgcatacacacagacacactactctgcctttctacacatacaccggacatctttctgaaatctaaactgtagtttctgcaaattaagcatgcattgcatgtgctttagcaaaaaccaaacggctctccgccatgccagataagcaaagcttgaggttgaggttgaacatacagtttacatagttataaaaattcaaaaaatataaaagcacaaatcgcttgttgtatatccctctatcaacatgaaaaattaagcttaattcacacatgaaaaaaatttgaaaagaaggaaaaaacaataaatttagtgataaatgtttttgtttctttgtgcatatcgaatttgacattactataaatttactccctccatccaaaaaaaaagtttaatcctaggatgtatttgaacatgcacattgtctagatacatccccatgattgattttttttattctcttgataggagaatatgtatgaatacatgacacaatcatctatacatttcatatttgcatatccttttttgaaaaaaatattttaacagtctaaaccctagacaaaaatgtttacaatgttagatttgatgggcagttgaggtagccacggtctcacggaattccctactatacgctgcagcagcgctaacgaacccggccgtgttggggacttcgggtacgggcgcggctaattccctgttacacctgccgccccgctctcgcagacgcgcgggccccacggtctccccttctacagtttacgctcccccgctatataactcagcccgcgcgatccccgcaccaacctcctccgtcgtcctctcccccgaatcagctggtctctagcttcgatcggcactgccccgagaggtaattgcatcgaattactcctccacttgatcaggtccaacattacaagctcgatcgatacaacagctaggaatttcacgtgtgcacttgttcgtaccaagttgtgtgaaaatttttcacgtttgtgacattttccgtccgtttgttcgcggcggaagtcaattggtgtccgtcggcaatgcaggaagcgcttgtctccccggtgcgctcggcattggagctcaagccgttcaacttcggagaccagcggctcgcgtcctcgccgcgctacctccccagcggcgacgacgccctgtaccgctgctcctcccccttcaaccccagcttcgggttctcctcgccgtcgccgctagccacctccgtctcgctctcgccgtccttctccggctcccttgttgatgacggcgacgacgaaggagcggccgccgacgccacggggcagcggctccagctcgcgcgcctcgcgctgcagtaccaggaggtggccgaccgctacgagctttgcctctcccacctcgccgaggccgccgaaaaggcggcggcgctccgtcttgagaacgccgagctccgcgtcaccaacagcgacctcgccctccgtctcgcgctgctcagcgggaagcataccgccgccgtcgccgtcgccgacgagatccgtcggctccgcctcggcgagcagaaggtcgcggccgccaccaaggagcgcacgcccgagaagctcgccgtgctgccgaagagcatctccgtgcggtccacaagctacctcaagctgaaccagcaatcccaggccgccaccgccacttcggcggcccccaaccgcaagccccgcacgtcgtcgaacccaaccaaccccccgaactcggtgagtcccccgctctcgcctcgcgaacaccacggctcagcccgtttgatcggcatttgacattgttgcgcaccactatcaaatcatgcagcagcgcgcgtacgacggcggcaagaaaggcgacgagcagaaggcgcaacccgcggacagcggcgcggagctggaggtgtacaaccagggcatgttcaagacggagctgtgcaacaagtgggaggagacgggagactgcccctacggcgaccagtgccagttcgcgcacggcgtcaccgagctccgccccgtcatccgccaccctcgctacaagaccgcggtgtgccgcatggtgctcgccggcaacgtctgcccctacggccaccgttgccacttccgccactcgctcacccccgccgaacgcctcctcctccgatcctagctaaattaaggcagtgcgcggccagtcttttgcaccacctggatggtttattgctttcgcatgtatactatatacgattatacacacgaaaatgtacaaaaatacgaacatcgtaaataacacataagaggtacgtacagggtacaggaagccatatggtagagctagtagcaccgatattgtaatgtgaatatccacaaacaggattagtgttttcgtcagctcgatcgggttcagggacttcagattcgtcagtttgttcatattctgttcagaagacgtggtactataaggcccgtaaggacgtggattcgcaagtactacttcaaaagtgcaggtgtgaaatccccagaaagaaatgtggctgacgactgtcattttgttggtgtcatgaggctttttattaatggtatatagaggctctttgatagtttgatttcttcatactcgacccattgctgttactgcaattttccgttgaaatgaacagtgatttttgcggtatatacgtcggcatgttgctcacttgctcacagcaccgttcccttgtaaaaaaactgtgtaagaattagcgattctatactttgtgcatattgcctcatgacttaattttctgtttaaagtaacatattttaatatcttaattccaaatttgattgaggtggtgtgtgcgtgaccggccgcgagtggtagtggttgtggtggttagttggccaaggcactacgggatatcgccgtcaacaagtacaatcactcgaggtgattcttggcttagttctttctccaacttttccaattcacatccctcatgtttagcgtacgttttttaaactgctaaacgttatatttttttgcaaaaagttttcatatgaaagttgctttaaaaatcatattgattctttttttaaaaaatagctaatgcttaattaataatgcgctaatgagccgttccattttccgtgtgctaagaagcaacgttctctgttgttgggagctaatacatcaaacacgtaaaacggaacgacttattagcatataattaattaagtattagctaatttattttttaaaatagattaatatgattttctaaagcaacttgtatagaaattttttacaagaaacatgtcgtttaacaattttaaaaacgtacgcgcgaaaaatgagggatgtggttatgtgggtttttttattatttttatttttatttttattttttttagacaggtcaccgggggtcatgtgggctgtgaaaggaagaaaacgaactcagcctaaatgttgacgtgggcttccaattagcaacttggattattatttttggtgggggggggggggataatagcaacttggatttattggccactatgatgattgaagagcaaaccaaaatttcagagcaaattcacctctagaaagaaagatcaattcaactcacgttatgtaggtggcacggcagcgccaaccatgcttaaaattggatatacagacaagaagggatcctggacatatatagatgaagcagaagcaacttaaaaagcaacagaagggaacacggattttcttttctagggatgaaagggaatccaagggttatgagcgtctaataagtgccttctagccggtctggccatgcatat

SEQ ID NO: 33521 - DNA, 1306 bp, Oryza sativa
atatatatatatatatatatatatatatatatatatatatatatatatatatatatatattatcctctagtcaagttatggatatgttcagacttcctcaatctactccaaaagacgatactagtagtatacaagagttgttcaaaaaaaaaaactctaaaaagaaagtactcactgttccaccataggtgcagttgtagtttttcgtattcaacgtttaaccgtccgttttttttaaaaaaagttatgtccgttttttttaaaaaaatatgattagtatttttgttgttattagataataaaacataaatagtcctttatgactaacttattttttaattttttttataaaatttttaataagacgaagggtcaaccacaatagcacttacgatgaaatagagggagtggtatacaagagtccaatatgtggggaaaatgctccatactagtcccatgtgtggcgcagcgcgttggctgatgcttggcgggtcgtactcttcacggattttctatcatcctatcatatatgagcttcatatatgagcttctaggtagtaagttaaaaacgttttcttgcttttctgttcttccacgacgtcatcttaattaggagttatacatctaaaagtagatattaggaagagatagcttcatccttcccatatcttttatttagaaagtctcttcgctcttaaaaaagttaaaatactacttgtgtcgtttggttcaactacaatttcattggacaaaaataagagccgaagcccttattatgatgcgtttgatctcagttatttgatcggattacaaacatgccaataacatctgaactcttttcctggtccaagtagcatctatctggcgaaaatgctctggttcggacacccaataggaaagagaatatcgggtgctcgcaccccagtcgtccatgtctcatcgtccttttctctccttctctctcgatcttatccatttcccttctctctctacaccgtttctcttcacgcgaggcgcttctcctccagctctctctccgtatggcaacacttctccttccgctcctccttcgcaacggcgacatcactgaatgccgccacctcattccccgcctagccgtagtctgccagtggttgcggcgacgatgacaacagccggatccctagccctgaccctgcagccactgcagcaaccgcggcctccgccgtcacaacatggctcgggcccctgccaccgacgttgtgttgtcgtcgatgatctagccaaccaccggagagaatgaagcggatctaagtagtatttaggg

SEQ ID NO: 33522 - DNA, 1062 bp, Oryza sativa
aaaagtgatgtaactaacatatggtgcccaccacatgtgtttgccacatttcactaacattagggggccacatgctgaatcggcaaaaaccacttcctaagccaccgaaggagtatatttgcaccgctttccgaagtgggggagggagggcgtcatacccgcttttgtggttgatagatgcaatttgactagagtaagaaacaagggaagcaaaatagacttatttcataacctttcaccgatgagttttgcggcttcgagccttgcctttgaacaaggccaataataagttgccttaaagtttcaatgttctgaaatgagccaatatgcaagggcaaaaggccacgctatataccttgtttagttagcccatgttttccggtccactccacgttagtgggccacaattttgaactagattttgggcccatcgacgggaacgggttgggatcatggactaccaaactaatgaagatgaggtcacagatggaatttgctaggaataagaacagactaccgactactagttgccaaaatcaaagaagcatcaagcatccatgctacggtagtaagggtttgtttggttcacggttaaggttggatgggatacagcggtacatttttttttcatatggcaatccagtttttttggtagaatgaatatggcgatccagttttttgtttgatgtagggatgaaggtggatttggtgatctaattttttgtttggttgaagggagtatgatggatttgtaggtgtggtcacctcttacttgagatggtgaatataccccccctaatcaaattaatgcataatgcattttataaattctgtagcaattttacaccactacccctccatattataaacacacatataaaaagaaaaaaagaaaaaagaaaaaagcaatagatctagggctcactgccaccgccgcctctttccgccggcggccggcttccgccggctataggcttcgctgccgcctcccgccgacgcggctatcgccacccgcaccgtcgtcgtcgtcatcgtcaggttcgcatcgtcgtcgtcgccatt

SEQ ID NO: 33523 - DNA, 5516 bp, Oryza sativa
aaatgggccgccatgtcctatccatccatatccctccatccaaacacaccttaaactatttacgtcggatattgtcgaaaatgttgtctgtcgcgcgtccgatgggaggagaggaaaatcggactgtctgcgtgccactgcatgcatggagagaatcttttcccttaaactatttatctaatatacgatctgattgcaccactaaattcgttataattaaatctttacaacaagaccacacatgattatatttcgacaaaaaaatattttagttttttattaatttttttaatgttgcatatggtttgttttgatgtttaaaccagtagttttacaatgtttcagctagtgtactcatgatgtttcactatatacggatcaaatgttgcagtgaattttgatattatggaacacgccgttgcaacaaatcacccacatattttggaaaccctttattaagggaatttggtttatttttttgttccacaaaaaatgtttcatctagtgcattcataatgtttcactatgtatagatctaatgttgcagtgaactgaaatactccattgcaacaaatcacccacatattttggaaaccctctattaagggaatttggtttattttttgttccaccaaaaatgtttcacctaatgtactcacaatgtttcactatgtatagatctaatgttgtagtgaactgaaacattatttcgctatttgctgaaacattatttttatataagatgaaacaacgcccgatttaaacgattgaaggggattttctatctacttactgaaacaatttcgatatatttggtggaacatcgtgcaacattttaaaaaaaatcaataataagctaaaaaaattttcgtcggaatatatccatgtggggtcttgttttgaagatttagttgcaacaaatttaatggtacaatcggattatgatttggataaataatttaaaagaaaaaatcaatttaaaatagttttgcacgtaaatcggacgctgacgttagcgcccgatttccccatctccccttcggacaaccgacgtagtcgcgtcccggatattgtactgtggattgaatggtgcacacgattaatacacctacgtactgtgcacaatccactatatccatcacagatcacagggttggttcccatcggtaaaaatggctcccattaaaaagtgtaaatttagctcatgcgcatcgcacacttgggttatatttgccataaccgtccaaattaactattcagttaatggacactacattattgcgtatatttgataactaatcaaagctgtatttatggtgcaattgcatggatctagactataattgtttcaaagtaaatttggatttaaatataaaatataattctcttaaatccattccgagcatatatacatttagttattattgtgctccaatatatactcaatcggtctacactgcatatcctaacctaaccacagagtgtgcaaaagttcgtgtgcgtgcaggacgttttggggtaggtgggggaaggccaaagtccgccgccttgacccacaaatattttctatttcgtacctttgtattttaatattgtacatatataagtttcctatacctgtatttaatttcgaccaaatatcgtacattacaatatgggagatttacaatatatatttagttttcagtgaaaagtatatctctatatgcgtgcaactgatatagaacaagagatagaaaaatgatattaagaagttcttttagtaatagtgaaataataaagtccggacaatgataataaaaatgattataattaaactatatcttgaaccttaggtaatgagtgggaattgatattgccgtattattttgaagtgtgtattattcttacatttatcaagtacaatgagtagcagccagtttttccacaaaaggatgcatggtatataatgcggtctcttgttgtacccaacacataatcccccacccacccgaaaaaaacaaatgtaaacaaactacagtagaatatctatatattcatgtatttattggtgagtcacatggacgtcctttttaaaatattgaaaaaaaaaccgtccagaaatatactcttagtcatagtgacaaccaagctctcctgtggtatatcgaagaacagaaccaacttgtgtcctcattcctcaaaaaaaaaagaaatcaggaactagatcaccgacggacgaacacaattccatacccatcacgagctcgtgacattgacttgacaatatgaaatgaactgctacagtacattctgctttgcaattaatttcttacaagtgactgtgaatgatctaaacacaggagagagtaaagagaaacaaagcaaaaaggaaaaaaaaacttgatatattggcagaagaactatacggatcatatgaccagagtactagagagtgcagatccctggaacgccggcgtgactccgtcgcgacgtaccggagatgtccgccaccttgcaattgctgccgatcgattaccataggaaccataggctcgcgaacgcagcacacgccgtgaacagacgtacggcgcggctcccgtgcgacgacggtgcgctcgacggcatgaacccggggtcctgcgggtacagaggccctctgccggactgcgcgcccccgccgaactggacgtacgccgctggcggcggcgggcagtatgacccggggtaatacgccggaggcggagggctgtagtagtagtacggcggtggtggggggagcgccggcgggggcggcgacgggtacagcaccgggcagtcagcgccgccgcacggcgagcacccaccgcacttgacctctccctcgatcgccgcggccgccgccgtcgacgccgcgacggcaaggatcgccagcacgagcaccggcgccggacgccgcatcatgtcgccggtgatcgactcgggtagctaggctagcacgctacgttatgttacgagaaagccggtctgcctacctagctaaggtaacaagaagagaagtgccctacggtatggccgggcgtgcagcctgctgccccttttatgatgcgcccacaactcaccaagtatatcttctagagtcatagtacgcattatttggaggaatattaggtgggggttcgttacaaaaaaacagcggccagtaagcagtagaacccaaaagggatatgcataattgtagtgctggtggcagtggccatcgaggggaggagtagctgggccgggacagtgtgtggcttcctgaggccggcaccaccaccacgcacggcacgttccagcgtggctcgaaagcgacgaccatgtggcggcgcctaaatcggtgggccacatgcgcgagctatgaggctatctactacgacgactactatctattacgacgactactatagtcgtgctgcattatgggcgggcaaaccgaccgatcggagctcggtttggtgcgcgcccgggccggtgaatgcgtccgggagggagcaccgacgcggctggtgcgggccgttacatgtgcgtgtgcgtgcctgtccgggccaagttgcggtaggagtattctttattccgcgcggcagcgcgacgcgtccaggggagggagtgggcaacgtgagttcatcattggggtggaggatcgtggagctgggagtagcttcaagctgggttcacctgcgtctgcgtgtgacgaagttttattaatgaagtgggaattcagaagcttccgatctggtctccgattcgtccttttgcgtgagccatgtgactgaatgcccctgatcctgccttgggaatggattgatttttcccgtgcatttcggtgtgtgcgaggtccccacatgcaactgaataagtcctacctccatattttaatgtataacgccgttaacttttcgtctaacgtttgaccattcgtcttatttaaaatatttataaaattattatttattttattatgacttgattcgtcatcaaatgttctttaagcataacataaatattttcatatttacataaaaaatttgaataaatcgaatggttaaacggtggttgaaaagtcaacagtattatacattataatacggagagattacatccgttcttttactatacacaggttagttgcacatactcgcgtgaatcctctgcgcactgcaggtgtccgtctgtatgatcactttttttttattttgaagtggtctgtatgatcactttgattacccgcactgactactggttatgtttgggtttgttaactacacgtttaccgcttaacatggaaaaaatatttgaccactactgccaagtgaccatctttgactctttatctccaacggttctttcattctttcttgtcaccttttccgcggtgttctgtacggagatgaattctaataactcgagtgcacatccacccgtttatccatccgtttattgtatgtcaattagatggttacaaaaaattttaaaaaaaattgacaagatcgatcaatatgtatctccacaaacatacaagttcaaattcaacttctataagttgtaataaaaataacaaatttaattataaatattcatatagtaatttcagttttgtttgttatttttgttacaatttgtagaagttgaattttaacttgcatgtttggggattgatatattaatattgatctatcttattcatattttttttattttttttcataactacttgcatgacatgcaataaacgggtagacgtccactcgagctgttaaaatagtttcccggctataccctttttcttcaaccaggagtagtaacatacgtaggggcaaaactagaataggaattaccctgtgtcccatttaatatcacacacttaatactccaattacgtgtgccatgaaaaaacatgctttggtgaaaattttatggacctgtgtggctgtgtcccatgcactacggaagcgtaatgtttttaggggaaaaaaatatcgcgcttccgtagtgcaatgtggcttcgctctggcagccacagacctacataattagtaatatatcattgtcggtgatatgggaccgggaatatcatgactagaggcttgaggcagacacaatcgcccacggggcctggcaccttcggggacgtcgggcccgagggtgaggtgtccgccctcctcctgattccccccaagggggggtcgggttgcgcttgccccggccccgagggccggggcaccccgaccccctttaggaagtctgcgccacatatatgggataagtgagcacagctgtgctcacctaacagcatttaatgcagtctggtcaggcgtgtcacgctgcatgcagcgcagtacggcgcgttcctttatccggtctgtgaccagtcacagaccggtcagatcacgggttaggtggcgacaggcggtcagacgcacgcttcgccccatcctgtcaagacgagagcttctaggcactcgtccccggctggagctagcgtgttacatcccagagatgacacgctagccccgatc

SEQ ID NO: 33524 - DNA, 1308 bp, Oryza sativa
gtacgatgggagcgtcaaccccaccgagtttctccaggtctatacgaccgggattgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaactttcaaggcacatatccgcgcccaggtgaagaagcggacttgcatgcagtacagcgaggcgatgatgagtcgcttcgctcgtacattcagcggttttgccaagtccgcaatactataccatgcatccctgcacacgcggtgatctacgcgttcagggggggtgtgcggcacaaccgcatgctcgaaaagattgcctccaaagagccccagactaccgcagagctttttcagctcgcagaccgagtggctcgtaaggaggaggcctggacctggaactcctccggttccggagtggtagcttcggccgcccccggatccgccgctcagacagggcggcgtgacaggaggaggaagaagaggccggaccgttccggcgacgagggtcatgtcctcgccgtcgagggcgctccacgggccactcgaaaggggaggcctgcgagcgacaaaaagaatgaggctggtacacccagcagggagcgcctcgccggcaggtggtgctctgtccacaacacctccctccacgatctcgcggactgtcgtgcggtcaaaaacttggccgagcgaacgaggaaatgggaggaggacaggaggcaggaacgccgtgagggcaagtccccggcggttccttccggcaaacggcgaagtgaggccaagcagaaggcccccgctgttgacattgatgatggtgatgatgacctaggtttccaagaacctggggccaccattgccaccgtcgatggaggagcatgtgctcacgtctctcgccggagcttcaaggctatgaagcgagagcttctggccatggcccctacccatgaggcgatgcgtcgggcgcggtggtcggaggtcgctctcactttcgaccagactgaccacccaccgtgcattgcccggggagggcaggttgcgatggtggtttcccccaccatctacaacgtgaagttgggacgtgtcctcatagatggaggagcggctctcaacatcctttcccccgcggactttgatgccatcaaggccccggggatggtgctccgaccgtcccagccgattatcggtgtgacgccggggcacacgtggccattaggtcacatcgacctaccggtcacctttgg

SEQ ID NO: 33525 - DNA, 1046 bp, Oryza sativa
acatattcttctcccacctctctctctctctctccccacattaccaacaacacgtacaccaaatcagtcggactatcatatcgggtttattccttttctcccatacgccttctacggcatcgcctctagcaccgaaaaggtcataccaataatgccttctttccctccttctcctctacactaagatgagcagcagtgacatgctcctttcccacagtattttcccatctccggccggatggcttgcgccatcggagatgccaccaatcaccccttctaactaattcagataacacccctgccactagccccacccagggtcctttggcattgccaacgccacctcactgccctctcatgttcatcacctatcatcgatctaccgtctctccatttggtcttctaagcttagagaaatcttctcttccctctttcatcgtccctaatccccacccctaccttgtaaccctaatcccagcatcaccgtcaacatcacataatcataggaaaagacaccatcgctgagaaatatgaatagagcacgaataaacttagtaacttataaaattggtaaaaatatttttaatagtttctttccaaaacttttatataaaaaatatttgtaaagaatcatattatttaacagtttagaaacatacccatggtatttagtggtggccacaatctaactttttatatatagttggtacacactaacaattagttgaaactaaaactcaacatggaatgatgcaacatcatcactcactagcagttaatattctagagcatcttaaatcttatacaaagatgacatatcagttaggctatgtccatttcctggagttggaaactaatccctctgacctgtacaacggaacgactcattagcacatgactaattaagtattaactatttttaaaaaaaagattaatatgattttcaaaagcaactttcgtatagctttttttggtgaaaaacgcacaaccttagaatataatgttgtaaaactcaacatacaaatatgtcaaatattttttcttac

SEQ ID NO: 33526 - DNA, 198 bp, Oryza sativa
cctaaaatctactcagcgtcggcaaaggagccatggattctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgat

SEQ ID NO: 33527 - DNA, 6830 bp, Oryza sativa
  unsure (1)..(6830): unsure at all n locations
acccgatgagtccaatccatcccaccttatccccaaaccaaacacatgctaggagtaattgctgccgcaaataaaaacataggaaaagcaaaggaaaattcaacgaaggaggatcataaggtatatcgtataaactatacctcaataaaaagtttatcgcttttaaactgtggctgataagctagccgtgaaaaataaaatgaatgtagcaactaaaaataatttacggatgcaatttttatatgatattaaccgatgttttctgaaatatatgttagaaaataaaccatgatgaaaacggctcaaaataaactctaaacttaaggggggttttttttctgcaactggtaaatcaacaagcatagaactattagagttataacttcaattcagtaacggcaagacatacacatctatatacttgcaagtgcatcacttatattccgtgtttactgcattgggacacccgatcttccgttaggtgaagaaactattgatttagcggaaacttgacaaacataatttggcttccgatcaaaatgatctaaaccctgcaatcgcagcatcatgtctcctctagttatcaaccgtgtcgaaacctgatggatctcgccgagaaggctaattcctatgcaaatctcgaagaacacaaattagaactagaaagataacaactttattacagatgaatgattaattaagaacacaaagttggggttccacaaatcgatctagcggcgaaactgctatgacagaaataatctaaacaaaacctgaccttaactcaacgacgactattgaatatatatatataggttttagagtcgaccttggacccctgagcgcatccctattggactacaacacgatacatgactcaatgggcccaaagacgatgatgcaatacccgaatagattctggacgtcttcttgttttgtgattcccattgacttgtaaggaactttacatgagactagatccattggaaatgtgatcttgttacctttccataccgttgatgcgaaacacggcggcatgggagatctgcttaactccagtgcaggtccaaggctagccttgtgtgtgtcaagagcgtgccagctgatttgatcctgcaatcagcaagaaagataaaagcagagttagtcagctgatagcgtatcgttagtggtctaagccgatgtagttagaccaaatcgcctatggaccggatagattaaagaataaaagaccctaaacatgtctcgtctgctatagtgttgttgttaacaacggaattttgcatcagattcggagaagaaggtagaagattgaagcgaatttggtgtgaaatcgagttggatttggagtcggactacacatcggctggataccgtatcagctagaaacagagtgcgagttgataaaggttgatgaggcagatggctgatacagccgatatggtatgatttgggctcggtctgggcctagattggaataaccatatttgccaactagagatggagcttgattaaggcaattgtatctattaattggatagttgagtcaattcaactttggcgcatcgccaccctttttgtctttactttccaacgagttcgctttgcaagaggtaacacgtctcgatggcctgtgatattggggctattatgtcgttttagaaattttagtcctcgtatcatgaccattttttttgaccgggaaatagtgggggaagccccacggtacttttcattaatttaaaaggaactgtacaaagatttataaggtgtcaatccatgattgaaaggggctcgtatcatgaccattgttatcatatgtctatgttaatctagtcttagaatatcgatttagttctatcggctgcttctcgctttagattttctgctggtatcggctaaatcgacttgctagattagattaatttagacatctaccatcttgaaaatcagtcaacggcttgattgtctagatattgtgtttcttttcatacttagtgctgcatcaatgcattttcgacctagtaagtcgtgtttagaaccatgatccatagcaagcttcttgatcactaataggggtagtatcggggttttagccgatcttacctaatatacatgtttctttcaggtggcaagcaagccatccatattgtattgagcactttgtgcttgactgcttgaagaaagaactgcattacgcatctaccctatccatcctataaaataacatcctactactagatatatcacatcctagtacaatgaatctgaatatgtctttatccagattcgttctattaagatatgtcgcgtccagttctagatttgttttttttaagatggatggagtagttgttgacggctgttaagtaccaagttaacaccgtcaatacctgcataaaaccacatatataaaacatccaacatagtggtaggatttatttctaacaatttccacgagtgttggtgtatatttgtacgcaggtgacgaaccaccaaagttgagacaaaagatacaaagaggaggtggtgaattaaacttccatattcaagcctatggagttttggacccacaaacctaatgaaacacattcaaatgggccaattgcaagtacatttgggctgaggggttctccaccaaagcccacgagaaaattcggagcaaaacgggccaacaagggtttggccgaaccacttggttcggtcgaacccgtagctgcgccgttcggccccaaacttcacaggccggcaattaccgacttgctatgacggtttctaccgactttacctgaataaccgtcattagctggacacatggcactaggaggatgaagatgctcattggatgcttggaggatctccactctctcaactcacctccacactataaatacccctctcctctccctcattcacacacaccaaagcatgagctgaattacaagaggctctagtgtattttattgtatattagaacagggagagagtaaagtaatggaagtcggaggaattccggagttatcggtaaccctctcttatctcttgtactttgtttattattctgctttaatagaaatatcattctgagtaattaaggtttacttagtgagaattacttcttggttagttcctaattagcatactggatcattgttcactatagtctatttatttatagtgattgctttagtgtttgatcggcactagagtagttattaattgcgtaaacgcggtgtctgggtaaataatntcaagtggttgctgcgtatcccacagtacgtttgaggtgggtgtagaggtggtgacagccctcaagagtacttaagtcctcactgtccggatacgtagtagagcgacatctgggaacagcgggttggcagtgcctgaagtattgcgttaggattaaacttaagctttccctggacactgcttctcattaggaaatcctttctgccttctgcccaccttagctttgtgtccttagatgaacctgacgaggagataatcacacacgttccttggattcgatacccttggaatactccgtaggggaagtgctacatcggtatatccgtgcacttatggatcttatctgtgatcgtaagaaataccaacagtagttacacttacagtgcttgatccaacggcttgcgagctgccacacacatccatgcggccatgcgcggtaactactccctccgtttcatattataatataagtcgtttgactttttttctaataaaatttctttaagtttaaccaagtttattaaaaaaatataatagtgtttttaacagaaacaaatatatttaatgttaaatttaatgaaacaaatttaatatattttagatgttgctaatttttttggacaaactggatcaaacttaagggaggttgactagaaaaagtcaaatgacctactacctctggcaaaaaaaaccataattatacacccgttatgtctaacgtttgaccattcgttatatttgaaaattttttatggatagcatttttattgttattaggtaataaaacataaataatattttatgtgtaactatttttgtaaaaaaatatattttttaaataagatggacaatcaaatattggatatggaaacttatatcagtatttaaaatgagacgaagacactgtaatataaaatataaaacggagcgagtagctcgtacgtgcagtgcagtgaatcctcgtcctagctagccatagtaaagtacaagtacgtagcaagatggactcgctgtcacctgcacactcaccaggctgatcaccataaataatatttccagcgagaaccttgactgtggctttcaaggtgatgatcctcagacgtacagtacaggtcgatcacttggagttgagtcgtacccgtccatcgacgtcttcgcagttacaccattaattgctctgtcgcaattggacctctaatccacaccattgaagagtggatctgtgctacatcctgcgcctagagcgcgtcacgggaataaggtgcaagagtagagcaccagtgcacgggtcgccgcttgccgctcgcttgctgcctgtctttgtgcccatttaattcgatccccctaggctcctctaacctcttcgcgtctctgtgtacacgtcacatttcccctgctgcacagcacgactactcatcttttaaaaacagatacggtttaggaggagctgaaattgtacgatttggactactaaatataaattttggtgtgcaaaaaacaacctagtttcatatatttatatttatgtccctatataaaatcatttgccattcaaatagcaaacccgaatcccaacgaaatttgaaggaagaaggcaaaactcttgcatttttctttttttttacagtaacacaacaggggaggcctccctgttaaagagattttattaaaaaaaattaaaggtcaaaaaaagttacaacgaaagagtccaatctttagcaacatctctatttatttcatttagcctaaacaagagaagaatgaggtctcccttgaggagttgcctccacgaagataatgaaagaggtttatggaaaaaataaatcaattttttttgcttccaaatgttccatgcatctgtaagaaattgctccataaaacatcttcgattataaatggctttggcttccaatatcatgctctgaagagcaatggaggtattccatactatacccaatctgttccagcaatcaacaatcaatttttcgttttgttgcatttttcttcaaattgcaacgaaatgaacaatgaaaaaaaagaattatgtaaaaggaaatcgacacgtaagcactcaaaatttgattgtatatgtatcttccaatagagaagagaaatgtggtaatatggtatggatgcaataattattccaatacatattccacaccctagtgtgcctacacccactttgaaatttgaacttgtgctctttgggaaattataagaaacatggtatacatgtaaagaagcagatactgagtttttattaaagttaaataaaacaaagacaatttttttctagtacattttttatttttagatactttccatgtaaacattttatggcatgcattacatgtagtatatttatttagaatttttttagtgtgcattgcatgagcaaactgagaataagtatagctagctagctagaaccattgttcacaaaaccattcgtaaattaaaacgtgagttacaaatcgctcgttcaatcagtcaatttttttaaaaaaactaatactaaatttgaattttttaatatactttattttaattccagccgttctcactagttctccaatggtttcaacgaaaagaaaaaattaaagctaattaaggagatctggtaaaggcttttagaaatcagaacattggctaaaactttgctacacaatctcctgtgttctaatatacaacgcattattgttttccataaagtctacatttgaaaaaatggactaacaattaaataaaaatatgtgtttagtgccatgcaagtagcatttttgtatttgtatttgaaaacattttttatgatgttgattttgtagtagatggtaatatattacgaaagagattaatgatcaaagtataatgttggaacaatatgaaaggtttaatataaaaggtttattataagcctagccacttattagcgactaaaataatttatggtaaaactattatataaatgtttttagcaactacctatgcttaaaaaataaactaaaattcaaaatttaactatgacagatgagaatacaaatcatgtgttgtttggtttgtgcaagcatatcaagggggagaaatcagttatatactacctctgtgacaggaagatcgcagttttgtttatatatatataacgtttgactgtccgttttatttgaaaattttttataattagtatttttattggtattagctaataaaacatgaacaatactttatgtgtactatttttctttatttttttataaattttttagataagatgaatagtcaaatgctaaacacgaaaacccacagctgtattttaaaatgagacggagatgtaatcgatcactcccaatccatatgtaagtgacacaggcattccaatgcgcatactatatgtggcaaggcattcttggtgctgggctagtggccctctctggattatgttggattttcaatccgctcggcttgcgtgattaagagggcacaagtggtcttccaaatttgcattccaaagacaaggacctagcttccacctacaaaagcgtatactagtgtggaccaaaaccccttaccacggggcacgg

SEQ ID NO: 33528 - DNA, 2925 bp, Oryza sativa
ccggcgacggtgcttgagcggtccgactcgctggcgttcacgtggcgccaccgcatgtacgaccggctcgcttttcacctgcccaagcgcttctgcgagctgccgctcctcccgttcccggaggagtacccgacgtacccgtccaaggaccagttcgtggcgtacatggaggcgtacgccgcggcggcgggcgtcgcgccgcgcttaggcgccaccgtcgaggaggccgcgttcgacgcggccgtcggcgcatggagggtgcgtctcgacggcggggaggtgctcatggcgcggtggctcgtcgtcgcgacgggggagaacgccgagccgcgggtgccggactttcccggcatgcagaagttcgccgggtgtgccatgcatacttccgagtacaagtccggcgagcagtttgccggtaagaaggtgttggtcgtgggatgcgggaattctggcatggaagtgagcttggatttgtgccggcatggcgcgaagccctccatggtggtgcgcaacacggtaagaaactagttaaactgagcttatgctttagaacctatctatcatgctctgtttttcccctgttttttttgtctgtatttgatttatctttctgtgtgtcacatcttattgtcattggacatattattgtcatcttaaatccgttttcattgtgcatggctgtattggatcatattcaggaaggagaaattagacctgttaacatcttccattccacacaactttatatgtcgggtgtcttgtcctatcaacagccgtttctttcttccattttgcctccccctgccctccgataattacgcgtgtcattttcattacattattatgatgacgggttacacaaatctaagcgccgtggtgatgtttcgtccaggtgcatgtcctaccaagggaaatgttcggtctatccacgttcggcatcgccatggcgctgctgcgatggctaccggttcagctcgtcgaccggttccttctcacggcggctcacctcatcctcggtaacacggggcagttcggcctaaggcggcccaaaacagggcccatcgagctcaagaacctcaccggcaggacacccgtactggacgttgggacgctagaccacatcaaatccggcaaaattaaggttagtgccaaccattcagctagcctagctcctttcaagaaccagtagtagaaactgagaccagtcaaactgtcgagctgtacatgtgagctgctgggcgtctacttcctaatgtggcacatcagctattcgcacatgcagcatgtacatttctcttgtggaaaatggttctcatatggagattcatttattttatccctgtgggttttctcctgtgctttgattgatgaggcgctgatgggaatcatgcatcactaggtagtgggagcagtgaaggagatgacgaggcaaggggtcaggttcacggatggcaaggaggagcaattcgacacaataatcctcgccacaggctacaggagcaacgtgccatcttggctcaaggtaaagcagagtgtgactcactcttgttcgttttatttttctttctgtccgcactgcactatactactactagtgatatatatctcgagatgatacggattatatggtcaactgtcaagcccaaggatgttaattatatgtctatatgtacgtgtgctttatgtgttgtaggatgccggtgacttgttcacgagggagggcatttccaaggtccccttccctaacagctggagagggcggaatggtctctacaccgtcggattcactcagcgggggctcctcggcacgtcatcggacgccctcaacgtcgccaaagacatacattgccaatggagagaaagggaccgatctgctattaatgtacttgaaataagcaactcttccttttgatttgactggaaatgtacagtgttttgattaggaatattgtattgtgtgcatataacaccatgttctatctcccttttcaacaaagactgataatcttgctctgccttatgtcgattacttgcctattgagcatcttttgggcaaactgttattatgacaagaatttagaatttatatcaatactcctttaaatgggcgtaatggtagccaccaacttcctattttctttgaaaagaaaaaaaaatacagtgtgaaaaaggaaaaataatgattaagtgggttactaataattttcttgaattaaaaccctgtcgcaatacacggaaagacaacatgctagttagcatactgttgttaacgccgaatatacttttgtgcatatatggtcagcgggtgaaaagcatcacatatttgtgctgatctgataaaaacccatttagacaaatatggttctgatccaacccatcttgctcaccgaggttcggcgttgggccgcaagcccacaatccaggagatctacaactttataattaatatattttttcatttcagatcgtttaataatccaaatattccttacaaaatctctaatctacgttacaaacgacttccaatatagacaaacttatacaaatgttgtagatcttgacgagatctacaactttgttgtttaccagcttttatttaggctgtgttcggaatcggacgttcccagcgtgcacagtaagtaccgaaaacttagcggtctattagcgcatgattaattaagaattagctattttgtttaaaaaatggattaatataattttttaagcaactttcgtatagaaactttttgcaaaaagtatacattttaatagtttgaaaagcgtgcgcgcggaatacgatggagaggggctgggaaccttcagttccaaacacagccttaaaattgtttagagtatcaaataagcattattagtttttttagcaattaaaaccgacaagaagatctaaatgcaaaaaaaaaaaaa

SEQ ID NO: 33529 - DNA, 1165 bp, Oryza sativa
cctgcaggtcgactctagaggatccccgaattcgattttcatccttcaaaaaaaaaaacagatacaacgggtccctcaactatgaaaatcgatactaagtccctcggcggtttggacggcggttttcactgacgtggtgcctacgtggctaatttgactcaatcttcatctgacgtggcatttcgatccgaaaaaatattaaaccctgtgggacctacatgttagtttcacacaattaattaaaaaatagaggccccacataggccccgcatgtcattcttacccctacctcctctttctcctccatccccatctcccctctccggccacggtcacagcggtgcaggggacaacgacctcaagaaggcagacaaggccggtcttgactcttgacgcccttcccatgtcctccgccactcacctcggcggtacgctcggccggtggagagaagaagcgcagtggaggtggcccaagcggtgagagtggagatcggagggagttgggggcgcccccggcagattgctaccgctctgccccaccggcttcgcgcgccgccaccgccccactccaccccgtcgctctgccgggctccccgacggctgcgcccgctgcgcaccagaagacgacgatgacgaggctggcgccctccgcttggctccacagccccgctggctttggacgccgcccaaaacaatggcgttaatcatgttaggattccacattcagagagtgagctggagcacaacattgatttttgtgcagagatcgatggatcgattgattctgtcgccaacgactccaccaattctgtccagggtaagagcaggtacaatagcatattattaaccagctataaatatattttaatgagatgatgagctgcagaccaatctgtttattgacaaccacaaaactaaaggagttgttttgcagataatgaacttgaaaaccatttggatcaccacccaaacaagcacaaagtgctaaagccaccgaatcaacattcaaacgaaacttgaggtgggaaaaacataccaccaacttaaaagaagacgatctagcgaaccttggaatgaaatgcacaggggaagagaatcgaggcctgatttcttttgcaaactccaaacctggagagaaatcccagccatcgacaaaaggggatcc

SEQ ID NO: 33530 - DNA, 4366 bp, Oryza sativa
  unsure (1)..(4366): unsure at all n locations
caattttaccatttcctataaagaaacataataaattaatggtgtatattgtcggagcgtagaaatttgttagctgggctattatatttatgtgttagctatcaccgtattatttgcaataaatatgcttttagatataacataaaaattaatacttatttattaattagttattaaaggttgtttatgaagcatataaatatatttgtcttataaaaaaaatctgttgtattactatcaaaacacatggtgcataaaaaacttttattaaataataaataagtattaattttttatatcatatctaaaagtatatttgtcacaaataatatggtgcataacgaactcataaatataatagtcccacccaataaatttctacactctaacaatgtagtccattaatttattatgtttcttcatagcaaagggcaaaatagactttttcataagaatttaacggtcaactagcggaaagggtatgaaagagatccaaactaaaattcatgggtatgtgagggaatgagcaaagtttaagggtgtagacaactgttaagtaccaaattaacaccgtcaataccagcataaaaccataaaagtaaaacatccaatgtagtggtagggtttatttctaaccatttccacgagtgttggtgtatatttggatgcaggtgacgagccaccaaagttgagacaaaagatacatgatgaggtgaattaaactcccatattcaagcgtaatgaaacacattcaaatgggccaattgcaagtacatttgggctgaggggttctccaccagagcccacgagaaaattcggagcaaaataggccagcaagggtttggcgaacccgtagttgtgccattcgaccccatacttcacaggtcggcaattaccgacttgctatgacggtttctaccgactttacctgaacaaccgtcatcagctggacacatagcaagatgagagtgaagatgccatttagatgcttagcatctccacaatcccaaggcatctctccacctataaatacccatctctccctcattcacaacacacaccaagatgtagagctgaattacaagaggctctaagtatactttaggttctttatatgttctatagtatacttaaaatagggagagagtaaagtaaaagaagttggaggaatcccggagttgtcggtagtcctctcattattcttgtactttgttaattaccctggttcaaattaagatttgtttagtgagaattaattcttggttgtccacccggacgttgtcaagtcgagttgcgcattgagaatattggtgccgctcaatacttttgctaaaacctgcatatagtatgtttagaacaaaaatccactctaacccaacacctgaaacattggtatgcttcaagaccataaaatttttatgtaaaatgatactatatatgatctgatagtctccaacacaacacaccgtgtatgtatcactagttatagtgacaagtgagtaactgacaactactccatgcgattgcaagaccaaatgaggtgcaaaccgtgtatgtatctactggaaggtcagagcatctatagtagtaatacctgaggaatgttaaaggggcagattgcaatcaaccacacatagggggaggaggtgatcgatcctctttgtagctctcggggacaaagcacgacactggcataacatcgaacgggtcgcgagtgaggaggtgatcgacccaccaggactccactgtcatgagaccacgctgtggctgtcccatgggcgacctgggaggggtagtcgatatcctgctcagcacacccccctcttcgacgagaaacagagtagcgtgccgcgtcgctgccgatgatggggttgaactcggggaccaggtatctgccgccgccgggggcgatggccaagctgaggttatctgtgtgggcgatggtcatctcggggggccaggaggcggagagcgctcgcagaaatggaaaggtggagcgtgggaaccatgtgaagtagcccttaagtagggattccacagaacgagcccgcgccccaacttgtcgatgatgagcgggcctgtgtggcggtgctgcgaggtgaaaaagaggagacagggggatgtcggcggcgaggacggaggggaagttgtgtattgtggtcggggttggcgcattgtggggccacgacgaagatggcgacccatggcggcgtggagggtgtgagggagagctctgcactgccgagctcggcgtcggttttgtagcggcgagcatggcccacggcgctgccggcgaggatcccattgaaggcgtgtggggttttggtggaagaaagtggagaggccagggtttgatgtctgtactattttgaaatcaagatgcgcaggcgtaacggagcaggcagagttaggcaaggcccccgcaaccgcaactccgcaagcctcaattttgcccatttcggccctttgcataaatttattttatgaattattccttcgaaaaacttttcttgttcggtttagaggggactgaaaagaattggagagtattgaggggaaataattccacatctaaaataaatctccttcaatccgtccctcacagggattaatcgaacatgtaaaccctcacagggattaatcgaacacgcccttacatgggaggaaatttgtgtagaactagtgggattcattacaaatgaaaaaactcatataaaagcccgttaagtgcagaaattggtttgaaggaattttgaatgatagaaaatattccttcatatctcggaggaattctaacatgtggtctcatctcatgtttacacatatctttgagaactctaaaataatatataaatcttactccctccatttcataatataagacacaactattttttttatattccataatactccctccatccacaagaattagatatatttcacatttgagtttttccaaataagttgtttctatttatagtctttatacatccaagacttagggtgtgttcgggagtgagggttaggaacccaagttgcctagcacgcaaaacgaagcagcatttagtgcatgattgattaagtattagctaaaataaatttgaaaaatcgattgatatgattttctaaagtaactttcatatagtttttttcgaaaaaaatgtaatgtttaacagattaaaaaacgtgcgcacggaaaacgatgaaggtgagttgggaaagtagagagaagaactcagccttaaattgagaggtaaattatatgtttgattaaaacccaacaagccatgtaaatattcattggttccatgtttgtattcattctttgatctttattacatgcaagatgagttaatttctcattgatcttggtgacaaaagtaataggtgtaactttttttgaaaggaatgagtataaggcatgcatgcatgcatgcatacaattaactaagacctcttctccattaaattattactcatttttttaaaatcatctaccctcgagatctctaattctatttaatgcatgcattacatttattaggatgatccaaactatgagatgataagaattgtttcttggtctctaggttagagcaatttgaatagtatagccaactacaggctccaaatcatctatagttattttaatagccatggagtaattcatacccggtatgttgacctacaagtagtgaaactactaggtaggtccgtcggtttggcacgcaaactaagaccaaagcaatttatgtgtacttaatgcaactttgcaagcaaaacaatcaagatttaaattataagagcaatatggtcaaggcctcaagggtgacttttcttgctcaaggtgttcacgacacttctcgaaatctgcactcgaacataattccgataaagtagtgaaaatattcaaaatcatacacaaagaccaataagaagaccttatttaggactaataatagtgccaatagatagatcacgattaggggtgaaaatggtcggaaacgatcggaatcagtagcatctcttcagaaatgatgctcgatcggccggtaattgatcatatttatcatttaaactactcattatcgatattaatacgatgaaaaaagaattgtgaaaaaaaaaaatttaaaaatagccaaaaaaggttacggtcggaaacggtactcatatacggaaacggcgctcggtcgataaggaatttccgccaccattttcacccctaatcacgattttagaggattactggaagtggaatgaagtcaatcggagctacgtatatgaatttctagagattaatttattttgaggaacaacagaaatgatttttnnnnnnnnnnnnnnnnnnnnnnnnnnnnnn

SEQ ID NO: 33531 - DNA, 4729 bp, Oryza sativa
tgcctgcaggtcgactctagaggatcccctgatcatatttatcatttaaactactcattatcgatattaatacgatgaaaaaagaattgggaaaaaaaaaaatttaaaaatagccaaaaaaggttacggtcggaaacggtactcatatacggaaacggcgctcggtcgataaggaatttccgccaccattttcacccctaatcacgattttagaggattactggaagtggaatgaagtcaatcggagctacgtatatgaatttctagagattaatttattttgaggaacaacagaaatgatttttggatttggaaaataaatattccaaaggaatattcatttcgggctgacaggtgggacctgatgtgagagggattgaggcttatgcctctagggttcctgtagacttttgacttacattgaccaaaggatgtaggaatcgataccgttaacttttgacatacattaaccattcgtcttcttaaaatatagaaaacaatataaaccatgctcaaagtatctttaataataaaataaatcatacaaaaataaattataattacataaatctattatatactaaaagtcatttaagcttcctacaaatactcttaggatgcgctctaaaaaattagagaaaatccaagcaattctgagaaaaaaaaagcaaaacatcttgcctttaattttaatttaatacagtggacccattttttaaaccattggattacatctattaaaaataaaccacctaatctctcgtctgtacatacaacagaaaaaatatgtaattattcaacagagagaaaaatctcttgtgttatgtacatacgaaaaaagaatcaccgaagaaaaactacgtacgtatgattgggaaaaaaaacacgattaatccttcacccctaatcctcacattaaatatattttgattaaaaacatgtcacatagaactaaagtctatccttttttcatttcattctcatcctaatagtgttacaatattagtgtccaaatgaattaaaaataatagattattccataatatattaacccatgcatgaaccatcaacaggtaaattagatctataatacagaggaaaaaatatcaacacccatattaacccatatgtttttgaaggattattggtcgaacaaatattgttttcacgtgattctcgccaccgaatctattagattttttaaggcagattgtaattaatgtggacaatgtgatcaaatgaagtgtcaaatttttcttaaaaaccatatcaactactatgttttgatttaaaaataatgacatgtaggatcacattctagccttttacatgttgtccaaataattataaaaagaacatagattataacatatattactaataagttataagtgctcaaagttggaaccttaatagtactctaagctgagattaaactttttaattttggctataaatgactttaaaatagagttaatttaatccatgatattgcaaacatgttatttcagataaatgctattacaatttgtctatttgtagttgtgccattgaaattttacaaaattagaaccgtgccactgtcgtcacgtttgtacgatcaaacacaagtaaccaagtctaccagagggggtgaatggtagataccgtagattacgtcagcggaagtcaaataatcgaatcttgacagatcaaaacacaccccaacctcaaaagccaatgaaacacatgtaatccagtctatccgacctactagagtcagtctgaccgagcctggctggtctgaccgcaggtcactcggcggtctgaccgtcagccctaaaaacagcacgacagcgtttctgtaaaaacacgatttctcttaaaccaaccgttggatcgagttgcaaacttgatagaataaactagacaaactaaggaaaaactccactggagggatttgaaaaataataaacggtttaagagaaaacaccctcgaaagtcagttgtctcagagtttcagcaaatctgaaccctaaaactgaagcaaattcaaatctaacaataagccaagtttgtgaaattagatagggtttcgtgagaaacttgtaaggggtgcattgttaaatatatgatccgaattttgggcccacaatatatttggataagttttctaatagaacttgactattatgattagtttcctagtttgactcataagtctttccccactaggactgttagatttatactatatatattccttgtaagccacacggggagggtgcgatagcccaatgtatcccatgcgtatgtatccaactcctcaatagtgatcattgccggtcaacgcccatggtttttcccgcaagggttttccatgtaaaatttgtgtttcggtttcgggttgttttattgtatatctgtggatagttcatgtttatggcttctagatggatactatgcgtatgtaatactgtagttttctaataatgagtcacgttggagatagtttggaatcggaatatggtttctttgtttgattcatgtgtaggtgtctaaatgcctcgggagagtattgccggtgatgaatcgggagtcaacttggagataaggtgacgtccggatggtcagatatcatgcgggattcttaggctaaagatcaatgcacgtgattggtgaatattccatatggcatatgatggagatattgtgtgcgtatgggatgtggagtcgaatttggaaggagtccaaatttggtataattggagtttgtaaagttggtttcttgtactggaaggtttcctaggtggattaggacttcttgtatgagtttggttcgtggctttaggcagcctacctcatgtataaatagagagggagggtgtggattcccggtatcactttagagagcattgagttgagagattaattagggtttcgagtttggtcgagatttttgtgaggtgtgctgctgttgcactttgtaaacatagagagaagtaataaagttgtcatctactttgagatatcttcaatttgtgtttgcacgggttcggcggtccaaccggcgggataccggcggtcaggccggcggcattgcagcggtcagaccagcggcgacaacaggcatcggcgacaagttttggcggttagaccgggagatcaataccggtcagaccggcggctatggttcggtcagactggttaatctactccggttagaccgcaattcatcgattcaagggtaacttttatttccgctaaaagttttggtttttgggtacaccaaccattcacccgtctctggttggcttagttcctgctgttcggtcatgcaacgttctccatccatttcctcatttgcacgggggcccacttatcagattcctcttcttccttccccatctcagcgtcatggcgaggagagagctcctagaagtagttctgtgcgttgttgtggtggaacccctggtcctgttgccccaagagggaaagcgagagctagagcgaggtgagcgggtcatcgtcgacgtccccggcactaatggcatagaagccgcgagggcgtggaacacctgcgcacttccgcaccccatggataaaaggcagtctcggttctggttggtttttttaataggtgacgattttttaaaagaatcggcactatatctatattataggtgtcaattctttttacaaaccggcatctacagtattggtatcggttttttatctagaaccgacacctataatgtaagcaagcataggtgccgattattttaaaaaaccgacgtctatagtattagtaccggtttttttaaaaaccgacacctatattgtttaaaagtgtcggttctgtattttttcattgaggcagaagtgggagaaggtttaaaaccagcacatgtgagccgacaccaatgaaggtttttgttagctgaacggaaggcccatgcacaaatatccaatacggcatgagttgtggatatacacgttgcctagcaccatgccaatcggacggcataaaaatttgattgaatcagccataaaatctgtcgactgatttttagcaacaccatacttttatactcttcttgcgtgtttatatattttcttaaataaatgagcggtgaaaagtttaggatataatacgaaattatttgaagacagagtgagtactaattacagcaacccgtgcagtggtacatcatgtgaaaaaaatagaaatgctagatgttgtatacagatcgctcggtctcggtgactcaagagaatttagaaccaagagaccagcctttgtcaccctatggatctggcatgcggaatggacaccagagccatctgtaggtggttttgtaaggaagaacgtcgtcattcataaacaagtcggcgacgagtcgcatgtcgatctgcacctctagctctgccaaggattcgccacttgccatatgttcgtgcacgtcctgtgccagcccaaccagctcgcttgacgtggctcctgttactgtgtcacgagtcatcttcttcaagcagaagctgccggggatggaaccccggccaagcggggtccctgcatgccagacggagaactgccactctgaggtatacgcgtaagtttatatacgcatatgcaaactttgtttacgtgtattttttggattttatatatatgtaatactaattttttattcacgtataccaagtttgtataaagttgtttatatacgtgcattttttggatttttat

SEQ ID NO: 33532 - DNA, 725 bp, Oryza sativa
gcctgcaggtcgactctagaggatcccctaattatagtacaatcgtagtgtaattacactgtaacttgcatgtaactatagtataacttgtacgtaagtttcacataattttgaatcgttagatctattacaagatttgttctggtaaggaagaaaaaaatcacagcacacacatgtgaaaggatttgttcccacgacctctattttactgaaataacatgttaccgagagattcttgaaagttacatacaagttacattatagttacagtgtaattatatacaagttacagtgtaattacactacgattgtactgtaattacatctgacaaatttttggaggaaaatttgtcgactatagtaaattcgagaaaaacacttaagtatgtgggtgcgtgcgcgagatgcgtttcttttcttcccgctgccgcgacggccaaacgaaccgggtggacttttaggtgggtgcttttcccgtttggcgatgccggtaggatggatttgtgctcgccggttgccatcagggtttgttatgcactgtgcggtagatggcgacggttcgtgcgaatgaaggcatgcaccacgacgcgacggggctgatgtgccgcttggaccagaaatggatgctgatatgcgatctctggattctgttccattcgtcgggcaatccagttcgcccctccacccacccaagatatagattttacattgatttctattaacac

SEQ ID NO: 33533 - DNA, 639 bp, Oryza sativa
gcttcgagccgatcaatattggatttgatcggaccttcagatagctgatcaagtttggtcttctcttcatgcacaagctgccgattagcttggattgcggcctcaatctctttgcgctcacggtgttcgactagtcttagcttggctttttccagcttgaactgatgttgctcgagataagcggctggagttaggacatcggccaaatcttcgggaatcagagcttgaacttcatgcagccgtgtcctaattgatccacagtcaactaccaaactatctaaagaagaggcttctagccgatgagagatatcttcaagtgttcttctcacatcgtcagataggggagctagagctttgcttgaagtgtcttcttctgcctcatcgagataatttctgatgtcaaaagagaaaagatcggctagaacctgtagagacaatttcggaaagagtaagagctgggtaaaatgtagccgatctaattgttgagacaaaggaaaacttactgggatagcaggagcagttggttgttcttcttcctcgatgtgatgactccccacaccgatggagtctggtcacttgacggttgttgtacaggataaggaggctgtagaatagacaagtgttatatagagccagttg

SEQ ID NO: 33534 - DNA, 1721 bp, Oryza sativa
  unsure (1)..(1721): unsure at all n locations
nnnnnnnnnnnnnnnnnnnnnnnnnnnnnnnnnnnnnnnnnnnnnnnnnnnnnnnatatctttttagctgattgtggatcaacaaatcccttgagttgtgtcatgtacacatcctcatcgatatttccattgacgaaagctgttttgacatccatttgccatatctcataatcgaaataggcagttatcgctaaaacaatctgaatagattttagcatggcgactagcgagaaagtttcatcataatcaacaccttgaatttgtctgaaacctttcgccaccaatcgtgccttgtagatgtgaacatttccatctacatctgtctttttcttaaagacccatttccactcaatggcttttacaccatcaggtggatcaaccaagttccaaacttgattgacatgcatggattctatttcggatttcatggctccaagtcccaccattgcttcctcataggtagttggttcatcgttttctaacaacaatatatcacgttgtcctgtagttaataacgcatacctcgcaggtgtacaccgtatcctttcggaccttcgtgaagctggtgcttccacaactggttcaacaacaacttgttcaacctgttgaacaacatcttgctcagcttgtggttgtgtggacgttgaagcgttttccagtgtttcctaaatttcttcaagtcgcaccatgctcccactattctttcttaaaataaactctttttccaagaaaacaccatgtcgggcgacaaacactttgccctcttcccgattataaaaataatatcctttcgtttccttaggataccccacaaagaagcatttatctgatttaggtgtgagtttgtccgattgcaaacgttttacatagacctcacagccccaaatctttaggaaagacaaactgggacgcttccctgtccatatctcatatggtgtcttattcactgattttgatggaaccttgtttagtgtgaacgcagctttctctagagcgtaagcccaaaagcttagcggcagatcagtttggctcatcattgatcgcactatgtctaacaatgtacgattcctccgttcagacaccccattccactgaggcgttcctggtggagtgagttgtggaacaattccacactcctttagatgattgccaaattcaaggctcaagtactctccaccacgatcagatcgtagatacttgattgtcttgcccaaatgattttgtactcagacttatgcttcattaagtagacataaccatatctactaaagtcatcggtaaaggtaataaagtacccaaaaccacctctggcagttgagctcattggtccacatacatcagtatgtactagtcccaatagttcacttgccctttcactttgacccgtgaaaggtgcctttgtcattttgtcaagtaaacaagattaacatgtctcaaatgattcaaaatcaaacgagtgtagaagtccatctctatgaagcttctccatgcgtttctcatttatatgacccaggcgacaatgccaaataaaagtgggattcaaatcattaggacgtcgccgttttgcattaatgttatagaccgaacatccatcaagattcacaatgtataagccattcatcatgggtgcatggaaatagaaaatgtcattataatagactgaacaaccattgtccacagatctaaaaccataaccctctgcttgcaaacaagaagcagag

SEQ ID NO: 33535 - DNA, 1706 bp, Oryza sativa
gttgttcatgttaaattcattatgaacggctcaaagctgggagggagcgactgaagaatcaaatcagtaccaactcttgggtaaggggaaagccaagcttatccagactctcggtataacaatcattttgatcatatgtgggctcactggattaccttctgcaagcctgcacgcaaacaaggacttttaggtattaaacctctcagctcttgcttggtcctcaaacatgttacatagtcccgtgattatcgtatgagcatccaatgcctcatattgcctttgaagctcaggggacatagtagcaagcatgagacagcttatatcaaagtattcattgcatcgcatttcatgctccctacgttgagcagcacgagcattgttgggcaagtcagctagaaaaggttgtgtaagcacaaactctttgtgctcttgcctgagaacaattctcaggttgcgataccaatccatgaagtttattccagtcaacttctctttctcaagaatagaccgcaagttaaaattggatggtgcaggagctgccatgatctacaatagaaatatatgtatgcaaagtcagcaccatgtttacatttaacctttcattaaacaatttaacaaaagatactcccactatgtattgtgaaacaaaattccctctagtaacatagtgagtcaagatcctcattttattagtgtctagtgagctttggcatcacagctatacaactatcaaaataggtaagcaacaccttactaatcacatcatatgtgactcttgtgttgttgggtgacatctccatgtccaacccaacctatgccccaaggtccaaaactgttttgataaccttgtcaagtaaactaataatctccgcatatagatgtccgacatctatcctattttatcatgataaaaagtgacactttgctatggcaaacccatcacttatgatcacaaccgtaataggtgcaattattggaagagcataaactacacttaatttttctgagggaatctatcctaccatgtcatatcaaatatacaaacaacaataaagtaagatagatataaaaaccccaagcgaaatctaaggggcaacgcacacggcggtcccacgggtttcagggcagcgccctgaaaaggtcacggggtacatagatctcatctacgattcgccatgtgaaaaccttaacagcgtaatcaaattatgccaaaaccgagtcaatctcactggctcgtttttctcattggcgtgcagttccagtggacatcggactatccgatgaacacaattgcactcggccttggtgagtactagacattccagtgaagtcaccaacacacataccgattgatcttatcaacccatgcggctaccagttcatctcatgttccgatcacctaagaacacatatacaacataatagatctcatctactacatccgcatatcaattatatgcaatgatctagatcataaactatacaaggcggctctgataccactgttgggatacgcgtaggctatgatagcatagatcaaaattttctatcgcgtaaaccaggaaccatgaagtgttagatcatagatcgttaccactcgacgtgctgcgcagcggaagaagacactgagaagttgaaggaactctcgcgaagtagcgcgcgtcgatgtagaggaagtagtcgatcgcaccggctcgaccttctcc

SEQ ID NO: 33536 - DNA, 997 bp, Oryza sativa
  unsure (1)..(997): unsure at all n locations
nnnnnnnnnnnnnnnnnnnnnnnnnnnnnnnnnnnnnnnnnnnnnnnnnnnnnnncaaagtatctattacttgatcttcacttaaatcggtgggtccaatattataaacctgttgacagaaaacacgaggcctggtagatctgcttaactcctgcaggtccaaagctcgccttcgggtgtgttagcgtgctagttgatttgatcctgcaatcaacaagaaatagaaacaaagagaccgcggttaaatctataaatgatagccgatcggctaggtgccgatgacatatcatttatctttgagccgatgtcatatgtgaatcgatcggcggttgtaaatagacaataaagaactaaatctattcgatcggctgtagatattaacaatgtatagttcttatatcgatatatatttaaatcaagtgactgggatagatctgtcgccatgccgagacagtataaatcacttagatcgaaatatatattaataacaacattatatatgtttatagcatagccgatcagatagatctagcatgtatcggctaatactccgatactactctatatcaagatatcaaaacaagtataatatatcaaataaaagcctaatatacttaaatgcaataagatcttgacgtaaagggcggatttaacatgtcaatgaagcatatagaacaaatatggttaaatcagataagatcggctgaaactccgatactactctaatcggcaaccagaaggcaggctagagattgaaattctaagcacgacttaatagatcaaactcaactgatgcagcattaagtatgaaaagaagaacaatatctagacaatcaagccgctggatgtttcataaagtggtagatatcttatataatctaggtcaacatcgctatttaacctaatcggctgccttctgtcgacagatggtagccgagnnnnnnnnnnnnnnnnnnnnnnnnnnnnnnnnnnnnnnnnnnnnnnnnnnnnnnnnnnn

SEQ ID NO: 33537 - DNA, 513 bp, Oryza sativa
tacatggtcataggcgtataaatccaggaagtttggcttatcatcagttacactatttaaaaagaaagattattgcaatgaaataccaaataagtggccattactcaccagggaggtgaagggtgagagtttggcgcccagggtttccgtttttctaagcacccagggaagatgagcaaaacaggtgcgacggaagcagaagaggcataggggggggggtgagattatggtgctggcttgctgcgtgaggaaggacggcaagcggggaaggagagcgaacagttggggcagggcaatgggatgggccttgctcatcagttgggctttttgcaatgatttggctatgctcatcaggataactcgacatctcactagggaccttctcatccaatggtttatacgcgatctcatccaccgattgaacgactgagaattagtgatgacgtggcacgctgaggttttagctttgagtcgtaactttatagaaagaagggatgtcaccatgcttattta

SEQ ID NO: 33538 - DNA, 1620 bp, Oryza sativa
ccacatttattgcggtttggttgagcgtgtcacgccgcatgtaacgcagtgcagtgcactcgtttatccggtctgtgaccagtcacagaccggtcagatcgcgggttaggtggcgacaggcgatctgacacacgcctcgccccatcccgtcaggacgagggcttctaggcactcgtccccagctggagctagcgtgttacctcccagagatggcacgttagtcctggtcagatatatgccaggcttcatcctaaccattacaggcaagatgttgtgtgaagaagggcgagcatgtagattgctaagctgacacgtggtggacaagaatgaccgacgtgactggactaataccggtcatgtcgtcagcagacagccacgattccacgtcgcgcctgcttccggcggaagtggaggtaggtatgggccgtcccatcagaaggtcattcggacggcaaccatacaagtctccgtctgtttatgaaaaggtggggtaagtccccacaaaaaagagagaaatggtgcatgtggtatccccttaagatataaaaggaggaccttgcccacggagagacgagactggacttttccagattagaaacccagaacaagggagaggctggctgatactttgtagctccttcatacacagatgtcccaaaacacaggagtagggtattacgcttctcagcggcccgaacctgtatacatcgcccgtgtcttgcgtgtttcctgtctcgcgagccttccacatacagagagcttagaatctctccctgagtccccggccgaaccggcaaaggggggcctgcgcggtctcccggtgaggagccccacgctccgtcacactccatcctcgaatcatccctaaatcctgaaatcccaaatcctcaaatcgatcatctccaagtacatcctaagtcatcacagatcacagatcaaaaggatcatctccaaatcctcaaatcgatcatctccaaatacatcacaaattcctaaaaaaattacatcataagttctaaaaaattcatcataaatacatcacatattcacatcacacacaaataaaatacatcgcaggatcatgcaatgaatcacaaattctttaaaaaaaattgttgctgcagcctcccgcctcctctccggcagaggcgccggccggccgctaccgcctcccctcctcccgtccacgccggccattgccacctcccgcctcccctccgcactgccctccatgtcgtcacgcaggctgctgcccgtcgcccggacgaccggccctctaccgcgccctgcgccgcccggtcttcccgctccagcactccttctccagcgctcgttcctagccaataaggctcagctctcagcgaaggaaagagataaggaaaaaagaaatagagagaggagtttgtgtggacgggagaagaggataagtgctatggaggattatatactgcattttgatttttattcctggttagtaattggtgttactaaccgggactaaagatcccgatcgccctgacacggcttgacatggaatcaactgggactaaagatcacatagtcccattgtgcttttaaaccaagactaaaaatattctttagtcttggatttttaagcaa

SEQ ID NO: 33539 - DNA, 2666 bp, Oryza sativa
ttaatccatcgctctgtttcgtgtgtcggggaggatgagttcccaacccctcctcctgaacagagatcactgaactacacacgacgttgaccttccatcttcacttgtcacatctacaaccctaatgtagtttaccgcttgcaacccaaaaatgttttcccgctgctctcgctgttgtcaagccttgcacagctcaaaacactggcaccatcacaaaagagcacattagtaccctcttatcagtgctggtttgacaaaacccgatactgatgatggttgatggttttgaaccccaaaaaataagttcttgctacatacatgcttcatctggcattgatgaggagacatcaccatggtcaccggcacacctcactttccctgtcccaacctttgcctctcaagtttatccaactgccaccttgtcttagcgcatctgtatcaccacaactctgtcactccttgctctagcaccatctacagtgacaccaaaggaagtatgcagcagaaaatgaacgtgaaccgattcctaggaaactgtgcgatgctggtactagtcccaggaagaacatgctagtacctgtggttaattgaggtacatcatataatataaatagttgatatcatataggaggtcacaccttcagaataacttcgaaaaagtaaacagtaagtagagaagtagcaacggaacttagtgtagctagaacccagttacaagcaactggttgggattagatatgaaacccaactcttcaacttcacttctttctagggagaggaaaaataaggttgagttcgtatgtactcagcaagtcatgaaaaatgtgagtatgcaagcttcgaaggagggctgggtttatttcataaatctttcttcaaaatacatttttttaaaacactaagcgtgggttgtttttataacatgactgtaaagaggctttcgcttcaaccctattcatgaattgatttgcaacaactaaagcagacgaagcaagttttagttgattgaaattactagtgaagtctattgctctgccatttgtctaaccaaagaaaatggctcatagtctaccatcaggcaactcttatctcttctctcctctggctgattctagtaaatggttctcattcccacaatccatttttacaaagcataggcaaagaaatctacacaagaggaaccattgcacatacacccatgaccatgggcgcaattgtccgaacagtttcatcctgcagaggtgcacgctttacccacatgactcgaacttacttcccacacctgtagatagggaaggttcatgtcaaggccttcccaaaacaattctagtgatacctcatgcacgatagtcaatccactctcaaacaagtagtatgcgaaccttctgcatcctcacccttctccagaattcggggatgtcacctcactgcacatcccgacatttctcacctattggcaaatgaggtatattgttctggctaattacatagccagccatgtcctataccactcatgtgatcgtactgtatttatgatcagtgtaattccacaaggaatcgatccttatatgcaaatatagaggattgcctccaataaggccgctttgcatcgtgtgttttcgaaaataacttctattttcacaaacattgcaacaccacgtgttgggattttaaaggttttgcaatctagttttacatgtcgacaagcaatgcttttgtgagtgggaccatcggcaatatgaccaagagcacagttaccgaggtaccatggggtggagtgacaaggcgtactggtatcaatcaacctataggattgatgcaactatcaggtaggtccatcggtttgtcacacaaaccaaggccagtcaatttagtgtgcacactagtaatgtaatttgcaaataaaacattttgtaaaatggggaccatatatggtcaagggtgacttgcctctgtcttcatcttcaaaatctcgagaacccgctccaaaaataatttccatcatcgaagactgcatgcaagatggagaaaataacacaaaatcttacaaagaaaatactatacttagcaactaatagtgccattggtagatctcattttttacaaaaatttggagacttgaacggggtcaagcggagatatggataaaaagatattgattttctggaatttttggaaaagattaatgaattttggaaaagagtattctcaagaatattctttttgtcagactggcatgtggggtccacatgtcagtgatagggtgagagggagggaggtaatgtggacttacgtatacggaagggggtaatgggctcggcccaaagaggagggaggcataatggactttgcaatgtggatcgggcttagtgggtcggcctcaccagctcaagcggagagatgctgcagcatgggggagggaggttaaggaggtggggcctagtgtcatcaacactttatttgaaatcacctttaaatggtctctagcccacatgtcaatgaggtacgaggagggattagcatggatgagcggtgtcagtgggatctgacgatggggtggcggtccaaattttgccgacgaatgacggcggtccgcgagcagtggcgcccaccatgagaataagtgggagtatgggagtccttatgcgggctcaatgtggatgggg

SEQ ID NO: 33540 - DNA, 2205 bp, Oryza sativa
tcatgctgacatgggtgagcgggtgtgtgcgggggtacgatgtgcgctcctgggctggcctgtggccgtggggcggtggcggtgcgagggatcaagttgggccgaagaaggaaaggaggggacgtctctatagggaacattagcacttcataatttcaagagaatatatatgaagggtagttgaaggatttgaattgtggtttgaatcaaaatttgatatttgagctcacaaaaagttttggatttcattcaagaggcttttgactgggatttagaatatttttgagaaaaggtcttgatcttcagtataaattgaagaacaaaaggatagaaaaaaatggaaaattcaaggaggtttggatttgaaaatttgaaatttgaataggagatatttggtgggggggggcattgatcaggaagaggcttcagggacaaacttgatgagaccttggcatttgggtttttattagagtaagtttcataatggatcagtttttattaccttcattgcatgatggactaggtggtagcataacttttcactttgggctaggtattattaccataaattcacttaacactagtggcccatatgtcagtcaatgtccgtaacccttatctctctcgaacactggtggccaacaattaacagatactcaacctaatcatagctacccatcatcaacttctctcctgaagcagcttgttggatggaggtttagcttgagagattgcaggactaggagggttgagcttgatgcagtgacgggtgtgggcgagatcgaccgagtggcctgagctgacaaaggtcgagctcaaacttgagctccaatgcacaagcagggattggaggaggtcaagctagattggtggcacgatcttgatggtctgctcaccgccgatggtgagctcaagtgcggagcaacgctcaatgcagctccagtgcaaggtcgagcttgatgcagtgtagggcaggggcttgatcaccggccagcggcagctcactcaaggtcctggtctcccagagccttgctcatctatggtagcgaccttcagctagatggcaggtacacctttacagattgggtacaatacaactcaatggagaagagagttggagaagaacaccggttcaatgtgcaactattgtacagttaacaggcccaatgtgaaaatataggtttacctctagttcactgtgcaaccaatgtaaatattagtggtccaatatgtaattcacttcttttattaaaatagtttttaacagaccataaaatagggcatgcttaatagtttacaaatagtttacaaagggtgatttaattgagatctttggcacgcaaacgtagctacgctcagagaatctagatttttgacatagcagggttcgtgttaaaatagttttgtcaattgcatggaattcgaggtgttatagtctgcgggggtcagcgtcaaggagattggcatggacccgtatgacatcagcaccaacagggctggtgctaagctcgcggtccctttttattgaagttttctaacgcagtgtttcgaaataagttttcaaagtgaaacaatttgtcaaattttcggcctccttattacattcgtctgcaatatactacggagtatatgtccacagggtgttcgatgttttcctgaacgaaaagctgacctactttcggaaatccttcttcggcctggtgggtaccatatcagcgatgctagtgaaggtggagaaaggctccttctgcaggatggaaggggtacggctaatgctggcgcgcgttttgctggttctccagctggtggtgctggtggtgatcctctcccctctcgcggtgttctacctgttcggcctcctcatcaccgccggcctctcgctgtggcgcttgctgcagcgcgactacggcgccggcgaggaggcggccaacctcgcgccggcgctcaacgtgctctactcgctggcgctcgtccagggcgccctcttcttctactacttcacctcgcgcctcctcgggaggcggctggcgaacttggtcgccggagtttacagcttcggcggcgagggggaggaggaggatgacggcgggcgcacgtcggtggtggagtacatgcggcacacgaggaacggatgcgagaaggacccgtcgtcggtgagagggaggaacctcgtcacgttcgccgtgacgatgatgaaggagtcgt

SEQ ID NO: 33541 - DNA, 4261 bp, Oryza sativa
agtcgtcgtcgtcgtcgctgtcgtccggcgactactcctccggggctaggatcctcgacaagctcctgtcacaggcctggctgcgggagcagcacgagctcatcaggcagctcgtcgggtcgtccaccgacctgatggacaagctgctgcagacgctccggtgcacggggacccgcgaccgcggcgttcgggagcacgccgcgaggatcgtggcgcacctcgccggcgagatcacgctcgccaggttcccgcaagggatccggtgcatatactcgctgctcaccaccccgagaaaccagcagcaagacgacgacaacgacgacgacgacgacgacagcgcccagtcctccgatcactacaagaagctcatggtgcagggcctcgtcatcctccacaagctagccgccgcggagcacaaccggcggatcatcatcaacagcacccagggacggcagctgctctccatggccatggcgcccgtcagcgccgacctgctccaccgcatcgaccacgaagcgtggaacgacatcgtcgcctgctcgctgcagctcatgtgccggctcgtcaccgcccccggcgagaccggcgacaagctgcgttcccaggtgctgaacgacaaggacgccatcggcaccatggagaggatcctcaactgcgacggatgcaacgagaagaggctctatattctcgccattaacatcctcacgcagcttcccatggcggcgaagaacaaggtggtggacgaggcttcgagcatgagcgtcgagagcagaaggaaattcaccaagctacttctactcatctataccgacgaagagaaggacgcctttatgagacaaatggcaggtgaagcattggcaatgctgtccgaacgaagcaagagcgacgccacaatcatcttgaaagcaagtgacagcactctcaaggacctcaccgcaatgctcttggatgtaaatagcaacagaggatacagaatatgtgcagctgaaatcctggagcatctgtacattcgatacaccaagcaagatggctatctcaacaatctgacggaagccatgaaagatgtgttgccaaaggtgatcaatatcgaataaatgaatatattatttagtttgtttcatgttgattaactaataagagcaatgtctgtaacaatatatatatatatatatatatatatatatatatatatatatatatatcttgctgttcgtttcaggtgctcggagaaatttttcttgtgtcatggacgcataaagaaaagcaaccaggaatgacagaacaaggaacagagggagttaatttctcggcacaaaaagctgacattgaaagtcaagatcccgttgcttgtcaacatgaaaaggttaaagaggaaaacgaaaaggttaaagaggaaaatgaaaaagttaaagagcaagatgaaaaggttaaagagcaaactgtggatatgaaactttatgcagctttactgtcacttagtgaggcaatatttcaaagattggtcaatgatgataaagatttggctgaactgactgataaaattgccccaggaggaggcactgcatttagcttcgccggaaagctcaaggagatggtagaaggaaacagtgaacaagcaacagccaattgcctgagaatgctgaagattactaccaggatgatcatatcattgataaatctcaatggagccaaagtcggagcagacctggagagcttgatgcattctctgttaaaagcttcagaaaagatgttggaactggagggcttcatgattttctctagcagcgatcgtaccgaaagcacgaatcctgccaacattctcgcttccctcgtgaaagaagcacaggagcttctggagaagaagaggcaggcacaaactacacccgctccatcaatggagaccagctgattgagtaaacagactatcaacacgatcgtatgctgatctgcagactgttggcagtaatacctggaaactgacaccgtacaatccctgaaaactgtctctgtaatctgtatgtgtgctgaaacttatctatcttgtcaattgtcccatctatttcaaaaactttcaagttgaactttacaacaaactgttgagctttattggcagttcgtataatatcctcttggaacagtagataaaacctatctgaagaggtgaagaggccaaggatctgcatcaacctactgcacattcagtacttgctcacctatgttaggggtgaaacaactattacataattcgggtattttgtatgcattttaaaacaagttggataatcagagacaccaattctgatgtactcgtctaataaatttatccaggacttcggacggaactcagcccatctgaagtattcagttagtttgttaggctttgttagatagggttgttagtcaattagaatcaatcaatcaagaaagttaaatctatatctagtcctcccttctatgtccatcctcattcaagctctgggacagggaggctgcaggcctcgcccttcgccctcccgtcgagcaccccaattcaatctacgcacacaatatcttggtatcagattcaagcgatcctttcctagctttcaccgtggctgccatcatgacgacctccatggccttcgtcattcatccatggccatgcagaacgccatcacagagatcaaggatgggctcgacaaagtgacaaaatcggtattggccctccgcgcggggtttgaggcaaagaaggtgcggggagaaacaacgacgatgacgacgacgccgtctctgtcggccacgtggtcggaggtggaattgctgcaagccactcgctgatgtggcgccactttctcagccgttgtccttatccaaggctgtggtagtggtgccatgcctcgtcatagtccagtctattattcaacccctgtgctacatccgtagtctagagaggttgtgtaatatctataaaagtgaagatacaagatataggatgggactctcttctcattcttcattctatcatcctcaagcacaagtccaacaatgagcagcccccctcctctttatgtagctataatgcacatatggacggtttagatgtgggcccaattagtgtatatatagaaggtttccatgttgcatatatggaaggtttcttgacactcctcccttgggtactcaccgtgtgatgtctatgcctcatcaaaactccagaaaacccagtgggaaaaaattgaagaaagagtacatagcgtacgcttgcaatgtcgcacggattgcctctttaaaaacctggataagaaacttttgggaaaacttatctaaggaaaaaagagtacaatgcacccaattctttgttcaatcattctagattgattttgggtacttgatttctatatcaagattctgtaatgagtcggcgaaattctccccctaaattttgcatttctctaagtctcattattccgatttcttggacacacctattcaaaagatgtcaataatgagttagtggacaaatctgcaggacttatgcattacttagttcgttgcttctatgcaattgatgcacatagaagagcttggggttcatgtgcttagtgagtttgctcctcaagtaactcatttgcatatatgcgacatatactgctttagtttcataaatggtggggggttgagatagttttcaaactgcgattgctgttgcaggtaaccatctctcaaaaccatacctagactttgaataattcaacgatgcttagttcggtttagttcaactggccaagtattcttgtgctgctacgacacactcgtgtttgggaattttgtcccaatttggcggtaattaattattctaaagccatgcaccatgaacatttctatatgtggttggactgatgtactagacttccatctgtcgtatgcctttagctgcaagcgtaagtatgatttggatttggccaaatatttcaaattaaacataaattcaaaacgaacgagtttgtttcttcaattattttctagtttattctattctttatgtgttggttcgggacctagtacttcttcatgtactattatgcaagtgttcgatccaagctcctgaaatgcattcattaattctatcgtcaatgcttaccaacattcaggttgatttcttcttttcaacttctagttcattaattccattcaaatcctggttgactgctaatgagttttgttgtctaaaagagacattacccataataggtctcattgccaacttctactggttgcatga

SEQ ID NO: 33542 - DNA, 11899 bp, Oryza sativa
  unsure (1)..(11899): unsure at all n locations
tacaaggagatgattttcatatgcttcttcttcttcttcttattgcttaatgcctcttgatgtgggcatgtaccaatgttagtgtgcactccagcagttggttttcttccttgatgggaaggtgcggtacacctattttgaggtttcgtgccgtttgctagatctcaactagccccccttctattcgatggggtactttttgtgactttgagtatgatagtccctcttgccctgttttcaccagacgtctccagttactttaggggcatgaggagccggagtttcttgtccaattgtttcttttgttcgaggcctctagacatgatgagggatacctttgctttcttcggtatttcaccctcctccggtgcattaattcatgcaacttagtcaaactcttcgaaatcataaaagtatttacaaagtgattttggcagtttcaattctttctgcatactacattcactactagtgcggtgtaacatgtattagtccctttctactatcatatttgctgacatatcctatttaggggttcattctctccaagcctcgaacaaggatactttgctgactgaatttcagtacattgacttcaagcctctcgtgacattgatggtacaaggtttaccatatcattgatttcttgcttgctcaacggccctcatgtcacatttttgaaggggcatttctattcagcacttatgtacctgctacttcccaactacagcagcatattttggttcaaaaaacagaacaaaaagttgagcccagtgagtacagctacacatagaagaacaaatttttgtgtaataatacattggaagatggcctatatcatgatagtcaataaaacatgcatgtatttgttctgaattcacaattaaaacaaattggattggatgaatttctaatgttctgttaccttctcaagcatataagcttactacagaagccttaaaagccatgttttaggtggggctttcctttgctgtgggaaagaatgtgcaacctctttgtacaaactgtagttaatgctggccaataaaaatagatgggggtagagtgctggcttatgctacttgtagcttttcatttttctcatgcatgattttcatggacgactatccattttgtattgtttttccgttgttgcattcgaccttaggtataggaggcatccaggagtccctcatctatacagcagtatattaaaaagttccatggaaatttaaaagcaggaacttgcacttcttcagtatgcaatcatgatttccactaatttagttgtctattcagatttcagaagatgacagatggatctactgcctggttggaggattaaaccatctttgctatcctaatcgatgttaaagagagcttcttcaatcctataaactcataatctctcgctaaggcatgtgaagttgtaacaagaccaatggacgacgattagcccaagcagaagtgtcccacccttttcttccgcctttctctactgcaaaaatagattgaaagatgctagaaaagaagcgttcttggtaatacaggaacatgaggaaaataaatagactataagctgctttgacatgggtgagtacacctgttatttttatgcaggtcctattttttttatcaaataaactttgcctcatattcatatcattaacggtttggaccatcatcaaaatgcatgtaattggacagttttactctatgtggtgctaatatgagctatcacagttattttatgccaaagtattgcacaatgaacaagttaatggttaaatacgataaggaaaaataatttcggctatgagaacatgttccagcaacaaaataattatgaagagtctatgacccaagcttgggaatatgttattgctgaaacaaatatgatatcttgtttggtcaaatcattacaaggttccctcccttcctctattatcttaacctccagcctaaccggtccctctctttctattccaccgttgggcccagcagtcatccaggtgagctggtgtcttgaggccctctcacccatgctgctgcttaggtatgagccgaaccagttgtgccacgtccaaccatttaatgcgttgtgcctgcctatcttctccctccagctacaaaaccattacttttcagttcattacatgaataagcaaaaaaagaacattattagagttgtcgaattagacttatgactgaattgaaggttgattaagcctgaagactaaaacaaaccattttaagagtaaaccttcaacaacaacaacatttatgttagcatacttagaacaggataaatattatgtgccttccatcacatttcaaatatctatatataaactaataatataaagatacaattctattattgacaatggttttgacttttgataatgcccttctgataggatatgtgtaatttttccaaatttactaatttaaacaaataaagaaattgtatacaaaataacctcatgccagtaaagagacccatgctgggctcccatatggcaaccaagcaattaaggcaaatcgattacactttcaatatttgagcttctacacatgaggcatcagaatgtctggtatcatgcttcagattcctcgtgctagttctttccaccgaactagagatttctcatgccaattcacaattgaattcccatctggttgtctgttcaggcagttaacaagacattccccacttttatgctacaacaagggcctcatcctatatacctatacaaatcatcctcactaatatgaatttgctgccatgaggtgcagccacgtcacttaaattgtttcagccgttagatgagcatctatcaacaatagcaaccgtcagatcaaaagatcaaaagctcagatagcatactggtacatgtccatttatttggcccatcccaaccgccgcttccattacggcccattgcatttgcaccagccgcctctcccaaaattttctccgatcaccacagccatcgcttcgcctccgtcttccgctctggcgccctcccatctcctcccaaccctagcgcgcgcgttcagagttccacaccgcgcacacgccgccacctgcatttctctcgtgtcgtctgcgctccgctcgcaccacctagcaatccccgatcccctgcggcgcatccaagggaaacgccccgcgtctcatccctttcccctccccggcgacaggcaggggaatcgacggccaccgcctcagtccgcttcgtctttgggtcttccctgcctaccgccgacaaccaccaacgagcagcttttcatgttttccatgaaaacaattacttcctgtagctgtagcgtaacagccaaatcaccgttgcccttcattgaaatatgaatattagtcgatggtaacgcccgtctacaaaagttgattgccttgcatttttcatagtcacacgccggaatcagcagtctcttttccgttgcattggcgacctgcagcaaggtgccatttttgttccacccatcctccttccttgctatacactttcttatttgtttgtctccttcacctgtccttcctgcagaattgcctcttgctttctctaaactttccttcacaatgtgctgtacgcctttacatgtgcaattttcttaacattttctctcttttttctgtgtatgtacattctgattcggctacctatcggggttgtgggggaggtaaaggtaaatcctgatgcccaattttactgcaggtgagagaatcataccaattaaaggtattttgctgttctggagcaatcgatcaagtaattcgttacttttaggggtgtcaaccttatgtatgtatgatttgcaaagctgtccatcattgttttattatatatactcatatagctagagattttgtaggcgaatttcttatgtctttgatacttgacatattttgtaacgtgaaccttccatcgccacaaactactatgtgcacggttgttttttcctggtaaaacactaaaacatgaatggtctcagctcatcaccagacaattggatggaaggaataaaccgaatccggtctcttcctcttcaagcttacattggtggaaatattgaagggcttcatcttacatgatctcactggtacgtaaacttgagttcagcatataaatatagtagtatgtgttttctcaatgtttacaaccactgcatagcacagcaccatttggtttcatgaagctcactcactgtatcgattagcatctggttatccaagaacaattcaagttattatggctttacctagccatgtgttgtctacacatttttttgtttaatctatgattacaatcaactgcacaattttcctttttttcccttcctgcacatgtcgtttagtctgtaaacaatagaaatcccctgtcaacttataggtgagtctgttagattgctatgtcgcatattatatccccatcaacatatatgattatgtcagttcattggcttctctttttttctttaaaaaaaagctatttcataatcctacaatatgctattccacaatgttccgcagcaacgcgcagggtaccatctagtttactaggaaaatagtccctattttgtttctttggatacacagtgtgtacttatcttgctatcgaactacttgctctctctaaaccttaatttgtaaactaaggcctctgagtgttttcagtcatatgcctatgttgaaaacaaatagttggcttaagcgtgcacatttgaaaattggttttcataggcgagccacgagcagcttaagccactttcttgtgaaaataaaattttaataaataacacatatctatacataacttttccatataaaattggatgaagattaactttataataaaattttagatcttgacgagacctacaactttgtagttgataaccttttcatttgagaatttgttagaggccgaaacattcattacaagatctcatatatatttttataaaatatcatatatatctttcaaacatcaaagttatagggctcgatcagatctacaactttggtactaatgacctttttatttaagatcatttagaggaccaaataagcgtttcaagtcttgtagatgtaatgttttagaaaatagtgtgatggtaagaatagatgtgtgtggactatgggtcttgagttcgagtccttaacaccacacatgtgcgtacatagagaaataaagaaaatgatgtggcttgtgacttggtgtataaatgtgtatagacgcctactcaaattcaaaatgtgtatagaaattatcatagttgggcagtccagctatgataatctctagttccatagacaccaagaggggggcgggtcactcaaccacttatcaaaatgggttnnnnnnnnnnnnnnnnnnnnnnnntttatgtagcactggctttcactcattttttaagcatgggcaagggaggcatctggaaattggttttcatggctgctatgaaggagacttgagagttgaatctcctgttcagcaattgcgctcatcatcgatcacctccaactgcgatgaagtcattcccattaaagcggaagcgcccagcatgtgtcgctctctttgatcatgaaatccaccaataccagttaggtgatctttctcttgctttattccttcatcttgccttccatgtcatccaaggattttgtttcaagagttgtgcgtgagaggagcacataccactattactatgtgggaactatatacaaatgttaacttagacgaactttggaaggatactaacacagcacaagagcaattagctgatttttggaaaaggttagctatggagctttaaactggtatggatggaaaatttccatttggcattgtgcagcttgaacacatttcaattatgttatataggtttgatgcatcttaattttttagtcccctccagaaactttgcattaaaattgtgcatattttcatttcaatatcagagaccaagagttgattcttccactatggtctcactttttatatgacagaaccaccataactactagaaccgtcaaaccaaaaccatatataccacgaattttaatttgcacttggcttcttgatgtactacactactgaaaaagaatgttttcacaggtggccaaaatggctctatatatgcaggtggccacaggttctgcctgcaactaaaagtctgcgaagatagattgatatagttgtgatatgggcctcgtttctagtagtgcaacatgcacatgggctcgtttttattgtgcctgtaattatgtaaggcaagtgaaaaattgaattcacataacaataatgttggcaaagaagaggttcatcttgcttcgctacagatataaaaaaggagtgtgttgtagacccaataaaacaatagtacaatgctagctgacatgaaggtttttccccaagcaactttttttacatgccctcgctccattttgaaattatcagaaaaccgatgtttgagtactggattggatggcctcggggacatcagtttctatttcagatacaggcatacagctacagtttttgtgatagctgagtgcacacaaacctcaccgagtcgacaccgcacactgacatcaacctgagaagaacaaacaatcgttgatgccactgtgatcttaagtgtgggttgtggtggtgactctacgcgagcatcatctctgaatctctgtacacacaaacatttgcttgtgaaatgcttacccttgcacctgatattacaacggccaccaacgacaggaaaatgttttaccgacagacaacaacctactgcaagatgtgatggtgtaacaatatggcctagccgtattgttttgctccatgggaaaaaatgtactacagcctttctttgaaccaacacgacacaagtgatcaagcattgggccgggttcacctgatatcactcacggcgtaacatgagtaatgtgttaatccaacttggcctagtgacaaatcgatcctgggcagtagtttctggtgtgactgtcactactacaaaaatcgtttttctgtacaagggggtcggtaggttccatggccgcttgtggcggcgcctgcaaaaaccgcccccccgggggcgggttgattagccacatgcgaagatccattatcgcatgcggctgcttaagacagccgcatgcgataataggtctattttcgcatgcggctggcttaagggaccgcatgcgatgatcggccatatatgctcctccaggcctgagcttgaccatttgaaaacgaagctttctctctcctaaagcaagcaccaattagggggggaggttttcaactcgaaatttttacttgaactctatacgaaaggtgaagaactctctatcctgcttcatttggctccatttttgttatatttcgttggtggaaagtggagtttttttaatattttgacaaggtttgttctaactattttttgcaaaatctagcttcaaaatatatgttttgatgggcaaattttgcatgtaatcaattgtacatactagttacatgtattgttgtattttttttgggagacaaatgcatttaaacttttgtatgaaatacctgcggtctatttttttatctgtaacttttttgcctttatataattagatggatcggtcgtcatggatgtatgagatgtggagaacgcagccgatatttattaaggaagtatctaaatttattgatcaggctaaggcgcatgctttgagggagaatatgacaaagatcttttgtccgtgccgtcattgcaagaatcagaaattgttggtagatcctggtgaaatattgggtcacataatggagtacggattcaccaccaactacaaggtttggacctatcacggggaattcgccaatccggaagatgacgatgaagagttaagtttcgagatgaatgaggcagagaattttataatcgaagacatgtcgcgtgaaagaatggttgtcgatgtttccaccgatagtgatgatttcgatggtggttttgatttagaggatatgctacgccatgttgaaccagatgtgctagcgggcaggtcacgaggattggagaattggcaggcattagagaaggcatcgaaggatcgtcttttcgatgaaacgaagggatgtgataaggatttcacagtcttgcgttcagtgcttgaacttctgagattgaaggctaaacatggatggtcggacacaagttttaatgatctgatgagtttgttgcgtgtgttgcttcctaagcctaactttgtaccatcgaacacgtatgaagcgaagaaactcatatgtcctttatctcttggtgtagaaaagattcatgcttgtaagaatcactgcatattataccgtaaagaatatgcggaattgaaatgttgcccaacgtgtggcacaagtcggtataaaacggggaatgggcccgtagattcagagtgtaccgatccagattctgataagggtaagcgcgggaagattccttcaatggtgatgtggtacctaccaattaaggaccgcctgaagcgtctgtactcaaacccgactgatgctgagttgatgagatggcatcaagagagccggaaaatagatggtatgattcgacatcccgccgacgctcgccagtggaagacatttgatgcaaaacacccagaatttgctaaggatcctaggaatgtaaggtttgcgttgagcactgatggaatgaacccgtttggtgacttaagcagctcgcacagcacatggccagtccttctcacaatgtataatcttccaacatggatatgtcagaaacgaaagtacattctactcactatcctcatacaaggtccaaaccaacctggaatcgacatagatgttttccttgagcctttgatggaggacatggaggagctttggaaagaggggttacgactatgggatgagtttaagcgggagcacttcaatctacgtgcgatcatattcgttaccatcaatgacctacctgtaaacttttcattatctgggcagattaaagggaagactggatgtctgatatgtctggaaaaaacttcatacaaatacctgacgtcgtctttgaagacagtgtacatgcgacatcgacggttcctaccacaaagacataggtaccgtaagatggctagattgttcgataatacagtggagaatgacaatgccccagtagcaagaggtggtacatacatgtatgagataacaaagaagattaaggttgtatatggaaaaggaaagaagaagacagtaaagaggaagaaagctgatggtgacaacggtactgcgtcgcctttcaagaagcactcaattttcttcaaatacttagattactggaagaacctagagattcgacatgcaattgatgttatgcacctcgagaagaacgtgtttgatagcaccgttggcacattgctggacatcccgagtaaaacgaaggatggattgaagtcacgtaacgaccttgtagatttgtccatacggcataaccttcacccagtagtgctgccaaatgggaagaccgagattcctcctgcttgttactcgttgacacttgaagagaaaaaagccttctgtaaatgtttacaaggggttagagtgcctactggtttcgcatcgaacatcaggaagctagtatcaatgaaggatttgtccatttcgggatacaatgcgcatgactgtcataggttgctaacggtgttcctaccaattgctataagggcagtcaaaccagtccatacaaaggtggttataacaaagttgtgctactttttcaatcgaatttcgcagaaggtatttgatcctttggaattaggtccgcttcagacatttgccgtcgagactgtatgccagcttgagatgtatttcccaccatcatttttagatatgatggagcatttgatcattcacatcgtccctcagattattgaacttggtccattatacttacatcagatgtgggcctatgagcgttacatgtcgatcctcaaaggctatgtacgcaatcgcactcacccggaaggatcaatgatagagggatacacaactgaagaggcagtcgagtgttgtatggactacataaaggatgctaatgccattggcattcctgttcatcgacatgaaggtagattgtctggaaggggtactgttggtaggaagcagttcttcaataatgattacaaaaaggtgtccgcggcacacaacagcgttcttcaacagctcgctatcgttgagccattcattgagcgacacctagaagaaatcaaagcctgcttcccagggcggtccaatgattggatatcaagagagcacaagcgtcgctttcctctatggttgaaagatctaaacctgccagttggtgattctgtggaggaacttactttacaaagactggcatgtgggccttcaagtattgtcaattcatggcaaggttacgacatcaatggatttaccttgagtacgactacgaaggacatgaaaagcaccgcacaaaacagtgggatccgtgtcgaagcgattgacacgagtggagaaaagaggtcgtattatgggaccattcaagaaatatgggaactggactatggcctaaacatccagatccctgtgctctattgtgaatgggttaaagacacaataggggtttccgttgatgactacgggctaacgatagtcgatcacagtaaaacaggccacaaggatgatccatgggttttagcagagcgtgtggctcaagtgttttatgtgaaggacccttcagatgaaagaaaaactattgtcatatccggaaagcaacagatcgtcggcatcgacaacatcgaagaccccaatgattacaaccagttcgacgatgtaccattgtttactgatcttcctatgcgaattaagaaggttgagagaacaatcgatgaagcaaatatatcgtacgttcgagcagatggtgttgccaaggttattaagtcatagttatttcgtaacctttagttctcattgtattccaaatgtacgtgcatgaatttaggtcccccttatgtagtaatcattagcatgtaacatttgattacgagttttgagcaattttcatgagttttcttagtgccaaaaacatttggaatgtataattgtggcgaaatattgggaaaaaaatatatatggacagtttacttagagaaaaaaaaatatgagtttttttggtaaaaagatctttctatgcggacgacttaagccagccggatggaaagatctttttcccatgcggccggctttatggcccgcacggaaagatctttttcgcatgcggctggcttaacagcccgcatggaaatatctttttcgcatgcggccggcttaacagcccgcatggaaagatctttttcgcatgcggccggcttatgtcgaccgcatggaaagatatttttttcatgcggtcccttaagccgcccgcatgcgatgatctgcgcctatatatagggagagcggggagccaaaattttctaagtcccggctcccgcgaaaccctagccgccaggctgccaaaatttcccaagtcgccgtcgccgtcgtccccgccaccgccggctcctccccaaagtcgccctgccccacgccgtcgccgccgccgccgtcaggacctctccccctcgccgttgccgtcgccgccgccaggacctctcccccctcgccgtcgccgtcgccgtcgccgccgccaggtcaccgtcgccaccgcacgaaacgctcccccctcgccgttgccatcgccgccgccaggtcgtccccgccgccaagtcgtccccgctaccgccggctcctccccgaagtcgccccgcccctcgccgtcgctgaggccactgccaggacctctcccccctcgccgt

SEQ ID NO: 33543 - DNA, 14882 bp, Oryza sativa
  unsure (1)..(14882): unsure at all n locations
cctctcccccctcgccgttgccatcgccgccgccaggtcgtccccgccgccaggtcgtccccgctgtcgctcggtaacatttacttttaaaaaaagaaatgtgaaatgtgcaattgtggattgtggattgtttaattgtgcatcgtggattgtgatatgtgcaattgtggattgtttaattttgagaaggtttaattgtggattgttaaatggagatttatgtttaaattgggacttatgtttaaattgggacttatgttaaattgggatttatgtataattgggacttttgttaaattgagatttatgtataattgggacttttgttaaattggcacctatgttaaattgtgacttatgtttaaattgagacttatgttatattgggatttatgtataattgtgatttttgttaaactgagatttatgtataattgggacttttgttaaattgggacctatgtcaaatggagatttctgtttaattgtgactgatgctaaattgggacctatgttaaattgggacttatgtgaaattaagttattgggacttatgtgaaaataagttaaattgtgacctatgttaaattgagatttatgtataattgggacttatgttaaattgagatttatgtataattgggacttatgttaaattaggacttatgtcaaattgagacttatgtgaaattgcgttaaattgggacttacgtaaaattgggacttatgtcaaatttttttacgtcaagttggaagatgtcgaacgaaaaggttccatcgaacgcaccaatagtgcctcaagaaggtaacgctcctcaaaattccggtagcaataagcagccagacgcttctagtgaagaaacgtggcgcacaccaagtgacccgtttccaatggaaataacacaagtcgccccccgcgatgatgatccggactacatacctatcgaacaggccgtaagtgctgaaaatcgttagccatgtattattccctaactatgatgtgacatgaacctaatggtgtatagagttacctattctgtgcagatggtagtccgacgccgctcgaaacgtggaagtccgatctaaatcgggattatgttcagaagaatctcccaccgtttacggattatggacatatatcgcaggctgactgggacacgtttgttgcggatcatacaacagctgaagcattggctttgaggaaaaaaatgtccgagctcgcgaagaagaacaaatatccccatagattggggtcgagcggatacgctggtcacgtcgatcaatggcaggagatcgagcaaagatttgccgcggccggtaagcccctgctggtagaccccatggttgaacgtagcaagaactgggtttgggcgcgcagcacaggtcaagtctcggatgagggagacatactattcgagactccagacatagaagaagtgactactaatttgcagcagatagtcgagaaagaaagatcaggacagttcgtcccacggagggagcgagatcagcttactgcggcgttggggacggctgaacactctggacgtgtaaggggtttgtcctcaaagacaagttggaaggtcgggtttccacaagacgcaccaagttataagaagagagacaaatacaaagaacaactatcggacaagatctatgcgcaagtgaaggaacacttctactcgttggcagctgaaaacccgacagcctttccaaggttattccctgatagccagtaacccacacaatccgcacagcaaacaactaatgtacccagcagtgtaggctcagtgcagacaactaccttccctgtggatagtataactggaccaactccgtgcagtctcgtcgtaccaatcggccgtgctggaaagactaagaaggttgcaacgggtttagcgatacccggacgtcaattccacaacacggcaatccctgaggattacgcaagggtacaggtcgccaaggtccatagcgaccacgtttccttggaactagacatacctgcacctgaggggattgaacttctcggtgatgcagtgaatcagtttatcttgtggcaccgcagagacataatcctgagcgcggccgttcctgcagcaggatcttcaaccccatcttcatcgcaggcaatgactgctgccgctcctgcaccaccgtcgcctcctgaaccaccgtcacctcgacatccgccgtcaccaccaccgcttaggtcaccgcctcgccaacctacaccaccaccctccccttctcaacaaccgcctctcccggccccgcaaccagttcaagcctctcccacctccctagctaaacagcatgctcccccggctccgccctcagttcaaacctctccacctacgccccaatctgctctggtagaacaagtgcacataccagatggtactacatccgaaccaaagtctaatactttggaactgagtcgtataattccaaagttgatatcgacatacgacccaaaggagattgacaaggataaggagaagttcatgttttcagctttcaggaattctgagaagagaaaagaacttgctcacgtcttgtcagactcccagaagtcagtactagcggcccaagatgaagtgcaatcctggttatctgccgatgtgcctgaaacttatgagtatggcaagccattcttgccaacttatcttatgaacaagctaccatgggaaatgagggtaatgcacgaatggtatatgaaggcatctaggaaaggtctcggtttcataagcgtcgccgtcccggaaggcgctttcatgagtggtcctaatgggatattttttatctctttccaagaccattacgccctctacaagctagataaaatggacgttaatctcgttgcggctttctgtctgtaagtctgaactctttattacatgttgcacgtttcattcgaaacaaataaaccaaatctcatttcttctttattcattgtacagtatgcaattccacgaagctgatagaactggagcaaaggttggatacgtcgatccaacaagaatatgcaaaacacaacacaccgtagagctgagagaggactgcgagcaattggttggcaagaccccggaagaaaaggaagaatatgtgaagacattgcacaagaggaagaagctagaagtagcaacatacttggcaatagcaatgttggcgcacgccgacaaagatgtcttaatggtcccctaccagttcacgtaagctctctcttctttttgtttaattaatttatcttcttcggaattttctgtctcgaataagcctatcttatatgtagagaccactacatattattccttgtatatccgaaagaccaattgatcatatcattggaccccgcacactatgacaaggagacatttatggaatttctcactattttgaatttgtaagtgataaacatttcattactataaattgtttaggtcgatcaccggtcttctaactactaataaaacaattgtttccttcaaacagagcacacaagtactaccgcaaaagaggtggaccagtacatattccatcccagaagaagttatctgtcaggactggctggccggtactatcaaatttataccaatacaactaattatcgaacagtacatatatactaaatatatctactgagatcggtccccataattatatcgcagtgctacaaacaaccaccaggaaccaacttgtgtggttattacgtgtgcgagatgctcagagtaaatgggaggtacaaaacaaccagtaaccgagtaggtcatcgaactcttctctacaaagaaacccatctcgcacacacttctcactgagtaccattttattttcctttctgtgtgcagatccccgaaatcccatatattgcacaacgattcaacgacactactatcttgaacgtggccgctgacctctgccgattcatccgtcgcgatgtctacaacgcaagaggtctcttctacgacaaccagagtgaactcgcaatggacgacaaatttaaacctctcagagagtgggagaaagaacatatgcaataacatgtacactacttatacatatgcaataacatgaaaaaactgtgccacttgctattatatatttgtatgtaaattacgattgaattaatggttatgtattacatgtttgttactgcggcacttgtcttatcttatatgcttactactccgaaatacgataataaatccctcaataatttaatattaattacgaatcaccaaaatgctagaataaatattattttagctattcggaaattgaatttcgcatgcggtctacttaagacgcccgcatgcgaaaatagaacttcgcatgcggtcttcttaggtcgaccgcatgggaaaatatatcttcgcatgcggcttcttatatggaccgcatgcgaagatctattttcgcatgcggccgtcttaagggaccgcatgcgaagatcgatcttcgcatgcggctgcgacggccgcatgcgcaaatggtgatctttgcagaccatttcgcgcatgcgggctggccaaccgcatgtgaagatcgattccgcccgtatgcaaaaacgctttctgtagtagtgtgttaatttcaccacgaacaagcaataagtccagtgcaatatctttgagtggagttcccagaatatttgtcccatgtgtccccgtggtacggtaggggtggttgataattttggaagattattgggaatagaaagttcattttttaggcaaataattaaatgtgcaacacatatggttctatgacaaataattaaatagaatattgtcacagctctaactccagctccacttctcctggatctgaagctcaaccaaacagtttcagctccacctaaaataagagtgaagctgggtggagctctctcacgaaatgatctagagaggtggagctggatttaggcagctccacaattccactccagacccaactcctttagctaaatttaggagttggaccctactaaacaggccctgcataagaaatccttatctctccaataggtttgagtttaactattctactagcagtttcatcctcatggtctataaaaaacactcgctagattaaaacttggataaatattaataagagaagggcaggtctatagctagaaacaagggtttttatgggtggtggaagtagtaaaaagcatggtggacgttttctgacgagttaagatagcgagttattaactactccctccatctaaaaaaaagttagcttctaactataaatttgaattttgttgaggttcataaccataaattcttttttttaatggagagagtacttaatttgaagcatcaagtataaaatacaagtacatgaagacgtcatgtcacacttaaatccggtaccaaaatttgtttcagagaggtataaagcattgcatttcttgttgagtcatccaatgaagttgaacgattagcaatgtagtactataaatcgagacatgcatgtccagattgatattcatatcatcagaaagtgttccctccggttctatgttgctgtattatgggatggaaagagtaatttcgttagtttgcacatacataatattataggaagtagaggcatcatgagtgaaatgtgttcaaaacatgtacgtttcttctcccaatttcgatccaagggcacttcatgttcatgaagtttgatcccctcgaaaaaaaaatgttcatgaagtttgtgggaattctgcggcatcctgtcacaccgagttgggtacagaaattatgtggatttccaatgattatcctaaacttgtacacgtggatcatgcataggttccgacttccgagccgagacgaggagatcagtcataatcaggaattaggcagaatttatgctccaaaggaaacaacagccaactattacatatttttggcttaaaccctaaaaaagtagctaccataaagtgaaacagaatataagtaatcactccacaagcaaaagaagtgatacatcttattcatacaaaaatgctattagaaaatctccattgaaagttggcaaaaatttgtttgtataaccgtaatctctacagtacaacaagcaagatcaatggattcttcctcctcattacacctttgtaggtttgctcaaaaccgaagccaatatgttgctatgaagagtatatgcatataagatttagttatagttttgatattgagtctatgccaacaagccaattaccaaacatatgggcaaaattatgagaaaattttaaaccaaaggatacaagaactgttctccaaagaaatttagcaatataacaatcaaagaatacatgttggatattctcatcatgcataaaaaacaatattttgtattaccatttcaattcatttttgctaaattttccagggttaaaaccacccctttatgcaagtagtacataaaggtcttaattttaattttacgagacatcttcaatctttataaaacttgtttactctctgcgtaaccattagcaattagagctacatagagtgaacataaaacaatccattctggtgaaaattccatataaacatatccttatcaccattaagttgaatatgcacaattttcgcaaccacattattccaattttcaaaatttgtcccactaaattccttctaaagtaaacattaagtgaaactgtactcataacagttataattgatgcattttttctacaaacaatgttgtatagagatggaagtgtttcttaaaggaggaattctcattgcatccatcttcccataatctaatttgttttccactgtttactatgaaaaatccaaggctcaaaatttatctttatctttcattaagcccgacaaaaaagggagtcacccggttatctgactacctcagtgatcgtttgattcttaaatatttttttctccttagtaaatcttgcaaaacaccatcctcattaatcaacttaaataaccatttacttagtagatattgattttgcacatctatcttaagaattcctagtccaccctgtccttttatttgacaaataatattccatctcattggtatattctttttcttatattcatcgctttgtcaaaataatctaataaacaattttttgaagtactcttcttggaatctaaaaaacgacatcgtagatatatgtaccaatgaatgatttttttttgctggtaccgcaagcagctagcaggttgaaacttcataccggtaaagaatgttgctcaataatgctatgatctgcattgttattcatcaagaagcagagtaatttatgaatgctcaatttctaccgttggatttttctttttttttaaaaaaaatgaatagtttatggtgatccgttctgtttcgcatcgatcttattcttcaaaaaggaaaaatgaaatgcacagataatgcctttttaacatagacaagtacactcacactcactggtggagaaactatctttagtcggtcgaccaaattccacaatagtcccggtttcattaaaaaccgggattaaaaacgacttttagttccggttaaaaaaattttgatctttagtcccggttaaaagatgttttttagtcccggttcatcctctgtcagaggcatgtcagggggccgaggatctttactcccggttgatactaccaaccgaactaaagatctaaatgatctaccaaccgggactaaagtggtaatctttactcctggttggtagtatcaaccgggactaaaattcaacatagtatataatccctattccttatcctctcctccacaatcacaaccacttcctcacctacggatcgatcctcctctcttctcccccttcccctctcctccccttcctccttccttccccctcccttcctcctccctcccctggagacggatgaggctgctcctccttccttccccttcctcctccctcccctggagatggatgaggccgctgatgaggccacgccgcgcggacacggtggacgaacggacgtgccgcgtctgcgcaggcgtgcggcgcagacgaccgtctctttttttttttgatattttgtgattcacttagatgtaattttgtgattcattgtatggatttgagatgtataatctgtgatgtatttgatttgtgcgtaatttttttaggatttgtgatgttttagatttgtgtgtataagtaactttaagatttgtgatgtggatttgggatttgtgatgtggatttgagatgttactttatttgggatttgtggtttgatttgggatgtgcatgccatctgattcggaaaaaaataaaaaagtaacaaaaaaaaaggaccatccgggattgtccctatcctctctttagtcctggttggtaacaccaaccgggactaaagatccctctctttagtcccggttggtgttatcaactgggactaaagatagatctttactcccggttatttcgcccgggactaaagatagctatctttagtcctagattcgtagtcccggttaggaaaccgggactataggggggttataaaccgggagtaaagatagtttctccaccagtgactcattgtttccatcgtatggtcagggtatagtgctcattttggaagattatttggaatagattgcgttttaaggcaaataattcaatgtgcaatgcatatgcttatatgagaaagaaataactgggatattattagaaattactgcatataagaaatccttatcccttgaataggtttgagtttaacttaattgtactagtagtttcatgctcacggtctacacaaaataaaaagaactcactaaccgtcggggccagggttacacgccccgacggtaagcacggtaaccatggtaaccgtggcaaactgtacgaaaccatgtaaaatttatcaaattttcaaattatcttttaaatttatttgaatttaaggaggttgccgtggttttccttttaccgtaccccgtcgtaagcacggtaaccgcacggttgctgacggttttgcaaaccctgctcactagtggtgaaacctcaaatagatattacaaagggagagaactcactagtgataaaacctcgaataaatattgaaatgggaggagcaggtgcatagctagaattagaaataaggcattttaagggatggagagagtagtaaataagcatggtgacatcccttctttctataaagttacgactcaaagctaaaacctcagcgtgccacgtcatcactaattctcagtcgttcaatcggtggatgagatcgcgtataaaccattggatgagaaggtccctagtgagatgtcgagttatcctgatgagcatagccaaatcattgcaaaaagcccaactgatgagcaaggcccatcccattgccctgccccaactgttcgctctccttccccgcttgccgtccttcctcacgcagcaagccagcaccataatctcacccccccccctatgcctcttctgcttccgtcgcacctgttttgctcatcttccctgggtgcttagaaaaacggaaaccctgggcgccaaactctcacccttcacctccctggtgagtaatggccacttatttggtatttcattgcaataatctttctttttaaatagtgtaactgatgataagccaaacttcctggatttatacgcctatgaccatgtaatcactactcagaaataagcagtaccctccctctcctccattgcggcagcaattctttcctcttttccaggtcccatttcccctttctctctcgcatgtgttgctttgttaccttatactggagacaaccaagaagtatttcattgattttaagagtacgtgagtggcgagctacatttttgcacattgcattcattttggcaagcaacaaagcaagcaagcatgtggttgctgttcgtctgttgatttatttattgagtattttccctttctacctctggcaatgttttatttgttgctaccatgtcttataacagaagccttcttacggtgttcaatgatgctcatacagccattattttattcccaattcttaataactgtacaatttggatatttttctatgatataaaattttgctttctagcaaaatggattgtttatgtcacagtttattttgtccatatttctgtattgcgcatcaaaagaatacaagatactgtgatgtgtgtatacctatcttcccttttttttctcttccatggttatagttcattgaattgcaaaacgtttgaagtttttttgattgaatcctttgaaatcccacagcaatgcacagggtatcatctagttatcacacaagttaaagacacagagatttattacactactcctgcttactttggagcatcaagtactccctccgtcccattttaagcgtagccatcgagtactccctcggtcttatttgaatttttttttaaaaaaaaagctaaaaaaaacagaagttatacataaatactattcatattttataatctaacaacaacaaaaattttaatcataaaatttaaaataagctgaacaatcaaagttggacacgaatacttatgactgcgtttaaaatgggacggatggagtatcaaatactagtaggtcaagacgtcaagtcacttaaatcggtagaggtaccaaaagtttcagataagtataaaacattacactacatgttaagtcgagaccatgaaatgaagttgaatggtaccaccattaccacatagaaattcacatatccagttggtccatatatataataggattgagaggcatcaggataacacattacaatgaaatgtgttcgatatgtgcgtttcttcctcatgtttgtttgaataaaatgctgtggcgagctgctgcttccagtatgggtagaaatgatgtacgggtatgtagaaatgatgtgaagcccatgaatttggagccaagaataggatgaatagtcacgtattccctccgtccaaaaaaagacaaaccctgggtttctgtgccaacatttgactgtccgttttatatgaaatttttttataattagtattttcattattgttagatgataaaacatgattaatactttatatgtgacttatctttttaatttttttcataattttttcaaataagacagacggtcaaaacgttggacatgaaaaccagggtttgtctttttttttaggacggagggagtaggaattaggcacaatgctccaaaggaatcaaccgtgaattcagttggcactagtatctactactaatgaatgattttcttttctcgctgggcctggagttatatgctggtagtcaatattgttcaacaatttacaattctgtgatctttttttatcaacaagcttagtaatttattaatgctcaattctcattgccatattttttaaaatgaagaatagtttatgacgcccagttttatatttttcatctttttcttcatagaagaaaataaaatgtatggataatggcttgttttgatcctacaatataatactcattgatgacatctcatctaagttttgtgcttctatacaatatagtctgattgtacaaattaaaattgatttttatgaagcaaaatgcagcaaaataatcaagcgccagcccattaaacgatgcccgtttgccgagctgatatatacttggaccataacaaaacttaaatactcgcaattgtacttctgatggtactccaatgatacttaatgatactagccatgtaataggctaaaacttttagtaaacttttaacaaattctaagagtttggctaaattataaaagactttaagtggacgtgtttgagcaaagttaggcagaaagggccagcggattatgactcattacttagatgatagcacaatatacttatatgtagaacaacaatccttgtgatactcagttcagtttaatggggacgggaggggatccagaaaaaataatttcatacctatggaataaatttctttcaatccctttcacctggagattagctgaaaatattatggaaccctgtacatcactacagggtgtgtggcggtatgtaactacaattaggcagtatgtagttacttgatgtcttatatggctactaaaacattctgtattgcaagatatatcacaccccaaatgatatagtaggacatactcccttcgtcccaccaaaaatcgatttctagtggagagagtttatccctaaaaaatcgatccctgcacaaaacactagaagcaataaatgacattgtcctctctcttctatcactcacgctttaacaccaggaatcttatctctatctcatctctctcctctgccttatctcctactctacccatttctttcctctacgagcaggcaagcagctagccttcaacccttcaccactctgcttctccctctcccgctccaacttcttgcactcttttccgcacctccctccccctctctcctgcaggccctgctccacatccctctccctacccacaaccttccgcatccaccttgatgtggtggcgaggaagaagatcccatggagtctgatggatgcagctcgatgcaccggggcgcgttgtaggcaggggtggcgttgcgatgcagtcggcgatggagcttgtgtgtcttcaatctgcggtagatctaatcttggcgcttgatgcatgagccgccatatttcttttttttctctatattccttttctatctttcttttttctctattctgggttcttcctattgcagtagtagtctgatataggtgaacgaacaataattctttcctcatattgtagagatcagtgaattttttttggcgttgtttattctattccagatgcctcttgcgtgtaattaattactgcagagaaacgacagtgctgataaccggatgtagttaatggggggcattttcgccttttcaccttagtactaaacttgtcttggaaactcacgatgtcccaagcccgtaaacgccaattccccttgctgataggcccacccaagcccaaaccgagacccaaacccaagcccaaagtgcccaacggtcatcacgcccatctccaaaccctcgccgccggcacatcgccattcccagaaaaaaaaacaagaagaagaaattccccaactctctcctcctcccacggatggatccccacgccggcgcagttgccagcggcgaatccgccggcgacgaggacgacggcagcggcgagcacgagacccacccgacgtctcccgcgccctccgccaacagcaggccccggaagcgctcgcgcctgaccgccgccgcagacgaatccacgaccgtcgacgactgctccgccggcggcagcggcagcggcagcggcgacggcggcggcggcggcggcgagtcggtgggcgcctggccctacgacgagagcgcagccagggacgagctcgtgacgctcatcgtctcccaggatctgcccgtcgggatcgcgggcagtgcgtccttcgaggccatggtgctgcaagcgttctgcccccagttcgagcgaatcgacaatgctgtcaccatcagagacatcttggtgttccacgaagaccatgtggcgggattgaaggaggagttcaccggtggtgatctctccttcgcgttgtcatgtgaaatctgggggacttcgtatcataggatgagctatctctgcgtggccgctcactatgtcgatggggatcacattctgaacaagagggtgattagcttcaagcttatcgacggcgcgccgaccgcggaggcgatggcgcggcgcattcttgatgttgccatggaatacggcattgagaatcggattgtttctgttactcttggggatggtttagcagatgctgaaaccatggatgcattggctcctcttcttgggtggtacaccggcggatttgtgttcctgcagaggtgcattttcagcatcctcaatgacatcgttcgagctggtttgactgagatggctgagcctttggatgctattcgttccgcgattgcgtacgtttccagttcggaggcgaatttcgccgagtttgagaagtgctgcgtcgagcgaggccagaaggctaggaagctatggcctgattccaaagtaaggtgggattccacatatgacatgctcaaggaagtgcttccctacaaagaagttctgactgactttgtcaatggcagtatgcagcaagagtttctttccgagcacaattggtcgctcctcagtatatttcacaagttcctcgcgaagttttataaggctgctaccaagttgtctgttgtttacagtcagacatcttccttaactttgatttacatctgtgacatggcagtattgtttcggtcttataggacagaccctgttttctctgccattctgaaaccaatggaagcagtgtttgtcaaatattttcaaagaattccacgcctctattgctatgctttgattttagatcctcggctaaaattacatggcctggaagtggccttgaagatgttaggtgaagccttaaacattgattattcaagcactttcacacaaattgctgatgaatttcttgaagtcctttccatgtatgaagagaagtttggcagcacactccgtccaccaccatcaccgccctcttcactggtctttagattattcgctgctagactgaaggagttggagctgaaggagttggagcttcaaaaggattcctcgccctcttcatcagtacaccaacgaaaagccaaaaacgagttcaacaagaaatacatcgagactccatgctcgttgcgtcttaattctcgtggacctgatcccaatattatcatnnnnnnnnnnnnnnnnnnnnnnnnnnnnnnnnnnnnnnnnnnnnnnnnnnnnn

SEQ ID NO: 33544 - DNA, 4043 bp, Oryza sativa
ttcaaagaattccacgcctctattgctatgctttgattttagatcctcggctaaaattacatggcctggaagtggccttgaagatgttaggtgaagccttaaacattgattattcaagcactttcacacaaattgctgatgaatttcttgaagtcctttccatgtatgaagagaagtttggcagcacactccgtccaccaccatcaccgccctcttcactggtctttagattattcgctgctagactgaaggagttggagctgaaggagttggagcttcaaaaggattcctcgccctcttcatcagtacaccaacgaaaagccaaaaacgagttcaacaagaaatacatcgagactccatgctcgttgcgtcttaattctcgtggacctgatcccaatattatcatgtggtggaaggacaacaaactgtttcatgttgtgttagctcaactagcaagggatgtccttgcgtctcctgtgtcgacagtctcttctgcagatgcattcaacatcaacggaagagtagttgaagatcaaagatcatgtctagcaccggacattttagaggcaatcatgtgcctgaaagattttggaaatgctgctactcgagaacaggatagaatggtgaatgctgagtttgctagtgtggtatgccttgatatgtaatcaagcaatccaatgtgttttacctcctatggttccagtgttcagctcatctttgtttctatctatctgattagttaaatgaagacatcgttatgggctttagttacttgagaactgcatggtaaatgctgagtcttctactgatcttcgaggtgatagtaaatgcattctctgcatataactcaagttttctagcttcagtgacttcagttccaattttaggggcagtccaagtatcattgaggttaatttagtccccacaaaatcggagcagtttatcacattgaaagccatagatttccatggaaatccatctggttccatcactggtgctaggtaatacgagactgttagttggtttaacacagtggcatgcattacagaacaagggagcatgcatttcatgacagaaaattagatggctttttgtgaagtgcatgtacaccgttgaaaaacgcatagaacgtttggtaagtgaattgttgtgaatgcattgctgcgaatctacagagtacatactggtatgtatttgacaaacttgaatgaaccaagtacgttgatcaaaatcttgccacattaattaaaagattgcaattattcatgtcatggaagattctgggaaccaaataaataggagaccgggtttcatgttggtagaagctagaagcctagaacatgtaccatttcctttttgttttgcaatgctgtttcccttactactgacatctttccatgtcctactttaggttacggagacattagcaatttagacataccacataacctgtgtctgtcttatcctacaaggccagatggatagtaccttttccacctcagtttcgaggtttaagttctagttttgccactgaacatttgttgaacgtttggtacaatatcaagaattactcgtggtggacataaaaaatcatgaaataaatttcgaaactactatctataacatcagatccatcaccactgattggacacttcttaagaatgaggcaattgatttttgcgatcttacaatctagtgatctctagactctagtatagaaatgcaaaagcttctgagttttccatcgaggaacgaacgatcccttatacgaattgtcatcgaagttcttcaaaatatcagtacaagtgtccttgtccttttctgccacaaaccatatatttttcctccctttctcaaatcatatagatttaatattgtcaagttatagatttaatattatcaagtttgtgggaatggtgttgcatgctgtcgcctgagtttttgtagaaattgtgtgaagctccaatgattatcttacagccttcaacatgtagatcatgggttccgagatcagatcaggaggcaagagagtcataaccaggaattaggcataattctccagaggaatcaacaattaactcagtaggtacttatctactaaatgaacgatgttttcgctggtaatggcagtagatactggtaatggatattgctcaagaatgcatgatctgttttttttgtcaagaagcagagaaatttgtaatgattattttctactgctaaattttgttaaaatgaataataggttatggcacttgatttgtacctagaaaatgccatcttaagtgtttccccctttcttttgtccattgccgtttggttactcactagcccttaattttcatttaaaaattttcatttaaattggtgggtctaatattatacatagttaaataaaattgatcataaaacaaacaaaatactatgggtcccacctctcatctttctcccgtggtcacgtacgtacatgtgggtatgtagtacgtacggctccctccattttttttctttttttttcttttttccatttatacaattgatatatatatatatatatatatatatattaaataatcataattttacaaacaaagaatataccatcatataactctttataaacataggtaactaaattagctctacaatctttgaaaataaaatttacaccattatatgtttacccattaaatcaataatataagatagttttcacttaaaacagtgtactcattactttgtattattattctcaaataatgcactgttttaaaataaagtctacaccattatagtgtgcacccattaaattaacaatttaaaatctatattaactaatttacatttatactagaactggtggacccattatttaaatcatcggatctattgttaataaataaagtgtccaaagttttcttttttttggcatgctgcacaatgcacgtttgcacttttgcctttcgcactttgtgacaaagcatcgtgtctgaggcatctaaggtgatcatgactgctgcagcgctaccgctttgccacatatcaaatcgtatatggagatgattaattttgttaataacatgaaaagaaaattaaaggtgtgatgcagtgagagaagaattaagcaccgtgggttgagtttttctagcacttaactctatttaacctgaaaccaagagttgattacataattattataatgtattgtgttatatcgtatttggattttctattatttgatcttacagttgaaataaatcattatgttataaatataagcacaatattagtgaatatcaatagaactcttactaggaaaagagtgttataagggagtttaaggccgtatttttttcctattccatcttttggatttttgtttgcacgctccacgctccacgctttccagtataagggagtttaagggttttttgtttgcacgctacacgctttccaagatcctaaactttttaactttttagaagttaattgattagtttataatctcaaatagctatcacataaatcagataattcatcaattttagttgtcctaaatcctaagtagtacatatttctttcatgcaagtcttggtgatcagtaaattggtgatcaacacttaatcaagatcgtaagatatcaagatcgtaagatgaatctgtgagagctactatgaacaattgtaaataggtgtcaaaatatgtactacttctaatggctatcacataaatcagataattcatcaatgtcagttgtcctaaaccctaagttgtattttttttttcatgtgagtcttggtgatcagtaaattggtgatcaacgcataatcaagagcctaagatgaatctgtaagagctactatgaataattgtaaataggtgtcaaaatatgtactactattaattagacttctaatggcttgctagcattgtatataaacatggacgaagctagaacgaatattaacatatatcccatacatatatattacatggttaatattctaatcacatgtggtaagtccattaaatttttttaaaat

SEQ ID NO: 33545 - DNA, 2811 bp, Oryza sativa
aattacatagggctcgggtctatttatactcgagaattacaagatatgtccataccggacacgactattatctctaacaaactctaagataccataagtctttgcggcagacttttgcccaagcatatctctaaggaaattacataaaatatcataattaatagatacaattgccttctctggactctatgcatgtgcggcaatcatcttgaagcacctcaattcaacccgatgtcatacaccaagttgtattgtcggaatcggccgcatcggcttacctagtccgactcagacccagccaatcctaatcgtagccgatctggactccagccgattcctgctctattcttgaattcgatctccgcctttgacttcacttcgatctaatcttctttcccgatgccgatattaccaaatttggttgttaacacatgccccccaagtccggaatattttgtaatgtttcggatttgctgtaaatcgactccgagcaagtttcgcactttgccattttctgaccgttactgtcgtgctttaaatactaaccgttaccctcgagaagtctcacaccgtcctcctccgttttcaccgctgaaaccaactttgttctcactctctccggcgatccccccgacgcacaaggctatccccaggcgattttgtttctgatcagatctccgcctgcggcgatgtcgtcttccaccagcccgtctactgcgccatcggctgagtacgctgaggtaagttctcaccggctagatcccttttcctcgcatgacatcgatttctccttttcttatcatgttttctgcttcccggttcctttggatttgcagcacctttccaacctagtcgcgattcccagcctatcgcacaaaaaccactattttcttggcccaatcggcaatcttgaccccactgatttcatcatcggtgaaaccaacagaatcccctttagactagccaaccctaacctgggtcactggaagaataccttcaagtcttggccatctctcgaaaaacttaccccctgataagagctggaccacctggtacctacgcgtatcggctagtaagaaagttcactgggatgagattgggatcggccaagcgcttgctctcaccatagccaattctgctaaggatgaacctctgatggctgccgccacctatttctggtccaacaccatcaatgccttcttattcaaccaagggccgatgactccaactttgatcgacatcatcatgattactggattagatgtaacttcatcggctaaccctatgagtatgaacaccaagaacctatttgacttcaagaccaaaagcataggagggtggtctggttatgtagcggcatacatgggcaaagggcctgtcactcctcgggagcacgtagctttcttgctaatgtggctagaaaagtttctcttctgtggatccagctgtggtcccacaaccaattggcaatttgtagccgaagccttagaatcaaagaaataattccccttgggaaaaatccttctcggctatctataccaaatgttgaacaatgcatcggctaaaatagccgtaggctcaatagttggagcaggtggatcatggtggctgctgcagacttggttaaacctgatagtcatgaaggttgtcaatcgaccctctgtgacagaagctgaattaccattgccagagccgattgtaggagacgatggagaagaacgcactcatcgcagatgcacatcatacggagaatatgcatccacaccaaccgatgctggagcgaagctatcggctgagctgctcaaggactggttctgcagcttctacgaaggttttaagaaagatgcacggatctggtttccttatgaagacttagtaaatcttgaacttccatcagactttagatttgaagacattaatcatgaaaaattccaaaaatccagagaagttcttatagctgcaatcagcccatgcatccttcctatcggtattcaccaagggagaaacatccaagtctcctacgagttttatcacccaatgagctcggccagacaacttggattgggccaactcccaatcggcttattatttgccgacaagattcagtgccgaggaaaaatcacatccactctaatgatggatcggctacttaacctaccaggaccacctctgagcagcattgataatattgagttggcaggatttagaagcaaaaactttgacagatggtggggtgtatggaagctgcatctatttcatcaatcggcctcaatgtacatgacagatctattccctgatgtcataccctaggtaaactttgtcattactaaattgcataatggttaaccgattcattccttgactaatcttttgctcctattctgcagacaacagagtcctcccctccacatcaaagtaatagtggcaggaacattgaatatgctacaggtctaattccgaatggaggtggactatctccctgcgttatcggctaccatgcccccaagacttcaactctccttcacgacctaaccagggaaccagccgatgcaggcaagaaaaggaaaaccagatcatcggccgtgagtaccttggccttagctccaaacaaaaaggccaaattcaagaaaactaaaccgactgataagccgactaatgatctgcccgccttggatccatctattgaacaagctctagatgaagaggaaattggtgaagatgttgaccaggctgtagccgaaatgagtgacacagaaagaacaccatcggcttcacccaagcaaacgcctccaactccttctgcccccgttc

SEQ ID NO: 33546 - DNA, 29245 bp, Oryza sativa
  unsure (1)..(29245): unsure at all n locations
aactgctcctgctatcccagtaagttttcctttgtctcaacaattagatcggctacattttacccagctcttactctttccgaaattgtctctacaggttctagccgatcttttctcttttgacatcagaaattatctcgatgaggcagaagaagacacttcaagcaaagctctagctcccctatctgacgatgtgagaagaacacttgaagatatctctcatcggctagaagcctcttctttagatagtttggtagttgactgtggatcaattaggacacggctgcatgaagttcaagctctgattcccgaagatttggccgatgtcctaactccagccgcttatctcgagcaacatcagttcaagctggaaaaagccaagctaagactagtcgaacaccgtgagcgcaaagagattgaggccgcaatccaagctaatcggcagcttgtgcatgaagagaagaccaaacttgatcagctatctgaaggtccgatcaaatccaatattgatcggctcgaagctcgcaagatcgatctcttggcacagcttgaagaatgcaatgctgaactagatatggagcacaaaaagctagccgatctctcaaaatctatcgaagaacaaaaggtaaggctcaaatcggctatcaagaatgttgctgacctaagcaagtccctgaaggtcatctttggaactgatgctcaagatgcccaagctattgaagaagtagaacaaattaggcaaagggctattttggctatccagcgatacttgtctcaataacttttgtgtaataggacttagaaatctttgtaatcggctaagatactctagtactttactgtcttgacaatcctttgtgccgattaatatgactttgaaattcgctcaaaaattttttgcattttgatatatatgtgcccccctaattttacaatgtcaaaagcattgataaaattataaaaacaactaagggagatataacaatatcggccattgtacatcggcaaaccacaaccgattacaacatgaaaaaacaactaagggcgatataaccatattggccatctcaaggcgatgtaaacacatcggctgtcatgcatcggcaacactagccgatcatgcgttaacccaaacacttgggtaatatttcttcaagtacttgccattgagcgctcgtccatagacttcaccatcaagcccttgcaacatatatgctcccttagacacaaccttataaatttggaacggtccttcccaattcggcgaccacttgccgaatttactatcacgagtcccaatcggcaaaatcaatttccatacaagttcaccttccgaaaaatctttgggtaccactttcttattgtaataccgagcaacacgttccttatccttggtaacctttgcaagggctcgcaatcgtgactgaaccagatcctccctctcatcggccataaggttgtaatactcatcagctgttaaatcattttgtaattccgttcttcgagagccgattctaacttcccatggcaaaatagcctcatgcccataaacaagtttgtaaggagggacttggatcgatccatgacaagccatcctataagaccacaacgcttcagccaaccgagtatgccattgccgaggataatcagaaattttctgcttaatcaatttggtcaaagttttattagatgcctcggcttgcctattagcttgtgcataataaggtgaagaattcaataatttgatacctatactatcggcaaactaaacaaactcgtcggacacgaaaattgaaccccgatcagttgtaatagtttgaggaataccaaatcggtagattatatgttcttgaacaaattgaattgcatccccagaatcaactttcttcaaaggaatcgcctatacccacttggtgaaataatcagtcgccactaatataaacttgtgtcctttacttgatggtgggtttatcataccgatcatatcaattccccaacctctgaatggccatagcttaataataggattcatagccgacgccggcgctcgctgaattgccccaaacttctgacaatcttgacaccccttataatatctgaaacaatcctccagcattgtcggccaaaaataccctgcatgccgaagtaaccacttcatcttatgagctgattgatgagtgccacaaattccttcatgaacttcgccgattgcaactttagcctgatcggtactcaaacacttaagtaacactccaacaatcgtctaataataaagctcatcatcccacagtgtatactttaatgccttatatcttaatttcctagaagccgattgagatggattatgcaaatattgatgcacatcatacctccaatcatcggctgtcattgctgcaatttcaaccttaacatctttgatcatcaacttataccccgatgccccttgggccaaatcattagcttcaatattttgttcttgagacacatgcttcaaagtaaccagccgaaattcattcatcaattcttagcatttctcattataaaccattaacgtatcattcttacattcatattctcctgccaattgattgattaccagcaaagaatcccccatgatttcaatagcatcggcttcaacttccttgagtaattgcaaccctttgagcactgcctcatactcagcttgattattagttgcatacggtttaatagtataagccaactcgaaacatgcccccctaggggaaattataactaggccgataccacaaccatgagtacacaccgatccatcaaagaataaagtccatggcactatttcaaccgagccgattgaatcatcacgatgttccacaataaaatcggctatagcttgtcccttaatcgccttcggtgactcataccgaagatcaaactcggttaaggaaaatatccactttccaacccttcctttcaatattggagccgataacatgtatttgacaacgtcggccttgcatataacagtacactcgttggatagtagataatgcctcaaccttgtacacgaaaaatatagacacaagcataacttctccacaggggaatatctagtttcagcatccaagagccgacgactgagataaaatacaactcgttcttttccatccaactcctgaatcaagactgagccaattgacttctcaccggccgacagatacaatctaaaagatatccctttctgtggaggaatcaaaataggaggagagctaagatattctttgatattatctaaagctttttgttgctctgccccccaagtaaattgctgatcggccttcaatctcaacaatggtgtaaaaggttctaactttctagacaaattagaaataaaccttcgaacaaaattaatcttgtcgatcatctcctgcaattcggtcttgttttccgggggctgaatcttcttgatcgcattaacactcctttgagtcacctcaatccccctctcatgaacaagaaatcccaaaagctagccagccgatacaccaaaagcatattttgtcggattcatcttcaggccatattatctggttctctcgaaaaccttcctcaaatcggctatatggtcctctatttccttagacataacaaccacatcatcgatgtagacttcaaccaaccagccgattagatcatgatatatgtaattcatggctctttgatatgtagctccagcactcttcaagccgaaagtcatgacaacccattcaaataagccgattgcaccagggcctctaaaagctgtcttatggatatcttctttagccataaagatttgattatatcctgcgtttccatccataaaactcaaaattttgttccctgacgcagcatcaaccagctgatcggctactggcattgggtattcatccttcggtgtggctttattcagatctcggaaatcaatacacaccctgaccttgccattcttcttgataactggaactatactagaaacccattcagcgtatcggcaaggacgaataaaaccagcatcatacaatcgtttaattttagctttgacaggttcaagcatatcggctttacatctcctcggaggttgctggtgtggcctaacctctggtttgataggtagccgatgttctacaatcgatcggttgagtcctggtatctcgtaatactcccaagcgaatcaatctctaaactctttcaagagctctatcagcttggttctaaattctggagataagttcttactaataaatgtcggccttggccgatcgcctggacctatatctatttcttccaaatcatcagccgacatgaaaccttgaccttgcttgtcatcgagatcatataccgtgtcctaagtgtagacatttgaaccctccacgacgccctcaaaataatagcttgggttctccatcttcaattggctgtatatcagaatcgaacaattttagaaaatctccatcccaaacttttccagataaacaatcaaggccatccatctcccaaagagctaaatcggcactgacaacattaactgacctgtcggctggcacgatctctatcttgtcgccttgccactgaatcaaacattgatgcatagttgaaggaatgcaacaattggcgtgaatccaatcccttccaagcaacaagctgtaagaacccttcccatcgatgacaaaaaaacgtggtaggaatagtcttactgccgactgtcagctccacatttagaacacctttggtttccgatggattaccaccaaagtctatgagcaccatatttgtcttgatgagatcctcggcatttctacccaacttcttgaacgtagcaaaaggcatcaaatttaccgcggccccactatcaaccatcattttagacatcggcttcccattgacatagccgtttatatacaatggtttaagatgccgattctctgtcccctcaggtttctcgaacactgcctgttctggtgatagaaccaacttagctgattcctcttccacctcgtcgatatcggcttgatcgatcccgaattcggctggcaaggtaaagaccatgttaaccggtgccgtcacaacactcttcccctttgccaacctctttgcctcatcggctgcaacatcatcggctataggaacctgattcttaacacgccactcctgcctcggctttgctttcttcagccgatgattaatttcttgttcgacctcctgaaggcgctccctgttcctcaatctttgaacccttctcttctgattcttcgtgaaaataccagaaggacaccattgattctttctgattacattgtcctcttggccatgatcttgattcactggacccaatctttgatgaacaaaaactcttgtctgccatagccgattgcccttattatatgatcagcttgagctctcgatgatgtcactgcacccagggcagtttttaatagatggcagcctcataccttcattccagcagaatctaaagaactcacaaccccaatgaggatcaaaaccaccatcgtattcttcatgatgcttctcctgctgcttgtcatacttcctctgatatttgttaataaccttagctgaattcacctgaaaacctcttgcacggaccctatcggctgtttggccagctgtatgcaccatattaacaggaaaatggttaccattgaccttcattggctttttggaatcatcaaacctaatcttgcctccctcaatggccacctgaatctgctgtctaaaaaccttgcaatcgttagtagagtgggatccagaattatgccatttgcaatacctctttttgcctaattcctcagccgatggaattgtatgaccagcagggagttgaatttgcttctctcggagtagtagatcaaagatcttgtcaactttagtaatatcaaaattatacttctcttcttttctagaactctttacccattagcacggtatgacctttttactcctcacccattcggctgcagctatttcagaattgtcctcatcgtcatccaacccatacatgtaacgacaaacatgattaaccttcttagagtttttcctaacttccgcagacctatgctcatgcaaggttaccttctgtatcagatatgacaagctatcaaagtcttcagacgagaatttctccctaatcggagcaatcataccctgaaaggccagatcggctaactgggcatcagttaaactcaagctgaagcatttgttcctcatcttcctgaatctctgaatatactcgtgcacaggttcatcatgccactgcttaatcgccgtcaagtcagataatttcatctcatgaaccccactgtagaaatagctgtggaattgcttctccaaatcggcccaactattgattgacccatacggcaaagaggaaaaccaagtaaaagccgatccagacaaagataaccggaataaccaaaccttcaaagtgtctacagccgatgcttcaccacactgagctaaaaatcggctaatgtgctcataagttgacacaccatcttgtcccgaaaatttggagaagtctggaactttgaattgattgggaagaggaactctctcaaaccactcagggtaaggctgccgatacaagcttccagtctcttttggtttaagcccaaactgttcccttattacgtcagcaatcacatcggcccacggtcgttgctgagctgctccctgtgcctgttgttgcatgggctcgaactgaccatattgagacgcaaactggggttgagccagtccccctagttgatattgggcttgcggggaaggaggctgatattgataattcaagttgccctcttagtaattatgaaggttcggctagatattacgtgctaagtgctcaggaacaacttgaggcattactgtgccatccggctgtatgtggtgaaccaagtgttctgggacaacttgatttaaaaattgttgtacaggctgaccaccaggcgttgcaaacccggccaatgcgcttattgaaccttggtgctgaatcggctgaacgatttgctgtcttaacggcgtctactgaatcggctccataggctgctgccttggtggtgtttgctgaactggttgcacaacctgttgctggattggttgtacaacctgttgaactgggagtgtctgttgaatcggttgctgctgtattggatcgacagcaggttgaggttgcagaaacgtggcaacaacctgatattgggtcagccgattcgcaacctgcccactatgctatggctgctctctcattaacaaccgagggttcaccagctggcctggtgccatcgctgacggagcaggcaagggagtcgatgccggcgccatcggctgagctgatggtgcaatggagggaaccgcctgaatagatggctgaacatcggtgatcaaagaccaataatttggaaagacacctccttgcaaataaactgggcctgcagcctgatgctcagctattgaaccatcggctattgacttcatcatgtttgataaggtattgactaactccccaaactgattgatcaaagcatgatgcacagcgttgtcaacccagtcttggaaattattgaaaaatcttgtgccacatcactattctgattaagatttcctccttgctacccctgagcactatcaccttgaactccatgcactccgtcaccttgaactccatggactccttgagaattgtcaccttgatttcctatagaaccatcggtagcacctttgtcactcggttgagccgagccgtctggagcttgtttcccatctccatccttagaagaactggtcccaggatcatcagcaaccacttttattttgtacttctaaacaagtgtccccttgcgggtctacatgaatgagttcaagaactgatcccgtgcttgctgcaacattgcttcaaaatctttcttctgctcaggtgtgaatttttcctgatcaatgggcacgacgtttccttcattgacgtcagtcaatcccaacttctggatcatttccttaatagtgcctggactagccgaggatggcgacagcggtggtttctcggccatgaggaagaattgcttgctgacttcttatcggtcctactggacgtgccaaaagcgtgttgacagaaaacacgaggcctgggagatctgctaaactccagtgcaggtccaaagctcgccttcgagtgtgttagcgtgccagttgatttgatcctgcaatcaacaagaaatagaaacaaagagaccgcgattaaatctataaatgataaccgatcggctaggtgccgatgacatatcatttatctttgagccgatgtcatatgtgaatcgatcggtggttgtaaatagacaataaagaactaaatctattcgatcggctgtagatattaacaatgtatagttcttatatcgatatatatttaaatcaagtgactgggatagatcggtcgccatgccgagacagtataaatcacttagatcgaaatatatattaataacagcattatatatgtttatagcatagccgatcagatagatctagcatgtatcggctaatactccgatactactctatatcaagatatcaaaacaagtataatgtatcaaacaaaagactaatatacttaaatgcaataagatcttgacgtaaagggcggatttaacatgtcaatgaagcatatagaacgaatatggttaaatcagataagatcggctaaaactctgatactactctaatcggcaaccagaaggcaggctagagattgaaattctaaggacgacttaatagatcaaactcaactgatgcagcattaagtatgaaaagaagaacaatatctagacaatcaagccgctggatgtttcataaagtggtagatatcttatataatctaggtcaacatcgctatttaacctaatcggctgccttctgtcgacatatgttagccgattgtaggttagatgacgatattgtcgaagattatgtaagatatatgataacttgacgaattacatagacaagattagagtgtcgtaaagatggaagcactaatcccgagaacacaatccatcataacaagttttacctcttgttgaagatcgaaaccgatgcagctcaacccgaaagcaagaactcgtcgaaataaaactaaagcaaaaaggtggcgatgcgctgagattgtattgaacgtgtgtagattccaaattacatagggctcgggtctatttttacctaagaattacaagatatatccataccggacacgactactatctctaacaaactctaagataccataagtctttgcggcagacttttgcccaagcatatctctaaggaaattacataaaatatcctaattaatagatacaattgccttctcaggactctatccatgtgcggcaatcatcttaaagcacctcaattcaacccgatgtcatacaccaagttgtattgtcggaatcggctgcatcggcttacctagtccgactcagacccagccaatcctaatcgtagccgatctggactccagccgattcctgctctgttctcgaattcgatctccgcctttgacttcacttcgatctaatcttctttcccgatgtcgatattaccaaatttggttgttaacaaaaccattagattaaattgatcttagaacaaactaaatactacgaggtcccacctctcaccttcagtacgcacctacgtacgtgggtacctactcttcccctcctcattttcatttttccctttatttttttctccatgtatatgcttccctccctttcttattatgtcatgcgtcttcatgagatgatttaatcacaagaattttgagtatcttgctcccgtatttttcatttgtaaccatactacaagcaataatttattatttactcgagaaagaaaacatgattcaaaagtcgtaagtacttaatccatcttctattcaaaagtttgtgaatggatttttaagataccttaaaaaaatagaacccttaaattattaaaaaaatattgcaaaataacagtatccgaactttagtttaatattgcaaaataacagtatctgaactttagttttcccttaatttatgagacaaaatttttgaacaaacaataaaaatcttaccttttaataatataagtgcgcgcatgcgcggaccaccttcctagttttagaaaaaatccatatctacttcctcctctctagtggccagtcattgttgggcttggcactaggcgctgttcattgccaccaacggcctgcagtccattgccatcgtgccatgctgccattgaggaaagtcaagtttgaccgatgaaaggccgccactgtcatggatgatataggggagagagaggagataatgaccggggaaagagaaagcaaggtaagctctacagaataaggcaggaggtagtgtggtgaagaaatgtgtgggatgatgcttttgatattttaccttactttgaatgcttgatttgaagcatctccgtcctgaaatattttggagtagttattcccttcatcccataatatagggaattttagagggatgtgacagatcctagcacgtactacgaatctatacagaaaacctatccagagtcataatactaggacatatgttatatccctctaaaatctcttatattttgagacggatgaagtatttattattctgaattttaattgtttttcgatcgcaatgctagacaaaaatggtttggacagaccatgttaaataggctaatcaaactttcaccttgttgaaattaggcaaaacataatctaagtaacttgtcgtaaaagccatagagtgaaacaagaaagctgtagtaagtataacacccatgtatgtaatgagtgtgtcgggcttgcgatgacgcaattaataatctcatctcatgatgaatgaccgcgcggagagtagaggttgatggaggagacaccgaggtaggcggcgagtaggtcctcgtcatcgtcctcctgcctcgccagcgcctccttcattgctggccaccactcgggtaagtcaccgctgccaccgtcgtcgtcgtcattgcacattgcattggtcgttgccagcggtgaggacactacttctgctaatcccgtcgattgactgccgtcggcagcatcgccggtggtggagttgcgggcgaaacggcccttcaccctaggccggctgtcggcgagcgtcttccggcaagcatactgcatgcatatgcaatccaataatatccaatattagtatatgtgtgtagtagttagatagagaggtacttaaaaaaaagaaaatagcaatgcagacaatatgggcttgtgggttttgagaccctcttagggttttcattatcggtagcaaaaagtattggagggtagtggtaaacaagataattggaattatcggaattctaccgtggatagataatttttttttgcaaaatttgttaagaaaatcacacagactctatccaaccaatttggcataaaaaataacaaaaatatatatactccacacacccaatacatgattcaaaaaattacattttttttaccgatacacaatacaaactctaaatcacgattgttgttatatacttttgtatctaacttttgttgcgaaacacaatacaaacataaataagtgtgtaaaagataaattaattagcaagtgggcttttatgcgagattgtgtattatattcttataaggaaactgaatatgtaatccacgtacggtgatcttcctttcgaagttgcggtggtttcgcttgctccggtacttctcaatgcgctcctgccgctcctccgcactgtaccttcccaccgccgccgtcgccctcggaagctcctccttcgtcggtgagtggtcgctggacggcggcggttgacgagacgagactggtaagacggcaccatccatcctgacactattgaatggacgagatgaggaagacgaggaggtgctactgccactgccactgctactgccattgctaccccagctgtgatacatattttctaggttcaagctaccggcctccttgtaaatgtataccctacatatgactcttgaggatctctccatagctgccattatatacgatattggatttcatgtatggacgttcgtgtagctagagcctccacttgaattgtacatggagcatgcaaggaggaattgctgtttgctgatcttgctcctgcagggagtcaactcttggctctacaatgatttgacacgacttactagcttagtgattgtgttgtgccatcgtggatcaattgccaatcatgatatatgccaccaaatcttgagattcttctcgtgcatgctatgtctttcatgtcccatgacatccccctctctctctgttttctttttcttgttgagatcgtctcatgacatggtggtggatctcagactctcagagccacatacatatggcattattgttatttgttaaccatgcgtatgtcatgcagaaatcaaatgtgtttggcacatttcttaaataaggccctgcttagttcccatacaaaaattttacgccctctcacatcgaatgtttgaacacccacaagaagtattaaatataggctacaaaaataactaattacatagattgtgactaatttgcgagattaatattttaagcctaattgctccatgatttgacaatgtggtgttacagtaatatgctaatgacagattaattaggcttaataaattcatctcgcggtttactggctgattctgtaattagtttttttattagtgctcgaacaccatatacgacaccctatataatacccgatgtcgatgtgacacgccaaaactttacacccctggatctaaataccccctaagaaacaaggaaaagggttcgttttcactgacacaatcaagtttagtcacgcgttcaaggattattttctttttccccgaaagatgcatatccatcatatatactccttccatttcagattataagttgttttggctttgtcaaagtcaaactacttgaagtttgactacgtttgtagataaatatagtattatttacaacacgaagttagcttcattaaattgataattgaatatattttcctaatatatttatcttgaatttaaaatattactctttttttttataaacttggttaattttaaagtaatttaactttgaccaaagtcaaaacaacttataatctgaaacagagggattatcaaacaatgcatgtattgatgtgtataaaactcagacacagagtgagagctgccacagacacacatagcacaaagcatgtggtagaccaacgaaggaggcaccaatagcagtatatacaaggctgtttaagatagcaagtatctcattcgactatgtaataaacagcacaagtagaaaaagatgtgtagcaacacgggctaatagcaacgatagtgcagtgagacgattcagggaggcataagcaagttgaccacaaaagcatacgcaccgtaggctggctgtaccctgctatgcctttattctgcacctctacatcgcattacgcccaccttgcagttgaccacaaaagcaacaacaggctctaccactttgctccatcatgtgtacacaggattctaggtcggattgagatcctctaatatactgtcctctatgtgggtcattgacatatgggttcaacgggcctatataatggtgactcaaagttagaggaaaacaagtcagagaatcttcttccatgggtctaataaaccaagtgtttggctgactccaaggtattcaatattcctaagttaagcattaataacaggatactcggttgcagcgataaatgaaaaagaaggagctcctgcagttcttttatttatatctaaaatgggaaaacaaaaacaaaaaatgcacaagaaacccaccaagtatgatgaattgatgatcatgacccatgatgagacagtccctccagagtccaccatgaccctatgattagcttcaaaaaattgacatctcccaagattttagtggggaagaatgttgtccccttttaacacttgcagccgaaaatgtatagctcccaacaggtatatccatgttgtttcgagcatctattggacagaggttagaattttgttctagccgtagatccaaggtgctgcttttagttggaaattggttgttggcaaaataacttgaagtgacctagctagaccaaccgcattattccattctcctgttatgataattcagcgttttctgataaatccttaccgtagcccacttaagaatgcggtatatcatgaactcaccgaccttcaagtgggcttagccaaccaacaggatgaaatcaaagggcaccaagcattaacattgtagaaaatgcttggattgcttgctctaacagttgttacagttttcttttggaagcaacctgcatagattttaagatgccccaggcatgcctatttgtaaactagcactgtcagacagtgaaaataggtgggactattaggatagtggtgtagttctcttagattttcttttccttctagtaagtcaactataaaaacagttcgaccactatagcacgatcggaatgcaataattgctaacagagtaacagttgaagtatgcaaagaatttacagaaatgaggaacatataaactagtcatgcgcggttgtacaagaattggaaacgaagagacaaaagttggctatctgtctaatttacagcaagaagtctattatggcaggtcacagttttatgtagggtgaagtttgattaagattgggacacatgttagtgtagaataaagtgtgtttgatttttaggccccctttgaataacaggaatgaaaaaacggaagaataggaaaaacataggattctcataggaatacaagtgtaaaacagaggattacaaaacacaggaaaaatataggaatgaccgtttgattgagctgtaggaaaaacacaggaatttgaggagagataaagactcaaacgattcttaacatgaggttctacctcatgctaaatttcctccaaaacttgcatgggaagaggcattccatagaaatttttgtgatgaacaattgacatataagagtattggttttgatatttggagattattggtgaagtggttttggagataattggatttgcaggtgatgaacagagactgctgtattataggaaccggttagacctggcaagtgctgctggtcaaaccgaaggtgtgcgagcggtcagacaggctagcccgcggtctgaccggttcactttttgtcggttttggtttcgggttgtttcgttggatatccgtaggtaatttgtgtttatgacttctagatggatactatgcgtatgtaatactgttctttttttttgctaacaatgagtcaagttggagatagcttgtccttggaatatagtttcttggttaattcatgtgtaggtaatcttgacgtcgcgggagagtattgccggtgatagatcgggagtcaacttggagataaggtgacgtccaaacggtcagatatcatgcgggacacttaggctaaagattgatgtgcgtggttggaaaagattccatatggcatatgatggagatattgtgtacgtatgggatgcagagttgaatttgtaagaagtccaaatttggtacaattggagtttgtaaagttggtttcttgtacgggaaggtttcctagagagatttggacttcgtgtatgagtttggttcgtagctttaggatgcctatctcatgtataaatagagagggagggtgtggcctcccggtatcgctttatagagcactgagtcgagagaatagttagggtttcgagtttagtcgagatttttgtgaggagtgcttttgttgcactttgtaacacacatagagaagtaataaagttatcgtctactttgagagtttttcgatttgtgtttgctcaggttcggcggttcaaccggtgggacaccggcggtcagactgacggcgtcgcaccgatcagaccggcggcaactacaggcgacgacagcagatttcggctgtcagaccggcggcttccaggcgcaacttctccgatcataccacgtttcatcgattcgagggtaacttttaattctgctaaaagttttggtttttggatattacaaccattcaccccgcctctggttgacttagttattgttgttcgatcctacagttagctttggtaaaatgacaacatagtaacgacgaatgataagactatacaatatctagtgacatgcatgaaattttgaaaaccaatttccattagctccccacatctttcttttgtctacgctactggagaactgatctttcgtcgtggtacccaaaatcacaaatatctcggttagattaaaaaccgatactaaagatgctttagtatattactagttctaaaagtccaagtcactgaaaacatttttagtcagtactaaaccgattgaaataaccattactaaaggagggttttcaactggtgttaaagatcgttacttcactagaggtatgccaaatcgtatggatcaccttttccacatcaaatccattgtaacttgcacagtaaatcttgcttctatttatttgtggctctcattacaatttatatttcctaagcaaatcctgataagaattgtagtggcttaaaatgtagtaatgttctcttacatgaggtactgatacgtgcatttaatttgacaatttaaccctttccgaaaactaatctcgcaaatgaatcatggccaaaactttttttaaaaatgacccttttgttcagcgccaaaattgtatagcgctgaacttagacacctcagcgccacgtcaactggtgctgaatgctgtgccaccgcgaatgggaggctaagtcggcgtgccaatgtgcattcaacgccgtgctatttgatgctgatatatctaagttcaataccatacttgacattgaacaaaagggtcatttttaaataagttttggctgcggttcatttgcgaaattagttttcggaaagcgtcaaattgtcaaattaaatgctgatatgtgggctggctgattctagggcccacatgtcagatccgtctccggtggcttggtgggtaagaaccaggtcgctcgcaatgattcaggagcaccacggtctcacttgttggtaggtaggataggaaaggaggtgcagagagtgggatcacactggaagagagaaaaggaggaacttgtaggaaccacacacgatatggtatttatttaaactctccacataatatgtaaaaactctgatatgtccaactgtgtcacaatatatagctgatgatttattccttcttggtatatagggctgtaaaagaaaacgtaggacttgacagggataggagctgttggcttaaggtcataaatatgagctcaacactaaacgagggatcagatccttatgagcgaagctcatccatgctttgattaggccctaaatccccaacacatctatatctatctatctatttatctatacctagctaattaagataacatgatgaccatgttttactctatatatatacataatacatggatctagtctacctcctaatgaaatatataggttgtatgggtactcggtatctatatcatccacacaagtgcaccctaccgtccatcccaatctcatccacagcagcgccatggcaagcttcactacctccacatcaatctccagggctacctgcctcgctgtgcaagagttccacttccaggaagcatgttctggtggtctgacaactaagcagggggaacgagggcagcacgatgacagaggtggtcgtcatgggacgaagatggctgatgaggagttaggtcccgatcttccgataggtattgataaacagttgagttgggcggagtcgtgacacaactcgatccggcttctgaacaaacacgctactgaaccccgcaatcacagcaccacgtctcctctggttatcaaccgtgccgaaacccggttgacctcaccgagaaggctaatccctgcatgcgaatcgaagaacacaagcgagaataagatagattgcaaccaaattgcatatgaatgattaagcactcgaatttggggttccacaaaccgatctagcggcgaaactgttcttgacagaataatctaagcaaaacccgactctaaatggtgacggctactgaataaatatgattaaggatgtcctagggttgccctagggcgcacacccccttgagctaagcccacgacacaattacaaggcccaaaacacaaatcagattcggactggatgagatacgtggcttgttttgcagtttcccggcaacttagtaggaattttgatgtggaaccaaatccatcagaaagtagactccataagctttccaacaagtactcatgggccctgaaattccttctagaacagcggctaggtccgtttgaagttgatgctatcaggaggcctgaatccgaatccaaaacgtgtataacttgatctcttgtcttctatgggccaaaagtgacatggtgaggtagaagtagacttgtagaaggtcttgatttggtacccaatcaacttctttaatcatctatgcattagttatgctcggtctcttttccttcgcccaagcaagtacctctgtaaacaaaaacacacaaaactcattgtttagcaacgtttgttcaaatatataacaagtaaatctaatgtagaacacatacacctttatttgattaatatataaggtagtcatggttatatccgagctagttgtgtcctcatcgatggctgtgtcgatggtcgatgagatgagcatggcgattgagaggccagctaagcagatcgagatgcgatggcaccgggtaagatcgatctacccgctatgcaccttcgtcacttgatccatttgtgctctgtgccattctcttggcggagtcattacgcaacgcttccttttctctgactcatctgcaactccaccttgaccacaagttacctggatgctgccttgaggtggtcatccctgatggcaccaaacaaaactgcagccgccaccaaggacgactgctacttcccacatgtgaggttgatgagagatacaccagatgagaccactgcctcgcgccaatggcggtggttggaaacaaagctgagggtgagatgggggagagagcaggggtagaggaggaagaagagaggttgatgtcactaacatgttggtcctagttatttttatttaactaggaaggtagcccgcgcattgcacgggaatgtattttagattgtgtttaaaaaacttatataggcggaatatcaaccggatgacacctgccatgtttcaaaagtattgttactccgtaatttttcttcatcggtattgcttagataatttttccaagctatttgttagcttcaaaatatataatatttaattcatcggtataaacaattatgtatgatacgcatgaacacatgccatgtttcaaaagtatttatttagtttgtttggaaaatgtgcctaacaaattaagcgtaaattaaaagtaaaatggtttgtcttgtttaattgaatgtttagtggccttttttaagaaaatcctaaagaactactattattagtaaatgtggtttatttgtgtcatcaagttagtcctctttttagttggttcaatatgcaagttgttacatgcttacatataaattaatgaaaacatatcatagatcatcacttccttttaatttgtgtaatctatagtgtggtttctaaaagaaaatatagtcgacatgagtctataaatttaaatataatagtaacaaatataaccaactgtatagtctggcttaatatgcaaacaaactcataatactatggtattggatagatgcaagatgtgacatcccggcctagcgcttaataggattaatagaatactcatatcaacaagttgcaacttcttttctagaagccgatctcgaaagaactctgaggttaagcgtgctttgcctggagcaattttgagatgggtgtcataatttctatggcctataaaagctgccaaatataagcgggcctggcctgggagaggcgggatgttacaaaatggtatcagagtcgactctcgcggtttcacaggcgcgtgtgtcgcagttgcgcagtgtcacgcccgaaaattcactagtaatttctgaactaatttgtgcataaaaatcctcgtccaggaatcagccgagatacacaaaatgacaatttaatatacaaatccatcataaaaataacggtacatacttacaaaagaaaagaaaacagcagcggaaataacggtttagcgatggcttcagctctactcccacaggcagctcaactggggtataagccaaacgtcttctccttctggatccttttacttcaactaaggttgattgattattgcaagaatgagcatatgacatacttaacaagccacacagcaaatatgcaagtgcacaaggataccaaaggatggcataatataggctcatttgcaaaagcagcatttagcaaacatttaagagtaataaaacagtagagtactttaatcattaattttaataaacactgaacaacacgcccatgctgctcaggcccaaccatacctaaacaaccaaccctggctatacagatctaactccaaaccaggagctaagcaaattattaccaattatagcatcaataattattgtgagaggtgtgactaatcacgaaaaatattgcttaactcgcccataaccgcgggcacggctattcgaatagttttactctggctagaggtgtaccactgtacccacaagacacagcctcaacatcatgtctaccatgcgtcgcgatactggaaagtacccgaatagaggctgtgacaataccccctgcacaacacaactcaccacagtgcaccattcctggatcataatcaccccctctataaatataaccagaggcatggactacccagcgacccccacggacttctcgccgcttctcagtctggcaccccgtaatgaaccatgctatacaaaaggtaaagccgttgcccacgctggcttgtggttggcacggttaatgtttcacaacagtagctcgtgaaccggtccttaattgtcatgagcacgaccttcaaaaccatgtgctcacaacccaccattgtcaagttttagttatcaattaattatcataacacgattaaccatcgtgagctaccattaaatataaccataattaataatatagtatgattcatccctttaatgagctattgtttctaagcatggctaagcaactataaataacatctagctgaaccaatccaatatataaggtccatgctagtcaaattataacccataggaaaataaagtcatattcggccattaattaatcgggaaaggctcacctcccgatgacattcgaaaataatgcataagttgaaataaaacattagctttaaacgggttcaacatgctcaaagggttgtttgagatctgtgtgacttgccttgatcttccgcaaacacttctgaaccttcctcaacgaaaacgctctcctcggaacatcggaaactaaagcgaaagaacaaaatcaacaaaatagtacaaaaacaagcaaaaacagtacatgtggatatttttaacatgtagatcttgattttagatgaatttagcaacttgaaccactcgaatccgagttacgatgatttagttatgaatttcggaagtttaatcgattttcatctaatagagaaaactaaggaaaagggattaatgacgtcatcgctgacgtcatcgccggcaacggcggcggctagagcaaggcggcggcggccctacgggcgatgggggagctcgggagttggagcaaacgaaagaggacgactaggggatgctatttataggcttggattgaagagaccggactcgaaccgagaggaattgagccggaaaaaccgagggttagttggagagataaacttgaaaacgaattcgattccgcgttgatttcttcgggataaagtccgactcttgggggaaaggatagaggaggataagaggaatatttcccctcaactaatttttcaaacggagcacgggatgcggccgatttggtggaggaagcggcgtcggctagagcacaggacggcagctcgggcttctgtccaagcttgaagatgaacagtacacggggaggcaaactagactttcgtcttgagctggctgaaaaacaaaggaaagaaagaaagaaaagagggagctcggctgggccgacttgggctgcacagcactcgcgcgagggagagagatgttgggctgaaatcagcccaacggcttaggagaggatttaaaaactttttctaattaaaataatcactgaaatgatctttgaattgttaaaaatacttccaatgctcaaatagtttcaagaaaaatcttgaaaatacttggacactcaaagtaattaaaaaaattataatcagaccattcaatgaataatttaatatgtggataattactgaaatgttctttgtatgattaaaattaggaattgagctccgaaaaatctgagaaaattccagagagtataattaaccatggagaatttaataaaaattaaatccatccatgctttatatttaggaaattttatttcccacatttaacttcacttgtaaattaatgaacatttaatataaattctaataataatttattaaataatttataaatcctgaaacgaaaatcaggatgtgacacgcaggcatggtgtgcatggctggtgtggacccggagtggtcacacagcatggcacatgcgctggcactagacacatggacgtggccaagaggggacgttcctggcctggggttgatcgacgggggcgtcgatctctcttaatggggtgaggatatgacatcccggcctaaggcttaataggattaatagaatactcatatcaataagttgcaacttcttttccggaagccgatctcgaaagaactatgaggttaagtgtgcttggcctggagcaatttcgagatgggttaccgacaaggaaattcttcccgagtgcacaagaatgaggataaagtgtgcaaaaaagacttgtgttggtctgtgagggcagtctatggcctataaaagcattcttcccgagtgcacaagagtgaggacaaagtgtgcaaaaaagacttgtgttggtctgtgagggcagtctatggcctataaaagctaccaggtgtaagcgggtccggcctctcctcttcccgagtgcacaagagtgaggacaaagtgtgcaaaaaagacttcgcgagtgcacaatagtgaggacaaagtgtgcaaaaaagacttgtgttggtctgtgagggcagtctatggcctataaaagctaccaggtgtaagcgggtccggcctgggagaggcgagacgttacacaagaacaccattatttgattttctccaaatagttcaatgcagcttaaaaaatatgcatgttttaatattattgattatttttcggtaaaaaaaaagggataggtagaggagagagtggagagttcaagctgagacgagaggggacgggtagtgttgttgtgcacatgtggggggatggcgaaatggatggggtgtttttttgctaaatgattaaagtgaaaaccgatgatttttttgtcaaaatttctaatatccttttttttctaaattttaagatgtagcacatggcagcttaagattttatctaaagttatatctattggtaaaaataatggatccacttattaagtcaaaacgatggtcggatgtcttttctaaccgtttctaagattttatttttaattaagacgtaacacgtgacacctacagaggatgtacaatgatttgaggtgatataatacttattgtcattttttatttataatactctatattttttctatttggttaccatgcaaaggataggtgtgtatgctcaaatggttttttttttatacagtaaagtatgagtaatgtggatcttgaattatttatttaattagaaataaaataaaaattcaaataaaatagaaattatatataacataagaatcataattattttgctttgtaattattgatctttttatatcatgttgttaattagttagaaattataagacggagttgagtgagagagaagagaataagagaaagtcgaaggggacaaagtacacacacatagaattctatttttttttacatttgtagtgttttcaggtattcttactttatttactaaaaatagtataaaagttttattgattgattaagatctatcttttttactcgtcttttcctatataggaggaacactatagattaactaatgttattttggatttattataatatcaaaatgggagttgtaattttttggaacaatactcagtacttttgtcattactggtctaattgaattattgtgaacttatatacgatgacgaaatatatatcattatttttcataattttatagttgcttgaatggcacacaaaagccagaaaatatagccccaaatatgggtctttaaatgtataataatcaaaatacataagcaaaagtattactaatttgatttagggaacctatgatttagatgttatagttgctaatttctttagcataactcttgctttctaactaatatattttgggaacattactcataattatgcttattttacctttatgactgtaggtataatttaattattatgaagttatgcagaatgatggattctattatattattattatttcatatttcttataattgcttgaatggcacgcaaaagtctgaaaatataatccaaaataacatttttttctcaaagttgaattatagtgaaaatttggtcttttagccgtaaatttagtcataaaaaattttgaagatatatctggatcaaaaattagttgtatatatttagatgttatagttgttgaattgtttaacaccaaacttttgcttttctaactaataaagtatgaataggagaagaaatacgtgcataaatatgaagagattgagagaagaaggggtggaagtacattacaaaagtacaaacttactacctctagaaagaaaatgtacgtacgtactactgtatgtctgtctgtatgtgtaggcccaggtggaccctggtttggggttagagtggtttttttctttcgataaatctaatggtggtaaataatggatctatctaatttaatgaaaatcaatggctagatgttttgtttatttcttagaacttttagaattttctgtaatttaggatgctacgtggcggcttaggagcatttgaaggaagtttaatgaatttttagtatataatagaagatatattatatattaaaagtctactcctaagaacgctcctaagctgccacgtgtcatcctacaaacgctcataggccgttacgtggcattctacaatcccatcgtcgattttcatttaaactgttgcacccattagattatatctattttaaaagttcatcatcgatatttatttaaattgatggacctgttattttagaacgtaagattatatcgattttacaaagttatttttaataagataaccgatgttatcatcacaggttacatattgtgttagaaagattatatatataattaaaattatgctcatcatatactacattaaaatccataaactttagactacattaaaattactcatcagattatacatgtcacattatgcctgttacaaagatctcatacaattgacagctcatgccatcgtcatatttcaaatatgttatttggttgcccataaaatatgatacccttgaaaagatttttttatttacagtagcatcgctaaaactctatggaaaaacagatctaatcattaatcatttatggtaacaaattatggtgtgcatcttttgactaccttaattaggaaagaaaagaagagattgatggggaggaatttgtacgtacatacacatgtgggtctggccaggaggaaaaaatgaaggggattaagttttgatctaatggttaatagtatcgagtccaccgttttaaatgaaaattgacgggtagatgtttttcttttttcatatttttctgtaaattattaaagcgtcacgtggtggattaggagcgtttgtagggtaccacatggtggtttaggagcgtttgtaggaagtttaatagacttttagtatataatagatatatagattttgccttaatgccatgtaagcggtacttaagataaaaccaccatgaaaaccgctcggggttttgacagtggagagaattatctttgtatctggttttgtggtcgatacaggttatagactttctcccttggtcaaacaaaatatagactctttccttattgaaaaggaatgctttgtattacccacattatcacttgcattttctccaattatatcataataaccatttaacttaaacaaaaccatatcatttcatagccatttattttaacttatatccatactttagaatcacccatagatacaactccagtaaccaggagcacattatatacaaatactatcggtatccccaaggtatacctaggtttactgcacaacaactctagttggcaagctaaaaatgctaaaacaagtatctctcccttctgcatagtataaaatgcatgctcaggttattgctcggaagtatttggttcaaggtgtgccccaacctacttttacatccacattgtaacattgttactcaatgggaagtcttgggcccatcgatgccacaggtgtaattagctatcctgtgaaaaggtgtattggatcatgcttgaagaatgatgactataagaacttattgtaactaggtcaatccgaaacactttattaggacaattatagaatactggatctgccactatattttctattaatttagaatttgatacaaaattagttaacggtaattatgcatacaacttgcattgtttctttgatgttccatttgggatgcaaccatcaacttcctctgttgttacttagaattccaactataaattcttgcgaaaatgctagtgattgtatgacatgccttcaatatggccaatgctttcttgtaaaaaaatgtatatggccaatgctccaaatttagtatgaccttactatggaaggtaatgtaaactaaacttaggttaatttcatcctcaaccacacattcaagatcttgcacatgcacaaaaggaacaccacgcaaagatgacttctcattatattgaaaaactatcctttttattcagtaactaatgatcttcgattgttctattaaaaaaatattggtccttggccatttcctaatctgagttgcataaaactacatatgttcccatggtcttccattgagagaaaatggcagatgatggtttcaaatatcatgaggttagttcgtttccagttgccatttttttcttgtgatacatcttgtgtgttacaattgatatcgatcttgtattatgctgaataagagaattttgaaaaacaccatcaccattttattttgtttttatcaagggatgtgagattcaaattttatgttggttgtaggaatatgttacaaataaacgagggatgaagctctttgcatgccaatggagtcctttagaccatgaaccgaaagctctaatcttcctatgccatggtaacattatctattgatactcttatacatttgaacttcaaatacaattattccaacatataagcaatttgtttccttacaccatctaatttaattacaatttcatatctttcaatgtttaggatatgccatggaatgcagcatttcaatgagaggtaaatcacacaatgttgttaaacaactttaaataaacaatccacaagagtatgcctatatgtcatgttgaaaaataataataccatgtcgtacttgtttagcattcagtttcttttagctacttgaaaacaccattttaatgacaatatgttgatgatttgctactctcaggaacaggtgttcggttggcaaaggctggatttacagtgcacggattggactatcagggccatgggaagtccgaaggacttcaaggctatatcaatagttttgatgatgttgttgttgattgctcgaactactttgcaagtgtttgtggtatgttcagcataatttaatcaactagctagctagctcattatttgatttaggaaacaaataatttgctatcctgatgaagtttcataaagtttgtaaaactagacataactaaacttaaaaacaatgcactatttaaccataagctatcaaanccntgcactttttgtcaacctcggcttagatgcgaaatcattttcggtggttctctcacttatatggtgatggtgtcaaggttgaaattgtttttgaattttaaattttgaaaatgacttcacaattgcacattgtgtcattgtaaaatttattaattagtccttgagtgtatcgttgtaaaaaaattaattagtccttgagtgcatcattgtttagtctctatcactctgcggtcatcctgtaaggcataaaaaagatctattacaatttgtgtgcgcaaaaaaatgatatggttctttgttcatgtaaattgtagaattacaagagaacactaagtactccatccatatcatattgtgttgttttgattttttttcttagtcaaatttatttaactttgtccaaatttgtgggaaattgtagtaatatctacaataccaaattagtttcatcagaactaacatttaatatattttgaatatgtttatgttggaatggttgatatatttctttataaacttggtcaaacttaacaaagtttgattaagaaaaaagtcaaaacgacttataataaaaaatggagagagtatttgatttctcaaatgcttggtcactcaaaatatgtattttgagaaagaaaatcaaccatgctacaatgctcatgtatattttaattaatgtatttataaaagtggatttaattaaatttagacatatgttgtttcaaaaaaaatgtaaacatatatatataaattagcaacaaaatgttatctcaaattacttgtcagttgtcac

SEQ ID NO: 33547 - DNA, 732 bp, Oryza sativa
  unsure (1)..(732): unsure at all n locations
cagatcctggaagacgatgagcgtcacgagctcgtccctggttgcgctctcgtcgtagggcaaggcgcccacgactttgccgccgccgccgccgcggtggccgctgccgttgccgctgccgcggccggagcagtcgtcgacggtcgtgnattcgtctgcggcggcggtcaggcgcgagcgcttccggggcctgctgttggcgaagggcgcggaaaacgtcgggtgggtctcgtgctcgccgctgccgtcgtcctcgtcgccggcggattcgccgctggcaactgcgccggcgtggggatccatccgtgggaggaggagagagttggggaatttcttcttcttgtttttttttctgggaatggcgatgtggcggcggcgagggtttgaagatgggcgtgatgaccgttgggcactttgggcttgggtttgggtctcggtttgggcttgggtgggcctatcagcaaggggaattggcgtttacgggcttgggacatcgtgagtttccaagacaagtttagtactaaggtgaaaaggcgaaaatgccccccattaactacatccggttatcagcactgtcgtttctctgcagtaattaattacacgcaagaggcatctggaatagaataaacaacgccaaaaaaaattcactgatctctacaatatgaggaaagaattattgttcgttcacctatatcagactactactgcaataggaagaacccagaatagaga

SEQ ID NO: 33548 - DNA, 769 bp, Oryza sativa
gggcctcgtttctagtagtgcaacatgcacatgggctcgtttttattgtgcctgtaattatgtaaggcaagtgaaaaattgaattcacataccaataatgttggcaaagaagaggttcatcttgcttcgctacagatataaaaaaggagtgtgttgtagacccaataaaacaatagtacaatgctagctgacatgaaggtttttccccaagcaactttttttacatgccctcgctccattttgaaattatcagaaaaccgatgtttgagtactggattggatggcctcggggacatcagtttctatttcagatacaggcatacagctacagtttttgtgatagctgagtgcacacaaacctcaccgagtcgacaccgcacactgacatcaacctgagaagaacaaacaatcgttgatgccactgtgatcttaagtgtgggttgtggtggtgactctacgcgagcatcatctctgaatctctgtacacacaaacatttgcttgtgaaatgcttacccttgcacctgatattacaacggccaccaacgacaggaaaatgttttaccgacagacaacaacctactgcaagatgtgatggtgtaacaatatggcctagccgtattgttttgctccatgggaaaaaatgtactacagcctttctttgaaccaacacgacacaagtgatcaagcattgggccgggttcacctgatatcactcacggcgtaacatgagtaatgtgttaatccaacttggcctagtgacaaatcgat

SEQ ID NO: 33549 - DNA, 754 bp, Oryza sativa
catgttgggtgaagcgtggagagcaagaagttacttctgcagatagaagtggtgcaaaaaatcaggaagaagaagatgagcatgatatgtttgtaccttctccattgggcagtgaaatggttgatgtggatcacgatctgctgcaggacatgttacgtgacgttgaggacccagcttacaacaagagagattctatgaagttcagaaggttggtcagtgactcggagacacctctatacgctggatgcagggcaaaacacaccaaattgtcagctaccttggacctaatgaagctgaaggcaagtagtggatggacagacaagagtttcacacaaattttgggaatattgaaggccatgcttcctgatgatatcctaaccaaccggacaaggaattgggcaagggcaagggtgaagaagaatagcgacggaacacttacgttcccaaatgccgaagatcaagcagtgtatcagaaaattgtaagttcaacacatcgcatatgttcaatttgtgtttgtgtctatcgtagtgtcgatttaacctggccttaattgtgcggcaagtcgaccttactgcctagagacagttctcgcaagaggtctcctcacaaagatgggatgatgacatcctcacggtagcgttgggaaacgaagaacaccgtggatggataagcggcattggctccgatattccatggaagcatgggtttccccaatacgcgtggcagtacaagaagaacaaactgacaaaggcg

SEQ ID NO: 33550 - DNA, 1312 bp, Oryza sativa
atgtaaacatggtgctgactttgcatacatatatttctattgtagatcatggcagctcctgcaccatccaattttaacttgcggtctattcttgagaaagagaagttgactggaataaacttcatggattggtatcgcaacctgagaattgttctcaggcaagagcacaaagagtttgtgcttacacaaccttttctagctgacttgcccaacaatgctcgtgctgctcaacgtagggagcatgaaatgcgatgcaatgaatactttgatataagctgtctcatgcttgctactatgtcccctgagcttcaaaggcaatatgaggcattggatgctcatacgataatcacgggactatgtaacatgtttgaggaccaagcaagagctgagaggtttaatacctaaaagtccttgtttgcgtgcaggcttgcagaaggtaatccagtgagcccacatatgatcaaaatgattggttataccgagagtctggataagcttggctttccccttagccaagagttggctactgatttgattctccagtcgctccctcccagctttgagccgttcataatgaatttcaacatgaacaacctgaataagaccttggcagaattgcatgggatgctaaagactgcgaaggaaagcattaagaaaaactccaaccatgtgatggttatgcataagagcaagcccaacaacaagaagagtggtcaaaagagaaagctaaactctgatgagatcacgagtactagcaactctaagaccaaggttcaaaagacagggcccgctaaggatgcagagtgcttcttttgcaaggagacaggtcattggaagagaaactgtaagaaatacctagagtagctcaagcagaagcagcaggatggaaagagtttcacctcaggtattaatgttatagaaattaatcttgctacttcctctactgattcttgggtatttgataccggatcagttgctcacatatgcaaatcgttgcaggggctaaaaagaagtaggagcttagcaagaggcgaagtggatattcgcgtgggcaatggagcaagagttgctgctgttgcggtcggcactatgccattatctttaccgtcaggattagttttggagttaaataattgttattgcattccagctttgtgtaagaacgttatctctgcttcttgtttgcaagcagagggttatggttttagatctgtggacaatggttgttcagtctattataatgacattttctatttccatgcacccatgatgaatggcttatacattgtgaatcttgatggatgttcggtct

SEQ ID NO: 33551 - DNA, 857 bp, Oryza sativa
gggactgatatcctgagggaagcagaagaaagggtaaaaatcatccaagaaagattgcgtgtggcccagtcccgacataagagttatgccgacaatcgccgcagagatttgagttttgaagaaggagattatgtgtatcttcgtgtcacgcctcttcgaggggttcattgttttcacaccaaaggaaaattgtcaccgcgttttgtgggaccttataagatcgtcagtagaagaggagaggttgcttatcagttggagttacctcaatctttggcaggagtccataatgtgttccatgtgtcgcaattgaaaaagtgtttaagggtacctaccgaagaagctaatcttgaacagatagaagtccaagaggatctgacctatgttgagaaaccaatccgtatcttggaaacagatgagagaagaaccaggaatcaagttatccgtttttgtaaagttcaatggagtaatcactcggaagaataatcaacttgggaacgagaagatgaattgaagtcagctcatccgcatctgttcgccagttcttccgaatctcgaggacgagattctgtttaaggggggtaggtttgtcacaccctgaaaatcataaatatataaattgttgtttaaatggaattttttttgaaataattttaaaagccttgaagagaagatctaattttaattaataaattccaatataaaatggggccagataaaattttattaaatactttgcttaattctataattcctagatttttctgggatttatttgagctaaggaagtatttttaataaatggatttgcatttaagaaataatttaaattgaaaaatgttttaaaaagtcttcttttg

SEQ ID NO: 33552 - DNA, 676 bp, Oryza sativa
gcatactcttgtggattgtttatttaaagttgtttaacaacattgtgtgatttacctctcattgaaatgctgcattccatggcatatcctaaacattgaaagatatgaaattgtaattaaattagatggtgtaaggaaacaaattgcttatatgttggaataattgtatttgaagttcaaatgtataagagtatcaatagataatgttaccatggcataggaagattagagctttcggttcatggtctaaaggactccattggcatgcaaagagcttcatccctcgtttatttgtaacatattcctacaaccaacataaaatttgaatctcacatcccttgataaaaacaaaataaaatggtgatggtgtttttcaaaattctcttattcagcataatacaagatcgatatcaattgtaacacacaagatgtatcacaagaaaaaaatggcaactggaaacgaactaacctcatgatatttgaaaccatcatctgccattttctctcaatggaagaccatgggaacatatgtagttttatgcaactcagattaggaaatggccaaggaccaatatttttttaatagaacaatcgaagatcattagttactgaataaaaaggatagtttttcaatataatgagaagtcatctttgcgtggtgttccttttgtgcatg

SEQ ID NO: 33553 - DNA, 695 bp, Oryza sativa
cctagggcaactcctaggacatccttaatcatatttattcagtagccgtcaccatttagagtcgggttttgcttagattattctgtcaagaacagtttcgccgctagatcggtttgtggaaccccaaattcgagtgcttaatcattcatatgcaatttggttgcaatctatcttattctcgcttgtgttcttcgattcgcatgcagggattagccttctcggtgaggtcaaccgggtttcggcacggttgataaccagaggagacgtggtgctgtgattgcggggttcagtagcgtgtttgttcagaagccggatcgagttgtgtcacgactccgcccaactcaactgtttatcaatacctatcggaagatcgggacctaactcctcatcagccatcttcgtcccatgacgaccacctctgtcatcgtgctgccctcgttccccctgcttagttgtcagaccaccagaacatgcttcctggaagtggaactcttgcacagcgaggcaggtagccctggagattgatgtggaggtagtgaagcttgccatggcgctgctgtggatgagattgggatggacggtagggtgcacttgtgtggatgatatagataccgagtacccatacaacctatatatttcattaggaggaagacaagatccatgtattatgtatatatatagagtaaaacatggtc

SEQ ID NO: 33554 - DNA, 448 bp, Oryza sativa
  unsure (1)..(448): unsure at all n locations
nnnnnnnnnnnnnnnnnnnnnnnnnnnnnnnnnnnnnnnnnnnnnnnnnnnnnnnnnnnnnnnnnnnnnnnnnntatcactagtgagttctctccctttgtaatatctatttgaggtttcaccactagtgagcagggtttgcaaaaccgtcagcaaccgtgcggttaccgtgcttacgacggggtacggtaaaaggaaaaccacggcaacctccttaaattcaaataaatttaaaagataatttgaaaatttgataaattttacatggtttcgtacagtttgccacggttaccatggttaccgtgcttaccgtcggggcgtgtaaccctggccccgacggttagtgagttctttttattttgtgtagaccgtgagcatgaaactactagtacaattaagttaaactcaaacctattcaagggtaccgagctcgaattcgccctatagt

SEQ ID NO: 33555 - DNA, 825 bp, Oryza sativa
  unsure (1)..(825): unsure at all n locations
nnnnnnnnnnnnnnnnnnnnnnnnnnnnnnnnnnnnnnnnnnnnnnnnnnnnnnnttgaactttacaaaaacggataacttgattcctggttcttctctcatctgtttccaagatacggattggtttctcaacataggtcagatcctcttggacttctatctgttcaagattagcttcttcggtaggtacccttaaacactttttcaattgcgacacatggaacacattatggactcctgccaaagattgaggtaactccaactgataagcaacctctcctcttctactgacgatcttataaggtcccacaaaacgcggtgacaattttcctttggtgtgaaaacaatgaacccctcgaagaggcgtgacacgaagatacacataatctccttcttcaaaactcaaatctctgcggcgattgtcggcataactcttatgtcgggactgggccacacgcaatctttcttgaatgatttttaccttttcttctgcttccctcaggatatcagtcccgaaaacctgacgttctcccgtttgatcccacaaaagtggagtgcggcacttctgaccatacagtgcttcgtaaggggccatctgaagactagcttgataactgttgttgtacgaaaattctgcataaggtagattcttatcccaacttccaccgaaatctaaagcacaagctctcaacatatctntcaaaatctgattcaccctttcggtttgtccgtctgtctgcggatgataagcagtactaaagttcagcttagaacccatctcttcnnnnnnnnnnnnnnnnnnnnnnnnnnnnnnnnnnnnnnnnn

SEQ ID NO: 33556 - DNA, 631 bp, Oryza sativa
ctccgtcacactccatcctcgaatcatccctaaatcctgaaatcccaaatcctcaaatcgatcatctccaagtacatcctaagtcatcacagatcacagatcaaaaggatcatctccaaatcctcaaatcgatcatctccaaatacatcacaaattcctaaaaaaattacatcataagttctaaaaaattcatcataaatacatcacatattcacatcacacacaaataaaatacatcgcaggatcatgcaatgaatcacaaattctttaaaaaaaattgttgctgcagcctcccgcctcctctccggcagaggcgccggccggccgctaccgcctcccctcctcccgtccacgccggccattgccacctcccgccttccctccgcactgccctccatgtcgtcacgcaggctgctgcccgtcgcccggacgaccggccctctaccgcgccctgcgccgcccggtcttcccgctccagcactccttctccagcgctcgttcctagccaataaggctcagctctcagcgaaggaaagagataaggaaaaaagaaatagagagaggagtttgtgtggacgggagaagaggataagtgctatggaggattatatactgcattttgatttttatt

SEQ ID NO: 33557 - DNA, 783 bp, Oryza sativa
acaccggtgagccttttaaaggggctaggaggcggcggcgaaggcccacggcggccggcgacgagaaggaaacttcgtggcttgaaggaaagaggccgatccgaatcgaactcgattccacgaacttccaaaacgttttagccgatgattccaacggagaaaaggtagaggagattccggagatcatttcccctcttttgattcggccggagaaggaaaggaacggccggatttggaagggaacggcggcggcggcgcgctagggtttcggccgggcgacggcggctcggggaagacgaacctgacaggtggaccctacctgtcagtgagcgagggagcgcgcgcgcggcggcggactgggccggactgggccgtggagagagagaagagaggttttgggccgactttcggcccaaagccaaaagaagactttttaaaacatttttcaatttaaattatttcttaaatgcaaatccatttattaaaaatacttccttagctcaaataaatcccagaaaaatctaggaattatagaattaagcaaagtatttaataaaattttatctggccccattttatattggaatttattaattaaaattagatcttctcttcaaggcttttaaaattatttcaaaaaaaattccatttaaacaacaatttatatatttatgattttcagggtgtgacaaacctaccccccttaaacagaatctcgtcctcgagattcggaagaactggcgaacagatgcggatgagctgacttcaattcatcttctcgtt

SEQ ID NO: 33558 - DNA, 697 bp, Oryza sativa
  unsure (1)..(697): unsure at all n locations
nnnnnnnnnnnnnnnnnnnnnnnnnnnnnnnnnnnnnnnnnnnnnnnnataaattccaatataaaatggggccagataaaattttattaaatactttgcttaattctataattcctagatttttctgggatttatttgagctaaggaagtatttttaataaatggatttgcatttaagaaataatttaaattgaaaaatgttttaaaaagtcttcttttggctttgggccgaaagtcggcccaaaacctctcttctctctctccacggcccagtccggcccagtccgccgccgcgcgcgcgctccctcgctcactgacaggtagggtccacctgtcaggttcgtcttccccgagccgccgtcgcccggccgaaaccctagcgcgccgccgccgccgttcccttccaaatccggccgttcctttccttctccggccgaatcaaaagaggggaaatgatctccggaatctcctctaccttttctccgttggaatcatcggctaaaacgttttggaagttcgtggaatcgagttcgattcggatcggcctcttttcttcaagccacgaagtttccttctcgtcgccggccgccgtgggccttcgccggcgccttctagcccctttaaaaggctccccggtgtcttctctacccgcagncaccctcgccttcgcctttcgtcgcccgtagagctctagcgc

SEQ ID NO: 33559 - DNA, 17909 bp, Oryza sativa
aaagtcttcttttggctttgggccgaaagtcggcccaaaacctctcttctctctctccacggcccagtccggcccagtccgccgccgcgcgcgcgctccctcgctcactgacaggtagggtccacctgtcaggttcgtcttccccgagccgccgtcgcccggccgaaaccctagcgcgccgccgccgccgttcccttccaaatccggccgatcctttccttctccggccgaatcaaaagaggggaaatgatctccggaatctcctctaccttttctccgttggaatcatcggctaaaacgttttggaagttcgtggaatcgagttcgattcggatcggcctctttccttcaagccacgaagtttccttctcgtcgccggccgccgtgggccttcgccgccgcctcctagcccctttaaaaggctccccggtgtctcctctacccgcagccaccctcgccttcgcctctcgtcgcccgtagagctctagcgccgtgtgccctagcgccgccgtcgccgccgtcgctccagccgtgcgccgccgccgttccagacgtcgccgtcactcgggaaggtcgtcgtcgtggtcgccaagtcgtcgccgtcctcgtccgccgcttcatcaccgtcggaaaccgccggagcatcgtcgccgtcgtcaagccgcagtctgccgccgttccttcgtcatctccgtcgccgtccgttggtcttccgccgctcccttggtcgccggtgagttcgccgtgccgtccgctacctgttggtgccctccgtttgtgccgtagtgccgccgttcgccggcgagcttgcgccgtccgagctgtcgagccgccgagccaccgccgccggttgtgaaccgccgccgtgcgcccggtccaccgcgaaaccctagcccgctgacgtaataaatcccttttccttttcaaaaataattcattattgcgtcataattcaattaaaatcaatttaagtgttttaatccgatttaatcttcaaaaattcataactaattcatcttagctccgatttagttggttcaagtctctaaatttttctaaaattgagatctacatgttaaaaatatccacatgtactgttcatgcttgtttatgtgctgttttggtgattttgctcttttctgcttagattccgtcgtttccgaagagtccgttttcgccggagaagagtttgaagagttccaaggccagcaaggcaagtcacacagatcccaaacaaccctttgagcatgttgatcctatttaaagctattgtttttattcaaatattgcatttattttcgaatgtcattgggtggaattaacctattgtttgttatagcccttttgttcttgattactttattccttgataccttgggttattataatttgactagttgagctttgtttatattggttcaactagatgtattagatataattgcttagccctgcttagaaacattagcacactattgggataacttatgactcactattatttaaagatggcttaatgatagttcacgatggtcaatcgtgattggttaattaattaatgtgccaactaaaacctgataatggtgggttgtgagcacatggttttgagagtcgtgctcatgacaattaaggaccggttcacgagtttcggttgtgaaacattaaccgtgccaaccacaagccagcgtgggcaacggctttatcttttgtatagcatggttcattgcggggcaccagactgagaagtggcggagataagcccacgagggtcgctggggagtccatgccttgtttataagggggtgattaagatccaggaaaggtgcgctgtaatggattgtgttgtgcgaggggtattgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtctcacacttctcaccatagtaaatgatgctataattggtaataatttgattagctcctggtttggaatggtatattcctggtttggagatagaactgtgcagccggggtggttgttcagaatggttgggcctatacaacagggtacgttgtatagtgttggattaatattgtttaattattacttaacagttttattaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacagtgaagctgatggtgtggaggattaggtgtagccctggtcaagcagcttgtggagtggagccgtctgcgccgtttatcttattttccgctgcttagatctttattgattgagaggaactatctacctctgtaatgacattttattcgcttattaattagagtaataattgtactctattatcaatttgttattgtgtgcctcggctgattcctggacgagggctcacacacatgtaagcgttttgaattttggatagaaattccgggcgtgacaagttaggaaataaaatggtcagggttaatcatagattatttttggaaattcctcgagcgtaatagtatttcggtcgaaattccgagttaattataaaaatatgtttcttgaacagattagattaaaattggtagtaatttagatataattagtagctaaacaattagatgaattcttatagattattatagattatttttggtaatctctataagtcatcggttcacggtagaaattcggatttaattactaggaatcttagccgtgtatcatatttaatcgtttagtcatagactaaattaagttgtataatatttctaggatttcgttcgatatttagctcgtaatagaaatttctaacctattatatggatacaatgctcggggagagtaaattaaaaacttatgacaacgaaataattatacccgcaaaatagtttaaatcaaaattgggtttgccgtagttcgcagatagtaaagttaataaaaaggaatcgactttcgcattcgactttcatttggatttatttggatttttatttgaattctaaccgaattcaaatcaatttttgcacgtaactatagagcccgagggagttgcggatccaagcgaaggccaagacccgcaagactttgagcaaggcaagtcatcactattccttgaacatgttgatcctaattgcgaaattgttttgtttacaaacaaagttgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggtaattacctttgggaaggtaattgagatgcggcatgtggagacatgagcgccacattgccatgatgttgatgacatgatttgtgaaaggagaaataaaattaaacaattgttttcgactggggcggacggagaatttgggttgtatctggaaaaggctagtaccgtccccagtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacgatgggacagccgttgaggtagggccgagaagcgtgccctacatcggtgtcgccattggtaggactgccatgagtgtgtgagagagagaacttaacttgaaccataatttaatatgcgtgtgagacttctctttccccgggagcgccagaactcctctcactgctagaaacatggacgcctagagtgcatgaggatttaagttcatggagcgggtactggcaatgcgaggttatcgaaaagctttgccgtgacgcgtctcatgtgttgggacgaggctcatgtgttgggcagtcgcggagtgcgggtaaaatgtacatccactgtagtgtgagtaaaccaaatctattcgaacagccgtgctcgcggttattgagcaccgggacatgtattacacttggctagactctaaattctttaacttgtgtgggatgggatattacatgatgatttttatgctgatggagccacttcctgagaggcgggaatgtggatgtcctcagaaaaccataacgactcaatggcgggaagctatccttgggatcacaatggatggtggacagaaccgtcattgttaaatatgaacactggtaataaaacttgatcagtctatgctaggtcttaggcttgtgaaaataattacaaaacttgcttgcgcaaaagaaccatagccatcctttgaattcctctgtcatgtgcatcattgctgtggtggcttgctgagtacggttggtactcacccttgcaaatataaaattaatcagaagcgggagatgaagcctcggaggatccctatacctactaccaggagggagatgaagacgatggcactcagtaggtcttagtacggtcgttgcctgtggcaatggcatgccgctgcctgaattccgctgccttatctatttctgcttttggatgtattccggaccgctcggtccgatgatttaagactatgcctgcgggcttatgatgtaataattcgaattagacactcgtgtatgtgcacttggtattccagctatgaattcgtgcgtaccagatctgatccagggaaatggtactgtttacacgattgactcctgttataaaaacgggggtccacagcatggctaagcatcctaagcactttagctaaaaccatataatgttctagctaatccaattattaaccaagtgacaaagtataggtaagcaataacaaaggcaataggttccacccaatgacattcaaaaataaatgcaatagttgaatagaaacaatagctttaaacaggatcaacatgctcaaagggtcttttgggatctgtgtgacttgccttgctggccttggaactcttcaaagtcttctcctgcaaattcggactctccgggaatgtcggaatctaagcaaaaaagagcaaaatcaccaaaaaagcacataaacaatcatgaacagtacatgtggatatttttaacatgtagatctcaattttataaaaatttagagacttgaaccaactaaatctgagctaagatgacttagttatgaatttttaaagattaaaccggattaaatcatttatatagattttaattgaattatgacgcaataaagaattatttttgaaaaggaaaagatatttattgcatcagcggtcttgggtttacagtggaccgggtgcacggggatggtctacggaacgaacggccgtgatctaatcttatccaaaacaaacggccgagatcgaatcggtctaccgcgggtctacggctgacgcggtgctgacgttggcgatgacgtcatcaccggcggtggcttggcaactcacgctcgccggagaacgacggcgcggcgacgcaaacggagggcaccaacaggtagcgggcgacgcggcgaactcaccgagggcttagacgatggcgaacgacaacggacggcgacggcggtgaggttgaagctgcggcggcgttcgggtcaacgatgatggcggtgctccggcggtcttcggcggaaacagagggcgggacgaggacggcgacgacttggcgatcccgacggcggccttcccgaccgacgacgacgaccggagtggcggcggcgcacggctggactcccttcggcggcggcggagcacgggctctagtgcctagggcgctacgagcgacggcgagctaaagcgagggtggcggcggatagaggaggtcccgggagtccttatataggggctaggagcggtgacggaggcccacggcgaccggcgacggcgatggaaagtttagggttcgggaggaaaaacgaatccgaatcgagctcgaatcccacgatttccaaacgaaactagatgatgtttctataggagaaaagatagaggagatcaacgggatcatttcccctctaccaatttgatcggatcgggaacgacgcggccgaatttggaaggaggcggcggtggcttgcgtgcggcgggctagggtgcggctggcccgaggaggacgacgaccctgacaggtgggacccccacctgtcagggggagagagagagggagagcggcggctcggctcggcgggctaactacaccggggcgctagcaggccgaggagagagagaggggttttgggccgactttcggcccaaagccaaaagaggacttttaaaacctttttcattttaaattattcatgaaatgcaattccatttattaaaaatactttcttggctcaaataaatcctagaattatctaggaactatagaatcaaatgaagtatttaataaaattttatctggcccacttttatattggaatttattatttaataattagatcttttcttctagacttttaaaatcatttctaataattccaattaaacaacaatttatacatttgggatttttagggtgtgaaaaacctacccccttcaacataatctcgtcctcgagattcggaagagctggcgaaaagatgcggatgggctgactttaattcatcttcttgttcccaggtagcttcttcttccgagtgattactccattggaccttacagaaacggataactcagttcctggttcttctttcatctatctccaagatacggattagttgatcgcaccagctcgaccttctcctcctcgtgcgttcacctcgctgtactcccacgccgataagcaccgcaaactagcggcgcctctaccggtatccacacgtacagggacggaacgccacgcgcagatgtgctagcacccgcgcgcagctagggttttgcttggggagggatgtgacggctagggtttctcacgtgatgcaatgcctctgccggtcacacccctcacgaatataaaggattcatcactcgggcctccaaggtccgtaggactcctattcggatccctatccgaattaagctcatattggatctctatccaatccccttattccggcccattaagcatgcgaccctgtaggttcatatatactcggctgtaacccgaaaactcctttttggtccacgcgtcaacagcagcccctagcataacgtattgacccaccgggcatacataaagatcatatcggctgaacctctagtgtatacttgtatgaacccctttgcctcacgattatcgattaagctcaaggccagatatgtgccatcctctaatagctcaatcattcactcgaacctgttgatggattatataacttgtgattgactcctcaatcacctttggcatggccatgcacttccataatcgacaacatcgaggggcccagagatatctctccataggaggggcaaatcccatattgattatttatattccactacatgtttcatagcatacctgaaaactacttttataactatctaattatggagtagcgtttagcagtccctaagtaagctactacacatgttgagaaccacgataatctcaggtctaaggattcaacaccaatactcaataagatcactgatgacacaacacatatggctcttgcagtgtctcatattgggtctatccaacaacatgtttaccaacatgtgtccacattattaatttggtatctttataccatgatccatgagacatgatcatcaattaatacatgtgctgatcatataaacatatttgttccacatatgatatttgatctgggatcctttagaaatagtaacaaacaacataaagagtctcgtgaaagaatcacatattcattaaccaataaggagttatctatttcaaggaacaatgtcggataaatatgtaaacatagtatgtgatacaattatctctatgattgcctctagggcatatcattaacagccaccgccagcttctcattccatgaagctagctagcagacaatggaagccactgggatgcagctgacgcactcatcttccttttctccccacctccgccgctcccggacttgcattagagcgtcgccgtgcatgtcgcctcgctttgacgccaacctcgccaaatctgccccgctgccgcggcatcgcttccttccatggcagcctcgatgagccatcgggctgtaatttgcggatgccgaggaacccatccgcccacccattttggcccacacgaagagctgctccaccattgctgtggggaggtccaccccgtcacatgcaggccatggcaactagccgacgcagagcgagagagcacaccagtggcaagcagttggtggtgaccatggcacgcggtggccgccagcgcacaggatgaggagatcgagcgtcgatgtcgacagcatggctagaccatgacatggtggctggcgcaaggttcttccgtcatcgaagctctacagtggcatcctagggaacccctgtttaaccttggcaatttatcgaatcctatttgaatgacggcatgttagcgaagctagtttttttttcaattacatagatgcaaatttttttgactatatgttcatcaagtaatgagaaaccataaaacactagtacagatcctcccatcaatgaaggcctctcacataactgggttttgtgttccgtcactccagatttgcccgagacatgcacctaaggagaaaatcgcaatcgggccgaaataaacaccgacgtagatcaactcgtacagatataattgagttgcatatatcaagtgcccatcaccgatgagactcatctgtgacgggcctacgtttaggcccgattgagattatctctacaatctttgtcgggcccaacacttaagcctgcaatggatgagtatcatcggtgacgggcgacaaacacatcccgattaacataaatttaaggcctatcaccaatgagcagttatcgatgacgggcttattggtatgcccgtttgagataactgaacgcccgtgaccgatgttctttcattggccgttactgatatctattgtacactacaaatactccaccccattgttctctgaagttatcccactgttcactattttggtgagaggttgaagggggtgaatttttgtgtatttttccaagaaaaacagaaaattcataaagtcagtgaagaatactaatcaattctcattaatttagtaatacttatcctataagatgtttctctaatattttttcatttttgcaatgatgaatcgaagttggatatatgggaagactgtgaaacgtcatagcaaggagtatagaaatgatgtattaaattttataaatgcagcggaggaggataagaaaagaagaaacaacgattacatgtgttgtccatgtgtggattgcaagaatgagaatatgtttgatagcagagtggacatacatggtcatatgatacaacgaggattcatggagggctacgcatgttgggtgaagcgtggagagcaagaagttacttctgcagatagaagtggtgcaaaaaatcaggaagaagaagatgagcatgatatgtttgtaccttctccattgggcagtgaaatggttgatgtggatcacgatctgctgcaggacatgttacgtgacgttgaggacccagcttacaacaagagagattctatgaagttcagaaggttggtcagtgactcggagacacctctatacgctggatgcagggcaaaacacaccaaattgtcagctaccttggacctaatgaagctgaaggcaagtagtggatggacagacaagagtttcacacaaattttgggaatattgaaggccatgcttcctgatgatatcctaaccaaccggacaaggaattgggcaagggcaagggtgaagaagaatagcgacggaacacttacgttcccaaatgccgaagatcaagcagtgtatcagaaaattgtaagttcaacacatcgcatatgttcaatttgtgtttgtgtctatcgtagtgtcgatttaacctggccttaattgtgcggcaagtcgaccttactgcctagagacagttctcgcaagaggtctcctcacaaagatgggatgatgacatcctcacggtagcgttgggaaacgaagaacaccgtggatggataagcggcattggctccgatattccatggaagcatgggtttccccaatacgcgtggcagtacaagaagaacaaactgacaaaggcggagaaagatgcacgcctcaaggaacaacttatggaggacatcagagctgagctaagctctgaattcgatgagaagttgtcacgggtggaggcacgcatcaggggtgagcaccagcaagggaacgtcgaccccgccgacgctcccagagtagaagtgagccccacggaaaggcgtagcagctgcgcatcaactgaagcggcggaagaacaaccaccagtccctaccgcagtggaccacacaatggtaaaaccaacaaataaagcatatgttgtcttagctcatcaatatgttatgacatattctaagaacatgtatgaatctatcacagggtcccatagagtgcaccctagtcgttagggtgacacaagcatttacacttcctaccgccaagggtcttgcgttcaagcctacaccgaaaacccgagttcatcgggcgtagttgatggccaggcatgctaaagtacaagtggacttagtcaagcccgaatgggtaggctccactctgatgcatccaccaaatgacgaggttttgaccctaggagttgcacatgggacctttatccaatggcccaagcataacattcagataaaatataagtcctaggccaacaccaagtactagacccactacaactcttatatctgcccctcctgccattgaagaaggagatgaagatctccaattgtaatatgatacagattttggggatgagggtttggaagtcgacagcatggcgtactttccccctcctgccaaaaagagcaagaaggcccaatcttctccaccacagcatgaaacaaaaaagaaagctgttgggagggggagaggaagaggaaaggtagaagcctcgcttctagttcccaataagccaaatcttggcaaggcaccatcagctcgtcccacggctccgaccgacttcacattaggcatgccactggttggagacgacatgttagcgaagatgggccctgcttgcaaggagttgcacgggtactacatggagatgtccaacacaaggaggaagcatagagagacctgcatgacgggccatcacgatagacagccattccttgggcctccaagctttattgctgttggtatttcttaatgtcacagataaaatccgcaagcgcacggaagataccgatgtagcacttcacctgggagtattccaaggtatagatttccacaggaacttgtgtgtcatctcttcactaggttcatccaaggacacaaagctaaggtaggctaagggtagagaggatttactagtgagagacagtgtctatagaaagctcagtttaatcctaacgcggtacttcgggcgctggccagtccgctgctcccagatatggctcttcaaagtacccagatagggatgactttagtgttttgagggctatcaccacctctacacctacctcaaacatactgtgggatatgaagcaaataccgaaaattaactacccagataccacgtctacgaagtttaataactactttaatgttagctaaacactaaagcaaccactatattttattggattatagtgatcagtgaccccataagttgattaggaactaaccaagaggtaactctcacagaataaatattaattactcccaatgatatttcgattaaagcagagtacttaacagagtgaaagaaataagaaaaggattaccgacaactccggaattcctccgacttcctctactctactctctccctaattctagtatataatatagtacaatagcgcctcttataatttagctcaagctttaagttgtgttgaaagtgaagtgaaaaactccttttatagggcaagtatgatgattataacgatgcaaaatgtcttaattgccccgcggttgacggtcgttatcgaccagtttcgaccatcaaaccatgtgaagaatggttgcacgttgttgcgagaaatcggtacaagtaagagaggacctcgagttaagtaccgtgaactacagggtttgaaatacagggttaaactctattgtttcctatgcaagagactataaaatgtaatcgcctagaaccaaaagagttggaatggaatgcatcaagaatactaagagtacggaaaagctgtttctggccctcctagaagatagtaccccatatgcatatggttttcttctagcatgactttctctttatggagacaactcttcccgttaagatataacagaaaaatagttttgttgctgctgacttgctaaagtatatacatagagttctctacattggtgtttaccctatcatgcaataggaaacggctggttaatttccattatttttcctaaataagaaaagatcatgccgctatttttttcattccaaggtgttttgagtatcgtaaatgggctatacatgttagactgttagcaaaaatgtactttgtttcaaattagtacttagaattgtaataggtgtatgatagacttagagtcatagtctactctaggttatcccttctttctataaagttaagacccaaagctaatatttagttaagccacgtcatcatttaattgtcagccgttggattacatctgagcggtcctcattgcgttttcgtagcacgtcctcggtcccttcgctcgccccccaccgcatcgccttccacaccggaccccacggctatttgcctccccccagcctcatcgcctattcgcctcctccctggccctggcaacaatgacgacggcggcgacggactctgtcgatgacgacagtgacagcggcggtcgcggacgagtgtggcgacaagggcagcagcggcggcggaggtcacggacgaggacgacggcgatcgagggcagcggcggacacggaagagggaggcagcagcatttgagggcggcagtggacgcggacgagggcagcagcgttggtcacggcgaacgagggctacagcgccggtcttaggcatatttggtactaatatgttctgtgatttatctgttttgcagctctgatgtgtagatgagtagcatatgactctccgtcgcaaatcgataatgcctattgcctgtgattctcccgcatgtctagccgaataattgcatccttcctcacaagcatggtgcagcgccaccaagtctctctctccaaatccaggaaactgcaaggcatcaactgtggcaattaaatcaattatcaattccatcagcacacttgagttttctcagaaatcgatttcttcaacctgcatccggttcctggccacagatgtcttctcacagtgtttgggtatgacttgaggactttatcttcatgtttcctttttctcatgtttttttcttctacttttatctaagcccctttcagcttattgcatcgaggtttggtattgcttgagctaaatcatatttatatgtgcagagcatccgcagatttggttcattggtttcgttcaagcttcactctttcattgtactgttaggtgatgtttgatgttctctttcatgctatatcttgcattcctactttcccgtggattttatagcacttacctctaaatttcgccttcaattttcagttttatttttttctcgaaaacactggagagctgcatttcatttcatttcagttttattttctgtgatgaggttttttttttctttaatgcaaaggtgatttatcaaactttcagaactgcaatatgctattctctgtttaattcttattatcggaatataccatattatgccagtgtcaatcatatcaagcacttttaatattatgccaggggcaatcatatcaagcacttttaatcaaagaacaaatgaacgcaattctcagcagcgtacagtaccaggtatattctgctattctataattgtatcccattaacctgcatttaattttttttctatcttgcaataacaatttgcatgggccttttactaaccatacaaaacacttctacattttgcaaatgaaatttcctatttcatcacacttctacattttgatggtgttttgcctattttcatcaagtagtgttattaccaccctacagggtgactttcctagatcatgtcatcaattatgatgtattctttagttgttgtttacccacaaacaagctctgatgcccaatattcagctacatgttcagctaatgagaatgtgtccaatcataggctaagtgacgtttcagtgttttaagataatttcacattcttatgttggacactcaattaattgtacatgtttttaatttcaggcttgaatatgatctgctaattacacaatatccattgcctccacggtttgaaactatctgctcacacttctatgaaccccgcaatgctcctttactaatcaagtaatcactccagttggtagctagattagggtttgtacgatacttaaaaggagttcagaagcagcacaccacttaaacaggtaaatatacagcagtttttttattagagattcattaattgttggaaattaagatgttcaggaaatcacacattcacacttgacaagttgatagctacttctagctatacaaatgcactatcgctgaattgagatctgctattttcaatgaagaactcccattattcgcaccagactacatgtatatatttgtacaacattcatattgcccttcttcagagttatttgcactgttcctaccctagttgattactttgttgtgtaatgcttgggcatttgtcagcacttaaaatatcatgatcacttcttacaaatcccgcagcaacgcgcggggtatcacctagtttgttaaatagagaagcacatataaccgtatggtaactatagcacatttttttaattagataatagattaaaaacccagtcactacatccaaaagctgtacacaaccaggtgactgtagcacatgcgagggatgattgggcggcagcctagtcggttgatggataccttgatgcgctgtaaccatgctatatcagggaggagcgttcataatcagaactttcagagatgtgggctatggctagactccatttctaaatattgtgcatccatatcgttattactttggatcttgtatggtgttgttccgcgcttgactacctatgttgatttcggtgcatgttttataacaatgcatttgcaacattatacccatatgaatattaatgagctatgttaggactattagaatacgcgtagactacgatagcataaatcaaaattttctaccacgtaaaccaggaaccgtgcaagtagtagatcatagatcgttaccacacgacgcgctgcgcagcgcaagaaagcgctaagaaggcgaaggaaccctcgcgatgtagcgcatcgatgtagaggaagtaattgatcgcaccggctcgaccttctcctcctcgtgcgttctcctcgccgtactcccacaccgatcagcaccgcaaggcaacgacgactctaccggtatctacacatacagggacagaacgccacgcgcagatgtgctagcactcgcacgcggctagggttttttgctcgggaaggagagtggcggctagggtttctcacgtgatgcaatgcctccaccggtcacatctctcacgaatatataggatccatctccaaggcccataggactcctattcggatccctacccgaattaagcacatattggatctccatccaatccccttatttcggcccattaagcgtgcgactctgtaggttcatgcacactcggctgtaacccgaaaactccttttcagtccacatgtcaacagtggcccctagcagaacgtattgactgaccgggcatacacaaagatcataacggttgaacctctagtgtatacttgtataaacccctttgcctcacgatatcgattaagctcaaggctacatatgtgacattctttaatagctcaatcattcactcaaacttgtgatagattacataacttgtgattgactcctcaaccacctttggcatggctatgcacttctataatctataacatcaaggggcccagagatatctctccataggaggggcaaatctcatcttgattattcatatcccactacatgttttatagcatactcgaaaactacttttataactacccaattacggagtagtgtttagcagtccctatataagttactacacatgttgggaaccatgataatcttaggtctaaggattcaacaccaacactaaatgaaatcactgatgacacaacacatatggctcttgcagtatctatctaacaacatgttccccaagatgtgtccatattattaatttagtatctctataccatgatccataagacatgatcatcaattaatacatgtgcttatcattaaaatatatttgttctacatattatatttgatcagggatcctttaaaaatagcaacatacaacgcaaagagtctcatgaaagaatcacatattcattaaccaataatgagttatctatttcaaacaacaatattagataaatatataaacatagtatataatacaaccgtctttatgatttcctttagggcatatcaccaacaaggacatgaagtaacaaatgagtagaattttgcctttgccaagaagatgtatgcacgtattcattataaaatttataatggcagatcttgtatgaacacggctagaaggctagaaattggaaactaattaaggttgaggtggaggattatgttacttccattaagcacaagcatattaattgttttgctactagtcagtaccacacatatggctagaagctttatctaacgcaattttttttgttaggacgtgtgaaatcatatgacaacacatgggaaacaaaatagaataaggccctgtttgattcagattaggattattataatttagattattaggaataaagtgaaacaaacagatagcctattatgatggattattataatctataagccagattactttaatctagtaatctactctaaatgttctttttttagtttattgggttgctaacagctaacaaacagcttataatccagagaaacaaacagcttatagcttattctatatatgttggcttattataattcagcttacagtaatctaactcaacaatctacgttacaataatattaagccgaaacaaacaggtcctaattcagtgtagagtcatttttgtacgtgcacgaaactgcttttccaaatcttgtttcatcttcaggtccatggatcgtcacaggttgtgcatgtatgaaatcaatactgtaacaatatcaccacaggagagtaatacctatgttttgcgcagaaatttcatcgttgaacagtggtttcatcctatttaactgagaattcactacatctattgtgtcacacatttggtctgcagtctgcacctagtacatttatatgaaatagtgggtcaccttctgcgatctgcccattggttcgagtcaagatcttgcaatatacattaa

SEQ ID NO: 33560 - DNA, 860 bp, Oryza sativa
aagtattcagttagtttgttaggctttgttagatagggttgttagtcaattagaatcaatcaatcaagaaagttaaatctatatctagtcctcccttctatgtccatcctcattcaagctctgggacagggaggctgcaggcctcgcccttcgccctcccgtcgagcaccccaattcaatctacgcacacaatatcttggtatcagattcaagcgatcctttcctagctttcaccgtggctgccatcatgacgacctccatggccttcgtcattcatccatggccatgcagaacgccatcacagagatcaaggatgggctcgacaaagtgacaaaatcggtattggccctccgcgcggggtttgaggcaaagaaggtgcggggagaaacaacgacgatgacgacgacgccgtctctgtcggccacgtggtcggaggtggaattgctgcaagccactcgctgatgtggcgccactttctcagccgttgtccttatccaaggctgtggtagtggtgccatgcctcgtcatagtccagtctattattcaacccctgtgctacatccgtagtctagagaggttgtgtaatatctataaaagtgaagatacaagatataggatgggactctcttctcattcttcattctatcatcctcaagcacaagtccaacaatgagcagcccccctcctctttatgtagctataatgcacatatggacggtttagatgtgggcccaattagtgtatatatagaaggtttccatgttgcatatatggaaggtttcttgacactcctcccttgggtactcaccgtgtgatgtctatgcctcatcaaaactccagaaaacccagtgggaaaaaat

SEQ ID NO: 33561 - DNA, 828 bp, Oryza sativa
ttagctccaaacaaaaaggccaaattcaagaaaaactaaaccgactgataagccgactaatgatctgcccgccttggatccatctattgaacaagctctagatgaagaggaaattggtgaagatgttgaccaggctgtagccgaaatgagtgacacagaaagaacaccatcggcttcacccaagcaaacgcctccaactccttctgcccccgttcattttacaagagtaagtatctctctttgacttcttctgaaattacctccctcttcggctaaatactcatagactttgtggttgtagaagaagaaaactgctgtgaagaaaaaaccagcagcaacaattgtcaactcggctccaccagtaagatgtctttaattcttttgcttaatcaatctcaactggctctatataacacttgtctattctacagcctccttatcctgtacaacaaccgtcaagtgaccagactccatcggttgtggggagtcatcacatcgaggaagaagaacaaccaactgctcctgctatcccagtaagttttcctttgtctcaacaattagatcggctacattttacccagctcttactctttccgaaattgtctctacaggttctagccgatcttttctcttttgacatcagaaattatctcgatgaggcagaagaagacacttcaagcaaagctctagctcccctatctgacgatgtgagaagaacacttgaagatatctctcatcggctagaagcctcttctttagatagtttggtagttgactgtggatcaattaggacacggctgcatgaagttcaagctctgattcccgaag

SEQ ID NO: 33562 - DNA, 556 bp, Oryza sativa
ccaacttatcttatgaacaagctaccatgggaaatgagggtaatgcacgaatggtatatgaaggcatctaggaaaggtctcggtttcataagcgtcgccgtcccggaaggcgctttcatgagtggtcctaatgggatattttttatctctttccaagaccattacgccctctacaagctagataaaatggacgttaatctcgttgcggctttctgtctgtaagtctgaactctttattacatgttgcacgtttcattcgaaacaaataaaccaaatctcatttcttctttattcattgtacagtatgcaattccacgaagctgatagaactggagcaaaggttggatacgtcgatccaacaagaatatgcaaaacacaacacaccgtagagctgagagaggactgcgagcaattggttggcaagaccccggaagaaaaggaagaatatgtgaagacattgcacaagaggaagaagctagaagtagcaacatacttggcaatagcaatgttggcgcacgccgacaaagatgtcttaatggtcccctaccagttcacg

SEQ ID NO: 33563 - DNA, 638 bp, Oryza sativa
ccaaggtgagtatatgacatactcagtaagccacgcagcaaatatgcaagtgcacaggataacaaaggatggcataatagggttccatttgcaaaagcagcatttagcaaacatttgagaatttaataaaactgttaagtaataattaaacaatattaatccaacactatacaacgtaccctgttgtataggcccaaccattctgaacaaccaccccggctgcacagttctatctccaaaccaggaatataccattccaaaccaggagctaatcaaattattaccaattatagcatcatttactatggtgagaagtgtgagactaatcacgaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagctgtgacaatacccctcgcacaacacaatccattacagcgcacctttcctggatcttaatcacccccttataaacaaggcatggactccccagcgaccctcgtgggcttatctccgccacttctcagtctggtgccccgcaatgaaccatgctatacaa

SEQ ID NO: 33564 - DNA, 573 bp, Oryza sativa
  unsure (1)..(573): unsure at all n locations
nnnnnnnnnnnnnnnnnnnnnnnnnnnnnnnnnnnnnnnnnnnnnnnnnnnnnagctgatgagtattacaaccttatggccgatgagagggaggatctggttcagtcacgattgcgagcccttgcaaaggttaccaaggataaggaacgtgttgctcggtattacaataagaaagtggtacccaaagatttttcggaaggtgaacttgtatggaaattgattttgccgattgggactcgtgatagtaaattcggcaagtggtcgccgaattgggaaggaccgttccaaatttataaggttgtgtctaagggagcatatatgttgcaagggcttgatggtgaagtctatggacgagcgctcaatggcaagtacttgaagaaatattacccaagtgtttgggttaacgcatgatcggctagtgttgccgatgcatgacagccgatgtgtttacatcgccttgagatggccaatatggttatatcgcccttagttgttttttcatgttgtaatcggttgtggtttgccgatgtacaatggccgatattgttatatctcccttagttgtttttataa

SEQ ID NO: 33565 - DNA, 2956 bp, Oryza sativa
  unsure (1)..(2956): unsure at all n locations
cgcatatcaattatatgcaatgatctagatcataaactatacaaggcggctctgataccactgttgggatacgcgtaggctatgatagcatagatcaaaattttctatcgcgtaaaccaggaaccatgaagtgttagatcatagatcgttaccactcgacgtgctgcgcagcggaagaagacactgagaagttgaaggaactctcgcgaagtagcgcgcgtcgatgtagaggaagtagtcgatcgcaccggctcgaccttctcctcctcgtgcgttctcctcgccgtactcccacgccgatcagcaccgcaaaccagcggcgcctctaccggtatccacacatacagggacggaacgccacgcgcagatgtgctagcacccgcgcgtggctagggtttttctcggggagggaagtgatggctagggtttctcacgtgatgcaatgtatccgccggtcacacccctcacgaatatataggatccatcactcgggcctccaaggcccgtaggactcctattcggatccctatccgaattaagctcatattggatctctatccaatccccttattccggcccattaagcatgcgacccttggaggttcatatatactcgggtgaaacccgaaaactcctttttgtccacgcgtaaacagcagccnctagcataacgtattgacccaccgggcatacataaaaatcatattttctgaacctctagtgtatacttgtatgaacccctttgcatcacgattatcgattaagctcaaggctagatatgtgccatcctctaatagctcaatcattcactcgaatctgttgatggattatataacttgtgattgactcctcattcacctttggcatggccatgcacttccataatctacaacattgaggggcccagagatatctctccataggaggggcaaatcccatcttgattattcatatcccactacatgtttcatagcatacccgaaaactacttttataactacccaattatggagtagcgtttagcagtccctaagtaagctactacacatgttgagaaccatgataatctcaggtctaaggattcaacatcaacactcaatgagatcactgatgacacaatacatatggctcttgcagtgtctcatgttgggtctatccaacaacatattcaccaacatgtgtccacattattaatttggtatctttataccatgatccatgagacatgatcatcaattaatacatgtgctgatcatataaacacatttgttccacatatgatatttgatttgggatcctttagaaatagtaacaaacaacataaagagtctcatgaaagaatcacatattcattaaccaataaggagttatctatttcaaggaacaatgtcggataaatatgtaaacatagtatgtgatacaatcatctctatgattgcaactagggcatatcactaacagtctcccacttgcactagagtcaatcatgaatgtatcttacgcccattgccctagtgtgtgcctgatgcttaggttgagggagtggctttgtcaacggatctgcaacattgaaatccgtatgtattttgcatatcttcacaactcctcttcccactatctcgcgaatgaggtgataccgccataaaatgttggacttttgatgcgatctaggctccttggcttgcgcaatagcaccactattatcgcaatagaggtccatagggctagaagcactagtcatcacacctagttgagaaacgaatttctttatccaaacagcctcctttgctgcttcagaagcggcaatgtattcggcttctgttatagaatcaaccactgtatcttgcttggaactcttccaactcacagcgcctccattcaggcagaacacaaatccagactgcgatctaaaatcatctttgtcggtttggaagcttgcgtcagtgtaaccttttacaacgagctcttcctgtcctccatagactaggaacatatccttagttcttctcaagtacttcaggatattctttacagctatccagtgactctcacctggatctgattggtatcggcttgttgcactaagtgcatatgaaacatctggatgtgtacatagcatagcatacataatggatccgattgccgaggcatatggaatcacactcatcttgtttcgctcatcagtcgtttgaggacactgattcttgccaagattaatgccatgtgacatcggtaagaaacctttcttagaatcttgcatattgaacctcttcaacaccttgtcaatatatgtactctggcttaatccaattagcctctttgatctatctctatagatccttatgcccagaatatatgctgcttcccctaagtccttcattgaaaaactatttttcaacgatgtcttaacggattcaagcataggaatatcattcccaatcaataatatgtcatctacatataggacaaggcttttcttcgtttttgacaaagcccacgccttgactacttcgtcaaaacgaatattccaactccgagatgcttgctttaacccataaatggatttttgcaatttgcatatctttttagctgattgtggatcaacaaatcccttgagttgtgtcatgtacacatcctcatcgatatttccattgacgaaagctgttttgacatccatttgccatatctcataatcgaaataggcagttatcgctaaaacaatctgaatagattttagcatggcgactagcgagaaagtttcatcataatcaacaccttgaatttgtctgaaacctttcgccaccaatcgtgccttgtagatgtgaacatttccatctacatctgtctttttcttaaagacccatttccactcaatggcttttacaccatcaggtggatcaaccaagttccaaacttgattgacatgcatggattctatttcggatttcatggctcc

SEQ ID NO: 33566 - DNA, 612 bp, Oryza sativa
gattcggtttattccttccatccaattgtctggtgatgagctgagaccattcatgttttagtgttttaccaggaaaaaacaaccgtgcacatagtagtttgtggcgatggaaggttcacgttacaaaatatgtcaagtatcaaagacataagaaattcgcctacaaaatctctagctatatgagtatatataataaaacaatgatggacagctttgcaaatcatacatacataaggttgacacccctaaaagtaacgaattacttgatcgattgctccagaacagcaaaatacctttaattggtatgattctctcacctgcagtaaaattgggcatcaggatttacctttacctcccccacaaccccgataggtagccgaatcagaatgtacatacacagaaaaaagagagaaaatgtttagaaaattgcacatgtaaaggcgtacagcacattgtgaaggaaagtttagagaaagcaagaggcaattctgcaggaaggacaggtgaaggagacaaacaaataagaaagtgtatagcaaggaaggaggatgggtggaacaaaaatggcaccttgctgcaggtcgccaatgcaacggaaaagagactgctgat

SEQ ID NO: 33567 - DNA, 586 bp, Oryza sativa
cgtgaatccaatcccttccaagcaacaagctgtaagaacccttcccatcgatgacaaaaaaacgtggtaggaatagtcttactgccgactgtcagctccacatttagaacacctttggtttccgatggattaccaccaaagtctatgagcaccatatttgtcttgatgagatcctcggcatttctacccaacttcttgaacgtagcaaaaggcatcaaatttaccgcggccccactatcaaccatcattttagacatcggcttcccattgacatagccgtttatatacaatggtttaagatgccgattctctgtcccctcaggtttctcgaacactgcctgttctggtgatagaaccaacttagctgattcctcttccacctcgtcgatatcggcttgatcgatcccgaattcggctggcaaggtaaagaccatgttaaccggtgccgtcacaacactcttcccctttgccaacctctttgcctcatcggctgcaacatcatcggctataggaacctgattcttaacacgccactcctgcctcggctttgctttcttcagccgatgattaatttcttgttcgacct

SEQ ID NO: 33568 - DNA, 3304 bp, Oryza sativa
gcgatacatacggtctggctggctggcggcgcgcccgtatatagcctcgctaattaagctacagtacatacgatacgatgtgtttgttgactactagtatggcgggaaaggagcggagccacgtgcacttgtgcctcaccgactacagggacggcacctacacctacacggtgcaccacatcgacgtcgcccccttcttcctccgctccgacgaccccgacgtcccggacccgggagccatggaggaggctgtcctgcccccacccgccacgcgcctcgccacgcgcccggagaccaacggcctcgagttccaccacctcctccgcgccgccgacggaggcgacatgatcgtggccaccgacgaccagcgccgcaccctcatctacgacgtcgccgcccgcgccgtcggcccggggcacatgctgctctccgacaagcgcgtcccggtctccgccgccgtcgccgaccgcctctacgtcctcgacacctcgcacgccgcccggcgcgccacctgcttcgaggccctcgtgtacgacggcgtcgaggacccgctgcgcgccgactggtactggcgccgcctcccgggccctccctacgccgacgacggcatcggccgccctctccccggctcccgtgtcaccgccctcgcggtggtcggcgcaggcatctggaccacgacggcgccggcggaggacggcgtcgcctccgtccgcccctgctcccggctcgaccccaggcgcggcgtctggacgacgcccaagggcgccggcgccggccccggcacctactcgttcgacaccgagcggcaagcctggaggagagagggcgactgggagctgccgttcgccggcaaggccgagctcgtcccgggctgcaacctgtggttcggcttctcccgcgccgacgggtcgtcgtcgctctgcgccgccgacctcgccgcggcgccgcacagggcgtgcggtgtgtgggaggacttccgcccgcccaaggagtggttcagctgcggccgccacctcgtcagcctcggctccggcaagctctgcgtcgtcaggttcttcgccaccgaccccctcgacaaatggaggcgtagggaccctgtcgccatcatcaccgccatggaggtgcggactatgcctgcttgcgacggcgacgacgacggcggaagaggaggagaacggcggatcaaggtggtgaagcacatgtctaggtgtatcaagctcccaaattacaataaaggcagaaattgggttctctaatactcgttaaatttcactctaaaatgcacaagtatgatttctttaattaatttatagatctaaaagatgtatgtatctacataaaattcaatgcaactccaacatttccttccaagtaaatggtattaataatctctcaaaagtgaaggataaagatgatgtactcatggcggcttctcaactctaattcccagtggtttgcttcatcctcctctcatccaaacggatagctgctgtttacaattggcttattaatccctgttcagtccccagatagttattcacttgtccaaagcctgtccattgtcttgattcctactactttcctaaccaatttgtgcaggcagaaagaaacttctcctgcaaagcagacaacttacaaattaggttgagttattccacctccaaacaaactacagcttgaagatgcagttgagactgtaaaaccagcccttgaaatttgattcaccgcatcggaaccagatcctctgacgtagcggacgtccgatggctctcgtccgtccatgcggcatcggacggagtcgaggcgagcatagtgaataggctcggcccatatggtataaaaatcgacccacgcgattcacaaccatcgacgccagtcgccacctccgagccacggccgccggcgctgctaggaagcaagtcgtcgccgtcggcgtcaccaccacagcctgcgcggctgcgcctccatgtcctccctcgaacgggagcctccgctgcgtccgccgtggaggtcgcggaccgtccgctttgacgaaaccatgactcttggaggtcaacctgtcatggaagatgcagcaagagggaagcaacttgtccaaagcaacaatgcattgttgtgagatttattgttaagagcatcataagtgttgcaatttcaacacagatttgatccaagtctgtattcatgtcagttccgttctcaaattgcagcactaaattaatgatgtatatgcgaatatacctttgtttttgccattttgcaagcaaacattagggtttcgtcaaatgctcaatgcagcaagaacagcacattgtaatgttcaatgtttactgtcgaagcagcatcaacacaagtgacattcttttgctagactgaagtttcacttcaattcctttaaacgtactgaattgaaaacgaaaaattgatgcaactacaatcttcacattctcaaatagacacaacaatcaatctcaattggcaaaggcattcagtcatcacattcagtgttgagttacaaacttgcaatcccaattcacatcaatttacaatatccattcatatcaattttagatctcgatctaggattttcaagatgctgccattgcaagcccttgtagtaggttctggtgatgatattactttcatcctcaagaaaattgaaactaggaatcagtcggcaacctcgaacaactgctaagtgtatataacctgctgctgctgctactaacgaattaacaggagtccccttgaacttttatgcagggatgatttgaaggagtacactgccggcagcgagccagcaacatgctaagggagagagaacgcaggggcgagagatggggaggagggcagcgacgaggggaggggcttcttccaggatccactccacccgcggatgcgccggaggagacgacgagcggcagtgagcggccggccgaagaccacgggaaatcaggagccatcccgattttgctggccgagaagaggatggtggcaacgaaggggccctcgcgcgggagacgcaggctgtggcggtggcgacgacgccgacggtgcagaggtctcccctcccccatttgcttcctagccggccgcggctgtggcgtcaatggttgaggatcgcgtgggctgatttttctaccatatgggccgagtctatccgctgtgctcactctactccgtccgatgccgaatggacggacgagagccgttggacgtcctagtgctttaggatctggttcccacagcatcagtaccccacccggtcatgaacactaccgtttttttgacaaattgacccttt

SEQ ID NO: 33569 - DNA, 39201 bp, Oryza sativa
  unsure (1)..(39201): unsure at all n locations
ccgcccgcctagggttcggtcgccaccgcgttctcctcgcccaatctcccccaaagacctctctaatcgaaggtgatttgtgcggcattgagtttgggatcgaaagagaaggtaaacccctctataaaccctaagttccccaaagttttattggatattttgcattgttttggttgtagacgtggtttgataatagttggctaaggatggattattagatggataatatgggtggggatgaagtgtggaggtggcatatctttatccatttggttgttattgatacatttgacaaaatatatttgggatggatgtttggtgatgcactagggtttgatgggagatggatgtgtggtgatggcctaggatgtgggatggatttgtggtgattgagagggtttgaaaggggttgatgtgtggtgaagggtaggtaatttgtaggagtagagtttttttttatcaataatgtgtagtatttgagtaatgtacttatttattggaaaaattagacatgttgttagcttttgaagtattggtattgcaatggtaattacatattattttcaagtaattaatgtttatgcatgggttaaaaattgtagatggatagattggtccggcttcattatggtggttgtgtggtagatgaaagtacacatggaagccaatttgagggaatgacagttagacaattagtgttttttgcgaagcctacctttgaggagttaatgtctcgcatcaagcatgaattggattggaatgatgagtcggttggtatgcaagggagatacgatgtgggcggcggtgtcatgtcacataagtttatgttagacttgaatggagagatcgaatggcaaacatatatagatatagtattggggtcacatttcaaatctcttgaggtgtttgcatggaagaaagatggtaggatagggaagaaagaacttatagaccttaatgaaagtccactcatagaatcacccattagttgtcatgaactgtcggagaggtgtagtaggaaggaagaattgattgaggaagacgtggaggggggcgagggagtaaatgatatggcggatgtggaggtcagggaagagaatgacccggtaagggaggaagtacatgcagaggagaatgtgccgttaagggaagaagtacatgcagaggacaatgtgccgttaagggaggaagttaatgtggaggagaatgtgccggtaagagaggaaggagatgttgaggatggtcgggaggtaggagatgatgtggagttgcctgaggaagaagcgaatgctaagaatgtaagtatgggccaagggagttggctaggctgaaattctatacccgagaggagtgtgaggaggctatgatacgcactggattgaacccaggctggttggagtatgatacagaggatgaattggatgagtccgcttccgactccgatgatgatcgttcagtgcgtaagatgtcagagcatgaaaggactgtgtttgcgaaactggtgggtagaaacccggaaataacacaattcgaggatcttaccagatctgggctagcaattgctgatggggatccacaatatgacggtgccttcgaaccaatgtgtgatgaaccaaggaaggggttggagtttcgatcgatggatgatctgaaaatatggctacagagttattctatccgtgtccaccggccgtaccatgtgaaggaatctaacgcgtcagtaaagtatactgtggcttgtctcgatcgccattgcaaatggcagattaatgtaaggaagagtggaggagataggtggcgggtgactagggtgggcgaagaccacacatgctgtagtgcggaagtaaccggcaagcatttgcaacttacttcaaggtttattggaaacaggttacaggcatttgtgcgagctgaaccaactttatctccagcagcgattgtcgaggcagttgagcaaatatggcactatcggcctacgtatggcaaagcatggcgtgctaagcaagttgctatgaaggttatttggggagattgggacgaggcgtatgttcgcttgcctacactgatgcgtgccatcaaagcaaagaaccctccatgcatttccgtgttgaggctcatcccgagaagtccaggatggtggatggagtacagaggcgagtatttggacgtgcatattggatatttggccagtccatagaagcattcaagcacttgaggccggtgctagcaattgatggcactttcttaaccggtaaataccaaggtacattgctcacggcaataggggtcgacgccgggttacatcttgttcccttggcgtttgctctggtagagaaggagaatacatccaactgggagtggttcatcaacatgttgagaaacaagttgatcggtcctaatagagaagtgtgtataatttctgatagacaccctggcattttgaactccatcatccacatcatgcctcatcacctaaccattcaccacaggtggtgcatgaggcacttctgtgctaacttctacacagctggagctacgactgatcagatgaaagatcttgagcgcatatgtcaaataaatgagaaagcattgttcctagatgagataaaacgcctcatgggtgtggtcggagagaggccaaagaagtggctagaagaccatatgccacttaaggtcaaatgggcaagagcatttgataccaacgggcgtcgtcatagcatcatgactagtaatatggccgagagtttcaataatgtattgagaggcattcggaaactgccggttacagctattgtggcatacacattttcgaagtgcaatagttggtttgtcgatagacacaaagaggcaactgtagatatcctgtgtggaaagaagtggcccacaaaagttaaggacatgttggaggagcagcaaagacgaaccttggggcaaagagcagcatgttttgatttcccttcgatgaagtatgaggtcagcgagcaaggcggagtcacggcggctggggttcaatggggtggacgtcactacgtcgtggttgcgagagataacacatgtagttgtcagttccctcagctccatcacttgccatgctcccacatgataaccgtttgtatgttgcgaggtttggatgtggaggtggccccccgaatgtgttatgaagcttccaataaggctgtgcaggactcgtactcccctaggtttgaaccttacctagatccatcgcagtggccaagttatgatggagagttcttcgtgcccgacttgtcgttaaagaacaacacacgaggaagaagaaggacaagaaggttcaagaacgatatggacaaagcatataaaggctcagccaaccgacggtcacaaaagccgaacaatacaaattcagagccggtcatgcaaaatagatgctcgctatgccacgaactaggccataagaaaactaggtgcccgaagcgagacaagtctaaggatcgaccgaaaaagcgccgtaggacggggggaggtggtgagggtagcacacaggtgggattggatgacattcatttgctaagttcatattgttgcttcaatgtttactttccgttgtcctcctttccgttctcattgtgatttttccatttaatattttttcaattactaatgattcaattttcatttgcaggatggagcactttccggggttggaggatttctacgaggagaagcaccgggccccacagattgccagcggagaggttagcatcaacaatattccatttttttatgatcgaatttattttttcttctttgattttagttcgtacagatagatcatccatcatagagatatctcaaatcaaaattcatgagcctcaaagcagagcatgtaaacacacagatcttcttttcagttttcttgctcaatcccaaaattaaagttcctagttgcatgaagtattttccacaacccttgtatatgatatattgtcgctaactttatgttattatgtttgtctattgatgcagcgcttgaagacccttcgagtcagaggtcacacggcgcacatactgttcgacgaccggtacgtcccgtacctacggcgggcgaagctcttggcgttcgtgaccatggcgcagcgaccggtgcctctgtacaacgccgctgctctgacggccctagtggaccggtggcgtccagagacacacaccttccacctaccgtgcggggagctgacggtcactctggaggacgtcgccatgatcctgggtcttcctatccggggtcaggcggtcacaggtgacacagcgtcagggaattactaacgagtcttcgtattcatttgttaatttttttgcaattactaatgattccatttaatttccggttacaggtgacacagcgtcggggaactggagggagagggtcgaggagtaccttggtctggagcctccagtggcacctgatggtcagaggcagacgaagacatcaggggttcctttgagttggttgcgagccaacttcggtcagtgtcccgctgaggcagacgaggctacagtacagcgatactgcagggcgtacgtgctgtacatcttcggcagtattctgttccctgactctggtggagacatggcttcttggatgtggctgccgttgctcgcggactgggacgaggcgggtaccttcagctgggggtcggctgccctagcctggttgtaccggcaactctgtgatgcttgccgaaggcaaggcggggacgcgaacctagcaggctgtgtttggttgctacaggtaagttcacgcatgttatgtttcataacatttcaatttcttgctaacatgttggaagctaacgtatgtgacgcaggtttggatgtggatgaggcttccagttggtcggcccatgtggaggacccatcaggcttggccgcaccaggatgcagaccgacgtcccactgtagctcacctgtgggaatcggtcccatctccagtagtaggccgcaggaatttggcgtactaccactacacaaacgagatggactacctacagccagaacatgtaagctattcggggttctatcacacatgaagatggtttcttactatatagtactaaatgtgcttcaatgtgttttatttttgttgctgcaggtggtgtggatgccatatcaggcacaggaagtgctcgagctagaactgaatcccatgtgccatatagaggatgcgttgaagaccctacggtgcccactgatctgcttctatgcagtggagttccagatgtgccaccgcgtgatgcggcaattcgggaggcttcaaacaatcccacaccgtttctccacgagtatcgacctacacaagttagtaatttcacttaacaatttattttgcttgcccaatcagtcacttcaacatttactacatatttgagttggacattttgcatacgtgcagggtggaccgtcggaagaacaagaaggtgactgattgggcttactaccatcaggatcatatcacgcaatgggagaagttcgaggagaatggagtaccagaccagggtcagcacaacgggacggagttcgacttgtacttggcgtggctccacaggacctaccgtcttgtcctacgtccggcttggacactagccgacatagcggatgaccccgaggatgttgaggagcagaacgagtacgatactcgtacccgtctaggtaccacggtcgagacgggacctgttcgcgacagagtggttagtttctagcattaatgttgtatattatttcatttcaatgccatatatgttgtgacttacttcatttcaatcctacaggctcgagagctcttgcggaccgtcaacgacgcgggagtggcgctaggcacggctcctggctccgaaggagagggcggcaccctccgcaacgccctacaggtaatcgttggaaagagatgaaactacggtgttttcttccaaaagcgataacttaacatggattattttttatgcagagactacggcagcgatgtcggaagttggcagcaaggctcggctgcaggtcgactgatgtggtcgaacatgctcatgcccaccaagagggggatgaagaaggggaggtgggtgacgaggagggcgagcaagacaaagaggcggaggaaggagatgaggaggaagaaggggatgaggacagagaagaggaggcggatgagctcggtccctcgcagctagaggacgcaccagagtcgtcacagccggatatcttgcagcccggcccgtctcgaccacgacgccggcgggctccttcgcaggactggaggtacacccccgacgtgcctcgtcctcgcactagaggtaggaggaggtgagtgcatggttcaatggatggatggatagatggatggacttgatgcatggttcgatggatgtatggactggatgtatggactcgactggatgtatagccgaggatcgatgggatgtttttatttcttatatgtatggacttcatatatggatgtattgatggattctatggatgtatggaatgatgttgggattgatggatggatgtatgttttgtatggttctctggatatattactgcctgtaaatttctgtcatttgatgtttgcctgtgttgtgtgcaaagttttgctaaagtttagcagggctgggacgtcagcgccatgcaaaatggcgctgacatgtccaaactcagcgccagtgcacctggctgggccaaggccgaaacggccaagtcccacctcagcgccaggttggctggcgctgagtttcccacagtcagcgccattttggctggcgctgaggtcccagcccgcaagccatccagaaggcttgcttggctgggccaaggccgaaacggccaagtcccacctcagcgccaggttggctggcgctgagtttcccacagtcagcgccattttggctagcgctgaggtcccagcccgcaagccatccagaaggcttgcttcgctgggccaaggccgaaacggccaagtcccacctcagcgccagtcccaagatcagcgccattttggctggcgttgaggtcccagcccgcaagccatccagaaggcttgctggtctgggccttggggttgcggccaagtcccacctcagcgccagtccggttggcgctgagatagctgccacgtcagctggggatcggccccggccgccacggtggcacaatgtcagcgccagtcccgttggcgctaacacggccaacgtcagcgccaatgtgtttggcgctgaggcgacggcctatttttggttgaagtttttggcaggggttagtttcgaaataagtttttgaaaagggtcaatttgtcaaaaaaaacggtgaacacttgccattttggacatcgatgtggtcttcaaaatgcagctatgatcactaatttctatctattgcaaaatattcaaaaggctaattataatactaaaaaatatttttttccttttcaagacaaatctataaacatgatttttataaatttaatccaaatattttataatatatggatgttcaaagtttttaaactttgacttgagatatgtccaaaacgacatgtttttgtaactgaaggagagagtacgtggcatccaattataaaagaaccgaaagaatcacaggtttgtaggaaagcactaacaaaatgaaatgagatggtgccatctgtcaagggttaagggaacttgtcatgtctttagccacagatagttcaaggttccagaattcccggtagctatagtgctataccaacaggtataccatctgaggccattggaagcaaagattgtgtatcgatatgaattagaacttacaagcggaggtcatttttgctacttacttttacacaagtgtatcatcataaagaaattgctcaaggttgctatatctggtgggccttgtaaaactgaacaaatgcatcttaacgaaaaaagtgtcagttaggacaaaaatcgctagttggtgcttgacttaagcagctaatgtccctgctgttgtaaaaatagtacagctatattgcttcacactgagacatggttagaagggtaacactgccctattatgtagtgaaaagatgtcgatagcatagctccatgatgtcaactccctatcaacactaggtaaaagtttgtcactcactcactctcaccaaacacattttatgtggaagctgaagctatgcaacagtaatccaattatctccttgtatatcatcatcatctgaaaaggccaaaaagggcaatctcgcaaactaatgttattaccttctgtgctccaaagtccaaacatccaactctgggctagaccatcatcattgtaatactttcagtgtgataagaaattgccaacaataccatggaaaattttccctacaatcatgccattgaacaaggaatgagccacaattgcagtttgcagacttgtatttcccactcataatcagatgcaagaacttagaagcacacaacaagatgtacattagtacataacatttttcgtacaggctatatatattttttctttagagaatcagaccatattacaaatataagtagtttgacagtacagtatatttatggtatgcaacacaaggaactataaagcatgctaagattcacaagcataattccagaacgtaatgtaagtttgaaagaacggtgtatatacttgtgtacaccataaaaaatggagcatataactaagaggaaaaaaaaagtactagtaggatacaacaaggacatgtataggactcagcagacaaggtattgcaatgttgttgtaatggtggcaaaataacatccaatcataaagattaaacgctcagcagtttagcagaagttcagctaaagaagtccttggttcactgatatgttctgaagtagttgaacttgatagtagaggataggacttgagtacttactccatcacactatcagatatggatcatacaaaaggcactgtagaagtgaacagtattcatttctcatggccttaagtgcttgtaagaatcatcactttatttctttacatgctccacagcaacaggatggtctatctgtcaaaaaatatcacaaatttattgatcacacgtcatgaagaggatgttgagtacgcatatgtcaaggcatgacaatattgaatgatctaactgcatggattaacacaggtaatgattttaaccctatatgtaaatacagatacttgtacagttcccttttttttcctatgcatatatgtgtgaatgtgtgatcgtgtggcttaaccttacttaattataaaattgtgatcttatgtgtgttgtgaccttgaggtcaacatgacatcatcagttcaccaggactctggtgtcagaagagtcctgatttgaccaacagatgtaatacagtggcagatcaactcaagcagcctggagtaatagacctgtagccatgtaggcaaggcacaattacaaaaaatgatatccaactctctacaaggtttacagcattatgcaaaaactgccattcaaacgctggacagctataggaattcctattagtacaatttgaaacataagtacataaaagcactggttctcgaaaacttttccctaaccaatggcgatgtgagttacaaacataagtccacacaggtcaagcagttaactctacgtagctggacagctctaggaattcttattagtacgatttgaaacataagtagtaaataataaaagcactggctctccaaaactttttcctaaccaatggcaatgcgaggtacaaacataagtccacacaggttaacactatgtagtcggtacagatttgacaatgtcatcacctaatgttacttgaaagtttgtggagtgattaatgaaatcattttctatgttaccaattgtttaagaaaattgtaaatttctgaagggtttaaattggttgcaatcaccaaaatttaggtgctcccagagcccagaaatgtcgtcatatagtaactgtacaagaaaacggcaggcaatactcggaaaataaaacaatgaattcaatgtgcattttgtctcttaccttgcaaattgcataataaccatgatgagcaatcccatacgtatctgtaatatccaagaacctcccacatctcttcaaggaatctcatgatcgctgtaaatagaggatattatcatcaatcataagaaaatgcaggaaattgctaaagtgtccatggatgattgatttaagtgattagatgaaatgaatgattacctcaactgttatttcagcatggcaaaaagggcagtgctttgtctgttgtgtgttcttggttcactttacacattgccaatcctgaatagattaggatgatatcatttgccaaagcatgttacttacatatatgctcttctgcaaagtcatcatccgtgtcagctatagatttcacaagagtgacttccaccagttcatcgcaaagtgcaagggttgactccaaattatcttcattaaaactgagatcaatataaaagttgtatacatctggttctgctgtaagacgttccttcctcatcttctcaaataatcttctcgcttcagtaaatttcttttttttattcaacaatcttataagagcattgtatgagcttgcagtaagcctgaatcccttttctatcatttcactatggaaatacagagcctctttcatatttcttgccttacaatgtcccttgatcaaaatattatatgtgttttcatttggtaccacctcctgtgaaagcattcccttgtagatctcggtggttgatttcatgttcttttcaatgcaatactgcttcataagagaattgtatgttgtggtatttgggtggatgttcttctccagcatccattcaagcagcctcttacctccttctaccctacctgacatgcaaaagccattcattagaacattataagtcacaatagtaggcttaattcctttatctaacatctcttgcaaaaggctgtgagccctgtcaagctctttggactggcaaagagcaccaataatagttgtatatgtgtaaacgtctggtttaagacctgcttcatccatgtctatcatggtcctcatagcttgctccaaattgccagccttgcacaagccattgatcagggagttgtatgtgaaaatattcagctctaaccccttgctgcacatctcatgcaatagttcattagcagcacacacatccccctgcttgcagagtccatctgacagagccgtgtatgtcactacatttggtgtcactcgtttctgcaccattttgttatgcaccagaaaggcctccgtcatcttcccaaccttgcagtacccatcaatgagaactgtatatgtgaccgcatcaacatccaatcccttgtcctccatctcctgaagcactctctctgcctctttcaactctccagcccgacaaaggccattgatcagcgcagtatacgtcactccatcagctgccaaccctctcttctgcatctcatcaaaccaattccttgcagctgccaaatcacctttcctacagaacccactcattaccgttgtgaacaccgctgcatccaacaccactccatgcatcaccatatcctctaccaccctcacagcatctgaaacctgcccttcgtcgcacaacaatgcaataacactagtataggctactgggttgagttccaacccccttgctgccatttcacttaacagcttaatcgcagtctccagctcactaagagtacaatacccatgcaccataatgccatatgttacaacatctggcggcgatgccatttcatcaaacagttggtgcgcatccttgatgcggccagcggtgcacagcgccttgagtagtatattgtacgagcaggtgttcttctccgggagttcctgaaacaactgaacggcttcatcaagcgggaggcggcagagcaccgcgttacaggactccggggagggagagatgccgtactggcggaggcggaggaggagaggcgcggaggggaggcacaggaggaggaggtcgaatgagacagggtcggaggagaaggccttgtaggtggagatgaactgctcgacgaaatgccgatgaggggacgggaagcgaagggcgcgaacgaggatggcccgcgcggcgccgggatcgcgaacggcggcgaggtgggcagcgaccgcgaaggactggagcaggtgagggtgcgggcgaggcccggaggggaagaggaggaggagcggcaggaggatggtggggaggtgcgggtgcgaggcgagcagggggagcgcgaggaggaggtgaagtgggcggaggagagggaggaaggggaggggagggagagagcccgggttaggggaggagaggacggcggcggcgaggcggcgcgcgaggtcgtcgtcggccggcgagtccgggcggggcggggagtagtccgggaacgggcgtggcgcggcggtggttgtgagggcgttgctctcagccggcggcgcgcgacggcggccgtgacgatgttgggaggtggtggtggtggtgaggctagagcaggcagagcccgcgcgccggaggaggggtcgcgagtgcgataatcgggaggagcgctccgctacggcggcgacggcgcggcggaggagcatccggcgcgggcggatccggggattgggcctcctgccggaggcggcgacggcggcggcggcggcgggagacgggcagatcggttggcaaagaaaaatgaaaaactttcgggacgcgatagcatattgaatgtcactaaaacaagaataaattcagcccaaaggtgcacgtaaattggtccaaaagtttatttgcaagtcaaataggcccagaatttcatcccaataattgggctattttgtggcccatagaaaaatcagtgatgggccaaaccgttgcctgacgtcagctggttgcagggcagaccgacgcttcgagtcccaaaccggtcaaaccgaaaccgagccacctctcgccgtcgtctccggtcgccaacccgtcccacccgtgacgtcatgccgaccgccaacctcaggtcgcgcgccgccgcggccgcggccgccgccgcatgcctcgcggccctcgcggtggcggctctcctccaccgccggcgcagacggggtcgcgctcgcgcaccagcctcgcccggcctcctcgggggacggcgagggcgccgcccgcgccgagcctgcgaggaggaggagaagccgcaggcccggttcaggcgcgtggtcgcggacaactcctactccgccttcaagcacctgcgccgccagggtgctggaccggttggctccggccaccacggcagcgaggcccagccgacgtctcaaggtgtggtcaccctgctcctgtttcttttgatctcggcattgccttgcccttgtagatgtgtggttgtattgggaattctgcgaacggttggtacgctaaggagactaaggcaggattaggggggacgtaatagcgtgttggttcttcggggaatttcgtcgaacattttgagtgcaaggttgctccgagcttgaggattgactatggagatctggacctgtctctttgcatacgaggaacataaggaaacgattgcttagttgattgcacagcgtgttagtccttacttggcataggaaggggccttcatgatgccagttcccttgttggagcttcgtcaggtagttatcaacgtgcactgaaaacacaacgtggagcttcgtcaggtagtccttacattgcatgctttgtctatttctttatcaatgcattactgtacatcatcacacccttacccataatatttggtacagttagtgcatctcttgtttaggaattaggattcctagttagacaaaaattaaaaaggtggatcgatcaaaattactacttcacgaggacttttattaactttaccaaagattcctacttctcaaatattatgagttagtaagtttactacaaggctgtactgcacagccttgctcacaatatttggtacagttactgcatctcatgtttagggactcctagttaggcaagtaaattgaaaagattgatcgattaaattactacaagtgcataaaccgttattgatagttagtaagaggagatgctgaaagcacaagtgcctgagtttaagtttgattgcatgagttttcaccatagtctctatgcgcatactgcaagcgaattgactgcacattgagtaggtgacacatttccttttcttatcgatacagagtcatcacaaaaggtgcatccatttgaggaggaaatcacttccttgctgaacaacccacctgattttcagaattttatgcctggtgatcgatgcccagaaatgagcacttcatacaattgggtcgaaacagatgctcagttggaggacctggctaggttgttggatgatgaaaaagcttttgctgttgatacagagcaacatagccttcggtcattcttgggatacactgcactaatgcaggtaactggtggtggataccttcttattgctctgttgcttattggcctgttaagattatgacatataaatatcatttttagatctctacccagaaggcagattatttaatagacacaatagcgctgcatgacgtgatgagcattctacgaccagtttttgccaatccttcaatctgtaaggttgtgcatctcttatatctgatatcactggaaaccattagttttcattttcagttctgcttaaagtgattttgccacttaccatttgtatttttgaattgtgatggatttgcatgttgtccaactttggaagctctagaattatggaatgtgcagtacagatgatggtgtgaattgatttacatgttattccaataaagtttaaattacacttgtgattacagagatagggtgtaggagaacatggtgtaaacaagttgtttccaccagcgtcacatttgtgtgcacccttggtactaagattactataaaagatatctagagaagttcagagattgattctttctggttaaagagctgagccatggtccatggtccataaataaaacaatgtaaaaatgccttttaattattatattttcaccataacacatgattcacattgtctgatgtgcaggagggattaagcctagagctttcatagttcatccctcctaaacgtggtttgtttgacagtctaatttcctgtttgtatcaagcttaaacccactaaactctaatttatgatatccataagatggtggattgttctttctcagccatcatgaaagataattatgtgtctctgcattagaggtagtaatatatttttttttccaagaatcatgctgcgttgttgatactgcagggccaggaaccactatacacaaacaaccaaaatatggaagtttgaaggacaataagtcaaaaattttttcagccaatcctaataagacatgtaatttctatagaagctgggccccgaacactctaaatgaacgaatgctgagtttggtatttggcctaacaaatcaatccaacaaacctaaagcccttaaatcttcttgtaaatttgaatttctggaacatggggccctaacagcatggatgatttacatggtacggtgggtgtttggttgatcaagataagattgctgaatgagtccatcagtgttctcatagacattttactattttgcccagaaatggtccgtttacccttggctcttcagaatcaatgctatatgaatcatttggttcttgttttttcctttcctgtctggttattattaacttttttcatgtattattctttgtcagctctctctctctctctcttttgtttactcttctctgtctattactcactatcaaactgatgatcacactttagcaagtgaacatttggacattggtagagttttagttatcgatatgtctgcttgatatttcaccatggagaaaaataaaccacagtgaagcaaacttttacaaagccgtatagacatccttatgtatatgaactgatgctagctctaacccctagactacggttttgagttgtttcattaccatccttgctcccttttctttttctgtcctttgtgcatatggaaccttcagtattgtctctggcacttgatagtctcatgaattccttcagagctcataactattttagcttgtaatctcatttctttgcaatgtagtggcagaggccttttttagacacctacactaatttctaatgagtttttgactattagccaaaatcaattgctgtataatcgtctcagcagaagatctgtgttgctttcttttattaaatgcagtttcatttaccttctccctacttatttgtcagatcttccatggagctgacaatgatgttctttggcttcagagagactttcatataaatgttgtgaatatgtttgatactgccaaggtaagtccccctacagtatgcatgtcttggatgaaacatctaataccattcggcagagatgtctccagcatgcgagcgaactgtgcctgttttntgtcgcatataatgtttgcttgccatgtcttttcactgtagcaagtaccatgccatactgtacgtagatatggcaataggtcatgaaacatcattttacttggacatctcattagatgtgagcatattttactttctttaatgtaatgaaagaacatcagcagtgccaatcaattgctgacctacatttgtgtgcttcccgttcatttttgcattagtggttatagttttttcatgggacaacataatgagctgctaagcatcatcaccaatattatgatatgtgatagtttaaagttcgtcacgcttgattacaatttcttatgtttcaattttatatatttgattttagcttcaagtttcaaccagaaatgtattcatggtttaagcaggggaaatgatttcataactggtttactgcaatatgaaaagatttatggatttacaatgtgtttacgatgaaaacatctttttttggtaccagttcctataatctagagtagagatcaccttcttatgaatattttggtcattgaacattggttgtttaatggcaactttgcccctaaagttattcacctatgctatcttagatgttcatttttttttcaccggacctcactttattatttatgttatgcatgtatgcccttttctgaattgccttatgaaagtaatttattgcaggcatgtgaggttctatcaaaaccacagaagtcattagcatatttgcttgaattatattgtggagtgaccacagacaagacaatgcaggtaggccatttattaaggttggcttgctaaagccactaaagtgttttcatcagcttatttactggtttgtttactgtttagtagctggttagctttcatctgccgcctcaatttttacatgattacttctttttagcactttagacacaatggtgcacagggtgctacaaaatgtttaaccatgttagttacagagaatctttgccaattcatttagagcatttgtgttgcacttatttatgagcttagcaagatatatgtttagcttttgttgaagctttcatgtcctagaaaacattagttgcataagctcatgttatgcattgttgattgtgatttcagaataataatgtagcagtaggttctttcaaattcatttttgcacctatggaagctcatgttatgcattgttactctgatttcagaatctactggtgtagcagtagattctaagtcatttctgcactatctgttgttacaaatattaagcaccattactgaaataaatgattgttgacctaaatacctaatggtggtcagtggtactaagccctaaattgtggtggttttctgaatttgtgcctttacatcctttaaagcatgtcactaaaatggttgtcacatctttagttatattttgtcactacttgcattactttatgcatgattcccttgcccttttactcaattccatttgatcctcatacaaattcttgatcgaaactctgttccattaatcaatctcagctgatatttagaagcctgtttccttatgcattcaattgttattaaataggtgacatgtaaaagaaaatgataaacaagttccttctgcctacttgtaatcgatgaccttttagttgtgcctgcaaaatttactccttccagtcaagtatatttgacatagggagtactagaactgatactcccaacgtcagatatacttgaccggaaagagcagtttgttttccagcatcacagttgctctcatttttacggttcattctccttgattctgatatttcagcgtgaggattggagattacgcccactaacaccagaaatgattcagtatgcccgttgtgatgcgcattatctgttgtacattgcaaattgtttggcatcagagcttcatgcaaaaacttacggtatgatctatgttcctatgtcgagtttccccttgcttttttggaggggaacttttcccttccaatatgtactatatgctacttttagttgttacaagatagtaatttgttcagcaaactgagtcaacaaggcaattagggtgtgtttggttgggtggatgggactggatgggagatggccgcctgattttttggggtgtttggttggaggacagggtggatatggtgacccagaatagagaatattctctcaatatgctggatgaagggatccggttcttttggccggatgaagccatccaccttctttaggacgctgattagtacatgattagtgagttgattagagtatgattaacggtattagcatgttttgctattaattagtagttagcatggcaagattagtgtcaacaagtgttaattccaaccggtaagtgtataactagtaatattatgccaattaagatattataattagttaattaatctcatccgatgcatcctcatcctatcaaccaaacaaaaagttggctcatcccatccatacaaccaaacacaaaacttgtatatcctcatccttaaaaacatggatgaacatatcccatccaaccttgcccttcaaccaaacatggatggacatatcccatccaaccagacattacagcattaccacagacagctacatttgacatcttagagtcctagacaatagaactcatgactccctgcatctctaaattagtttcacatgagctcacaagcatcagtttatctggattgttctatgttcacccttcagttcagctgagcacattgttttctgcaaatgtaaattactgatgtagctctgttgggctgcgttccaacctagaggttcaaaacgtttcctctctggcacgaaaaacaggtggctcattagcacatgattaaataagtattagcttaaaagacttgaaaatggattaataatttaatatgatttttttaaataaactttccaatataaaatttttgcaaagaacgcaccatttaccaatctgggaagcctgcgcatggtaaacgagggagtagaagtttggaaactggaaaggggagcttagaacacagccttagtctgttatgcttaaactttaaaaagcttccagtccttgagctgtgtctggaggaccatctatgaaaaaattatataaagatatgcactatctattgtactctcttttgaatgcttcctccacccaagaatgtaaggcatattttttggactgcagcccttagagatactaattagagagtaatcaagtaacgtctaatgactctttggtctatgttcaagatgaaatatatcttacattataggacagaggggatcagtaactttcaagctacaagtaaaaacaaaatttcatgtactaataccttaacctgtgcataaactggaaccttctggatcaagtatctaaaacttatttgataataatatcagcaaatatttagctttgtaagaaaatatattggtctattagcctatacaatcctgttatgcagcttaagaaaatgagattccgtgttgaattgatgatattttattgcttcctgaaaccaaattacataattatttccattgttccctgtctcacttttttgataaactgtaatatctaatcagatgcttcagactctcccaatgacaaaatcaattttttcttcgaggccagccatcgctcaaatatggtgtgtatgcaactgtatgcaaaggaaattgaatgtccaccaggagcatcctctgcggcgtctattttgtcaaaaaatttgcaaagccatggacttgactcctataaatcaagtgaagtgaaggtgctcgttttctgtatttgtttgcctgcttgccagtgatttcaataaattctcaattttgttgctcttttgtaggatcttgtttggaaaatttgtgcatggagggatttaatggtcagccaacatattcttattcttttagaacaattgattttcgcattttcgtagggtatattcttagctttttgttaaatctattagctgtatttggtgcttcacacattgtattttcctatttctgcatatattaagttgctgcacccaataatttgacatatctgttttcttgtgattctggtctctggatttccagactcttcaattatcttgattacttcattgcaggctcgcatgcatgatgagagcttacggtatgtcctgtcagaccaagctatagcttcccttgctgttagtgttccaagaggtccaactgaggtgtgttctgccatattagaaactgaaacaagcaattcaactgtgtatccttccttgccgccaccttcacctattgttgttgctcacgctgaagaacttcgctatctgattgaggacatcactgtcagcatggatgccatctttaaaaatttgcttgagaagtacaaagatccaagtagattatgtcgactatcagtttttaattataaccttgtatcacagctgagtttgaagcaaaaaaatatgttctcctttgcatcaagtggggagaagttgttgatggcaccaactaacaaaaaggcttcccgggaattattcattaaaaagttttcatgcaagtccccagtatatcacaattgcaggatctacgccagtgatggaagactgctttgctactgtgaccgtaaaaagttggaatggtttgtcacttagatgcactatttagtgtttataggtatgtaaaatcatggttatcttatcaaactgaccgactcttctttccaggtatattcaacgtaatttagcaaaattaatagaagataatcctccagcaattgtgctcttgtttgaacctaagggtcgcccagaggatgaggataatgacttctatattcagagcaagaaaaatatttgtgtcggatgtggagaaaagagccactatatcagatatagaattataccatcgtgctacaggatgcattttccagagcatctgaagagccatcgttcacatgatattgtacttctttgcgtagactgccatgaaattgctcattcagcagctgagaagtacaagaggcaaatagccaaagaatttggggtgccgctttttgtacagaagatattaaactcaggtgatataagtttaatagctggtgcatcattatctgaagataaatcaaatggaacaggtgtgtctcctttgcagctgaggactgctgcaatggcccttttaagacatggatccaatatgcctttgaagagatatgaagagctaatgcaggtgatgagaatcttcaagtattttgggcttcaccacagtttcaacattgtcttattgaaacttttcatgctagttatcatcaatatttcagtagaccaaatttgttcttataattagccttaaatctgtattgctgacctattcatttctttgcagattgtgaagtcatactatggtggtagggatgtgactcctgaagatcttgagatggcattacttgttggcatgagtcccaatgagcgaaggcgacattcaaagaaaaatggtttttcttaccgatcccaggctcaaaatgttattagaaaaagcaacagcaacggcattgttgagaataatgaacatgatccagaaaatggatatgctgagcaattttctaaaaatggagttgagaataacagtcatccagacattgatgagaataacaatcagctaggtattgatgaacataccagtcagccaggctctgggggtaataagatacatggtccaactctgagcaaagaaagcacaatctatccaccccgtatggctaatcccatttctgactctagcattgaggcagacaccgtgcagcaagcaagcttaggtggtaatcctgcaaacggtgatcttgacagggatccatgcggcagtaacaattctaaccaagccattccccaaaacggtgacaagaagatctccctgttaggtcatgggcatcacggtaaacaggtcgtggagcttttgctttccaacggtggcgaggaggccattaaccagttcagccaacggtggaggcaggtcttcgtagcttctcttcaccctcgttatttgccttcgggctggaatataaagcacaggtgaattcacctgtcgttttgctactcggtttgttctcacacattgataattgcgcatgtttgtggtgcaaaatcaccctggttatctatcaactatgtgtaggtagatttggaagattttttctgttagatgatttttttttcctggacaattatctttgaccctctggacatgcataccttgtgttctttgctgtgtagtggacggcgggattttggcgatttcagtgtctacaagccatcaaagaaacctcctgctgcagatcaatccgagactttagctgctgctgctgttgtaccctgaggttctagtttacattcgaagttacttccatttcattaaacctgaaccttgtacctgtactgtgcccttctatattcatgtactaccttgtttctacatctggaaagaactgggttacatctgtttgttccctctgccatgaagttttgtgctcaccaattctatatatgcagaagaattacagcaaaactggtaaaataaataaaatcatttccttgctaaaattgaaagcaacaagcacaagtactaaggctgtgtttagttccacgctaaaattggaagtttgaataaaaaagttggaagtttacgtgtgtagaaaagttttgatgtgatggaaaagttagaagtttaaagaaaaagttgggaactaaacttggctaacctaaccatcatgtctaaagcttgtgttaatttttatttttttgggtagtatctgatatctactgcaggatgccaggatatcctcagcacgatcctgagtcccagccagtgtgagttactagtatctcttttccttttatttttcatttttccaatatgctagtatttctttcagtttcagatgggccaagccaaaaaatgattcgagtgaaatggaagcagcagaagcagcagcacatccatccacatgatccgaccactgcctcctccaccactcaccccgccttgaaaaccccacctgccctacttccgcctggagagcctcggcccctcgcctcgcctcgcctcacctccacccaaacccaatccgaaatctttccctccactcgccgccgccgccgccgccgctgttgccggtgacccgccagccatgtcgtgctcgcacctctccaccgcctggtcctcctccgccctggccacccgccgccgctccgctcctagctgcggcagcagcggccgcctgcaggtggtgcggtgctcgctgcgtgagctgcggagccgcatcgactcggtgcgcaacacgcagaagatcacggaggcgatgaagctggtggcggcggccaaggtgcggcgggcgcaggaggcggtggtgtcctcccgccccttctcggaggcgctggtggaggtgctctacaacatgaaccaggagatccagacggaggacatcgacctccccctcacccgcatccgccccgtcaagaaggtcgccctcgtcgtcctcaccggcgagcgcggcctctgcggcagcttcaacaacaacgtcctcaagaaggccgagacccgcatcgaggagctcaagcagctcggcctcgagtacaccgtcgtcagcgtcggcaagaagggcaacgcctacttcatccgccgccccttcatccccaccgagcggacgctggaggtgaacggcatccccaccgtgaaggactcccagtccatctgcgacctcgtctactcgctgttcgtgtccgaggcggtggacaaggtggagctcctctactccaagttcgtctccctcgtccgctccgaccccatcatccagacgctgctccccatgtcgcccaagggggagatctgcgacatcaacggcgtgtgcgtggacgccaccgaggacgagctgttccggctcaccaccaaggaagggaagctgaccgtggagcgggagaaggtgaagatcgagacgcagcccttctcacccgtggtgcagttcgagcaggaccccgtccagatcctcgacgcgctcctcccgctctacctcaacagccagatcctccgcgcgctccaggagtcgctcgccagcgagctcgccgccaggatgagcgccatgagcagcgccaccgacaacgccatcgagctccggaagaacctctccatggtctacaaccgccagcgccaggccaagatcaccggcgagatcctcgagatcgtcgccggcgccgacgccctcgcctaaatccaatcaactcatttcttcatcccatccacctcgcttgagctgctgaggttgctgctgttatatatactactctattcttttttacttcctttttctctcttgctattgtgtctgtaatttctgtgatagcacgaaaaaaaaaaggaaaaaagatcgatccgactcgatcgatgtaattgttaatcgcgcgagatacacaagatttcaattcagcgatgccaaatgtacaagcagagtattctactactatcttgcaatctcctctacttgcctttctagattaggagggatatcgccgtatgcagtttcttccttttcttgtgtgattttggtgttgacgacacttcctttttttcctttccttttcttttctgtttgcttcactttcctcgagcaagcaaacctgtgatgctgcttcaccgtgcacaactgaaacagtgtcgtgtcgtctattagctgcaagttagcaactttgacgggcagcagttcacaggatcatcggagaagaacgacgccgccggcgtccagagcttcctcagcgagcttcattcccgactgacgccggacacatatgcccatcgtcgatctctcgttctgcttttctccgattggtctccgtattgcataaggagaaggtgcaaactgagccgccgtaagtcgtcgcccagcccctccggcgacacctccaccagttcggcttaggcttcgcgcgcgaatctgcgatttctaatcgggctcggattcagcaatgccgcgcatatagagaagaattcacgaggattagccattaatcacagcaagctaatcaccgacttcaactccaactccgtctccgacttgctaccatcaccgatttcaactcggactcggactcggactcggctgccgataaatccaagcccgccgccactctccgtctacgcattccccacaattccttccacccatcctcgcagcagcgctcgttcgtccatggcgcttccccaccactcgagtccccgctcctcgcgcccgatcagccaccgccgcagtgagctcgccgtcgaggccaaggggagagtagtctccaataaggcgtcaggagggtcgcccgtcaagaagatgtcatccgcgccgtcgccggcgcccgtgtccttcaagaagggcgacgaggtgcgcatccgcacgccggttgggaggctagggaccacgacgctgcgcctcgtcatgtggctcggcgcggtcgtcgtctccgacgctgatgccgacgacggccacctcgaggtcatctacaacggcaacttcccgcgcgacgaccccttccggaccgtgcgcgtcgccgtcaaggacgtcaagctgcccgcgccgcgcccggccccgaccctgaccccggcaaacatggcggccccgcggccgaccacggccgtcaagtcgctgccgcggctgaagatgtttgtgctggagaaggagcagctgcgggccaaatccgaggccttgttggcaccgtgatcagtgttcttcagtagtagcagtagctgcagaagtttgtaggaatcagaacatgtcttggtttgcatggaaggcaatgtgatcttgtaaattctcatagataggatgatttcttggcatgagaagaagaacatgcaatctgtgtgaactgtaatttctcattgattatgaatggaagatcgaggccaatatatgcatgcatgatgcatgttgatccaagtgttcggatcagaatcacaatccagctgcactctgattacatgtatgattacaatccacctgccgataactttgatcttatagctaggattcagcttccaattctttgcatgcctttggctttccttgcctttgttgatcaagagcctgggtatgcagcaaacaaagcatctagctggtaatgtcattttcaattttcattcagacgaaccgtttggctctcagcaacatcaacgaatcccaaaagaattagtagtagtctgttcacaaagaaatttagttgaggcggcaatgttattttgtttcactttgttgctccgaaaagatgtaaactgccgaactgcggattaagggactgtttggcacagccccagctctagctccacccctcctggagctggagctcagccaaacagtttcagctccaccaaaactgggagtggagttgggtggagctctctcacaaaatatactagagttgtgaagctgggttttggcagctccacaactccactccagactcaattcctggagttatatttaggagttggagctataccaaacagaccctaagtagtgggctttgggccaaatgcgtcagagatatttaactatttgctacttttaggtgtggcaattaacgatttaccactgggcccatatatcatagacccatgtggacccacatgtcattgagataggagtgacaaataattaattgccaaatctaaaaatgacaaatagcgtggtggacaagatttatgtgacatcggttttctcggctagtgggttcaagcaaacaagaccggaggacctacaaatggggctcctgatttttgttgtaaaaatcgggcattgtttcagtttgttaagaagaatgtttctccactggcttaacacatgtttcagactattaaaatgatgaaacacggttgaatcatagattgaaacatgtaacatcaaagttcaattactgaaacatcaacaaatccataaaaatcaaaggacaaaattgaaacaccataagaaatctcgctgtaacaatttgatccaacacaaagaaacatcgagatacatcggctgaaacataaaaaaaaatcgtgaagatatcagtcagagctggcttcctccctcacctccaatggcggcagtgcaggagtagaccgaaaaaatgacacccgtagacatccagcaagcggagacgagagctctggcgacaaccgtgacgaagaagacgaccatgctgctgttcacgaccggacaagaagctgccaggctgctccgtgtgagtcgaccaaccttcgcctctgcctccatgtaaacacccctcaatcacaatcaggcggcatgccttgttccatccttggacggatgagctgacgactgacgtccaacatggcgtcgatggtggtgaaggcggcggctgtggcatcaaacagagaaaacagcatcgaacgtgagagagagaaagggaggtgcgagaaagacagagggagtcacaggtggttgggaaatagcgcacggcattttcttctctccgtcaggcgcacgtacgataaatagcatttttgaaacaagaccaacagaaaaggatttctttttttttttcagaacaactaggaaacaagatatcgtctatacaacgggattagttatgagtgaaccattattttccatgatttagctatgctctgagtgcatgcgaaggtggcttaggcgtaacgtgaggaggtagaccgtggtaagctggttagaggctagaatagcacatcctgtgtactactatatactatactagtagttttttagtactactgtatactatacttttagtatacttttctaagtagtactagcttttctttggtacacctttttatgcagccaaagttcacactagagacctctaagagtaagtacaatagcaggctgtaagctagctataactatatatcgagaagaaaagagaagagagagaagaaagcgggctacagatttgtagccagctgcagcacggactctaagacgttgtgtgtgtatgagaggtaggaccgggtattaatggtgtagtatatttttataggtaactattatatgaatgggttattagattagctatagatgatttggagctaacatttggctatactattaaacttgctctaacacacttctagtatgtctttttatgcactagccactagagttaagagcttggccatatgtatagtactcctcatggctctcgttggcgcaaagacctgatacccacgaatcatacatgatacgcacaaggtatttgatgtctgtgtatcgagtccctaatacctaggtatcaggtaactggtacccagattattcgagttagtaccataggtactagacctgatactataggtatcgaggtacttggtcgctagatcgggatggtatccataagtaacagaccaggtactaggtatcgggtacctaaagtacttagtatctatatcggtcagataccagtaggtaccagacctggtactaggtatcgggtacctaaaatacttagtatctatatcggtcagataccagtaggtaccagacctggtactaggtatcgggtacctaaggtattaggtacttggtccctagatcgggttgatacctgtaggtaccaaacctgatattgggtattggatacctcgtactacattgggtattaggtacctaagtttgcactgatgttagcatcttaacaattgaaaccggtgtgttatgtcttcagcaagaagtcgtgcgctgacatgtggccccttgagagaacacgaagagatgtgggttgacacgtggggatttacgtgaagttgataaaataacacaagtggttggtcggtcaaatagtcatgctcatcaagtttggccgtaatctgaagaggcccaatataacgggaaagtgttttcatccatcgaggggagtttcatgcatgccacctaaatagtcatcaaaaaattttttaaaaaaattggtaacatatattaatatgagatatatcactctacaaacatgcaagtttaaattcaactcctataagttgtaataaaaataacaaatatagctatgaatgtacgataactatttttagtttaattttttacttttgttgtaacttgtagaagtttaatttggtctttatgtttgtggagtgatatatttcatattaatctatattgtctattgttttcaaattttttaatgactatttagatgatatgcaaacaacaaggagatatccactcgagagatgaaaatccacatcccaatataaccacatatgtattgtttcagactatcagtcgatctctcgttccatttttgggattggtattgcttatggcggcggtgcaacctgagccgccgttcccttaccttccggcgacaccttcagattgaacaatgccgcgcagagaatgaatagattgtccaagtagaataccggatcagttaatcacagccaagctaatggctgacttgaactcggacaccgacttcaattccaactcggactcggctggctataaatccatgcgcggccgcctcccttcgcattcaccacaattccttccgccaatcctctgcactcccagcagcgctctcgttcgtccatggcgcttcgccgctcgagtccccgctcgtcgcgcctgatcatccaccgccgcagtgagctcgccgtcaaggcgaaggggagactagtctccaagaagcggtcagtatcaggatcgtccgtcaacaagatgcccttcaagaggggcgacgaggtgcttgtccgcactccgttggggaggctaggcaccacggcgctgcgcctcgtcttgtggctcggcgcggtcgtcgtctccgacgccgatgccgacgacggccacctcaaggtcatctacaacggcaacttcccgcgcgacgaccccttacggaccgtgcgcgtcgccgtcaaggacgtcaagctgcccgcgccgcgcccggccccgaccccgaccccggcaaacatggcggccccgcggccgaacacggccggcaagtcgctgccgcggctgaagatgtttgtgctggagaaggagcagctgcgtgccaactccgaggccttgttggcattgtgatcagtagtagcagtaggtgcagaagcttgtaggaatcagaacatgtcttcctctgttcttggtttgcatggaaggcgatgtgatcttttgaattctcgtagattggatgatttgttcgcatgagaagaagaacatgcaatctgtgtgaacttcaatttgccattgattatgaatgaaagatcgaggtttcgcttctttatatttttttttaccaatatattttatccttgattttgttgatatccaagagttcagatcagaatcataatccagctgccctctgattacatgtatgattacaatccacgtgctcacaactttgatgttgtagctaggattcagctttcaattctttgcacgcctttggctttcctttccttcgttgagatcaagagcctgggtatgcagcaaacaaagcatctagctggtaatgtcatttctactctgacttggatatcagtttgtgccagtctctgtgtcaatttttttctttctgaaaggaaggcaagggccatatgtatttccttcactttccgttcagacgaaccgtttggctctcaacaacatcaacgaatcccaaaagaactagtggtagtctgttcactctgttcacaaagaaatttagttgaagcggcaacattattttgtttcacttcgttgctccgaagagctgtaaactgctgaactagtgggccttgggacagatgcgtcatgcgtggtggataagatttatatgacataacggttttctcggctagtgggttcaagcaaacaagaccaatagaaaaggatttttttttcttttttggaagagtaccctccgatggatatatgagccatccatatattttgatccaaagtagaagttgtggcagatttgggaaaaaaaagcatcatggtagataagtacatttgcatgtatttttgcatggacttcttagggcgttcacagtgcgccttcgtggtattcagccccaaacaactacatagacgaaatgcttacgtgaaggagagaatggagtggggaccatgttttcatggggttcccatgtccaatttgggtacccagagcctcgtcagttttttcagaaaaaattgggtgagtgagagcgtcgttagttccgtgcatggccggaaccagcagcaggaggaaagacaatggcgggctagtggcggagaggggaggttattgttggtgcaggtgaagagggtggggcggcggctgcaaagctcgtcactagcaccggcgaggaaccggtggctacgatgccgacgaggaagccacggtcaacctcgcatcgtgtccgaaaagccgccgcatccgacagttctagtgagcttgccgcgtcgtcatccccccctcccctcccccctgcccacaattcgctgccgtcgcccaaagccagatctgactggatctggccgctcagcccgacgccatcgctgctctgcccgccgccgttgccgccgcttggatcaccccgccgccgctccaaccgaggctccactcggtgccatctaaaccgatggggaaagtgagaaagaagaactgcgaggaaaaaggggaagggaagattgaaaaaagaagataatggtgaggcccactacaacgaacttacacttgagtatgtgaatttagagggctttggatctagttggcaactgaggctcaccaagtgcgatagctgcaccgtgaacacccttatgcagctggtggggccactggtcaccgatccgtaatacgaatatgattttcttggctaatcactggattatgtgtgcgagttagttggagagaaaataggcatgctcctgtggttatgtgcatttacgtacacggtttgcatgcataggaattaggtgagatctagcggcagcgagaggatcaatctaaacggcgagctcgccgacgatgccacacgatgggtagctagcaggcgatgatcatagccaatagaagcctattaatgtgcaggtcaatagaatggtctgttctgcacaaataaattaaattggaagtcgaatataatatggatcagtgatggcgatgtcctccgccgacgagcatgtgcgcggcgatgcctctctcgtctccgcctccatgctaggcgtgctcatgctcctcctctatggcgagcgtgtgcacagatcagccgccgctacgagctcgccgtggaggcggtgagatcgacggcgagctccactacctgccttgatgtgccagagatggagagaagggaaggcgcaaagaggagggggagaagaagaggattgggctgacagtgggccccaccatgtttatttgttgtggctgacagtgggtcccatgtatctttcttttgttttggttgaccagactgccacgtgtgcgtccacgtaggactgaaactacactgggtcgatctaggggggtaattcgtcccttttgtaagttcaaggttaaaaataaccggtattagagttcagggttaaaaatcagacgaccataactattgagggggtaattcgtactttttttcaaaatataactacaatgggggcctcaaagcccacaagccaaccccacttgcattcctatttgttggtggactagcgtcccccacttcttaactttctactcatggtttactcaattcattttttaattatttatggattattgaaacggaatatttcttccacacttcaaacaatatactttctttaaaaaaaacctttttttctactgcattgctaatatcatttgttttaagctatttgttaaccttgtttcttaaaatatttgatttgtcaatgaagcggataattcactcgttccgtttttctccgattgatgtttgcatatggagacggtgcaaactgagccgccgtacgtcgtctccctgcccctccggcgacacctccaccagttcggcttaggcttcgagaaatctgcgatttcaacaatgccgcgtgtatatatagagcagaattcacaaggattagccattaatcacagcaagctaatcaccgagttcaactccaactccgtctccgacgtgctacgtagctagcttcattggtttcgactcggagtcggactcggctgccgataaatcctagcgctgcatccaccacaattccttccaccccatcctcgcagagtcgcagtcgcagctagcagcgctcgtagccgtcgtccatggcgcttccccgccgctcgagtccccgctcctcgcgcccgatcatccaccgcgccgtcgacgccaaggggaagaagccgtcaggacgatcgccggtcaacgagatgtccttcaagaagggcgacgaggtgcgcgtccgcacgccgttggggaggctaggcacaacgacgctgcgcctcgtcatgtggctcggcgcggtcgtcgtctccgacgccgacgccgccgacgacaacggacacctcgaggtcatctacaacggcaacttcccgcgcgacgaccccttccgtgccgtgcgcgtcgccgtcaaggacgtcaagctgcaggggccacgcccggccccgaccccggcaaacatggcggccccgcggccgaccacggccggcaagtcgctgccgcggctgaagatgcagatgctggagaaggagcagctgcgggccaactccgaggcgttcttggcattgtgatcagtgttattcagtaggtgcagaagcttgtaggattcagacatgtcttcctctgtttatttggtgtcatggaaggcacagtgatctcgtatttgtgataggatggtttactggaaatcttcgcaagagaacgtgtaatctgtgaagtgtatttatcattgattatgaatgaaagatcaagatttttttatatatacacgagcgatctgtttcgtctattatctcatgatcaatgcaatactatctttgcctctctctcttgttggtattgtttgagacaaatattaagtttacaatcacaatgctttactctactgctaaagaaaaacaatcctcattcgtttgtttctctaaagataactttaggtgtcaaaatcaccactacatataaggctatctctaatgtgcaacaaaaagtgatttaccaccttatctctttaagcgtgtgttaacattataacgatgctattataacaaatttatgctaaaaactatctaaacattgtcgagccggataactgtccaaacacgtgctaggtaatggtaaatacacgtagatatagaccctctttgtttaggcttataagccaacttataagtcgaaaagtctaagcctaaacaaacaagcagtttttccgtttggcttttttgaagccataagccactctaacactattaagccaaaagctaggttggagaagcttttttggcttgtgtgaggtagatgtatgactcaactactaaacttaggacattaaatccaccggcttataaatcatataagccaataagctgacttaaaagtctagaccaataaacctaagcctaaataaagagggccataatactaaagagctttgaaacacaactgctaattggcagccaatccatgctatgccctcacatgtgaatcaagcagcagaacatccattttatcgacgcttgagatatggcagatgatttgccctcgaacattatctgaccatggcccatcaatgacttggacactgacaatagtggccatgcaagcgaaccgacctgcaaacttacttacgtgtcaaataagtggttacccatggatttccacatcgtaacctagattgccgcatctagaaatgcaagtggatcgatccataaactcatttataatctatgggttacccattaattttgcctataaatagatttgtggattagactgcttacatccctagtggcctcgaatatagctcgcatcttagctcaagcttgcaacgcttgctggagcaacgtttgtgcatccttgcagggcgtgtcgcgtgatcgtagatcatgttgtgtgttatgacactcatgatgaaggtttcgtcctcagactctgttttctccctttatgaaatccattagcacgactgcacaagacaggcgcgttaacgatttggatctctgcaagcatcacaagcaattgatcaataaattaattacctatattaacatcacaactcaagtaattgatcaataacataaattgaccaatccatgttaaatgtataattactctacacttagcgcactaaggtcaggaacatataatgtttttcacaggcttatatttgtacagattatagaagtgccaaattgttcatttagtttgtatcaatgagttctttacaaagaagagcatcataggaaatacacaattatgtatactaagaatgttaaaaatgaaaactgcaaatatagaaaggacctcgatgaaaagtttttttttctagggaagggtatttttttacccgaactctacatccaacaattatgttaaaaactgcaaatataggacctaggacctcgatgaatagtttttttttttttgagaagggtattttttacgtgaactcttcatccaactagacatatgcaatattttagttctcaaataacccaatctaaaatcgctcctatgaagatttgaacttagaaccttttagctctcaaataacccaatctaaaattcgctcctatggagatttgaacttagaaccttgggtgctactcaggtcactgcaaccactaggcaaatataggacattgatgaatagtttaggcacataaaaactataaatgtagcaatgacaccctgctctcacgacaacaaaaaaaagttcaacgaatatgtgcttacgtcacctagacaggctgcaaaacaaagtgatagaccgtcatacttgtcatcgaagaacattgtaaatattgattagatgttatgcaggtatcttgattcttgcatagttctggacgcaacaggtacccaatctcttgtggatttttttccagttaggcaaaatataagggaaatctattaacttattaaaggaactaggaatgtagcccgcgcgaatgcgtgggcatgcgttttgtacactatgtttgacacagttataagagcaaaatatcaaccgtagaacatctacaaccatagaacatctaccatgatttcttcgtaaattgttttcgtcgacattaattgctttttaattttctaacctattagttttatattatagcagtatcatatttacctgatatttataagcaattatttataatcttcttcatcatttgaaaagaaggtagacttattttctttagaaaacatgtcaacgaaatgtaagtgtaaggtaaactaaggtatttttctttttttttcaattgcatatgtattattatggtttattcgatgatgaattgggtgagacatgaagctccactaaatatatgggtttatatagcctaatatgattgatgtagtttgagagttggtccatctatgaacatttcatgtagagtgggtaagaggttccacgcaagctaacgtgcatacgataacgatgaaatataattgtacaataatatttttgaaatgtgacataccatgaatacacgcttgtgtttccttttataagatagttctaacggttagaaataatggttctaccggttttaaagatataggagtactccaagaatgtagcttaaaaattatggttgttttaatatccaatattattgtgaaatgaacgtagctcaaccggttaggtttcttgtgatggaacttgctcgagttcagacttaacaaattctttcagtagtaggcaatgtacccgtcgatatcaagacgtacgtggtgatttcgtcaatctcaaaatatatcagcctagtctcttcaaaatactcaaaggggtatttgcatgtgtgcgttcacagaagtgattgtgcacgcgttgtgagcgcccgcgtttgtactttgtttaaaaaaaacatcaaacattatttattgtttctcttttatttaatagataaaacaatagggaggggatggcagtgttgtgtacatgtgatggtgaggaggtggagattatatttttctaacttttttaaataatttaagtgaaagccaatgatgaggtgtttcattttttctaagaatttctaaggtttttccctttttataggacgtgacacacggtgactcaagattttttcttaaaaaatagatttaatacatcaaattaaattgatttttcttataatttaattacaagatctaatctattggtttattatagatctcgattacatgcatatacttccgtatatgatgtagtattatattttatttttttatattatacaaaatcctatttttagaccgtagtttttccacggatactaagtacgcttttttttctttatagtacgcttttttttttgctttattttatcgtacatagatgtctattttttttcttccagctaacagtaggtagctttatatgttttttttaaaaagggagtagctatatttatggcgccatatttttcaccaaaaaatagtcggtatgtatttacattgtaattccctgaattacatatgcaattttagtgtatttataatataagtcccaaaattacatatgtaaatcctaaatttatatactaattacatatataagtggagtgtaactacagtgtaaattcgtataaatatataaataattattagttttacgatggaggtgaagtgctaatgagtttagagcttgattaggtgcagttggttctttcgcataagctgtaagatggggtgcagccttcaagtgcttgaaacgaatattactggacgatctcacggttaaaacattcgactgtacacaaatttagcaataccgttttttaattgtacttccctagggacatttattttttctttccttttcccagccaccggttgcatatgttttttaaggggaaaaactatcacctttttaataatagatctaatctaatggtgtaaataaacaggtccaccaatttaagtgaaaatcaacggtgagattagacagtgccacgtggcagcctaggagcgtttgtaggagtcccacgtggcggcttgagagcgtttgtaggaagttttatggacttttatttagtatataatagatagatagaaaaaggagtctccacgttcgctctcacatactagaaattctcatattaatcggagaaaaagaaaaacagagtccatatagaaatacaatttagaaatagttgaaattcggaattaaaaaaataaggaatattggaagaggtgattagagtctatatagaaatacaatttataaataactgaaattcagaattaaaattaaaaaaagaattaaaattttaaaaaaggaaatattggaagagaagagtagagtccatatagaaatacaatttataaataactgaaatttaaaattaaaaataaggaatattagaagtagagtatagagtctatatcgaaatgcaattaagaaataattgaaattcggaattaaaaataagggatattagaagtagagtataaagttcatatagaaatttaaaactaactaaaattcagaataaacataataaaa

SEQ ID NO: 33570 - DNA, 3006 bp, Oryza sativa
tacgtatggagatggtggaagctgagccgccgtcatctccttgtccaccgctggcggcggcggcggcgacacacacctagcttcgcgttcccgcctgcttggcgccattcgggattgcatgatggtggcgaggcgtaacggacgtctccgattccgagtcgagctcggattgaagaattgtgtctgacagccacgctttgcttccttcacagacttcaattcgaactcggactcggctgccgataaatccaagcgcgccgcccccaccacaattccttccacccatcatcgcagcagctctcggcgctcgtccatggcgcttccccgccgctcgagtccccgctcctcgcgcccgatcatccaccgccgcactgagctcgccgtcgaggcgcaggggagagtagtctccaagaagccgtcaggatcaggatcgcccatcaacaagatgtccttcaagaagggcgacgaggtgcgcgtccgcacgccggtggggaggctagggaccacggcgctgcgcctcgtcatgtggctcggcgcggtcgtcgtctccgacgccgacgacggacacctcgaggtcatctacaacggcaacttcccgcgcgacgaccccttccggaccgtgcgcgtcgccgtcaaggacgtcaagctgccggcgccgcgcccggccccgaccccggcaaacattgcggccccgcggccgaacaaggccggcaagaatctgccgcggctgaagatgtttgtgctggagaaggagcagctgcgtgccaaatccgaggcctttttggcatcgtgatcagtgttcttcagtaggtgcagtagctgcagaagctcgtataaatcagaacatgtcttggttttgcatggaaggcaatgtggtcttgtaaattctcatagataggatgatttcttggcatgagaagaagaacatgcaatctgttggaactgtaatttctcattgattatgaatgaaagatcgaggtttctcttcttgtttcatttttttttaccaatatatgcatgcatgatgcatgttatccttggttttgttgatccaagtgtttggatcagaatcacaatccagctgccctctgattacatgtatgattacaatccacctgctgataactttgatcttatagctaggattcagcttccaattctttgaatgcctttggctttccttgcctttgttgatcaagagagcctggatatgcagcaaacaaagcatctagctggtaatgtcattttcacttttcgttcagacgaaccgtttggctctcaacaacgtcaacgaatcccaaaagaattagtagtagtctgttcacaaagaaatttagttgaggcggcaatgttattttgtttccctttgttgctccgaagagatgtaaactgccgaactgtggattaagtagtgggctttgggccaaatacgtcatgcgtggtggacaggatttatgtgacatcggttttctcggctagtgggttcaagcaaacaaggccggaggacctagaaatggggctccctatttttgttgtaaaaatcgggcattgtttcagttttttaagaagaatgtttcaccactggtttaacacatgtttcagactattaaaatgatgaaacatgattgaatcatggattgaaacatgaaacatcaaagttcaattactaaaacaccaacaaatccataaaaatcaaaagacaaaattgaaacaccataagaaatctcgctgtaacaatttgatccaatcacaaagaaatatcgagatacatcggctaaaacataaaaaaaatcatgaaaatatcaatcagatctggcttcctccctctcctccaatggctgcagtgcaggagtagaccgaaaaaacgacacccgtagacatccagcaagtggagacgagagctctggcgacaaccgcggtgaagaagacgaccattgccgccgttcacggccggacaggaagctgccaggttgctccgtgtgagtcgaccaaccttcgcctctgcctccatgtaaacacccctcaatcacagtcaggcggcatgccttgttccatccttggacggatgagctgatgtccaacatggtgtcgatggtggcggcggcagctgtggcatcaagcagagaaaacatcgtcgaacgtgagagagagaaagggaggtgcgagaaagacagagtcacgggtggttgggaaatagcgcccgatattttcttctctccgtcgggcgcacgataaatagcatttttgaaacaagaccaacagaaaaggttttttttttcttttttgaaaaactaggaaacaagataccgtctatacaatgggataagttatatatgagtgaaccgttattttccatgatttagatatgttctaagtgcatgcgaaggtgggctaggcgtaacgtgaggaggcagaccgtggtaagctggttagaggctagagtagcatatactgtatactattatactagtttgacggagcgtggggctcctcaccgggagaccgcgcaggcccccctttgccggttcggccgggggccctgggtgaggttctaagctccttgtctgtgtgtggaaggttcgcgagaatggaaaaagcacaagacacggccgatgtatacaggttcgggccgctgagaagcgtaataccctactcctgtgttttggtggatctgtgtatgaagaagctacaaagtgcgagccagcccccgatccttctgggatcgtttttcttctctccctcttttttctaagtgggcaaggtactccttttatatctcaaggggataccacatgccccctctctccctccaacttgacttctcttcattaatggacggagatttgtatggctgctgtccgaatgaccttctgatgggacggcccatacctacctccacttcctccggaagcaggcgcgacgtgggaaaatggctatctgctgacgacatgaccataaacagaccggtcacaaatcggtcattcttgtccaccacgtgtcagttta

SEQ ID NO: 33571 - DNA, 52093 bp, Oryza sativa
ccccccccccccccccgagggggttaggccacgtgggtgatcgtgtcttcctcaagtctctaagtcatgatactcccagtcccatgtcaccgacagcagcccccggcgttatgccagggcgatcgccctcctcgagggaagcggtcgggcgtgacgccacttcctaaggcctggtgacaggtggggccggtctaaaaatcgggacaagccggttcgtttttcctggagatatgatgatggcgcttcggtcagcgagcgtaattaacgcgcgcatgagatgttccatctcgactgccacagccgcatatccacctcatgcaccgcaaacgggcgaatgggattagtggaagcgtgggtgcgagaaacgagggtgcaagatagtgggcgcgagaaacgaggagccgggcacagcgttggcaagggtataaagtcgccgaggaagagatttgcttccttcctctcgccattattccccttgtcttcgccgcttgcgccctaactccttgtttcctgtgccctaccttcgcctcacgcgctcgctctcaaacatctcttcttccggcgtcatggcacggggctccgctccgcttgacggtagcgtgctgccgccttcccgcatcgtgagcgagagacaggccgggctgccgcgccgcttcatgccggaatctgccaccggccgggagatagtctcgctgggcgagggatgcccggcgccacgctacccggggcggtccgtcttcttcctcccttttgctatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtggttcttcaccgtacagccggtgtcgccgccgtcggtggttggtggttgctacttccagccgcgggggccggtgctgaaccgctacattccctgcgtcctccgcaagaagtgggatgactggaagagcgactggttctacacccccctcgccgacgaagcgcgcctccgacttccgagccagcctccagcgcaggcctccaactggcgggcgccggtagatctgggagatggctacgacgccgtcctcaaccgcttggcgggcctgcgatcccaggggctcacaggggccatggtgttcggcgactatcttcgtcgccggatcgcgccactccagcggcgcgcccggggcgcctgggagtacaccgggtccgaggactgtatgaggacccaccagggggtcagatgggactgggctcctgaggacttcaagatagtggtccaacgggtgctgaatctcagctccgtggaggcatccctcattcctcaaggagtcctccccctctgcagcgatccagaccgcgcctccatcctgaccatcatgcaggcggtcggggcgtcggaggagcaggctcctcgaggccacgatggcgcgggcgggagccgcaggggggaacaatctaccccgggagggggtcgtgcttctgggccccgcgacgggggcccggggagcggccgccctgccaacgcccgggggaagaggaagcaggaagaaacccctcccccatctcctccccgagggggcggggcggcgcgtgccagcagcaggcgcccggagggggccacgccgacgtcgcagcccgagggggagcggaagaagaaacggcttcgcaagatgggggggacagaaccatcccggggaaacctcatttcccctccaaggtggtcgtttaaccgaccccctcgcaggttcgtcccactcccatcgtggccgtattcattctctcaacgcgagttttcactcatccatcttgtttgtcttctggtctttcttctgtttcagcgagatcccgtcgcgtccctcccgccattccaagtctggccagtctgaggccgaggacccggcgaccacagaggctcggaggcgggaatctgaccggcgagaagccgcggatcgcctacgggaagccgaggaggccgcccaggtggccgtccgagctcgccaagctgaagaagccgctcgggaggaggccagacttcgccaggccgaggcggcaatgacttccgaggcagctcgcgacgagtccgcgggcgcatcgcttgggcccactccctcgggcgacgctcaggacaagccaggtccgggggacatccctgagtccggcacgtccatcggcgggccgagccgcgcggcatcctcaccgaggcggctcttccccacgccttccgttgctccactgagcgcagaaccccttctgcaggccttggccgtcgcaaacaccacggtgttggacgggttaagtgcccaggtggaggccctgcaggcagagcgggcggagcttgacgccgcatgggcgcgtgtcgaagaggggcgacactcggtggaggccatggtggaggtgggccgcaaggcacaccgccggcacgtctcagagctcgaagcccgtcggaaggtgctgggggagatcgccaaggaggtggaagaggagcggggggctgccctcatcgccaccaccatgatgaacgaggcgcaggacaccctccgccttcaatacgggagctgggaggcggagctagggaaaaagctcgacgccgcccggggggtccttgacgctgccgctgcccgagaacggcgggcggcggagaccgaggtggcatcccggcggcgcgaagaagcccttgaggcccgtgccatggcgctggaagagcgtgcctgcgccgtggagagggacctggcggatcgcgaggccgccgttgctattcgggaggtcacactggcggtgcacgaagccgcctgtgccgaagaagagtccgcgctccgcctccgcgaggacgcgctcaccgagcgggagtgagctctcgaggaggccgaggccgcggcgcaacggctggcggacagcctgtccctccgcgaggctgcgcaagaggaacaagcgcgtcgcaatctggaaagtgcccgcgccgagagggccgcactgaaccagcgggccgctgagctcgaggcgcgggagaaggagctggacgcgagggcgcgcagcggcggggcggccgcgggcgaaagcgacttaaccgcccgcctcgcagctgccgaacacaccatcgccgatctgcagggcgcgctagactcgtccgccggggaggtcgaagccctccgcttggcaggcgaggtagggcccgacatgcttcgggacgccgtctcccgtctagaccgcgccggccggcaggtgggcctctggggcgggcggactgcgaagtacgccgccaaccagggggcctcgcccagcgcctatcggagatagccgggactctccaacggctccccgaggagctcgagaggacgattaagtcatcctcgagggacctcgcccgaggagcggtggagctcgtactggcgagttaccaagccagggatcccgacttctccccatggacggcgctggacgagttccctcccgggaccgaggacggcgcgcgcgcgcaggtccgggacgtcgccgaccatatcgtccacagcttcgagggttcggcccctcggctcgcgttcgccctcaactccgacgaggaggacgatgacggcggagtgggcgacggtggcgacgaggctggcgacccgggtgcatcggagtgagcccccaggcccccgccaatctttaaatagcttcttcttttcttcttccgaggccttcgggcccccttcttatatagactaatttaatctgcaatcaaataaagaggaaattttttgtgtcaattctatttgttgtgtgtataagacgaggatgtctgtgccgcggtccttttgtgtcttggcttgaacaagggctcgtgcccaggtcctagtcctcaaatggctcgggtcggggctagtgcctggggagatccacatgtcgagactggccaggccgggagcgtggtgaccgagggttatgggtgacccgattgtgggtttttgccgattcccccccggagttcaccacgccccggggcacggctcggttctgggccccgtttggcgattttagccgacccgagcccccgagggcaggattgaacacgagtgacctatttcaagtcaagatccttcaaaaggaaacaacagcacagatacaacctttaggaaattgaaaatgcttttattgaagagagaatccattatatgccactgactttgtcacacatctacgatttaccatcgactttgtcacattctacaatataccatcgacttttgcttaacttctacgatttaccatcgccgtccaattagcctccgttagtactgtacaattttatccaaatgaccgaaatacccctaaaacaaaaacttccaaaatttggataaaaaattcaaaatatcatattataaacataagattgtaaacatccaaaatttggccaacaacttaaaatcttatatttcagaatttttatccaaattttgaatgtttttgtcccaggggttttttggtcattttgacaaatttgtacagtaccaacggagactaaccggacggcgatggtaaattgtagaagttaagcaaaagtcgatggcatattgtagaacgtgataaagtcagtggcaaatcatagacatgtgacaaagtcagtggcatataatggattctctctttattgaaatacagatataagagaaataagaatatgcatatgtggtagcccccggccaaccctgcacgcccgaggggggtgcggggttggcccgaggccgaaacctgacacccgatccccctttaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcataggacgaggtcgtcgacgcagagtgatcgggcccggacgtggcgctgatggtagcgccgcaggctctgctggtagcgcgcagctcggagggccgcgcgccgccttcgctcttccaagtagtcgaggtcatctctgcgaagctgatcttgatcagcctcgcagtacatggtggcccgaggggacctcagggtgagctcggatgggagaaccgcttccgcgccgtagacgaggaagaaaggcgtttccccggttgctcggcttggcgtggttcggttcgcccagagcaccgctggcaactcctcgatccacgaatcgccgtgcttcttgaggatgttgaaagtcttggttttaaggcctctgaggatttccgcattggcgcgctccacttggccgttgcttctggggtgggcaggtgaggcgaagcagagcttgatgcccatgtcttcgcagtaatcgccgaaaagttcactagtgaattgggtgccgttatccgtaataatacggttaggcactccaaaccgggctgtgatgcccttaatgaatttaagtgcggagtgcttatcgatcttgacgaccggataagcctcgggccacttagtgaacttgtcaatcgcgacatacagatactcaaacccgcccggggcccgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgttggccaatagaaaccttgacgaaaggctttgccaaccaaggtgcgtgaggcggagtgggctccgcattcgccttcatggatatcggcaagaagctcgacgccttgttcccgaggaatgcacttcaggaggattccgttagccgcgcgccgatagagggtcccttctaccagcacgtagcgtttggagatgcgctggacgcgttcactcccttcgcggtccttgggtagagtcttatctgtgaggtatgcttggatctcagcgatccaagcaatcaatctcagggagctgggagcgctcccctcgggtcccgaggcctggactccgacgggcatcgggggcctgtcaggcgcgtccgtctcccctaaggggtcgggtcgcgccgacggctgggcaagcctttcttcaaaggcgcccagtggggtctgggctcgcgaggaagcgagccgtgagagttcgtcggcaaccgtgttaccccgtctgggcacgtgccgaagctctatcccgtcaaaatggcgctccatacgccgtacttggcgcacgtaagcgtccatctgcgggtcagagcaccggtactccttacagacctggttaacgaccagctgggagtcgcctaacaccaggaggcggcggatccccagtccagctgccaccctgagtcccgcaaggagtccctcgtactctgccatattattggtcgcccgaaagtcaaggcgaaccaaatatctgaggacgtctccgctcggcgaggtcaacgtgacccccgcaccggcgccctgaagagacagggagccgtcgaactgcatcacccagtgggtggtgtgaggcggctgcgaggggcccgagctggcctcggggactgagacgggctcgggagctggggtccactctgccacaaaatcggcgagggcctggctcttgatagcgtggcgtggttcaaagtgcaaatcaaactcagaaagttcgattgcccatttcaccacccgtccagtaccctctcgattatgcaagatttggccgagggggtaagacgtaaccaccgtgacccgatgcgcctggaaataatggcgcaatttcctcgaagccatcagaatagcgtaaagcatcttctgggcctgagggtatcgggtcttggcgtcccggagggcctcactaacaaagtagacgggccgctgcacctttcggtggggccgatcctcttcgctaggggccacatccctggggcgctctttgtccgagcggcctcgcggggtgcactcgtcttctgtgccgacgacctcggggtcggaggatgacaggggcggccttcccacagtggcctcggggccgtcctgggggtcggggcctcctggcgtcgtcggacaagcgggcaaagggccaactccggtcgtcaggggccttaggccaccgttcggctcgggggcctcttctccctgctctctcccgggtcgagtcggcacagggttagcctcggggtcagagggcgataggtgcggccttcccgcagtggccctcgggccttcctgggggtcgggggcacctggcaccgtctgacaagcgggcagagggcctgctccggtcgtcgggggccttgggccaccgttcggctcgggggcctctcctccctgctctctcccgggccaagccagcacagggtgggggtgcgcggaatgaggattgtcctcatcgcgctccacaaccaacgccgcactaaccacttgcggggtcgccgctaagtagagtagcaagggttcatttggctccggggcgaccagaactgggggagagctgagatatgccttcaactgagtgagggcacgttcagcttcctccgtccaaataaacggcccggagcgtttgaggagcttaaataagggtagcgccttctctcccagcctcgatatgaaccgacttagggcggccatgcaaccggtgacgcattgcacatccctaagcttgctgggggggcgcatccgctctatagctcgtatcttctcggggttggcctcgatgcctcgggcagagaccaaaaacccgagaagcttgcccgcaggtacaccgaacacgcacttatcggggttcagttttatgcgggcggagcggagactctcaaaagtctccgctagatccaagagtaaggtctcttggttgcgcgtctttacaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaatgcagttttttcctcatcctccctagccatgcggatctgatggtaaccagagtatgcatctaggaaacacaaaaggtcgcaccccgctgtggagtcgacaatctgatctatgcgaggcagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctgccgccgtactttctgccgaaccggccttgcgcccgaccttacggcgagacggtgctcaatcacctccctggggaccccgggcatatccgccggtctccatgcgaagacgtcagcgtttgcccgcaggaaggagacgagcgcgtcttcctatttgccatccagaagaccaccgattcgtgtggtcttggatgggccgtcgcccagggcaacctccttgaccgggacctcgtcgcatgtgactatccgctgcctcggggcggcgggggcggaggtgccaagcctctcgtcgcctccctcgggcttggacgcggcggtgaggtggtccgcgcgccgctccatacaagcaagcgcgactttgaggtcgccatggacagagatggggccaccggggcccggcatcttcatctggaggtaggcgtagtggactgccgccatgaacttcaccaacgcgggcctccctaggaccgcgttgtagggcagactgaggtccgccacatcaaagttcacccgctccgtgcggaagttggcggatccacctaaggtgaccgggaggtcgatatgacctagcggccaagtgtgaggcggcgtcacaccgataatcggctgggacggccggagcaccatccccggggccttgatagcgtcaaaggctgcgggggaaaggatgttgagggctgctcccccatcaatgaggacacgccccagcttcacgttgcaaacagtgggggaaaccaccattgcgatctgtcctccctgggcaacgcacggtgggtggtcggtctggtcgaaggtgagggcaacctccgaccaccgcgcccggcgcgtcgcctcatgagtaggggccgcggccagaagctctcgcttcatggccttgaggctccgacgagaaaagtgagcacacgctcccccatcgagagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctgcctcctctcctcctcccacttcctcgtccgctcagccaaacttttgactgcgcggcagtccgcgaggtcgtgaagggaggtgttgtggacggtgcaccacttgccggttgggcactccctgctgggagcgctggcctccttctttttgtcgctcgcaggcctcccctttcgggtggcccgcggagcgccctcgacggcgaggacatgaccctcgtcgtcggaatgggctgacctcttcttcctcctcctgtcacgccgccctgtccgagcagcggatccgggggcggccgaagctgccacaccggaaccggaggggttccaggtccatgcctcttccttacgagccactcggtccgcgagctgaaaaagctccgcggtagtctggggctctttggaggcgatcttttcgagcatgcggttgtgccgcacaccccccctgaacgcgtagatcacctcgtgtgcagggatgcatggtatggtgttgcggacttgacagaaccgctgaatgtatgagcgaagtgactcatcatcccttcgctgtactgcgtgcaagtccgcttcctcacctgggcgcggatatgtgccttgaaagttcatggtgaactgttggcataaatcctcccaagagtggacggacgcgggtggcaagttcattagccaaccccgtgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaaccgggggcacggagggctgatccccgtgtccgtgtcgaggtgacactccggacgaggaggcgccctccgttgcgtgggcagcacgtcggccattacgccggtgctcgatactgatgcgggcatctggccccctacgcagatcttcccgggtcggaggcgctgacgaaggagtggcggccgaatggcgagcaaccgccgccgctcgccgcgccctccgccttgacgacacggagccggtggtagcagctccagaggtcttggtggcggtggaccgctcaccagcacctaggcgctgtcgtgccgtcatgaccaagttggccacgtcgtccagccaacgttgggctggagactccaggtcagggacaatgggcgggtgacgtaggagcgcgcccgcagcttggagcgcgccctggggcgtgctgccgtcgccgtagacgaggaggcgacgctccccatctcgctgcccttctccatcacccgtggatgtcgaagtcacggatccttcgaccctctcgagcgcctcctcccggctaggactttggcgtggagggggcggtggagtacgagctcgacggcgtgggttcggctccccgtcgtcaccgctaacactcggagagaggttgtgcgcctttgcttgttcggccattgggctgaacaggaaaagcttggcgcacacgaaagaatgcgagagcttagaaaaacacacgcagaggcccctacctggcgcgccagatgacggagcgtggggctcctcaccgggagaccgcgcaggcccccctttgccggttcggccgggggccctgggtgaggttctaagctccttgtctgtgtgtggaaggttcgcgagaatggaaaaagcacaagacacgggcgatgtatacaggttcgggccgctgagaagcgtaataccctactcctgtgttttggtggatctgtgtatgaagaagctacaaagtgcgagccagcccccgatccttctgggatcgtttttcttctctccctcttttttctaagtgggcaaggtcctccttttatatctcaaggggataccacatgccccctctctccctccaacttgacttctcttcattaatggacggagatttgtatggctgctgtccgaatgaccttctgatgggacggcccatacctacctccacttccgccggaagcaggcgcgacgtgggaaaatggctgtctgctgacgacatgaccattgacagaccggtcacaaatcggtcattcttgtccaccacgtgtcagtttaacaatctgcatgttcgcccttcttcatacaacatcttgcctgtaatggttaggatgaagcctggcatatatctgaccggaaccaacgtgccatctccaggagctaacacgccggctccggctagggacgagtgcttggaggctctcgtcctgacgggatggggcgaggcatgcgtcagaccgcctgtcgccacctaacccacgatctgaccggtctgtgactggtcactgaccggataaacgagcgcgctacactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgagacgggagcggtccgacccctcggggagacaaagagaagggcggccgcatcaccctcgggcccgaccccccccgagggggttaggccacgtgggtgatcgtgtctgcctcaagtctataagtcatgatactcccggtcccatgtcaccgacatagtttttttagtaccgctgtataccacacttttctaagtagtactggcttttcattggtacacctttttatgcatccaaagttcacactagagacctgctctaagagcaagtacaatagcaggctataagccagctataaccacatatcgagaagaaaagagaagagagaaaagaaagcgggttacagatttgtaggcagctgcaacacggaccccaagccgttgtgtgtgtataagaggtaggacagtgtattaatggtgtagtatatttttataggtaactattgcatgaatgagttattagattagctatagatgatttggagctaatatttggctatactattaaacttgctctaacactcttctagtatgtctttttatgcactagagttaagagcttgggcatatgtatagtattcctcatggctctcgttggctcgaagaccttatacccacaaatcatacatgatacgtgcagtgtatttaatgtctatgtatcgagtccttgatacctagatattaggtaactggtacctagattattcgagttagtaccataggtactagacctgatagtataggtatcggggtacttggtccctagatcaggatggtatccataagtaccagacctggtactaggtatcaggtacctaaataccatgtacttagtatctacatcggtcagataccagtaggtaccagacctggtactaggtatcgggtacctaaggtattaggtacttggtccctagatcgggttgatacctataggtacctgatctgatattgggtattgtgtagctcttaccaggtatcaggtacccaaatctattaacttattaaaggaatagaaaaaagagcctccatattcactctcatggcctagaaattcctacattaattggagaaaaagaaaacagaatccatatagaaatacaatttaaaatagttaaaattcagaattaaaaaataaggaatattgggagaggagactagagtccatatagaaatacaattgagaaacaatagaaattcggaattaaaaataaagaataatagtagtagggtatagagtccatatagaaatacaattaagaaataatagaacttcggaactaaaaataaggaatattagaagtagagtagagagtacatataagaatttaaaactaactaaaatttggaataaacataataaatttaaaagtagagtttagagtttttataaaaatacaatttacaaataactaaattcgaaataaaaaaaacatgggaagaagagtctaaagtcaatataagaatacaatttagaattaacttaaattcgaaattaaaaattagggaatattgaaaaataagtttagagtccacatagaaatacaattagaaataataaaaatttagaattaaaagtaaatcatattggaagaagagcctagagtccatataggaatataatttacaaataactaaaatttgatattaaaaataattaataaataacttgtatataaaatacaatataaatattatacattactagtttcgtaaaggtagtacaaaatttaaaattatgttgtcattttaatatatttgaataatacattgagaaaacatattgtcatggttatggataccacatacctaatagtaggtgactaaatctcggcaggacccaccacataccatgtcctatacggaaacaactttcggatataggaggagttccgataaggaaagacaaccagagttctacatgaaaacgacaagtactactcggattgtagccatattggtttccctagttctacttggacaagaggacacctatgggtataaatacaagccccctaggaggacagggggacacccaccatgagacaatcaacacccaacacaatcgacatagaagcctacatacgccaagacacaccgccggatatcgacttcagggataaacacggctagtaccctacggtgtctccggatactgtcaggagagacgaaagcgctaaccgggcacgaattcgaggtggaaggctaccctgttgtcgactacgagtcagatcatcagaccgacatgttgacaacagttagataggctaccccaaacattgtactggtgtggttatcataaataagagcaataccagcttcggccaacaagatgtagggttattacctgacaactcatgggcccaaacctgtataaaaatcctcgtctccatctcttttacctcagtctcgcatatatcctagcaccgacgatccccatactgtccaaataccgtagtcgagacatcaaacgtcgacagtggcgcgccaggtagggggattttggtgcttcagggtttcgacgagatgagtttaagagatggattctccgataacatgctactcgacaacttcggttatggggagatctaatccgaccggagtatgtcgtccaataagatcggaaccatcattgtcaaattttcgatccggcgagatcgatcaatcttcatcaagacgtagccaccatggaggacggcaaatcggtattgccgcccgcgcgacttcggcccagatcgaacacggtgccgattcccaccaaccaaaatcgctcaacgcaggctgcacatgattcatccgagaacaagtgccgctgtgtcactgacgtgtcgtgtcatgcctagacacgtgtatgcatgtgacaggttacactgctctacgaccaaaccaacaagatacgtcaaagtctaccgcatgcacatatatatatcttctgtagatagtatatcgggcatgcaaatcaaggtatttagtggattaatttactaagttaatctactaatttcgtagatatattcggcatatatctacaaaggtacgcaatattttatatgcaatttatcgtacctattcagatcatacaacattgtcatatcagtaatttattatgtttacctagagcatattttttatacaatatcaattatgcgagtgtttccgatgttaaatcaactacggtttaacgctggcggctcgctctgttttcttctgtataaatcatgcttgtttacggtttacataatgcctgatacttacatctgctcgttatatcctgataattctagaagatccatgcagcttttcgaatacatactcgatattatctgctatatatcttgccttctagaaaatatttttcaggaacaattgagcactcgggtaggttatggtcgagtacactccattatcgagaacattctcgacaaatgcggagttatcgcacccaacctaccaacgaagaccgatgacctatctcatagcaccggccatcgctggactactcgagaaaaggttgttaacagataattcctggcgaacgccgttggcttgatcacccgacatgattgagaacggacatccggatataccacgagttgggtgtgtgagtcatgctggccacatgagacgcacatgtaataaaccaactcgagcagttccattggtgctcgagagataattctactcgctcgctggttctcgcaccaagacgtagcaatttctcacaccacagcttccattggtgctcgagagataattctactcgctcgctggttctcgcaccaggacgtagcaatctctcacaccacagcttccattggtgctcgagagataattctactcgctcgctggttctcgaaccggtacgtagcaatctctcgtgccttaacttcagatagttgaggtatgactacggcggcgtagcggtcctcgcaccatgacttcagatggtcgaggtatgactatggcggcgcggcggtcctcgcaccataacttcagatgattgaggaacagctacaactggtcttcgaccggcagcgtagcgatcctcgtgccacgactccaaatgattgagagacacctactcaccggttctcaaccagttgatcgtagtgatctctcgtacatttgcttctagtggtcgagttacgactactgcctggtcctcgaccaacgatgtagcgtctctcccactacttccacttcaagtggtcgagttacgactactgtctagtcctcgaccagcgacgtaccgtttctcccaccacttccacttcaagtggtcgagttacgactactgcctggtcctcgaccagcgacatagcgtttctcccaccacttccacttcaagtggtcgagttacgactactgccttgtcctcgaccagcgatgtagcgtctctcccactacttccacttcaagtggtcgagttacgactactgcctggtcctcgaccagcgatgtaccgtttctcccaccacttttcactttaagtagtcgagttacgactactgcctggtcctcgaccagcgacgtagcgtttctcccactactttcactttaagtgctcgagttacgactactgcctggtcctcgactagcgacgtagcgtttctcccactattttccgctttacgtggtcgagttacgactactacctagtcctcaactagcggtgtagtgatttctcctactacctctacttcaacaaagttgatagcaggtatgcaatatcgccaagtgttttacccagagatcccttaccacgacgacacctagagttgaaacctatcctactgtccctttacgccgtcttgacaaggcctccgaggaacctaagggatcttcggctggggacgcctagaaccgataaggccttgtcggatcctgtagagaagaaagaccatgtaagatctggtcgtgtaagagttctcgccgtgcgtattaaccaagccgtgtaatcggaaattaactttccaacttcacggctgggggataggatcagttcttgttcaactaaggcaggtcaagggtccaagagccttatcctccgagaacgattctccgacgataaggctgggggctagggagagtgtatgactctacaaactgactgatcgaagtcggtaagagagaagacgcttatacacaaaacattggtcggtaaaattaattcattttttccatacatattataacatgtcaccctttgagcgttcgctcgggggctatttctatttgatattcttttctgagtattgatttcaggaaaattctattcgacattgacgaagactccatgtctccatggttctacaccaagatcgactgaggcgagtacgacaaatgtcgacaaggctccgtcgcagactctacgccttctcgatcactcgagaatggttgctggatctcgacaaggaatacggaatgaagaaatggtgtacccgccgagataaaatttcttgacttcgatccaaattctcgattacagcaagacgggagacttagtcgtacgctctgtactttttcggtcgacatcagagattgacttagacaaaccctttcggtgcccgcacgaggctgacaaaggaagtctaacgttatctctgaactcaccgaaaatggtcacgtgagctcgataacagttcctccgaagtctgcagttgagaatatgaactcgttcatttgcatcgaagtcgggggttactgtcatagttatggataccacatacttaatagtagttgactaaatctcggcaggacctaccacataccatatcctatacagaaacaactttcggatataggaggagttccgataaggaaagacaaccagagttctacatggaaacgacaagtactactcggattgtaggcatattggtttccctagttctacttggacaaggggacacctatgggtataaatacaagcccccctaggaggacagggggacacccaccatgagacaatcaacacccaacacaatcgacatagaagccacaacatagaagcctacatacgccaagacacgccgccggatatcgactttagggataaacacggctagtatcctacggtgtctccggatactgtcaggaaagacgaaagcgctatctctgatctcgccgggcacggattcgaggtggaaggctaccctgttgtcgactacgagtcagatcgtcagactgacatgtcgacaacagttagataggctaccccaaacattgtactggtgtggttatcataaataagagcaataccgacttcggccaacaggatgtagggttattacctgacaactcaggggcccgaacttgtataaaaatcctcgtctccatctcttttacctcagtctcgcatatatcctagcaccgacgatccccatactgtccaaataccgtagtagagacatcaaacgtcgacacatatatgttattatatgacagaaaatataatgatgctaaccgcgcaatctgcgcgggccaccatgctagtttacactgatgttagcatcttaacaattgaaactggtgtgttgtgtcttcagcaagacgacgtgcgctgacatgtggccccttgagagaacacgaagagatgtggattgacatgtggatcctcacgtggggatttacgtgaagttgataaaataacacaagtgattggttgatcaaatagtcacgctcatcaagtttgaccgtaatctgaagaggcccaatataatgggaaagtgatttcatccatcacggggatattccctcgtttcgtgcatgccacctaaatagtcaccaaaaaatttgaaaaaaaaattggtaacatagaataatatgagatatatcactctacaaatatgcatgtttaaattaacttctataagttataataaaaataaaaaatatagctgcaaatgtatgataactatttttagtttaatttattacttttgttgcaacttgtagaagttgaatttggtcttgtatatttgtggagtaatatatttcatattaatctatgttgtcaattgtttttaaatttttaatgactacttagatgacatgcaaacaaggacatatccctcgagagatcacattccaatataaccacatatgtattgttttagactatcagtcgatctctcgtaccattttcgggattggtattgcttacgacggcggtgcaaactgagccgccgttcccttaccttccggcgacaccttcagattgaacaatgccgcgcagagattgtccaagtagaatactggatcagttaatcacagccaagctaatagccgacttgaactcggacaccgacttcaattccaactcggactcggctggctataaatccatgcgcggccgcctccgcattcaccagcaattccttccgccaatcctcgcactcccagcagcgctctcgtcgtcaatggcgcttccccgccgctcgagtcacatctcctcgcgcccgatcatccactgccgcagtgagctcgccgtcgaggcgaaggggagagtagtctccaagaagccgtccggatcaggatcgcccatcaacaagatgtcctccttcaagaagggcgacgaggtgcgcgtccgcacgtcgttggggaggctagggaccacggcactgcgcctcgtcatgtggctcggcgcggtcgtcgtctccgacgcagacgccgacgacggacacctggaggtcatctacaacggcaacttcccgcgcgacgaccccttccagaccgtgcgcgtcgccgtcaaggacgtcaagctgccggcgcggcgcccggccccgaccccggcaaacatggcggccccgcggccgaacaaggccggcaagtcgctgccgcggctgaagatgtttatgctggagaaggagctgctgcgggccaaccccgaggccttgttggcatcgtgatcagtgttcttcagtagtagcagtaggtgcagaagctcgtatgaatcagaacatttcttcctctgttcttggtttgcatggaaggcaatgtgatcttgtaaaatgtaaattctcgtagataggatgatttcttggcatgagaagaaggacatgcaatctgtcaactgtaatttcacattgattatgaatgaaagatcgaggtttctcttcttgtttcatttttttaccaatatatgcatgcatgatgcgtgttatccttggttttgttgatccaagtgttcagatcagaatcacaatccagctgccctctgattacacgtatgattacaatccacctgctgacaactttgatcttgtagctaggattcagcttccaattctttgcacgcctttggctttcctttcctttgttgagaaccagggtatgcagcaaacaaggcatctagctggtaatgtcatttctattctgaattggatagtggtttgtgctagtctctgtgccatttttcttttctgaaaggaaggcaagggccatatgtatttccctcactttggctctcaagaacatcaacgaatcccaaaagaacctagacatagctaggcttagtcttttttttgacggcaagagtatttggtcctcttgttttttaaaatactagcaaaatatctatgcgttgtaacgggtgaaatcgctcataaatcatgtcttttaccaacttaatcttataaggatagctttaaaagtcatgatgttcgttttggaggactaaatattgtttacattaattaaaaaaatattttgacatgataggttctgattataatgggatagattgatgaataaactcagaggcacataagttattttcacagaaggatcaacatgtaaattcgtatgtgatccaaatatatttgagaatcagtttgatctatgttttgtcccagttgtcttggtagcttcatcccaattaggggtgaaaacggtcacggaaattcccgatcgatcgagcgccgtttccgtatatttaaaatttctaaacatgaaaacaaaacctatatacaagttgtagatatagatgcgatctacacttttcatttgagcttatctatggtattaaatatagattataagtttggatgatagtagtcttaaaagaatagcatttgtttcgaagacaaacagtattcttttcccctctttcccaactcacttctctcattttccacgcgcacacttttcaaactactaagcggtgcattttttgtgaaagttttttatatgaaagttgttttaaaaaaatcatattaatctattttttaagttttttaggctaactagaaaggtagcccgcgcagatgcgcgggcaatttatttattgtttacaaatataattggtaaattttgagataagtctaatggtttagaaaatttgaagattttttttcctaagagagtaggaaaggaaagaggagatgaggagagtacgtccgtaacagggaagggtgtggagaaggtgggtgcatatactttttttattcgatctaatagttaaagtattggacccaccaatttaaaagaaaatcaatggatagattttagagtgtcacttggcttaatccaaacaaattaaaattaaatcaggtctacttgaaaaaacacaactaaattgttttactttttcgcaattacgtagtacatttatgaagtgatatttgacatcctaaaatatgatatgaaattatttaaaattatcataacattaattattatatatttgcccaagatgtggtgatgtatttagaaccgcaatataaattttataagacacaaatattttatttaattaaagaaatacaaagggatcataaattgattatataatttaaaataatttaaaagatgaatgtttagagataattgatttgatattttttatttatattatagatctagtttatatttgcacatatttgtggagtaatatatttttatatggtaaaaagttatattttaaagaccattgattttgttctgacggtaatatgtattatcgattttaatttatttttaatcttaaattgttggtttaattatgtatagagaaacagttagattagatataatatgtatagcttaaaataactaataactgtggttgtttttttttatcataactactaaaaaaatatagatcagtggagggggcagaaagtgttgtgcgtgtctaatggtgggggtgaggtggaggggactttgtttttctattttttttctaaatcatttaggtcaaaaaccaattatcatgtattttgttttttagaaaatcttttttaattttaaagtcatcataatgacttaaaaaggtaatattagatacaccgatttaagctggacgatttaactggagattgcttggttcgaattagctacgtaatatcacggtaaagccatgtaaactgatttaattagctgtatatgttatattaccgttaatttccttccacaaatcatgtataataactaatttaattagctatgtataatcttcgtgttaatctcctagctcccatatatatacacatacatacatacatacatacatacatatacatatatatatatatatatatatatatatatatatatatatatatatatatatatatatatatatatatatatatatatatgccgtgcatataataaatatagctatgattagtagtaatacaatatgacagctaattaatctcaacttctaacaaccatagatactaatcatccttccggcaaaccatacatacgtacgggagaaaggtagatctaattcattggtataaaataatgggtccaccaatttaagtgaaaatcaatgacagataaagatctaatctaacaatgtaaaataatgggtccacaatttaagtgaaaatcgacagtgaaattatattgtgccatatggcggcctaggagcatttgtaggagcgccatgtgacggcttgaaagcgtttgtagaaagtttaatggacttttagtatataatagatagatacttaattaatctcactataatcgcgtgctttgttttctgtgtcgggaggcaaggttggtaaccatgcttccgaaagtgtttgtaggtgagatgtaaggtgactttgtttgaagcaaaaagtcttgagtttgaatttttcttagtacgtgtatatgaatatgggcacatgtatcatgtgatttgtgggaacgagagtatgaattttgcttagcacgtgtatatgaatatgggcacatttatcatctgatttgtgggaaagagtgtgtatatgaatatgggcacatgtatcatctgatttgtggggaagagtataatggtatagatgcctaaaaaatacatcaaatatttttttttgatttttttagcacctgcaaaaataaaaaacgggtgcacccctacacctataatactggttcaagaaccgacggtaattggtgccggaacctatatatgatataaacttttagaaccggcacattagtgcacggaagcaaggaatacatgtccctccgttaatatctcgttccatttatcggattggtatttcttatggaggcggtgtgctggtgcaaaccgagccgccgtcgtctctttgccctccggcgaggcggcgatacctccatcagttcgcgttcccgtagtagcgatctcagatttcgtatcggtctcgattgatcaatgccgcgtagagcagaatcggattcagaaggattaaccgttaatcacagcctctaagcaccgacttcaactcgaactccgtctccgacttgcttccttcaccgatttcaactcggactccgcttcggctgccgataaatcctagcgcgccgcccctcaccgtctccgcattcaccacaattccttccacccatcctcgcagcagcgctagctcgtcgtccatggcgcttccccgtcgctcgagtccccgctcctcgcgcccgatcatccaccgcgccgtcgacgccaaggggagagtagtctccaagaagccatcagcagggtcgcccgtcaagaagatgtcatccgcgccgtcgacggcgacgcccgtgtccttcaagaagggcgacgaggtgcgcgtccgcacgccggtggggaggctaggcaccacggcgctgcgcctcgtcatgtggctcggcgcggtcgtcgtctccgactccgacgccgacgacggacacctcgaggtcatctacaacggcaacttcccgcgcgacgacccattccggaccgtgcgcgtcgccgtaaaggacgtcaagctgcccgcgccgcgcccggccccgaccccggctaacatggcggccccgcggccgaccacggccggcaagaatctgccgcggctgaagatgtttgtgctggagaaggagcagctgcgggccaaatccgaggccctctttgcatcgtgatcagtgttcttcagttgtagcagtagctgcagaagcttgtaggaatcagacatgtatctgttttcctctgtttttttgacagtgattgtcgtaggtaggattattttttcgagttcttcgcatgagaagaagaacatgtaatcatcatcgattatgaataaaatatcaagaattcatttatacgctggctcgttctctctgttatctcaagaacaataaatgcatgctatccttatttgttgacgagccaaatgttcgatcacaatcatcaattcatcataactcataaggtggccaaagtgaaattaactctaatctgaaagaagatataagctgattgcacacttcacaccagtcctatgcactggcctatcctggaacggtggtgatcaaacttatcgacactcgatacagttatcctgcagtcctacgggagtatgtcaagaaaccaagacggtttggtgtttgacacttcaaaacttatctttcaaatctcgttttccatttataccacctttactggataggccagtgcataggactggtgtgaagtgtgcagtgaattagtgaaatcagcttagatcttctttcagaattcagatcatcactgttgactgttttaaacccagaaacattctggtatgggcgtatgacaatcacggtatttgcaaatttgcaggtagcaaccagaagaagaaacagacgacaagcgatatttgttctagctaagcaaagcatgaaaactccagcatatacgagattgtgccccataggcatgatgatctgatctcaaaacacatgagaatacataggagatacggtctctactcaacgcctcagcaatcaacatcacaacaatagtcagctaaacggttgcaactccttgatgtgctccaaggagaggatcagaggactgcctcaatggtaacctagtaacctaccaatatacggccacatcaaacttgctaaatttttcttttcagggaaggatcgaggagttaattctcgataatcacagcaacagtctatgatcacgcttcctgccatgctcaaagaaaaggatctcaggacggagattggcctgactgtaccggtcgattaatcctttccaggattcagcttgctgcaaggagacgaacatttacgaatgatgatgatatcgaataattctgaaaccaaattcgagtgaaaactcaagtgcgaaagctgacaaggaattgcctggactgtcgtgctgtcatgtatgagccaccttgcctcgtcacgaccaaagcagaggtattgccgcccctcatcatcatagcataccttccattaaaaacagtttgaaaattacccagatgctatcgcgcgaataccagaaacagaactccatactagtcaggcaagcattacttacgataatctgacactacaattgcctattgccaagcaactgatccgaccaaagaagataataaaatatactcctacaatgatctaccaacatgatagcaaagcaatatttgaactgatttgacaggtataacataaatgacaaatcatacataaataaaccccagactagtacattagatactattcatatacaaaaacacactgaaactgagaagaaaaggtaaagaacgaatcaacctcaggaacaaatgaattcactttttttttcacagatatgcataaaaaggaaagacttctctcagcacgtactgcagaaaccagagtgtacatgctttctgattgcagaccttcgtagatatgactaatgtccaactccgctgctaggctgatcaatactttatgcatgttaatatggtttcccttgttgtctggccatctcaaaactgtgacaaaacagcaatagaagagaaactaaatcagcttgcgtgcatccccagtcccgaccaaggttcgagtcctctatctcagatctagcgtcttcttctcaatgacaccagatgcctaggtcctcctagatattctcgatttaggctctaagtttaggtcgattgatgaaagatgcagacatctgtccccattactcagcttaaaagtccccttatatttcttttcttcatattaataagaagaatgcttgttgtctcctaggttttccctaattgccagaaatgaataaatgatgtatgtgcacagaaggctggcatcaaattgtcgcaggaaaggtcgtggcgattaattattttatgttgcagccattacaatagcagatatggtgtaatttatattcaacgattgatatggttttcaggataaaattaaagatcagatgatacactgatccaatgatttctttcgcttatctttcctttctcctacatagaagaaacatatgcacacaattacattgaaatgttagtcgagaaggcggtacctatcatgaaaaaatgtggtggataccataggtatcgggtaatcctatgcccacagccaccattcctgaagtcacaaactgactgcttgtctacagctttcaagagttcactgaaagactccaactgaataagtaaaaggatgttagtttgctaattaaagaaaagatggacatataaaaaaggaaatatcaaaaggatacactgtgcagtatgtaccgtagttccttcaacagaacccaaattaatactgtggaagaatgtagacttggttttcatggggacctcattcacacagttgcatttcttctcaataatgtgcaacccaaaaagattgtgtgctaggcatatacaacccagaaggctgggcactattgctgtttgtggcaccaaagattcacccttgaactcaaaatgcaaaggagtttgtgccacgtgcagcctctcaaggattgattcaacaactctatacgcagaaatgtttccagcctaaaaaaaaagaagaaccagtgatcttattggctacgagagcaacatgctcaaactttccttatgttacagtcaatatgtacactcggaagtgcaagtgggacagaacttggtttgcagtcaagactcagacaatataaaggtgactcttgtatcaaattagtaaaataagcatttgcagaattgaacctgcaacattctatcacgacaaacagggttttaatttaatttactttaaagaacggcaaattgttgcacaaaatggccaaaagattagcacagattcatatggatcacagaaatgtttatttctgtaaacatttctgtttcttttaataaattgtattatctctcaaattaaaagcctaaaatactaaacaatcactttgtgtattagagcaatgagccaatgagaatgtaaaacaagcttgggagtagtacgtaccaataagtagtttaagaagaatgccattttgcctatcttttccaatagtgcccaaacagaactatggagtcaaaactcaaaacttgaaagatatcaggcagctatccagttcattttatatgaaatatttataacttatccattataaatatgagtaaactacatggagacggttagcatttgataagaaagttgctctctggtattttccctgaggtcacaggctgcatttagataggtgggaaacagaaagcgaacgcaaaccttttcatcaatcacaaaacttctcaaagaatcaaccatgaatatcgctgaactaggtaggtcacatgttttgcactggtcccaagaacggaagatacgcaacaagatagcgcgatatactctggctttaacatcaggggatatacatggtatctcccagagatcaccgcagaatctccttatgtgccacaaagactgcagttatgcagagagaatcagagataggaaaactaatagctaaatattaaaaactgaaggatccaaacacacgttacccggagaatggcatccaaaggaacctgtggtttatgacaattttgtggatgagcaagtaaagcatcctctaggggatcattaaccaattttgcctgtcaacaatgaatatcatacacaaataaagttacagacatgctttacaagttcagttcgtgctgaaagaaccatactgacccaaaggcaagcctttgcaataggtgaaataaccgcaaggcaatcaacttgacaagttttcagaagactttccttccagtaatccacctcagcatcaattaatagcatctcaactcgtgcagagccaatctgcaaatacagcaactaggatttaagcattgatcaacgagattaaaatgatggtataaaattagagagcaaacataattttttttttaaaaaaaggaaaacatacccaagaatcaaaataagtcttgatgtcaatatctctctcaaaaatggccttaggaaggaaataaacacctccttgtattccttttagctcttcccatgagctgaatttcagcttcgctttacccaatgctcgacttatgttgttaagaatgtcaggtccatcaacaaaacattctctccacatgctgaaacacaattccatgggatcctcaagcaaaggttcagataatagacaggcaaaaagtcgatctgcctggctagaaccatcagtttctcttgatgcaatcttctcacaatcaaaagatagtgtgcctgtctcttgggaccaggtaatcccaacaagcgaatcttgctggctctcttgttcgccattgcgacgcttatgatggttgcagcctctatgggtatgcacaacgagcgaatcttgctggctctcttgttcatcattgtgatgcttctgatgttcccaacctctctgggtctgcacaacgagcttaagcggcttgagcaattcacacagttcctgaaggtgtgtggaactcaactgtccaatcccacaagacccacacatggatactaccaaaggtgctactggcctgacccggttcattatgaacttgtgcatgatgtacagaaggttgagagaaacgacttccaaatcaatgagctcaaagacgatttccttaacctcgcgcaagatctttgtcctccctgccaaatcatctccatcggttggctcccatctccatgatctgagaagctccctctcactgtcagatattctttcgggtactaatgacagaaattctttgcccacaatatgttcctcatcgatgtgactcttgaaagccgcgaattccacgtagatcattccggagcagaaagggcaagaccaacccttcttgacgaacacctcagcatcggaaagcatacttgtcatatccatcaaccctcgtgagcggcagtacgacttcatctctccaaaactcaccttgaggagcgcttgccgctcctcctcgctcatgcggctccagcgatcgccggcgattccgaggtcgacggtttccggcggccactccggcgtggacgcgggctccggtgaagccgcggcttgccccttgcccttctcgatcctcgcacgctgcccgcggatcgtctctcggccgtgggctttcctgtactcgagatcgaaggggttgtcgtgatgatcggcggaggagtagcggttgctcacgaaggtgtagtgcaacgccgggtcggtgggctccgccacgcggagggcgcggtcacgcacctccgctgcctcgtcaaacaaatccatggagatgagcgcgtcgatgagcagcgaggcgatgtgggggcagcgcggggcgagcaccgccgccagctcgagctgaaccctctcctgctgccgactgttgcgctgaaggtagcagcgcgcgaggatggcgcgggcgagtggcgaccacgggtacctgccgacgagcgccgtcgcgagcgagagcccgtgcgcgtgcccttgctcgccctcctccgtcagcgcgacgatcgccctgcccgcctcctcgcggaaggcggcgtcgcagtccgaccagtcccggttgctcttgctccccacgacaacacccgccatgggatgggaggagctgcggcttcggcctcagcctcagacgtgctgctgctgcggcggcgtcgtcctcgtcgtcgtggacgtggtcacggcgcgaggcagaaggcggcggattgggtcccgccgcaccgctccccggtcggccgagggggaggggcgcgaggtgttcgacgaaatgccgaagcggagaacgaaggtggcggcggaggcggaggatgaggaggcgggtggggagcaagtctctctcggcggagcaggagggggaggagacatgtagccggcgacggcgaggcggttgctgaggtttcggccgttggggtggggcccaactgccagagagacggagagagagagaggcccgttgtggtggggcccacgacacccgctagcgaagggatgcggtgtcggcggcggcgcttccattctagaagcttctggagacagccctgacctgcgccgacgagaggaagggagggaagagctatggaatggaagagaaagggaagaaggggaagaaggggaggggggaactttgagattcgtgcgaaagccatcagaatgaatgggtagtttgtgatcggcccaactagtttttgataggaataagttcacttcaggtctttgtccaacaacaatactggatcgattttgctatcgatcactcgcgtgatttttttgctgacatttcatgtttttttttttgcagcctcgtcagccggcgcgtcggacaccagcacatcggccttcgtgtctagctagcccaagcgcacacgataatggatattggagaagcacggtgacacggtggcctctaaccgtcgagccagccgctggtagcacggccaacactgatcggcgagagacaccgtccctctcgtcgttgtcgtgaaatataaaattacagtcctatataactaaacttgtatttgtaaatttagttgatttgacatgtaagtgcactgtaattttaataaaaataatatgtaagtaaatatgtacttattattttctttaaaatataaaattacagtcttatataactaaaattacatatataaatttagttgatatgacatgtaagtgcactgtaattatgataaaattgttgtgtaagtaaatttgtattagttattttattttgtagtccggtggatgcaaatccaagggaagaaaaaatctggttgattttttttaaaaaatcacccgagtgatgcataggcggtccaacatacatagtggaacgacttccaggaaaagcaataatacaaaggatcatgcttacttttcctaagcacttggaggcaactcaaagcttctggccagattattgcaaaacgaaattaaaatcagaacatttttctttgttcagtacggcaaagcatgaaactaaactaaaccagtccacgcactgaatgagaggtgaaagcaagacgatactattatttcttttaagtaagaaaagaactaaacccatcctaattaatttactatcgcctggaagctcttcgacaacactattatatatcgtgaggcgcagttgaatctccagttctccaccctttggattgtccttggcacctttttcatcatcttggtaagactgtatatatacttcaggtgtgccgatattcaggcctggtaagcacacaaaatcatgcaaagacgattaagtgaaactaatcaaagtttttatatcttctgagtaagaaaaggacattatattcttgtcacattaatatcttcttgaactgaatctatgtcttaatacttgcctcagcagtcagcaacattaccatcctcggaacataataccttttcaggtggatcatcgcgcagtttatcctgttaaacatgagtaaaacaaccatgaaaagaatgataattaagcaaatatataggtggtatattctaaacaaattaaataaagtcctatgtataacataaaaactatagtagtagactaacccataggtaatccttcatggctggtaagctgactttacgataatcacaagtacagacttccacgagctttttcttcaaatcatcaacttcggcatccaattgcaagatatcgatatctaatttagcctgcagcacattttacagccaaagcttagaagattggttcagtataatatcaaaggtacaaacactatctgaaaattaacagaaattcagggtacagtaaaatgaacctttttagtaaaataactttcatgcgtattcatctctattaagccacgttttagctcgattttctctaccaatgcagctgcacttgcaatcaacttttcgaggacacgagctccgttatcaagacaggcttgcctcatgttgttccatgaagtaaccgggtcttgtctccgaggtctagatagccagcgaaagagagcatcttgattgctagaagaaccatcgataatgatccttaacgcatcctcttcgacaactatggaaggaacgaaatcctcacgaacgaccgagacataatcaaaatgatcattactatcctgcagcttggcatcatcatcaccagcactcaatccaggcatagtcgatcgttcaaaaaatccaggcacaatcatatccagagtgagtgccaggacgtgaagcgccacaggatgcagcttagcgatgctgcagataggattctggggaggatcagcagaagcagctgctgctgctgtttcttcttcaatcgtccatctgttggtgaattcgaccaggttatccaagagatcgacggacagtgccttgcgatccttgatgcgctggagcgtgctcttgatcttgctcaagaacctctcgctctcatcatcatcatcgtcatcggatggcgctaatttaaccgcgcaagatccgatcagctctgcctcttgttcttcagatattctctccggcacgagcagcggcgatcgttggagatccgggaagaactcgtctgcgacgtgcgactggaagcactccgcggtgaggaaaaccatcatgcattgcggatcggggcacatccagcagatccaatctccggtgtccttggccaagtccaccgcgcaggcgagggcgctcatctgagcgtccgatagtggctctcctgtgtagtgcgctttcagatcctcgacgctcaccgtcaggaagccgcggcggcgctcgtcgtcgtcggcggcggcggcggcggccatggcgacggccttcgacgaggcctggaggaggaggaaccggagccgctccttggcgagcatccgcgcctctttggtcggcggcggctccagctgcaggtgcagaagctcctccgccgccgccgccgccgtgtcgtcggcgagggcgagggcgagcgcgcgctcgcactcccgcgccgcgagatcgaaccgctccatggcggcgtacgccctggcgagcgcgagggcggcgtcgaggtcggccggggcgaggtccctggcgtggaggagagggccgagctgccgccacctggcgtcgtcgtcgcggctgtccatgttactcgtgagaggaggaggacgcggcgtttacgtgaggagaaggcggcggcccgcggctgcgttgttgttatataggagtaataatcgggttgcaatggtgtccctaacaagttctctaattacatgtaaacccttcaaaatttcagttgcaattttatccctaacacaaatattcgtcacgccaaacagctcgctgagtttccctttttttagtttctcgctcagttccacttccacttttttttttgggggggggggggggttggctaagggataaaaatattatccatgtctcactgtctcacgccgcccctatgtgccctcaccttacgggataaataagttatatatatacttcccgtgtatgataaaaatatcaaactgatagatggtatgtttcgtaaaaaaaaattattttgttaaaatattaaataaattatttttgaaatgtatactagttaatagttaatcaatcatgtgctaattgctctttgatttttattgctagaataagcttacctcgtttggctgtgtttgtttattgttaggaactctttttctctgacacgtaaaatatagtggtagattagcatatgattaattatgtattagattaaaaaattaaataaatagattaatacaattgtttaaaaacatctttctttttttaaaagggtgcatttaatggtttagtaagtatgcgtgtgaaaaatgggcgtttgggactgggggaggtgctttatttctttaaacagcgataagcttcttgcagtactccctccatccgacaaaaactccattttcagttttggatacactctcttatttcaaagttttctatgattagtaattttattgttattagatgataaaaaataaataatactttatgtttgactaacttttttaaaaaatatatatatatttttaaaataagacgaacggtcaaatgttggatatataaacctagaaatgaagactttgtgggatgcaggggtagttctgtggtgccttttttttttcacaatttaagacaacgttgatcacgacgatttgtggatgcagtgagcctattgcatcgaattttttttttaaaaggaaatattgcatcgaatttctccggacatatatttgcctgttttctccgagatactatatgaacaatccttttgaaacgagatctttggcaaagggtgccggaacacctctgttttctgtgacagccgccaggtgttcgatgtcatccccggcttcctcggcgagcttctctccacgacagatgcgagaacacgcattccgtcgctagctcgttccatttttgcgactagttctgcaaatggagatggtggaaactgagccgccggtccgccgtcatctccttgcccttcgcgtaaacggagatctccgatttcgagtcgagttcggattgaagctaggaatgtctcgcagagcatagatgcgtataatcggattattcatcagaagtattctgcttggcatccacacgctttgcttccttcaacgatttcaattcgaactcggactcggctgccgataaatccaagcgcgccgcccctcgccgtctccgcattcaccacaattccttccacccatcctcgcagcagagctcgttcgtccatggcgcttccccgccgctcgagtccccgctcctcgcgcccgatcatccaccgcgccgtcgacgccaaggggaagaagccgtcaggaggatcgccgcctgtcaacaagatgtccttcaagaagggcgacgaggtgcgcgtccgcacgtcgttggggaggctagggaccacgacgctgcgcctcgtcatgtggctcggcgcggtcgtcgtctccgacgccgacgacgacggacacctcgaggtcatctacaatggcaacttcccgcgcgacgatcccttccggaccgtgcgcgtcgccgtcaaggacgtcaagcttccggcgccgcgcccggccccgaccccggcaaacatggcggcccagcggccgaccacggccgggaagtcgctgccgcggctgaagatgcagatgctggagaaggagcagctgcgggccaactccgaggcgttcttggcattgtgattagtgttcttcagtaggtgcagaagcttgtaggattcagacattgtcttcctctgttctttgggtgccaatgtcatcgaaggcacagtgatcttgtaatgtcttagataggatggtttattggaattcttcgcaagaagaacgtgtaatctgtgaagtgtatttatcattgattatgaatgaaagatcaagattctttttttatacacgagtgatgtgtttcgtctattatctcatgaccaatgcaatactatccttgtcttttttttgtttgagcaaagtgttaagattaaaatcacaatgatttaccctactgataaagaaaaacaatcattcatttgtttctctaaagataactttaggtgtaaaaatcaccactacatataaggccatctccaatgtgcaacaaaaagtgatttaccatcggtctctatatctctttaagtgcgtgttaacattataacgatgctattataacaaaaaaattagacaaagttaatatagcaaaattatgctagaaactatctaaacatggttgagctggatgatgtccaaacacgtgctagctaatggtaaatacatgtagatactactattcattattcaagagagctttgaaatacaactgccctcaaacatgatctagccatgacccatcaacgacttggacactgacaagagtggatctgcagtggagaccaaaggagacgatggtcaaataagccagatctaggctggtgcattttttttttgttttctgatgttttaatcgatgtatctatcatgtttttggggttggatccaaatgttgcactgcggtagtctgatcttatttcatctgttcttgcatattggttgaatctcaatgttccatttgtgaggatgagttgttcaatcttgatccaactatgtttcagcatttaatagattgaaacattttttatttagtggtgaaacattttttactaggagtgaaacaacgcttgatttttaggaaaagatcgggcgtccgatttgtagtcaccttcatatacttcccaaatcattcttgagataaaacgattatccacatcccaaatccgaaataaagaaaataaaagcaattactcccattgccgaatagtagtaatttagggtgtgattggttgggtggatgtgactggataaggatggtcattcaattttttttgtgtgtttggttcatatacaagatgagtgaccaaatcaggtggatgaaccgatgaaaccatccatgttttagcctggatgatgtggcctatgtcgattggttgtgatgggtttaattttttgttagcaaactataaataatttttcctactaaactatttatttaatttctaattcgattacatcattatattcattataattatatctttaaagcaagattttatatgttatattatgatggaaaatatgtatgacaagtgggcctaactaagttttgacttatcctattcatgttaaatctctctaaccaaataagaaattggatcactatatccatatatactgaacaaaaaacaaaaaattagatcgttatatccgataaaacatactatccacatgttatcttaaaccaaattactcctcatatttttatgacactgttctctcgacatggactctgtaaacaattactcctttcatttttatgacactgttccactactagacaaccgatattttatcgtgatacccaaaacatagatatctcggttagatttagaaccggtactaaagatatttttagtatcggttctaaaattctaattcccaaagactagatggaggatctttagtttcggttggtgttaccaatcggtacttggtaacaccaatccggactaaagatatttttagtaccggttggtgttatctaccaatactaaagatgccaccaaggttagttaaaaagaaagtatctccatccaagtcagatgtgtgtaataggtgggatggtaacatgcgtgaagtccaaggtgagaaatcttgtatttgaatctcacatccaacatattactttttatttagtatgcaagatcgagatctttagtctcattactagtctgggctgttagaaccgagaataaacgggttcggtagtaaagatcatttctctcgagaaaattccctacatacccctgaaaagttttgcaatctcttctatacccctgaattttgcctcatcccctacatgcctttgagttttcattttgatctcctatatccctattccgttagttgaccgtgaattgactgttaaatttttctaaaatgaccatatcgcccatttcccatacttatagtacatgctatttactctacttcataattcacaatgtgaaaaattgtaaactcatgataaaatcaaatgggacataattatttattgaaaagaaaatttaaactgtaaaccaaaatccatataagagttttagctagaaattctaaaccaaaattatttatttgttgggttcaaattttgatgaaaacaatatataaatttcataaaagttaatttaaattttttaatttaattttagaatttgttgtcaaataattatattccctttgtttatttacaaatagatctttttttcatataagaattgtgatttatcattaaactagtacataagtataacagaggggtaatatagtcaatttcaaaaacatttaacggtcaactaatagaatgtacatagaggagatcaaaataaaaactcaggggtatataagggatgaggcaaaattcaaaagtacataagggattggacgaactctaaaggatacgtatgggattttctccttctcttgcagtgttctctcatcatggactccgtaaacaagtgctccgattctaatggtgtcgctaacaagttctctaattacatacaaaccctttaaaattgcaatttaaattgcttattaattattagtccttctagtcactaatatttgtcatatatatagataagattcagtgaaccttctaactttcgaacgtccactttatattaaagtaactttataaaatttaggtgagactgtttgcggtcacggaggcgtgttgtttcgttaaacatagctactgcttcgtacagtagttttgatatgtttttttaaaaaaattataaatcctttattattatgatccaaattgcacaataccataaaaattttgccacgtgacacataaccctagatattatggttttaaaatttcacaaaaccataccataaatcatttttaacactcctatattaaaatttaaaaaaaggttgtcaaatttatatggtagattgtagaacttaaagaaaattcaaagtcaaaataattaacaatgtggtatgtgaaactttaagaacgtaatacgtgaggttatgtgttactctcacagaacttacaaccttaaatttttttaataaccaggtgatttcccgcgctttgctacaggaattactaagcaattctcaatatttttttaacaatctagttagcagtaaaaaggaaaaaataataatgaaacatcagggtttatcagacaaatgataccatgcttcaatgtgaaacatattgataagtatatgttaaatattgtaaaagtgatagatagatttgttaaaatatcgtgcaaatgatatgaggggtgatgattcaaggtttcacctgatgattcaaggtttcaaacatgctgctacccagtcaagtgaaattttgtccatgcatgtttggttttcaccttaatattgctatgttgtaggaagcaaacttatttagcaaaatgtaagtttattatactatgcaacagtaggaaataataagaatacctggtgatcagagatcttgacaggcaccaggaagaagtcattgtccacctccatggctccatagtatcctttcccccagccaccaccacctctttccgcatcttggacaggaggggatcctctttgtccccaatctctgcctgcagcacaccatccttgaacagcttcacacaaagtagcgaaagagaaagataatgccagaatagattgccagtgttgcccagcagaaaaaggaaagtctgtaaattcattctcacctaagatgaacaacagaggtcagtcctcaattctgtgtctgcaaaaatcaaccaagaaacaatgaggataatgagcagcacaacggaattagccaaggaggaagatttcctcttgttggacaaacgaaagaaaaaaagaagggcaccaattaacctgcagtagtagagtgggcgtgctggcaagagagaggaaccgatgatagcagcacgagcagcagaagcaaaggcactgctgccctcgtccgcgtccgccgtcgtcgccgccgccgacgccctcgaccgctgccaccgccctcgtccgtgtccgccgctgcctcgtcctccgagtttcctaatgggtgatcgatcgtcccggacgatcatctcatgtttcctttctgacaccgtattaactttctattttagtaaatttatccacctaaagtttgtatacctcaagtttacacatctaaagtttatacgtctaaagtttagagacccaaagtttataagtcaaaagtttatatatctgattcaaatttaaatttgaattcaaaattttttatatatatagtatttctatgcatctaaagtttatacacctaaaatttatagacccaaagtttataagtcaaaagcttatatatccgatttaaatttgaatttgaatttaaatattttttatatagtatttctacatataaaattttctaactttgtttttttattttttttagaaaattatgatgtagtaggaagagaagaaggggaggaggaaggggtagaggagctgtcataggggaggaacgggtgatcgctcacagcgaccacccgcccattagcacccccctcgtcctcgtccacctccaccctcgaccgctgccgcctccctcttccgcgtccgctaccaccctcgaccaccgctgtcctctcgcgacctccgtcgctgctgccctcgtccgcgtccgccgtcgtcgtcgccgccgctgccaccgccctcgtccgcgtccgccgccgccctcgactaccgccgccctcaatcgcctcttccgcgtccgccgcagccgccgccctcgaccgccgctgtcctcgtccgtaacctccgccgccaccgccctcatccgcaaacgccgctgccgtcgctgtcgccattgacaaagttcgtcgccgccgtgtagcgcccgttccgtcgtggcgcctagcgggaaaattatctcttaaaaaccctaattgcgaaatttgtttccttgcttgttgtctagtgtccgtgccatctcaagatctcaatcccgatctatcgtcgagttcaactccaaatccaattccttccaaatcgaatccctccgcaaaagtctagtttgcctcccccgggttcgatgggccgaattccgctcggcccatctcttccccggccccctctctcccgggcgtctctctctctctctctctctctcgcactctcccatctccccctcccctcccccggcgcgctctccctccgctccgccgcgcccgcgcgccgcgcacgctgcgtgcgcgagcgcgcaagccgcgccgagcgcctccttccccctccgctccgcccgcgcgccccgtgcacgagcgcgagagccgtccgcgccgagtcgagccgcgcctctccatccgccgcgccctcccgttgcaagccgcgcgcgcgtgccgagtggccgaccgtctggttgccgccgccgtcaccctctgccgcgccagcccgcgcctgtcgcctgtgtcgtcgcgccgctccaaaccgccccgccgtcatcgccgtcgtcatcgcctcggccccgccactcccgcgctagcctccaagggacggaggcagagcctccctcctccctcagccgcgcgcccccgctccctgctccttttcccgaagaggcaaggggacaagccccctttctctccctccttttccccttttcctcctcgccggcgtcatccgcctctgtcgccgttttggccgcaagcaccgagcgccagctagcgccttgaccgcccgaagtcggtttccaaaccgacgttgccgcccttaaagccccgggcgccctccctctcttctcctctcgttgcccctctcgccgccgcgccattgccgtcgctcccgtgctctgtctcgcctccgccgtccatcgccgagcaccgggagagccggtgcgttcgtggacgcggaaggggacttcggccgcgccctcttcttcctcttcctcggcccgaggccggagagattactcccgcgccgccggcctctcgtcacagcgcccctcctcttctcggtgatgtctctctccgttcttcctcctcgctccatctcctccccctagctttcggtagtagcttgagtagactccccgtagttagccggcgccgccccgaccgttgccgtcgctcgccgtgtgctcgccgacgtcgccgcccgagctccgtagcacccgctcgtcgccggccttgctcggcgtagttccacccaatccgacgctagcgtcgagttcccgaagccgcgtagatgctctcaccgccgggaatcggtctctcgtgacctcgtcgccgtttccctcttctcccgccaccggttgccgccgccgcaatccgccgccatcgagcaacctccggcgaatccgagccgttggctcgtctccccttgtcacgtgcaaccgcccggtgtgcacgcttttgcccgtatcaccgtggttcggtccgccgctcgccgccgccgcccgccgtccattcgcggccgggtcgtcgtctacctcccgccagcccacgtggccgccacgtaggcgccacgtcggcgccagctcagcctagaccgggtcgggccgaccccggtcggtccctccgcgtgcgcgcgatccaccgcgagccgtgaggctgcgcgtgggcccgccgcacctgcgtccaccgcggaccccgcgcatgcaccgcgtcccgtccccgcccgcgcgcgtgcgtcgcgtgctccctccgcacggtgagccgagccgctgacaagcgggtcccacccgggaccgcgcgtggtgagcccggtccaccggactctctcctccctcccgcgcgcgcgcgcgcttgggccgtcttgggctggccggcccattaagctcggccgagccgccccaaatcccttgggccgcaccctagccgcccgaggaaagtctaaatttcctccctcctttcttttctttttcttttccgaaaaggatttaattccttttcctttaggccaaaaattcaataatcttagaaattcaatatcttcccaaccgtaaatccgtttgactctgttcaacttccaaaatttcccaaatctcgagatctatctagtggcacgcttagaggtctttaatagggctttattttcgccgattgttgagttgtcccgtttcgcgtgtagtttcggagcccgaagacccgcagtgcgaggatttcgaggatcaagctccagatctcgagcaaggcaagccacccttgaacatcttgagcctatatttgaaatttaattatattgcttgcgaaatattatgcattgataggatcacacttaatctgttgtcccgtctgcaaggcagattggcagacctacctaatttgttgcatttgatccttcctttgttaattgttataccatgtccccttgtaaccacccagttgcacctcgatattcgtgcactctatgcgagtatcgacggtcgccttcaaacttaaaatctgagtaacaacttgggtaaaactggagttttacaaaagacttggaaaacccgacacctgggtcggcgcttgcgaactaaatgaatttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgttgtgtaaaaaggggttcggtgtttgaaaaatctgcagctgatgggatcagctaggcccgggtggccgtttgaaaagttgttggcccgggtggccgtttgaaaagctgttggccgggtgccaaccttgttgcaatcctaaagactgacacattgcacatactccgaccggacgggacgcactgtctcaaccgtgtcgtttgagaagcactcactcagttgtttcagaaaagagttcaaataaaatcaattgcaaaaataccagcctttccttgaggcctgcattaaacacttatttcccctggcttgctgagtattcccgtacttacccttgctctataaaaaaaaatcccccccagttgctgaagaagatgaagtggatcctgctgacgaggagttcttccaggagcatgtcggctacgatgagttttagggtttcggcctagttcccaagtcgcgcctgtgatgattggtccaagtcctggcttccgctttccttttgtaatgcagttgtgagctcgggatctgtccgcagcccaacatgactgtacttctactctataataaagagacctctgttgctgtgatactctgcctccctgtgataccagcactatttcctgggactggtatcgattagcaggttaatttggagcgtcacgggctagttccggtcgggactagttcggggcgtgacacgccgtagtcgttgttgctgtcgggggaggcgaatatgcgatgaggccgggagaggcgaatagtctatgaggccggagggaggcgatgcggtgaggagcgaagggaccgagggcattgctacaaaacggaatgagtaccactgagatgtaatccaacggctgataattaaatgatgatgtggcttcaccaaatctcagctttgggttttaactttatagaaagaagggataccttagattttgtgattataataggtgggattttataaaatttattttaacattattatttttacaatttaagacaacgatgatgacgacgatttgtggatgcagtcaccctattgcatcaaatttctccagacatatatttgccggttttctgcgagatacaatttgaacaatctttttgaaacgaggacttggcaaagggtaccggaacacctccgttttctgtgacagccgccaggtgttcgatgtcatccccggcttcctcggcgagcttccttccacgacagatgcgagaacacgcattccgtcgttacctcgttccatttttatgactagctccgcaaatggagacggtggaagctgaaccgctgtcatctccttgtcctccgccgccgccggcggcgacacacctagcttcgctgcgcgttcccgcctgcttggcgccattcggaatggattgcatgatggtggagaggcgtaacggacgtctccgattccgagtcgagctcggattgacgaatcgtgcctgacagcgccgacttcaattcggactcggacccggctggtgataaatcctcgcagccccgatcgccgcctccctccgcattcaccacgattccctccacccatcctcgtcgcagcagcgctagctcgtcgtccatggcgcttccccgccgctcgagtccccgctcctcgcgcccgatcatccaccgcgccgtcgacgccaaggggaagaagccgtcaggaggatcgccgcccgtcaacaagatgtcatccgcgccggccgcgccagcagtgtccttccagaagggcgacgaggtgcgcgtccgcacgccggtggggaggctagggaccacggcgctgcgcctcgtcatgtggctcggcgcggtcgtcgtctccgacgccgtcgatggacacctcgaggtcatctacaacggcaacttcccgcgcgacgatcccttccggaccgtgctcgtcgccgtcaaggacgtcaagctgcccgcgccccgcccggccccgaccccggcaaacatggtggccccgcggccgaccacggccggcaagtcgctgccgcggctgaagatgcagatgctggagaagaagcaactgcgggccaactctgaggctttgttggcactgtgatcagtagtagcagtagcttgtaggattcagatatgtcttcctctgtttttttttggtgtcatggaaggcacagtatctcgtatttgtgataggatggtttactggaaatcttcgcaagagaacgtgtaatctgtgaactgtatttatcgttgattatgaatgaaagatcaagatttttcttctttttttttacacgagctatcgatgtgtttcgtctattatctcatgatcaatgcaatactatgcttgcctttttctttttcttttttttttggtttgagccaagtgttaagattacagtcacaatgatttaccctactgctaaagaaaatcaatccttcatttgtttctctaaagataactttaggtgtacacagtacacgaactttgaaatacaactgacaatgggccaatccatcctatggttagcagttagcacctctgagccagggttgtctcgaacatgatcaggtcatgacccatcaatggcttggacactgacaatagtggcctcgattgttatcaataaggagctcgcatcttagctcaagctctcgcgacgcttgctggagcaacgtttgcaaatccttacggggcgtgtcgtgtgatcgtagatcgatcatgtggtgtgttatgacactcgagatcaaggtttcgtcctcagactctgttactccctttagtttcagatgaatttcgaaatcaacttgatccattagcacgactgcacgagatgggcatgttaacattagatttggatcctgtaagcatcacaagtaattgatcaatccatgttaaatgtataattattctacacttggcacactaattaaggtcaggaacatataatgtttttcacaggcttatgtttgtacagattatagaagtgccacttttgttcatttagtttgtatcaatgagttctttacaaagaagagcactaaggagagcttactaggtcctccatggaatgtttaggctatgccaaaccactacctcctgtaaaatcaaggagttgatttaagaatttgtgtgatgaaaatattggtggtttgtgatattttatttgtgataaattggtttcttgtgacgagagttaggagattgatagatggttggttttgtgaagtggttgtgcggttgacccgagaggtcagaccagccggcctgacggtctgatcgggcaaggttctgtttgatgtcaatttcaggttatcttgtccgttttggatagtttcttcgtggatttaacttctagattgtttctataagtatggatactgttgttatgctaatgtgagttaagttggaatgaacttgtgttcagaatatggtttctttattgttgcatgtgcaggtgttatttagatcgaagtcaacttgagagaagtggatgtccagagatcaagagaccatgcgggatactaaaggctagagaacgatgcaaatagtgataaaattccatatgacatacaagaggaattatgtgcatatatatggaaaatggagtcgaattcggacgtgagtctaaattcggaaagattgataaatataagggcctattcactttgctaccaaaaaaacattaccaaaatttggcattgccaaaattttagcatagttgtcaaaaatttggtaacttgccaaaattttggcatgatttcttatatagttaccaaaatttggtaacaaactaaatgtagccatttttttggcaactttaccaaaatttggtaaggttgaaaatggcatcaaagtgaacaggccctaagagatgagttagatacttgcaagagagggtttcctacgtggatgggaatcctaattaatgttagattcgtgagctttgtacaacattcctcatgtataaatagaaagggagggtgaggcatcccggtatcgatttttgagagagttgaattgagagaaatgttagagttctgagtctagtcgagattttggtgaggagtgttgttggtgcactttgtaaacactagttgatgcaataaagttgagatagttcaatctacatcttctagtttttatctacctgtgttttctaggtcccgacggtcagaccgacagcaaggtgacgttctaaccgacgagagtgcggtggtctaactgcaggtggcgcggtggtctgaccggccagacaatggaagtctgaccggcagcacgagggcggttcgaccgacgccttcaggacttcgtcgcctacttcatttgaggcaaatcttttattccgcaaaatattttgggtttttggttttccctaccattcacccctctctgataggtttgtttagtcttgttcgatcatatacctccatttttatttacatgggcagcgtaaaaaaaagagggagtataaatgtagcaatgaccaccccaaaaaaaaagacattaaccataacaggaaatacacaattatgtatattaagaatgttaaaaatgacaactgcaaataagatctcgatgaatagtttaggcacatgaaaactataaaatgtagcaatggcaccctgccctcacgacaaaaaataattataaattatatacagcattagggtggcctgttgaccaaattatctatgcaatgcttttagtttgatttgatacttatcgcatatgtggttaacctctaatttttcttacttcgtaggtttcaatttgccccacttgtgccggagagggtggagtcatttcagagtatcgcaaagaaatgtgctggagagggcgtgttcatgttggcaaggagatcaaagtaaaagttcctctaggtgttaggattccatcggatggctgattgagccgggagcgtttcagccgaagcccataggatggctgattcgactgagcccattcagcaaaacaaagtgggctcacaatggagggtaactggcgtttggttgatcaaggtggatattttccgtttcagttttactatatatttatggacaagttttctctcaaaaaattatgaaatgtaaataccctattgattataatttaattattatattataacttgtatgtaattttcatattataatatcaaattattaaatttgcttcaaggttcttgcaaacgtaagaggagaaaatcactgtgcgtgcacggggtgaggggattcgatatcacgacctccgctttgcaggaatcagcatgttacgacggaatttacgaaagttatatacaggatatattgaattacatgcatgattacatactacgactgtactatatttctgcccgaaaatttctctacaaaagcataaacagtcccgctgaactactactcctgtaacctgataggcccaattcaggcccacgaacgtgtttgggccgaaatgtgaacttgaacaggcctggattgaggcccaatacaactatgggcctaggtggaggcctcctgaacacaaaagaaagggaaaaaacccaagtgagaaaccctaaccgcgcgaggcgcctctcctcctctgcttgcctgccatggagttcgatcgccggaaggcggcggcgctggccgcgctcgcgtcgccggcgccggacaagtcgccgaagggcggcgtcgacgcgcccatcgcgccgctcctcgacgccctgaactcccacccggacctcttcaccacctcctcctgctccggccgcgtctccgtcctcgcgcagccgccgccgccgcagcaggccgaccccggcggggccaagaccaagaaaaaggcgcggggcggcgggtgggtgtacatctcccacgaccccgcggacccggaggccctggtggaggtgctgttcggtgtgaaggaagggggagggggaggcgatgatgagctcgtgttcaggttcgagccgatgattgtggccgtggagtgcagggacgcggctgcggcggcggcgctcgtggctgccgcggttggcgcggggttccgtgagtcaggtgagcgtttgaattcgttcagctataggtagtgagatagatggtgtttggttgagttctgtgtgtagtttgtgtaaaagaattcatttcttctgcagtttacttgggtcatttagttacctgtattgtactacatttccatttggaggtgctgtaatttcttgggttccaattctgtttaaaatgggtaaaattccggatgctctttgaattttttaatgtcgatttgatagagtttgcctaaaatttaccggtgaattaaggcacaggttaaattttcaagagttatgctttgacatatttatgttttagatggagatagtgtcatttatattgtctttccactttgcttgccttggtgtgccttttcaaatattctgatcaagctttttttatggtaccatttttaggcatcacaagcttgcagaaacgtgtaatggtagcattgagatgctcaattcggatggaggtgccactaggtcagaccaaagagctcgttgtctctcctgattatattaggtaccttgttagaattgccaacagtaaaatggaggctaacaagaagcgaatgggtggattcctggatcttttgcaggctaaggtatcatttgactttgcataccggtaggcattacatacctcatatttgcacctttctggcattgctgctcatctctaactgggcaataaccatgtgatatcatgcaaagttgaagcatgtatttcctggatatcgatttgatggataaagagaattataatatcctttttccaggtagtttagctattggtcatcacacttctttgtgaagaaaattaattttgtctgtagtgaaaggctcattgaagattatttagacatggaaagcttttattcctcaatttacttattaattctgctgttccatataccaccttatcaataagtatatggagtatggatttagggaatgctctaggcctctatcactttgctcattgtgttctttataagttttaatgcattggttccattcaaactgccagggtctcctaggttcatccaaaggatgtgcaactgcagataatgaatccttagttgcaaaaaagagtagtgatacctataattgtgatgctgataataattgtgataatggatttgtggagatttcactagaagcatcatatttggagagtcaagaccctgtacttcaaaatggtgccaagcatggttttggtaatgctaaacggcatgttctcatatctctttccttttatcctgcttttatttcccctcatggtgtcatgtaaacctattggcctgttcagtccttccatacatatgttgaggagattttggtttgtctaagagaatattaccatcaatacataagtacatgttagttatgtatgctaggcctattgattcagttctgcacattgatcttgtacaataaagtcaataaatgttatttgaaaatgaaatttggtgatgctggcactgtttcacaggagggcatttagtaagccatatttttttatggcattaaattggaaatattaccgtgccagttggctacatagtcttttcaattctaactcataactcagcagctcttatatatatttatcctagatacagagctctttttatatgactaaaccctattattccgtttattttcttctgtagattaacacaagaggaagcattgccaacattgtcaggaaatacaactcactgcctttctactgctgcattggagattactggtgaacctattgagaagctcttcttatggggacaatctgcttgtgcactcactgttggaagagagcaccatatcctaacttttg

SEQ ID NO: 33572 - DNA, 1040 bp, Oryza sativa
  unsure (1)..(1040): unsure at all n locations
tatatctaattttcttttgtaccaaataaaaaaatgctaaaaatagtgctaactagctatgtccaaaagttatggaattagtttcttgaaaatagcaacccatttgcttcagggaagttatgtgtttttcaatgcaggcaccgacatgctgctgctgcagtagatcgcaaagtatatgtctttggtggactaagtgatgatggcttatgttcttgcatgaacataatggacacagcaagtatccaatggaatgtgatttctcctgatgacaaatggccatgtgctcgccactcgcattctctagtgtcctatggttcaaaattgtttctgtttggaggtcatgatggtcagagggcactgaatgatttctatagttttgatacaacaacacttaagtggaacaaagaaaacactaatgggaaagctccatcccctagattttcacattgcatgttcatctacaaagactatctcggcatacttggaggttgtcctattagagaaagcagtcaagaaattgcattgctaaatttaaagcataaaatctggttttatgtatccattccatcattgagccaatgcctttgtgtccgtagctcatcagtcatcattgatgatgatcttgtcattgttggtggtggtgcgtcttgctatgcatttggaactagattcagtcagccaataaaaattgatctgcatttgctggagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33573 - DNA, 1121 bp, Oryza sativa
tacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcatgaaagacgatcgtctccatgttgtcctcctctggggcaacaaacagcaggccgagttggctctggccggaaaggtggccaa

SEQ ID NO: 33574 - DNA, 752 bp, Oryza sativa
taggtggtgggtccagtactccagtctatgcgtggaaccagaaaaaaaaaaaacaactcctctgattcagtcgccccatccgactcctcgtctcctccgtcgctcgcctcctcccaccgagtgatccccaatcttcaccgcccccacgaagaagtactgaggaaaagagagagagatcgagtgcgagatccagtatgtgcggcgatcgtggagttggcggtggcggcaggttgctccggcgacactgccgcccgagggatttcactcactcgctgaggtccgggccgccggggcgctatgcaagtccgctacggatggtgaagggcagcacgagaggagccctgctaaccagcgggggtggcggctgctgaatgaagacttccggcgcgccgccgctgccgccggccaccgtccacgcgcagaggagaggatgcggcggcgatggcaggacagaggaggagtgggccgaacgtgggctatacggcccatggggatggttagactgtggtgggcctggcggtccaatacttaaattactcacctcttcttctacaacggcttgacacctcctttcttcctccttggtctgccacgaaagcagaaagcagagaggtcatctccggcgatcagcagggggcgcctcctctcctgggaggaggaagaggagaagaacgtcgtgtcatcttcttctttgcgttctccagcatttctccttcgtgttctcctgctggaacgtcacttattctccttcg

SEQ ID NO: 33575 - DNA, 5033 bp, Oryza sativa
atatcagctatgtaccactggaaatttttaaaattgaaaccatatcactcccgtcactttttatgtctcatctctcgcgccgtctccgttcccatcctcatcccctctaggacccaagcgttcacgtggcgcgattcgcggcagagtcgttagacgcgcgcgcggaagcgaggggggatggtggcaggcgggacgcctccgcgccggcgacgaggagcagcagtaggaggacaggccggggcggttgcagccgggcctagcggggttcgcggcagagtcgtcaggcgcgcgcggtgtaggcacggacgcctctgtgccgatgacgaggaggatcaggaggaggaggacacgctccgcgtcctggtgtacatctccctgatatgccagaggagcgccgtcagcaaggacctcgttcgctaccgcaacatcctctgcgccatcgccgagatgctcaagagcggtagcccctgactccgcctcaagtccctccaggtcctccgtgtcctcgtcgaggacaacgatgacgacaaggtcgcaaatcccattccccaagtttcaacatcccccaaagcagataaattttgcaagaaaccaagtaatagttgatcgattcttagtttcaattttgcagaagttggggaagggcgacacaatacacaccatcatcaagttcttgtcgaacaagctatcggggcatgagccgacgtgcaagcggatcgtcgcggtcgggacggggagtagcaagtcggagagcgtcgttgccgtcgacaaggtggagagcatgctctgcaacctcgaccgcttcgaggccaacgcccaacatgaagtagggccgacaacgccagactgcaactactcctcaccaggctgcttcaacgccaacgtcaagcaggccgcgatggccacgcgttggcgaactcggtgaactcggctagatcactacctcagcgagctcgcactggcgaacgatgacaaggtgtcatgccccgaactagccccgagtggaactagcccgtgacactccaaattaacctgttaatcgataccagtcccaggaaacagtgatggtatcacaggaagacagaatatcacagcaacagaggtctctttattatagagtaggagtacagtcattatattgcggacagatcccgagctcacaactgcattacaaaagggaaagcggaagccaagacttggaccaaacatcacaggcgcgacttgggaactaggtcgaaaccctaaaactcatcgtagccgacttgctcctggaagaactccttgtcagcgggatccgcttcatcttcttcagcaactgggggggttatttatatagagcaagggtgagtacgggagtactcagcaagccatggggattaagtgtttaaatgcaggcttcaaggaatggctattgttttttcaattgattttatttaaactcttttctgaaacaactaagtgagtgcttctcaaacaacacggatgagacagtgcgtctcgtccggtcggagtatgtgcaaggtatcagtcttttgaattgatcaaggttggcattcggccaacagctttcaaacggccacccgggcctggctgatcccatcagccgcagattttccaaacatcgaacccaaaccacatcagcaaattttacaaagcagtagtcaaacaaaactacgctaggaatcacctcacatccgcccatgaccgtgggcatggctattcgaacagtttaataacctctgcagagggggtacactttacccacacgacattactaacccggatcatccagcccgtgcagaacggccacgactagagaccttaaggctttcatgacaaggcatttcgaaagccgacacaggttcaccatattgtcacgagaggggtcccagaccaacaccggattacgtcccagaccatactgtgccaggaaacccgggggttctccctgacaccaccccgttgaatccacatgtctcttggcatcatggttcccccgattagctagttactcagccaggggtgtcccattccacccatgtggtcgcacttgtcttatgttcggatgaaattccaaggaaacggtccttaagtgcaagagcgggagactgtacacccggtacgttccccggtccgcgattttggaaattcatttagttcgcaagcaccgacccaggtgtcgggttttccaagtcttttgtaaaacccgagttttacccaagatgtttctcagattttaagtttgaaggcaaccgtcgatactcgtgcagagtgcacgaataccgaggcgcaactaggtggttacaagggaacatgatataacaattaacaatggaaggatcagatgcaacaagttaggtaggcccacctgtctgccttgcagacggggcaaacagattaagtgcaatcctatcaatgcataatattttgcaagcaatataattaagttcaaatataggctcaatatgttcaaaggtggcttgccttgctcgagatcttgagcttgatcctcgaaatcctcgcactgcggatcttcgggctccgaaactacacgcgaaacgggacaactcagcaaacggcgaaaataaggccctattattgacctctaagcgtgtcattaggtagatctcaagatttgaggaattttggaagttgaacggagtcaaacggacttacggttaggaagatattgaatttctaagattattggatttttggtctaaaggaaaaaggatttatttaaatcctttttgaaaagaaaagaagagaaaagaaggagggaggggaattagacttccctcgggcggctagggcgcggcccgagagaaagggggcggctcggccgaacttaacgggccggtcggcctgagaaggcggcccaaggcatgcgcgcgggtggggaggagtgaggaagccggtgggccgggtccatcccgcgtggtcccgggtgggacccgcttgtcggcggcttggctcaccgtgagcgaggtgcacgcggggcgtgctagggtttggggaggggaggcgcggtgcatgcgcgcggttcgcggaggacgcggtgcggcgggcccacgcacagcctcacggctcgcggtggaccgcgcgcgcgggcagggccggagggagcggcgtaccggggtcagcttgacccggtcgcggccgaggtggcgccgacgtggcgcctacgtggctgccacgcgggccggcgggaggtagacgacgacgtcggccggaacggacgcggacggcggcggcgaaccacggcgatacaggcgaaagcgagcacaccgggaggttgcacgggacgaggggagacgagccaacggctcggattcgccgggggatgctcgacgacggcggattgcggcggaggcaaccggcggcgagagaaggggaaacggcgatggcgcgacgggagaccgattcgggcgagctaaagcatctacgcgactccgagaatccgttgctagcgtcggattgggcggagctacgccgagcgaggccggcgacgagcgggcgctacggagcacggtcggcgacggcggcgagcacacagcgagcagcggcaacggtcggggcggcgccagctagctacggggaggctactcgtgctactacccgagtctaaggggaggagatggaacgaggagggagaacggagggaggcactaccgtgcggggtgatggggcgtagtgacgaggggccgacggcacgggagtgatctctccggcctcgggcaggggaagaggaagaagacgagcgcccggagtccccttccgcgtcctagcacgcaccggctcctccggcacacacgacagcggcggtcggcgagagggacggcaatggcgcgggcgaaaaacggggaagattgggaggggaaaaaggaagggagggcgcctgggtttatagggcggcaatgtcggtttggaaaccgaccttgggcggtcaaggcgcgagctggcgctcggcgctcgcggccaaaacggcgacagaggcggatgacgccggcggggaagagaaaaggaaaaaggaagggagaaaggggggttgccccttgcgtctttgggaaaagaaggagggagagagggcgatgaggaggagccctgcctcctttccttggaagcacgcgcggggaggggcggggccgagtcgatgacgacggcgatgacggtgggggcggtttgaaacggagcggcgacacggacggcaggcgcggacaggcgcggcataggctgacggcggcggcggccaggcggtcggccatcacggcgtgcgcgcgcgggaagcaacgggcggcgcggcgatttgggcagcgcggctcgggcacgcggcaaggcagcggggccgggcagcgcagacggcgcaggcgcggcacgggcggcgaccacgcgggcgcgtgcgcgaagcaacggcgcgcggagccgatttcgcgggcggggagctcgcggggatggaggcggggagagggagagcgagggggaggcgctcggcgcggctcacgggcagagcgggaagagagggagagagagagggagagagagagagatgggccgagaggaagtcggcccatcgaacctgagggaggcaaaatagacttttgcggagggatttgatttgggaaggataattgagattagggtttggatttggattcgggacttgaacttgacgatagatcggggatttgagatccggaatggcacggagactgactgcaagcgaggaaacaattttcgcaattaaggtttttagaaattaattttcccgctaggcgccacgacggaacgggcgctacacaaggccacggtggccgaagccgtacgtagccatggagaggagggtgatgaggacgtgaacaaagacggagtgagagaggccgataattaggttttggtacgcacgcatgacgagttacaaaccaggaatcctaataggttttggtgtgcaggggagagaagtcgcgcacggtttccgaacatgttgcgacaagctagggttagggttagtattttaagggtggggtgaggggtgg

SEQ ID NO: 33576 - DNA, 6368 bp, Oryza sativa
ggcgtcggcgtcgaaacgacgtccgccccgagccacatgacgaggcgcagcgtcgttgtgcctagcctccccaacggcgtgcggacgcgcacctcgtcgcccttcttgaaggacatctcgttgaccggcgatcgtcctgacggcttcttccccttggcgtcgacggcgcggtggatgatcgggcgcgaggagcggggactcgagcggcggggaagcgccatggacgacggctacgagcgctgctagctgcgactgcgactctgcgaggatggggtggaaggaattgtggtggatgcagcgctaggatttatcggcagccgagtccgactccgagtcgaaaccaatgaagctagctacgtagcacgtcggagacggagttggagttgaactcggtgattagcttgctgtgattaatggctaatccttgtgaattctgctctatatatacacgcggcattgttgaaatcgcagatttctcgaagcctaagccgaactggtggaggtgtcgccggaggggcagggagacgacgtacggcggctcagtttgcaccgtctccatatgcaaacatcaatcggagaaaaacggaacgagtgaattatccgcttcattgacaaatcaaatataagtccctgtttctttcagcttgggattattataatatagattattgagttagattactataagttagattgttataatctgtagtagaataagcggttagttgtttcttttctagattattagagtctagattattgggtttgcaagtctaaaaagggagtggggtggcatggtgggtaatttttcacccaataatctagaaaaagctcacctaaatgagcttatcatattataataagctgggctccagattataagaagctactttaataagttgtctgtttctttcagtttattcccaataatctggattataataatctcagactgaaagaaataggggaaacaagcttaacaaataacttaaaacaaatgatattagcaatgcagcagaaaatatattgtttgaagaaaatatatcgtttgaagtgtggaataaatagagagaacctacggcttgggcgcccgatcggctgggagcaaaatccggcgctgatgtcaacatgacgtcagcgtccgatttacgtacaaaactattttaaactgatttttttctcctaaattacttatccaaatcatgatccgattgcaccattaaattcgttgcaattaaatcttcaaaacaagactacacatggatatatttcgacgaaaaaaatagcttattattgaattatttttaaatgttgcacgatgttccaccaagtatatcggaattgtttcactaagttgattgaaaatgtttcactcgtttaaatcaggtgttgtttcaccttatataaaaacaatgtttcagcaaatagcgaaagaatgtttcagttcactgcaacattagatctgtacacaatgaaacattattagtacactaggtgaaacatttttcggtggaacaaaaaataaaccaaattcccttaatagggggtttccaaaatatatgggtttttttgttgcaatgggatgtttcgttcactgcaacattagatctatacatagtgaaatattgtgagtacacgaggtgaaacatttttggtggaacaaaaaataaaccaaattcccttaatagagagtttccaaaatatgtggattttttgttgcaaaagagtatttttattcactgcaacattatatctataaatagtgaaacattgtaattacattaggtgaaacatctttttgtggaaaaaggggagagagaagtgagtgggcccaataagtgtgcacgtggggggaggggcgcacagggggagcgcccgatcgggctccccccgcgccggacgcctggctctaatcattctcggaataaatattctgtttcaataatccataaataattaaaaaataaattgagcaaaacatgactagaaatatagatggtcaactgggccgcccgacacagcacggcccacgcccagccatgcctaggctgaggctagtcgggccagcacggcccgaccgacacggccgtgccgtgccacgggcggcatacacggcccaggcacgacccaataccactcgggccgtgccgggccgtcccgaaggcacgatggcccatcgtgcttcctcatagaaaaagtctattattcgtccctcaactctgtgggttgtgttcaaatggctggaaaataagtctattttgtattcctcttctctttgggccttgccttatacagttatttaagtctattttgcatcccaatatttttttatttgatcgggccgtgccgggccggtccaccgtgccgagggtgcagcccaggcacgacccggctgtcgagccgggccggtacgggcatgaccctagtcaggccgtgccatgcttgggccgggccaaaatagtgtgcttcaggccgggccgtgggcctcgggccatatggccatctataactagaaagttaagaagtcagggatgctagtccaccaatgagtaggaatgcaagtggggtaggcttgtgggctttgaggcccccattgtagttatatttttgcatctgtttctgattattaggtaaaaaataaactaacatgtgtgcttttatatgcattacagtgtcgaagactcaaagtgttagtaggcactccaaaggaaaggggaaaggggacaccacgactcttgttcaatcaacaattctctactattataaaaattgaagatgtttttgccggtactttggtacatcatctatatatgagtaggtttttaagttcgtcctcttttggaaatacatttccgtatttgagtcggtttttaagtccatttgcttttgaaaatacaaaaggagtcgtataagaaatctcttttaaaaaaactcacatgctaacttgagatgaacagactcctatttgcaactcatgattttctaaaaaatattgtcagagggtgaactccgcaaacgggggacagtgaggccccccttgttggttcggccgggggcagcgggtgagattcgggagctcggtgagtagtttgacgtagagggggtcaggcccctcaagaatgatgagacaaaaggggtttatacaggttcgagtcgctgagaagcgtaataccctactcctgtgcttagttgatcgtgtgatgatttacaagatttccttattcgagtagaaggtgttgatgataagggggcaggaaaattcctctagtgaaaagggctcatccactccctaagtaggcttggacctccttttatatctcaaggggttaccacatgggctcaccgagcctatctagggaggataatcacattaaatgcatgtcttgttgcttgccttagaagccactagcacgcctgctgtggcgtggggccagccagatctatccggctgagacagggaacacgcacgtctcattcgtcattaatgagtgaagacttttgggtccttactcatgccgggaaacggaaaccttgcactgaccgggttagacggaccgcctcccgactcatcatcgcgacatgacaggggatattaggcggcacgccgcctgacatgcaactagtatgcagacacactaccctggttacatcggtcattcgaccggtcgtagactggtcgcaatctagtcaggtgcaccacgcaccgcatttaatgcggcgtggtgcgctcgctcacactgccttaaatgggggcgtccacctaacccagcacacgcggcaccgcatggaaggggttggggtagcccgatcccaggcaaggaggggccgccgccgccctgcctcaggccagacccccccccccctcggggagagggccacgtggctaccgggcacggcctcctccctatggacctgatacctccggacccatatcaccaacaaatatatatatccaagcgaattcccacagaatttcaccttaacttaaaaatataaccatataacaataataagataaaaatagtcgtcatcccttgcaacacatggcattttttctagttaatataaaaatccgagtttactattttgtgtcatttcttcgtcaatgttgtctttgccaaggacttatcgtagctgtatttcttccggcttgcataacatgcatggtagctagagggagtaggggaggttggacatttaccaagtaaaatgcgacatatatgtgtgaattttgaaatcatatgacagacaaagaaacaaaaatgagactatgccactcaactttatggtcaattataatatcatgttttttcaatatgcacgcggtaagccaatgcagagatcgaaccaaacagaaccgtaagattttttttattttggcattaattttggggtgggaggctaaggccgtcaaggtggtcacgatggaggagagggtgaccaggctcgatcggctcctcgtcatggccgtcggaaccgctgcggcgctcgcgggctgctacgcgaagggcagcggtgtcagagacggtggtgcgtgagagccggagcgcgccctcaccaaggtggagcgtctcgtctgattgagaaggggcaaattagtacttttcacgatttttctctatcgatctacatcggatataatcaaataaggttttcagtaactaattaccaggcttttgcggtgttctataaccaatttacatctttacggtttcccatagctaattacatgttttctgggtgttctgttgtaatttttgactttacgatacctcccactactaatgatagtagggtggtagaggtttgatcttaccgttgattatgatgggtgttttagacatttaatccaatatcatattatattcgacttccaatttaatttatttgtgcagaacagaccattctattgacctgcacattaatcggcttctattggctatgatcatcgcctgctagctacccatcgtgtggcatcgtcggcgagctcgccgtttagattgatcctctcgctgccgctagatctcacctaattcctatgcatgcaaactgtgtacgtaaatgcacagaatcacaggagcatgcctattttctctccaagtaactcgcacatataatccaatgattagccaagaaaatcatattcgtattacggatcagtgatcagcggccccaccagctgcataagggtttcacagtgcaagcctcagttgccaactagacccaagtccctctaaagtcacatccttcaaagtgcaagttcgttgtagtgggcctcaccattatcttctttttttcaatctttccttcccctctctctcctcgtagttcttctttctcactttccccgtcggtttagacggcaccggccggagcctcggtcggagcagcggcgggggcgatccaagcggcagcggcgacgacgggcagagaggtagtgtggtgacctaggcggcttggcggcccaagcggtgatggcgtcgggttgagcggccagatctagcttcgggcgacgaggtggggggatgatggtgcggcaagctcactaaatccgacggatgcggcggcttgtcgggcacggcgcgaggtcggccgtggccatggcttcctcgtcggcgtcatagccactggttcctcgccggtgctggtgacgagctctgcagccgccaccctgccctcctcacctgcaccgacaagaacctctcctctccgccaccagcccaccattgtctttcctcctcctgctggttccggccatgcacggaactaacgaggctttcactcacccaattttttctgacaaaactgacgaggctctgggtacccaaattggacatgggaacaccatgaaaacatggtccccactccattctctcctccacgtaagcattttgtctattagttgttggggctgaatgccacagaggcgcactataaacgccctaagaaggccatgcaagaatttatacaaatttacttttctatcatgatgctttttccccaaatttgccacttctactttggatcaaaagatatggatggctcatatatccattggagggtcctcttcaaaaaaaaaaaaaactttttctattggtcttgtttgcttgaacccactagccgagaaaaccgatgtcacataaatcttatccactaggcatgacgcatctggcccaaggcccaccagctcagcagtggacagctcttcggagcaacgaagtgagacaaaataatgttcccgcctcaactaaatttctttgtgaacaagagtcaacagactaccactagttcttttggccttttgggcttcgttgatgttgttgagagccaaacggttcgtctgaacgaaaagtgaaggaaatacatat

SEQ ID NO: 33577 - DNA, 3929 bp, Oryza sativa
aggattaaggaaaacattcatcatgcatatattggtaaaaaaaataaagaagagaaacctcgatctttcattcataatcaatgacaaattacagttgacagattgcatgttcttcttctcatgcgaatagaccatcctatctacgagaatttaaaagatcacatcgccttccatgcaaaccaagaacagaggaagacatgttctgattccacctactgctactactgaacagcgctgatcacaatgccaagaaggcctcggagttggcacgcagctgctccttctccagcataaacatcttcagccgcggcagcttcttgccggccgtggtcggccgtggggccgccatgtttgccggggtcggggccaggcgcggcgcgggcagcttgacgtccttgacagcgacgcgcacggtccggaaggggtcgtcgcgcgggaagttgccgttgtagatgacctcgaggtggccgtcgtcggcatcggcgtcggagacgacgaccgcgccgagccacatgacgaggcgcagcgccgtggtgcctagcctccccacgggcgtgcggacgcgcacctcgtcgcccttcttgaaggaggacatcttgttgatgggcgatcctgatcctgacggcttcttggagactactctcccctgcgcctcgacggtgagctcactgcggcggtggatgatcgggcgcgaggagcggggactcgagcagcggagaagcgccatggacgacgagtgccgagcgctgctgcgaggatgggtggaaggaatcgtggtgaatgcggagggagggggcgatcggccggggctgcgaggatttatcgccagccgggtccgagtccgaattgaagtcggcgttgtcaggcacgatccatcaatccgaggtcgactcggaatcggagacgtccgttacgcctcgccaccatcacgcaatccattccgaatggcgccaagcaggcgggaacgcgcagcggagataggtgtatcgccggcggcggcggcggaggagaaggagatgacggcggctcagcttctgattggtcttagtacatccgagcaactgattgggcttataaagaatcaacaaatacaagcgacatgattcaaaatttattttgcttcagtttctcatcatgtgatggccaagtcaaacgtgctaacggcattatatttcaagagatcaagacgcgagtgtacgaccggcttatggtgtgacatacccaaatttttattttggaaaattcaactgaactaaaaattcatgaagagttttttctcaaaaacttttgttacaatctcaactctcaagagcttaattagtcactagctagtcactagaccactaattaagcttttcattaggttaacccgataaccaatcatcttggctgagtagtaaaaatacgtatcaccagtgagtcagcaaaggctcgccattgatgagtgatgatggatggcttagaagctcaagtgctgcagaatacttggctcaaggatagcattgaggactggtcatgtactatgagacaacagagacaaaaactcttcctacgcctataaagaaagagaggagaccttttctaccattcataatcaatgatatatataggtcatcgattgcatgtcctgtcacgcaaagaattcaaaacaaattatcctaactaccaacagtgccttccaagaatccagaaacagaggagccgctgcacctcacaaatgaacaatgatttttctctctatccctttttcatttcctcattcaagagagagagagagagaaactatataggctgagcaaacagttgcaatgtacaatcaagcaatgaatcattatccatcaccatcaccacagcaagaagtagccaatttacatgaatgtaagagtgcaagactatccttctctattacaagacccccggtcactgatctagaacctgtctgattgaatgctgttgtcgtcctgatagtgttttaggaaaagagacatcaaatattatcctcaagtttcctttcaatccctcgccgattggccatccttcatcctttattaccagctcataccctgggtacacgacctcatcaactttgatcttcaagtagcgcccatcaagtgtcttaagatttatggtacactttgcaagtgcatccacaagacgaagaacccaatgaactaccaggtcatttccatagaggatgtaggtctcatgaggtgcgatgtcaagggtcaaaattaaatcatggggcggctggccgtaaaaatgggacccttcataaggaagtgttatttttgttcctttccttgatccaggcagcactttaacttgtaaaattatttcttcattctccacaggtctgcataatatgagaagcctaaacttagacatcaattacatccactgtgtttaaaggattcgcagatatatgattccttcagttgcagatttttaaaacataaaaagacggtaacacttaaacaaaagtgcaaacatactcatcagtgtgtcttgtgatcctcctatgaagtgctactgtcaaatcagttccctggtacagctcttcaagggtgcacataagttctccaactgttgcttgtggattatccaattgatcatgataaatcattgcacagctttgttcagcatcttgaatctaataaaataaatcacagttaatcaaaagttcaaattactaataaacaacacataaaactgcaggaaggaaagaatgatagttacatcacttacatttccatagaagaataacgtgtggggttttaggcacctcagctggttgtatctttgcaattcctgttgcaacaacggtaagaatagtggatacttcacaatgaagatcaattcaaactgttcagcggaataaccaccaacttcctctatcatgaagcatctgtctaaccggtggcaatttgaatgtcgatagtatttaaaaaatgtttctgggtcatgagccttttccggattgtcatcaacaccatagtttttgtgcttcagcgaagcttccagtaaataattcccttcggtgatttgaaaccatctgttttggtatggaagcttcttaagtatatcacgataagcagcatcattggtgtaggctaagacaaacctcatatgctcataagctttgaaatagaaaagtatcctgttttcgattggtatcagtggtgcataattgcagataagataaccatgctcatgtggattgtgcagcattagagacattaaagatctccagtcctctggtatttggtccatactgtaattcctgaatacagtttgacggatcacattacgaagatcaagataattttgacaaaccaattaatccgtcctttttgtcctggtgacaagccggaatcttatgtgtccagtaggggcaacccagatattagattcaccaaatcttgacaagcaatacccctcttcatgttgattgaataactccacagccattgatctgacacaacacttaatcctctccttaacaatccaaacattgagtttcttgtattctcccaacaaactacaccgagtgctgtctatatattccatcgctgatgtcgtgaattctctgacagagataaaatacttgtgatctggtaaatcaccataggaagtgcctatgtcatccttcattatgtcgtaaccctgagatagcatgctagtgaatgttaagacattgtataatttattcaaatcctaatttcattgaggaattctcccataacataaagggcattcacattaaaatctgaataaagggcctaagggacatttaatacactgctgtacacctagtttcagaacatgaacatctatctagtagctgtacacctagtttcagaacatatatatctagtatctaaaccacaaggcattttttctagtgaaacaagatgatcctttttacactt

SEQ ID NO: 33578 - DNA, 10933 bp, Oryza sativa
  unsure (1)..(10933): unsure at all n locations
aaatatatcagcctagtctcttcaaaatactcaaaggggtatttgcatgtgtgcgttcacagaagtgattgtgcgtgcgttgcgagcgcccgcgtttgtactttgtttaaaaaaaaacatcaaatattatttattgtttctcttttatttaatagataaaacaatagggaggggatggcagtgttgtgtacatgtgatggtgaggaggtggatattatatttttctaacttttttaaataatttaagtgaaagccaatgatgaggtgtttcattttttctaagaatttctaaggtttttccctttttataggacgtgacacacggtgactcaagattttttcttaaaaaatagatttaatagttaaaaataatggataaatcaaattaaattgatttttcttataatttaattacaagatctaatctattggtttattatagatctcgattacatgcatatacttccgtatattatgtagtattatattttatttttttatattatacaaaatcctatttttagaccgtagtttttccacggatactaagtacgttttttttttgctttatagtacgctttttttttttgctttattttatcgtacatagatgtctatttttttttcttccagctaacagtaggtagctttatatgttttttttaaaaagggagtagctatatttatggcgccatatttttcaccaaaaaatagtcggtatgtatttacattgtaattccctgaattacatatgcaattttagtgtatttataatgtaagtcccaaaattacatatataaatcctaaatttatatactaattatatatataagtggagtgtaactacagtgtaaattcgtataaatatataaataattattagttttacgatggaggtgaagtgctaatgagtttagagcttgattaggtgcagttggttctttcgcataagctgtaagatggggtgcagccttcaagtgcttgaaacgaatattactggacgatctcacggttaaaacattcgactgtacacaaatttagcaataccgttttttaattgtacttccctagggacatttattttttctttccttttcccagccaccggttgcatatgttttttaaggggaaaaactatcacctttttaataatagatctaatctaatggtgtaaataaacaggtccaccaatttaagtgaaaatcaacggtgagattagatagtgccacgtggcagcctaggagcgtttgtaggagtcccacgtggcggcttgagagcgtttgtagaaagttttatggccttttatttagtatataatatataatagatagatagaaaaaggagtctccacgttcactctcacgtactagaaattctcatattaatcggagaaaaagaaaaacagagtccatatagaaatacaatttagaaatagttgaaattcggaattaaaaaaataaggaatattggaagaggtgattagagtctatatagaaatacaatttataaataactgaaattcagaattaaaattttaaaaaaggaaatattggaagagaagagtagagtccatatagaaatacaatttataaataactgaaatttaaaattaaaaataaggaatattagaagtagagtatagagtctatatcgaaatgcaattaagaaataattgaaattcggaattaaaaataagggatattagaaatagagtataaagttcatatagaaatttaaaactaactaaaattcagaataaacataataaaattaaaattagagtttagagttcatgtaaaaaatacaatttacaaataactaaaattcaaaataaaacaacatgggaagtagagtctaaaatcaatatatgaatacaatttagaagtaactgaaattcaaaattaaaaattaaagaatattgaaacatgagtctacgtagaaatacaattagaaataataaaaatttttgcgaccagttctacgtatggagatggtggaagctgagccgccgtcatctccttgtccaccgctggcggcggcggcggcgacacacacctagcttcgcgttcccgcctgcttggcgccattcgggattgcatgatggtggcgaggcgtaacggacgtctccgattccgagtcgagctcggattgaagaattgtgtctgacagccacgctttgcttccttcacagacttcaattcgaactcggactcggctgccgataaatccaagcgcgccgcccccaccacaattccttccacccatcatcgcagcagctctcggcgctcgtccatggcgcttccccgccgctcgagtccccgctcctcgcgcccgatcatccaccgccgcactgagctcgccgtcgaggcgcaggggagagtggtctccaagaagccgtcaggatcaggatcgcccatcaacaagatgtccttcaagaagggcgacgaggtgcgcgtccgcacgccggtggggaggctagggaccacggcgctgcgcctcgtcatgtggctcagcgcggtcgtcgtctccgacgccgacgacggacacctcgaggtcatctacaacggcaacttcccgcgcgacgaccccttccgtgccgtgcgcgtcgccgtcaaggacgtcaagctgcccgcgccgcgcccggccccgatcccggctaatattgcggccccgcggccgaacaaggccggcaagaatctgccgcggctgaagatgtttgtgctggagaaggagcagctgcgggccaaatccgaggccttgttggcatcgtgatcagtgttcttcagtaggtgcagtaggtggaatcagaagcttgtaggaatcagaacatgtcttcctctgttctcggtttgcatggaaggcaatgcgatcttgtaaattctcgtagataggatgatttcttcgcatgagaagaagaacatgcaatctgtcaactgtaatttctcattgattatgaatgaaagatcgaggtttctcttcttatttctttttctttttcttttttaccaatatatgcaggcacaatgcatgttattccttggttttgttgatccaattgttaaagatcagaatcacaatgcagctgccctctgattgcacgtatgattacaatccacctgctgacaactttgatcttgtagctaggattcagcttccaattctttgcacgccttcgtcgtcaagaagattcatcggagtcagtaccaggttagccatgcgttagcgaataaagcacggtcggagaatgtctctgatttctggttggaagggtcttgtaactttatatcacagataatctgtgatgacgctaaatttgagtaatagatttacccttcctcgcaaaaaaaaaaattctttgcacgcctttggctttccttgcctttgttgagatcaagaaccaggatatgcagcaaacaaagcatctagctggtaatgtcattcatactctgaattggatattagtttgtgctattatgtgtctttttttttctgaaaggaaggcaagggccatatgtatttccctcactttggctctcaagaacatcaaacgaatcccaaaaagaagtacactagttcacaaagaaattagttgaggcggcaacgttactgtgtttcactttgttgctccgaagagtgggccttgggccagatggttggtggactaagattagggacgtatcgattttctcgactagtgggttcaaacaaacaaggccaatagaaaaacccagaaaccgaaggttaaaaaatttgagaaaaaaacgaacaagaaactattgttcagtttggtccggtctttgcattggcttgcgggttttttttcctccaccccttaagacatgcatattgaagaaacgagaaattataattgaccataaagttgagtgacatactcttatttttgtttctttgtttgtcatataattttaaaattcacacctatatgtcacattttacttcggtaaatccataaatgcccaaactttcctcctccctctggctagtatgttatgatcgagcttctctcctcgttggtagggatacacgctggacataaatgcatgtacgaaattaagtcgttggtaggggtagaaaggaagggcacggaatagacaactctaatttttatattcaactgttgattgaataacggtgtgtttagttcacgctaaaattagaagtttgattgaaattggaacgatatgacggaaaagttgaaagtttatgtgtgtaggaaagctttgatgtgatggaaaagttgaaattttgaagaaaaagttgggaattaaactcggcctaaggaatgtttccccttcttgtgaatccctttccgcttccgagtgcctactaatgcttcgacaatgcataaaaatacatgtgttggttcatattttacctactaggctactcgtacaataatagatttaaaatataactattattttagccatcaatcctatgaacctggacatgcacctttttggtctgcttaggttttttttaattattcaccaaattattgaaacatattgtttgctccaaattaaaaagatatgttgctaagatcacttgttttaaactacaccctccatcccaagaaaagaacaatccttcctataaacctagacatgtgcgtgtccagattcatagctgggattggttttttttcaaattgagagagtatttggtaagtttttttttcaaaatattcaatttatccatcaagcgaataattcatggcaacaatccgttcaataatctaaatcaaacgaagccaacatgcccatactatgttccatgtcctctttggtgatgagttcggtgtcagcaccggcttcgcagccatcggtgtccctccattgccatccacacgagcttgtgccatgggaagcaagagagcttgggcacggggcgatatgagcttgggcactgacgctggctgctgcgggtacgttcgcgaagagaaacaacgagaatacaagaccatgcataagacgctgaaagagatgagggcaattaatattaatctcgtctttgcacacatgacataatgacattgaggcgttatgagtgaaaacttaacagtaacacttgcgaactttcgatgacattgaaacaaccaattttccaaataactattgtgccccccaaattaaaaaacacacacgcagctagccaagatgtcgtgccaaatatatatcgacctgtgcttgagtattccagtagtattgtacagcagtacacagtacaggtctgagcgactgtggcgttgtgcgcaagtgaagacacggccgggccgtcgcatcgatcggtccatctgcgcgcctctttcttcacctgctgcggcagcgccaatgcgccatggccgacctctcatcacatccatcgatcattcacgtccatcgatcttggacgtgaatcgatccggccgctctggatgaatataatgctggttcgctggctggctgtggctgcttgcttcctgcagacaaggggcacaggcgaatctgtacttgcctcgagcagcctcccacccaatcgcagcccctccgctaccccgtctcgtcactcagcttatccgatccaaccacatctctacatatgcatatatatgaagtactagcaaatatgcccgtgctttgcaacgagagatctagtaagaggggttaaacgtttcgttgcactctattattatatgttttcatttttttagtgctacaaaaggaaaaaggtaaaagtcatctgtaatggaaaagaaacacacaccttgtagtatcgaaataaaatctgtagtggaatatgttcgaattttagaaataatttaatatttaaggaaataataattattttgacctgaaacaatctactgaatctactgagtgattaaataattgatcataatttcctagcaattttaaatggctcaaaatagttccaaacaaaattctgtaattttttaaaaaattaaatcagttgctttgaaaaataaactgattagggccttagtaagtttcggggacaacttgagggaccaaaactgaacttatccgtgcggagcgtacacgtggcccaattgtgtggcggcccgggaacggcagcccgatgcaggagaattcgcagccgtccgatctaatcgacggtcacgattgattcgtacatatataaaaggacggcaaccctaaccctaaatcatttccctcccctctctctctctctcacgactgcatcggcgacgcgcgcgacgcctttccccctccgtggctccccctctccctccccaccggggccgccgctccccttccccctccccccactggcggcgacgctccctttcccctcccttcttctctctctctcacgactacatcggcggcgcagcggcgcctttccccctccgccgctccccctctccctccccaccggcgccgccgctctctttccccctcccccgaccggcggcgacgctccccttcccctcctcccacaggcggcgacgttccacctccctctctccctcccgtctcttctcccttcagtggcggtggtggcgtcggctgcggtggcaacggccgagggccgcggtggaaatgatctggcgcccctctagcctccctcccgcggcatatccgccggaggtggcgacggtggcggctcgctccgccccctctcgccttcctcccgcggcggatccggtggcagtggcggcgtcgacatggaggcggcggttcggacggcgtggagacggccggccggacctcgcctccgccagatccggcggtgctgcggccaggacggcgtcgaggcggcgagccgggcctcgccttctctagatccggcggcatggaggcggctgcggcccggcggggcggcggcccggatagccggaggcaggcggtggtggcgtcggcggctgccgatttttttttttttgcaattttttttccatcgctatctctaacctaatcggattgtgtatggacgaaaaatcggacgaaattatatgtgatgaccggaaaaatacgaatatttatattagttatagatatatgtctctacatatacatatatatggagtatatatgttgacgtgtttgtgtcgagatgttgggttaaatctcatatcgataattgatgatgaaaaaacacaacttcaaacatgagtagttcttatccatgagactgtcttttggattgtgtaagtccacgatctaaagttatgactctgattgaatccatggtggaacagacccaatgtaacttgggtgatccatggttagtgggtccggcgcactataacaagtggtatatcaacttgtttaatttcgagatcagcttaaacatacttgagctcatagtcaaaataaatcgagtcaagttggtctttacacttgggtggcccataattagtggggcgggttacactctataacaagcacggtacgtttcgaggtcagctcaaacatactctatgggccaggctacacattataacaggtggtacaactagcttataacaagtggtatatcaactagtatggagatcatgtaacgtcccgccttcccccaggccgggcccgtatggagatcatgtaacgtcccgccttcccccaggccgggcccacttatatctgatagcttttataggtcatagactgccctcacagaccaacacatgtcttttctgcacactttgtcctcactcgtgtgcacccggaaaattcgaatcccaaattgctccaggcctagcacgcttaaccctggagttctttggagattggcttccggaaaagaagttgcaacttgttgatatgagtattctattaatcctattaagccctaggccgggatgttacagatcagcttaaacatactatgtggaccaagctatgcactataacacaagtggtatatatatcaatagtttcaaagtcagcctaaaatacaagacccctttgaatcaaaggattatgcaggaatttcataggattgaaatcctatagaaaattttctatttggccctttaattcgaaggattggagttttccaaattctataaaatttctatggaatgggtcattgcatgtaggttttggaggaaattcagcaagaggtccaacctcttgaagaaattcctttgagtctacctaactctctcatccgattactgtatttatttttcttgcggtctaactaaatgattattcatgtgtttttctgtgttttgtaattctgtgctttatgtacttatattcctatcagaatcacgtgtttttcccctttttttatttctacgatttaaaggggctcatagtcataataaatccggtcaagtttagcttaattttagctcgctagctagctcgacccaacatgtgggtgagcttgattagtgtatacttagtatataaggccacactatcaatttatgcttgttgttttgttatatttccaatctatttgtatttagttagtactttgctagctagtgtttattattttatttacacataataagttgaagttaaaactgttgaggtgatatgaataatctcagcggcggagccagggcccagctagcctcggcaggtgcccaagctccaccggatgtagccgtactgtgcagtcactaccacataaagggcctttggtgctggttgggaaacccccttaggtgccggttttcccaaccggcaccacgttggcggcactgattagacaaaccggcacctttgaggtatatgatttgcaaaaaaaactccggctcggctcaatttgagctgagccgatgcttcaaagcaccataaataaataaaaaagaagataaaacaatccacaatcagacaatcaacaataagctcatgatcaaatgttcatcaaattttcacattagacaatgaacaacaagttgatcaaatgttcatcaaattttcacatcattgaatcaaatgttcagacaatcatcagctcactaggtgttcagatccgaagaggccgctggatccaaagccccccgacgtcgacgtcaccgccttcgccgccgctgcctcacctcccgctagatctggtagaggggagggcgccaccgccgccgttgccccgaggatccaccgtcgccgggccaccaccgcctcccctccaccattgggccgccaccgccacccctccatgtcgtccaccgccactgcgcctcccctcccgcccctgctggatctggcggaggggagggcttctccgcccctcctgcccctgccgggccaccatcgcctccccttcatgccgtcagccgccaccgcgcctcccctcccggccctgtcggatctagcgcaggggagggcgcctcgagagcgagagacgagaagtcgagaaaaatcgaccttatctccaccgggtgtgagccccgccgggagaagaaatatctcatccggtccggctcggctcaattccaaaggtgtcgtttttttaaaaaaaaccggcacatttaattattataggtgtcggttctttaattaaaggtgttggttttctttatagaaccgacacctataattacttaaaagtgccggttttttgtgttttcggaccgctgaggtggtaaaagacctataggtaccggttttagcacttccggcatctatagtaccgacacctatttgatattttatagtagtgagtagttattagtttatgttaattaccatgcttagatacaagttcaggtgttcagccacatacaattgagtaaaatactactagtagcaaattacatgcttaatcaactagttctaatggatgagatcagtggatcagcacatatactagcaaaatgactagctatatacatataattaattataatgtctagtattcaacattaacaattaacgagttttatttcatcaatataatttcgtgcattggttgtcttctttataaattagaactcgatctatactaaatcatgcacgtggttgtatggatttaattgtagttctctattattaggtttgcccaggcttgtaaaaatttctagatctgccaccgaataaactagagctcgtaaacagcgctagctaataagcttaatgatagcttaaggccctctttgtttaggcttaggcttattggcctagacttttaagtcagcttattggcttatatgatttataagccagtgaatttaatgtcctaagtttagtggtggagtcatacatctatctcatataagctaaaaaagcttctccaacctagtttttggcttaggccctctttgtttaggcttaggcttattgggctagacttttaagtcagcttattggcttaaatgatttataagccggtggatttaatgtcctaagtttagtagttgagtcatacatctacctcacataagccaaaaaagcttcttcaacctagcttttggcttaatagtgttagagtggcttatggcttcaaaaaagccaaacggaaaagctgcttgtttgtttaggcttagacttttcgacttagaagttggcttataagcctaaacaaagaaggccttaatagtgttagagtggcttatggcttaaaaaagccaaataaaaaagctgcttgtttgttttggtttagactttttgacttataagttggcttataagtctaaacaaagagggcctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33579 - DNA, 751 bp, Oryza sativa
agtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaaggcgtggcaagccaacgttaagctgttgagtcgttttaagtgtaattcggggcagaattggtaaagagagtcgtgtaaaatatcgagttcgcacattttgttgtctgattattgatttttggcgaaaccatttgatcatatgacaagatgtgtatctaccttaacttaatgattttgataaaaatcattaggggattcatcagcactt

SEQ ID NO: 33580 - DNA, 765 bp, Oryza sativa
ttttttttttgaggttcatccgcacattttattactggggagattcagtacgatcacgaatcaccagagtacgtacaaaatacgggagggggtcaacccagaccacagactgatccgggtcccaactcacaccaatcttggctagattatgagcaacattattacaggatcgaggggcaaaggaaaccttcgaattagcaaaatgaagttgcagcagcatcttgatttcagcgaaaattgtagccccaacagcttggctatgggaggatgacgttactgctgagaccagaatagctgagtcagactcgatctccacctcagtcacaccttgcaccgagatggccaggagggcagataagcatgcccttgcttccgccgaaacaacatcatgaacgaattccagccgtccagctcctgccagtaatgcatgcccttcttcatcccgcagcacaaacccccaaccacccgtcttgcgatttgcttggtatgcagcatcaacattgagtttaatcttccctgcggggggcggtgcccagtgtttcatcacagcagcagtaacacgcgtatcaagcgtgtttgggtcagccatttcctaaaccatcgcgttttcactctgtgcacaactttctctggcagtagcccacgttccccggcgttgattttgtttcgggcaaaccaccagttccacagaagcagtatcacctccatcctacattcttcttctagtaataacacatgatgaaccacttctttagctgatttcag

SEQ ID NO: 33581 - DNA, 862 bp, Oryza sativa
  unsure (1)..(862): unsure at all n locations
nnnnnnnnnnnnnnnnnnnnnnnnnnnnnnnnnnnttactattgccagttggctgtcatgccatttcttaagcatggtgaagaatgataattttgcgatcattctacaaggcaaatcatctactgtctccgttcagaaatataaggcatattttgactgtccaattttgagctttgaccaactattaatctaataatatttacattttgccatgaaaagtgatattataggattttgagtatgcttttgtatccgtaagtgaaataatgtaaggaaactttacagtcaaagcttgtcttttggatcgtcaaaatacaccctttgtttttgaaaaaaaaagggtagtaaatagcttgatctggataatgtctatccctttatgctatgtaagattgcactcactgacttatttcctggactatggttccaattgttttttttttctttttcccattgtaggcaagtgaagcagcagaagaagatgataagtcgttgcttgtcgttgtccctggtagtgcctactcctgagttgggtagcgtggttctggctagagcatatgtatgtagattacagttggacattcttccaaagggcaccaatattttgtgcatatatttgttgcgtgtggccaagattgcaattgcactcatgcattatgattgcgatctgcaaccgtcttctgtttagtcggggcggcattttgggctgtgtaaggaatgggtgtgaaagaagaaaggaaatgtcaattttgttttcagtttttacccacacgaaacattggagaactgccacatgtttgtttgggaacttttttatttttaattttattaatagacttttacaaaaaaaaccatttccaag

SEQ ID NO: 33582 - DNA, 651 bp, Oryza sativa
  unsure (1)..(651): unsure at all n locations
nnnnnnnnnnnnnnnnnnnnnnnnnnnnnnnnnnnncacaataagtcatcatcattccctgaagcatttcatcaaattgcatttgcggtaacttggtcctcagtgttatcctatttgtaccattttgtcttcactacagaatttggaattctttgtgctgattttgtggttctgaaatttgtcttacttgatgaatcccaaaatgcaaacaaccataataacaaaagtgtcaaaactttcctggaccaggatgttgtgatattgaacaaaattgacctagtagaaggcagtcttgaggatttggaaaggcagattcatgaagtcaacgctcttgttacagtggtgcagtctgtccgctgccaggttgacttaaataaaatatttgatcagcaagcatatggtgccaaggtcaatacctagctcgaaacttgcattttgttatttctttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33583 - DNA, 7456 bp, Oryza sativa
  unsure (1)..(7456): unsure at all n locations
gggatgacgggtgggccccacccgtcatcgagggtggcgggcgggcccgcccgtcagtggcgcgcgcgcgggaaaagcccgagtgggccgcggggaagaggagagagggggagggaaatgggccgagccggcccaagagggggagggggggattttaaggtttttctttttataaaatcattttaactttgtatatttcttaataattattatttgtgctctgaaaattccactaaaatttatttacacattttaggcttttaggaaatatacaaaaatcctctaagccttatttgacttttaactttgcagattttaatttttggaggctttcacacggattttaattattctaagcataatttaaaggatgtattttagggtcgttttgggacgtgacaccattcgagagatacatgggaattctgaagtcctacgttcggaacagagcaaaaccagaggggagcatcattgaaggttacacgaccgaggaagccattgagttttgtatcgattacatggccgagactgatcctatcggagttcctatgtctcgccacgaaggaaggttggcaggtgtcggcacaactggtagaaaaagaattgttcccgatcaagcttcctacgcgcaggttcatttcgcagtgctgcaacatatggctgaagtaaccccatactttgagaagcatttagcgaaggtccgacaggacaatattggtcgatcagatatttggatcaacagagaacatggtgctcgcttcaacgaatggttcaaggatcgtgtagcacagtcgaccgatggcccaagtgagatattacaaaggttggcaaggggtccatcttgggatgttgacacatggcaagggtacgatatcaatggatacacattttacaccgtcacacaagatgagaaaagcacagtgcaaaacagtggagtccgtatagatgcatatcaggatcaagctggatcgagcacatactttggccgcatagagcagatatgggagctgaactatctgaacttcaaagtccctttgtttcgttgcagttgggtgaatatccgcacaggtgtcaaggtcgacaaggaaggcttcacattagtggacctggccaaggttggatatgcaaacgaaccatttgtactagcgaagcaggtcgaacagattttccacataaaagaccccgcaaacaagaagatacacgtcattagggatggcaagcaaagaattgtgggggtgaacaacgtcgtcgatgaagaagaatacaacaagaatcttcatgtcagacctcagatagaccttgacgatgatcccgaagacgaagtggcttacgttcgttcagaccattcggaaggcatatcactgtgaatgatcatctatgaaaataagtgcgttgttggatcggaaaatcagttggcataattgccaaggaatactcgcaacaaggattgttgtagacatgtcacaagggccttcagccgaacctgccgaaaccatcaaatcagcgagacgccaactgagtccacgaggttcctctcaagcgaagccaaaagacgaagtcaggagggttcgtcaccaagttcgaagggctcaccatcaagtttcccatccaggtgaagaagcaagaagggttcgccaccaagccgggagggctcatcgccaagtctccgctctgggtgaaggcctcagggtgaagcacaatgggttcgccccatggaagatgggtttcgctagggagaccagctagcagcatggcccatgaaggctgttcacctcttacgggccaggccaggggccaatcaaaggtcccatagttagaatggatactgtatgccccttttaatgtccctatccatataaattcccctgaacatattgaaccgtagagggtatgggcctgtagtaaggctataaatagcccaatagggccatgtaatgggggatcccctaaaaatttcataaattagcacgttgtttactattcaaatcattccaccaagagagccacgtcctttgacgtgaagttcttgtcattttgacaacaaggattagaatttactgttacaattaatagtttctttagttagggatctttgtagtgatttatgcaatagggagcaatgatattggtagaatcagatatttaccttacagtttgaaatcatcattaagtattgtttttgattgatcgtggaaactggcttgagtactgctcctgggactattatagtgctaagctaaataaagcccgtacaacgaagattggtacatgacttgtctctatcagtctgttgcatgaaatttaacgagcatgcttaggagttggagacgagggagaaatttaaatgatgagtgattggaggaaaaaataatactctagaattagacttacttttacaagttttgaatcctatgaaattacaattaatttattattatgagaaggatggagtaaataatggtccacggtacttgaacattgatagttcaaatattataggagcaaaatcaagagatagtaagtactataatgtgtgtttataggggtaaatttatgggcgctatcagcacatgcgtttgtaccgtgtattaaaaaaaatgatcagcataggtactcactggtgagtaagttgtaagccctcaaaaaagtgtgcaggggatgttccaccgccaaagcgtgttttcccgattcaatcattccatgtggttgttacgtgcatgcatagtgcgcaatagtgtttctgttgcttgtgtatttttttaagctctccaaacaactaaaaagagttttcatagagagcccaaataatgtgattaatgattgtcccattatgcagtctgaacatattagatgtacaccgaaatgcttgaaagaaaattatatttggtcgattaaaatctaaaaatcagttggcataattgccaatggatactctcaacaaggattactcaaacctctatgttgtaaggaggctacactaaatattttattattaattggtccaattagttgccaagccctttatgtatatgtaaggatattttgtgcattttttttaaaaaaatgtttcacgatcactataacatgcatggagtagaaacaattgacatactcatttgtaatttgtgtgtgtgcccgtatataagcatgcatacattcatggtacatcaatttggcacgtaggtgtagtttaatgcaagaattaatctgagtgtacgggtaaaacaatttgcatggcgggtacgaggttggtacaataacttaagaaataatgcaacaacattctttctatacacattcagtttttaagtaattattttgtcaatatacatggactaatttgtactaatatacttaaattttgcaattctagtaactaaagtcacttaaattttgggtttatagttgagagtgaaaaacaaattggtggtgcaaaaaggatgaggaacataattcttatatattaaattccagactgtaagctaatatccttcgaattgtgtaatgtcatatctaaagaagtggaagctgaaacatttcttgaaaaaagacgcgtccacgtcatcaataaaccttaaaacgtccggtatttttgtagatcgatgtgagccatcagattacctaaatggcgaaagatcataaatgtccgtcttgaaaattctattcatttgatattttactattttcccctccactcccccatccaccagtgttaaacggctcctcttctcctgccttagctgctctctccacaccgccacttttgcatcccctcgccgccaccgccgcctgcagccgccgcctctgactcctatccatcgcgccttggcagcaggctcctcgtctccctagccatactgcctccccatccaaaccgcaccgcgtcccccgtcggacccagacgcgcggagctcaagggcgctagactcggctaggctcacaacggttcaccgactcagcctactcgaccacaagctccgacgctgcctcctccccatctaaaccgcagctatctcatctcatcttacaccaacagcctctctcctcatcgccatcaatggcactgctgatccggacgatttctcatccaaatggttactatgcaagagggtttcttgaagagaccgaggaattagtgcatactaatcaccaacccgtgcgttgcatgggctattattattaatattataatattttagattctaattatagaaaattcattagatattttttaattatatcggtttaaacttaaagatatataaatcagatgtcaattacaacatggatagtataaactgaagaatcaaaagtattttcagtagtctgttattaactacaatagcctattgttaaatagggcattgttatttaatttttaatcgtacctatggtcatgataatacgatccaagtaagtactgaccagatttataattaatgttttagctcataacgagtgctctattagtttggtacactactacgaaaaccatctttcgtggcggtcattttgggtttccgctggcagaaatcgcagccgtcacaaagcaaaggccagtgaaaatgtcgatcttcgctagcagttatttaccgccagccaaaatgcatcttcgctggcggccgagaaaggaacgcccgccagcaaagagatctcttcgctggcggtagccttaggacggccgctagcgaagccaccgaagacatgtccttgctggtggcggacataacgcagccgccagcaaagaagtatctccgcttgcggtagccttaggtcggccaccagcgaagataattctttctttgataggaaacatattttcaaacaccaagtcaaagaagatagtagttcccatcccgggcaggcatgaattgaaataatagtttccatcccggataatagtgaatacatcctagcatttgccggcaaagccaagtaagcgtgatcagcgcttacccacaggaacatgaataaagatccaaattgcactcccatgactacacatgttccttgaataattgaaaactagaatcaaagaaccaaattgaaatcatattgcgcatccatggcaagcatggaacttgaattatttacccagaaccagaatccggaatattgaaacaagaataatgtcgtaaacataggataaacatgaaaacctaaatggcgtgaacaacaatatgaatataagcggtcacatgtcacatagaaatatatcggaaataaatagatagagcaaacaatccatgaatcacacaattagttcatcatacacttgcctccaaagaaaggttggtatcatgcacaatctgaaggaccactacctaatcacaaacaaaacctcagcaaacacattcaaacatgcatataaaacaatgaaaaaggtgaacctactgtcccatcccatcaaaacgcaataacaaagaacgccgtttggactataaacaagactgctgcttcaaaccttcatatcttaaaatatgaaaaggctatggccgcaaataaatacattttggaaatacgaaaatgctatgccattaaaatggtctaatttgcgctcgaaagaaggcttcacaatctgtccaaaatttcagactatccgcaccaaaacaatcaaaactggagttctactcgcccaatcagggtattcctgaccaatatggaaagctaagaaacacctctacaactttgtttataggcggcttgggtgattccactgtttaacccatccaaaaactattcaatctactactatccaaattatgacataaaaacaacagttatactaaaaaattcatatcgtctaaaccagttgagataaaaccgctctctttggtcagaagatagacataaatattatctacaacttcctaattatatacactttcacaaaaaatatcatttagtcctccgaaacttcgaaaaaccgaaacactgtaaatctgccaacgtgcagaacagccaattcgaaccacaacaacaaaactccttctctaaccttctttatccaggaattaaaccactaaaactaccatagaacaactgatacaacaaggggataagcctcacctagggttttccttctatatcccatgggaaacgacgaggaaactccgatctaacccctcctccttctcatctctcctcctcttcgttccgtttttccacattgcttcttgatccaagctatgaagatggagatctagggagggcaatttgttgtagaggggagatatgcgaacacatgaggaacaggaggaaggaggcgctggccagggagaggggtgggattcggtttcctaggttttaagggagaactaatgggcagggtttatgagccttctcatgttggcccacttataaagatatttttcttttatttatttctattaacatatttattttaacaagtcaacccaaactaaaaacctaaatatatttttttaatatacggggtattacaccttttcatgatgcctttgtgctatgtaagttttcctctcttcgggactcatcgcctttgtcggtgatatgggcatggggtctcaagaccagagggaggaggccaccccccaacaccacatggccctccctcgaggggagtctggcccgaggtggggtggcggccactccttcctagagactagatggaggaagctgccccccaatgccacgtggccctccctcgaggagagtcaggcccgaggtggggtggcggccactccttcccagagactagacggaggaagctgccccccccaatgccacgtggccctcccccgaggggggtcgggcccgaggtagggcgacagccactccctcatgtgactaggggtcgggttcccccgacgccctccgcgagtcgccacgtgcggtgggttaggtggccaccttcgagcgctcacctacccgcattaatggtgacctaagtaggcgcgccacgccacatttaatgtggcgtatagcacgcctaaattggtctgtgaccggtcgaatgaccgacgggacccagggtgtcaggcgcactatcgcatgtgtcagggggcgtacatcccgtcctgtccagtcagtcatgatgatgagaggtcttagcctcccatcccggccagagtcggttcattcgctctggtcaattagggttcccgtttcccagtgcaaccaggagcccagaagactacacaccttaaatggtggttgacaggggcaccccccgtgttaggcggcaagatttggcaggcctcatcatcaagatggtatgcgcttgcttcccaagtcaagagacaagacaggcatttaatgcaaagattgtaatccttctccactaagttgtgtttttgggcccatgtggtaaccccttgaggtataaaaggaggtccaggcctagtaagagagagagagcttatgcccctgatgatcaacannnnnnnnnnnnnnnnnnnnnnnnnnnnnnnnnnnn

SEQ ID NO: 33584 - DNA, 2744 bp, Oryza sativa
  unsure (1)..(2744): unsure at all n locations
nnnnnnnnnnnnnnnnnnnnnnnnnnnnnnnnnnnnacctaagtaggcgcgccacgccacatttaatgtggcgtatagcacgcctaaattggtctgtgaccggtcgaatgaccgacgggacccagggtgtcaggcgcactatcgcatgtgtcagggggcgtacatcccgtcctgtccagtcagtcatgatgatgagaggtcttagcctcccatcccggccagagtcggttcattcgctctggtcaattagggttcccgtttcccagtgcaaccaggagcccagaagactacacaccttaaatggtggttgacaggggcaccccccgtgttaggcggcaagatttggcaggcctcatcatcaagatggtatgcgcttgcttcccaagtcaagagacaagacaggcatttaatgcaaagattgtaatccttctccactaagttgtgtttttgggcccatgtggtaaccccttgaggtataaaaggaggtccaggcctagtaagagagagagagcttatgcccctgatgatcaacaccttctaccccaacaaggagatcttgtaatttctcacaagatcagctaagcacagaagtagggtattatgcttctcagcagcccgaacctgtataaaccccttgggtcagatctttttggggggttcaaccccatcttcacacatctacacaggaatctcgaatctcacccgctgccaaaccaaaaaagagggacctcacggttccctggtggaggagttcacctttcgacagccttgatgtgttccggtagcttcttctcgtctagcgtgtatgtgtggttcggcttacttatcatgcacgggtttaggtaggcaacaggcttttttatcacttcggcctccacgtaattcatcctgccaacaatggatgatcaaatgagctacgcatataggtgtagtgatctattaaaacgttcaagtctagcacttacagacaccagatggcaatcaaattggcgtccagcctcttcctacagtagagggaatgcatatcggagaaatggacttagagtagacaaagacctctctagaagatgttctcccccacagcaactgtgaatgatgaaatgcctttcatggtgcttgccctaatgtaccaatcgtgccgccttcttagttgccacggtccttctcttagtttccagtcgtaaatgaatggtttgtcattctcaaactcgtgtggctcatctagagaattgatatagttgagatagtgataaaaggtatgtttgaacccttttaattttcttttatcaaactcggcatttacgatatctttctcctttcctcggaatgccgttaccatatactgtttcttggacgcactttttgctttgtgcttgtgcgtccttaccatcactagcacatcggcatccttaggttcctctggttgcgatggctctggttgatcaggcattgtctgttcaggcaccgcttcaatttcacccgccgctagctttgtaggctccgcttgtacaggctctgatggttgtgcggaagacatttgtcgtattgctagctgtgattgttgctttgcaagcaccgattgttcttatgcatcctttttagtcggaggtgatgcaacaggaggctctgatcctggaggtgatgcaactggtggctctggtctagggggtgaagcaataggactatccctcggactagctacgactagtggacgtgatgataataccgatatccttggtggacaatcagttccttcagttgaccctagttcaatatcattcttgtgccatagtatgaattggtcgacggcatctccaaggtacacaatctactcagtagttggaaagtcgagcgcgtgcatccagtaagcctcaatgaccgtccggacctctaccttggcgtagtcatccggaatgtcttggcaatgaaacctgcgacctggtatgaacctcccagttgcaacgagtattttctttcccgccctgccgaccggaatcaagagcttgcacggagtatcctccgttacatcatcgaaaggatagctcagctcaggctctaaaacagcagcaccgtgcatcattttctgactccagtatatattgcattcgtcacgagctactgccctagcctgagagtcaatctcttccctgtagcgatcacgcttcttgtatgtatgagcatcctgtttgaatccatccttccagctagtctttgaggatactccccgtacacggccagagtgctccggtttgcccaaggcataggtcagctcgtcccagtctctatctggcacaaacgtccaggcctgttgctgcgtgatgatgttcttcatcttgacagctacctcctggagcttctgatccttgaatactacatccccctcagaggtgaaggccggtgttcttgcacgcacccagttcctgcttcgtgggttgtgatttttcataggaatcggtttcccagccttctccatctcttcatcttgttttgccatttcttcaccgcttgccggtaaccggtcgatcccaaatgatgtggatattcattccttcttgctagctcagccatcttctagctcttctccttttcttccgccgatgtcttaagggcaatgaactcatcccactgggcctgtgttatccttccgtagtccttaaacggcgtgagtcccttctacatatatttcttatttaggtctattttccagtttcgccacagcttctccatagtcttcaacgcatatt

SEQ ID NO: 33585 - DNA, 11283 bp, Oryza sativa
  unsure (1)..(11283): unsure at all n locations
tatagggcgaattcgagctcggtacccccttctacatatatttcttatttaggtctattttccagtttcgccacagcttctccatagtcttcaacgcatattccttggctttatcgtcgtctgtcccctctggatattcaaacttgctttgcagtgacgtccaacagctgttctttctactctctagaactttcttccaatccttccatgtgatctccacaacattccttaccaccgccccacattggttgctatacttcgaatatgagtcttccggtgacaagggttcccctgtctcactcatccgtgtcagcacacttacttccttcaatagcattttcttccctcgctcgcccctccatttcttgggtttgcttgaagctgttgtgcgcacgacagctgtagcttcagcttcaggttcggttgcggcttgggatttccttttggagcgacgtggagcattcttctatgtttgcaattcacgtggtttcaattaaaatccatagttcgtggttaatatgattggaactaaacatatattatatgctacgtaccaccggttcagggggaacatagtcagagtcaacttcattgtcactaccgccctttctcttctttgcaggagaaggatgggggtcactcggtgagtgatacgatctactacctggttcacttgagctcgacgaagattcctccgcgactacttgcgtgcaaatttcttcctcgatgacggcctgagtttccttgcccttgtcacccgtgggttgctcttgggtgggtttgtccattgatatcctttgaaggtgaatatatgagattggtaacgacaactatattacgatggttgaactaaattatcatcgtacatctcatggttgaaccaaacatctcacaatgtttaattatcaaaaaacatctcaccatttcaaactacctaattaagttccttaattatcaaagaatgacagatttcgaagtgcatggaaaattttggtgtctaggttggttccgtgcatggactaccctgaccaatccaaaaaaattccccatgcacttcgtattctgtgatggcttgataacctaggaactacattaaatctacggccaatctatcaattcatccatttgaactaaattttaaaccctaaacctaattaagttccttaattatcaaagaatatcttcactggtgtcagcttaagagggccgccagagaagatatcctatcttccctggcggccatcttaagttgatcgctagcgaagatgtgtttccgctggcggcccttgaccccccgactccaagattttctatgctggcggtttttccacatagccgccatgaaaaatattttccaaacgccatgaaaaatcgattttctagtagtggtataagcccgattaatagattttatatgtcgcttaaatattagagaactactatatgcaataaaagaactctaaatctctaccatttgactcaattagttgaaggttaaagaaaattaatattaaatgacactgtgccccatatttgtgtttgagaatgtttgtaagaaaaaatttgtagatatatcttttcctatataatattggcttgaaaatctatctagcatgaatacaaatgggtgcctgagggccacaaatattcatgactaactgaatcgaagcaaaccttcaaatagtagtatttcgcattttatttgaattattccgtagaatccgagactatctgtctattatatactaaaagtccatgaaacttcctagaaacgctctcaagccgccatgtggcgttttacaaacgctcctaagggcagtcccaacccataacactaacatagacactacccttccaatgcaaacaccactattccatacttcaatttaatgctacttatctcacatgatgtcttggatgttgtgtagaaccatgtctgatgcaagacatgatttccttctcttttctcatttattcacttgccacatcattttttatcctaggtggcagcttatttaatactatggacaccatcctagtcattgggttgggaatgccctaagtcgcctattagatcgatctcttcccttcccctgccgtacatgcatgccactgtacgtatgtacgtatatgtgatgcgtattccatatgccctccccttttctcctattttctaacaactcaatacaaaatagtttaaattttaaatagctaaataagcatgattctcaatttatatacaacattaaattcatttgtgctatttttatttgtaattaaataaatacatcaagatcggtattgcatatattttgcgaaggtaaaggaaaaactgaaatacgtttggacatagaccctagcgtcgcagtcattaaacaatataaaaaaatgacaacaactatatcatcttaactcattctatatataaatatgcacattaaattaaatatcatgtaggacccaaaccatcaccctgcacatcttaaaaattaagaaatcactactacgaaaatatctttcatggtggccattttaggttttcgctggcggtttttgcaaccgccacaaagcaaacgccaatgaagatcaaaatctaccctagcggttatcggccgtgagcgaaaattgattttcgctggcggttgtgttataccggccgccaattcaaattattcccaaatccactcctcgattcacaaattcacataaatttacatcaacaatttacaataaaaacagtcaaaatttttcattcacaatcaacacaaatccacacaaatcataagatattttccattcacaagccacataaatccacagaaatccgagcaccaccgcccgcggcccggtggcgtccgtcgtgacgaggtcgaggccgatagtcacgctccaccgcccgaggccccagggccgtgctccccgcgccgcagccagggcggatccgtcgttcccctgtccgtcctccccggtggcagcttcctcccctcagacagatctgggagaggggagaggatgggatgggagggcgcggcgccccagtagagctagctgcggctgctctccctcttgtggacactcctgacatggaatccgaggtaggacagcgagtcggtgaaggacagcacgcacaggatggtcgtggtcgccatcgtcgtcacttccttcgtgttcgtcgtcgccgcagcttccttcgtgatcgccgtcatcaccgtcgccagttgacgtcgtcaccatgcacatccatgccacgcccctcccgccgtcgtggtcgccatcgtcagcgccgcgcccctccggccacgcccctcccaggtggaggaggctgggggcgcagccgcgcagggaaggaggagggtctcggtgggggaggaggaggagagggaggtgggtgganannnangnnnntngnnggnnaggagatngagaagagaggggacagtgggtggttgaagggaatatattagtgcgcgtgattttaaatgacgttgatttttttttagcgggctttgttttttcgctggcggaactgtttagtaaccgccagtaaaaatgttggttttcgctggcggacatttaagaagtacgcctaaaaaaatagagtattttttatagcggacgtcttaacgtggttgccaggaaaaataggttttcgctgacggtcctatacccccacccctcttgatgtttttgctggcggttttagcatatatccgccagtgaaaattatagtgcgacgccatgaaaaattgttttcctagtagtgaatatcgttgaaattctataagaaaaaaaaagcaaaacatcctaatatcattttacacttaaatcggcaggcgtattattttcacccattagatatatcattctactcccataagccgctacttgtcacatgttaaaaattaatagaaattacatgtattctaaactaagagtccataaaactttctagaaatgctctcaagccgccatgtggtgctctacaaacgctcctaagtcatcatgtggcgctttaataaattggaaaaaaatcctaaaaattttaagaaaaaagaaaaacatctcaccattggttttagtggacccattatttttaaccattagatcaattttaaaggaatatatactcaatccaacctatgggcctattagatcgatctcacagaatatgtagccttcccttcccctgccgtacatgcatgccaccgtacgtatgtacgtatatatgtgatacatattccatatgccctccccttttctcctattttctgacaactcattacaaaatagtttaaattttaaatagctaaataaccatgattgtcaatttatatacaacattaaattcatttgtgctatttttatttgtaattaaataaatacatcaagatcggtattgcatatattttgcgaaggtaaagaaaaaactgaaatacatttggacatagaccctagcgtcgcagtcattaaacaatataaaaaaattgacaacaactatatcatcttaactcattctatatataaatatgcacattaaattaaatatcatgtaggacgcaaaccatcacccttcacatcttaaaaaattaagaaatatcgttgaaattctataagaaaagaaaaagcaaaacatcctactatcattttacacttaaatcggcaggcgtattatttttagccattagatatatcattctactactcccataagccgctacgtatcacatcttaaaaattaataaaaatcacataaattctaaaagaatgaagcatccgacctcgataaaatcattatttcagccattagatctatatttaaagaaaaactttaaaaaacaaagtgccatcccattccccctccccctcgattaacaaagcgccatctttatattctgaaattataaatatatagtaaatgaataaatatatcgttggagtatataaccatactaacaaaaacagggagtagggaaattgtcattaattaactcaagttgcacgcattagatttttaacttatgtggtatgaaaactattctacatggaccaatgggagtgctagaaaggtccattaggacacttccaaggttacatgtggccggtgatggagacaaccattaataaaaattcatactgaaaagcataattttatagcagagagtacatgtctaatatcatatcacgaaaagacaaccttgcatgagaaataacatacaaaatataacttaaatgattatctcaactctccattgtactatgttaggagtaactttgtctaatgtggtcaatattgtggatggcagtaacatccttaactctcctaagatttatttcgaggcctaacaaattagaaaacaagccatagcacaatggggccatagtaagaatgcacggggtttgtgcgagtcaggaatcccgacaatggaattgcctaagcatcaactctattttatactaacaaagaattacattggactctagcaaatgagataaaagtccgggcatggccggcgttgtattaataaaattgccaaagtatcaactcgatctattttgtattaataaagaattgcatagcaactaactccactgttgaaaaataagtttgtcgtaaattcaagattccacaattttggcgaattttaatttagattttatgtgttttaaggatcgttacaaacaaaatcataaccatatttcagagcaatcccaaatagatttttgagagaagtatcataggtttaaaatatgataaaaaatccaagtaaaaatcagccaaatttatacattcataaatctatctatctattatatactaaaagtccattaaacttcctacaaacgctctcaaaccgtcacatagaactacaaacgcttctaagctgccacatgacactctaataaattagatttatttttcttaaaatatgatggtcccattattttataccataaaaaaataaaaaattgaaaggcccacattcctctccttccgacctgtacgtgtagtacgcacgacatgctaccatacgtacgtacgtagatgtattggcccctccttcctttctgtttctatctctcttatttttcttattttgatgacccttctattcctatctctcctattttgatgatgtggtagattgaaaacatattgatgtgttcgctggaggaagttgggaacctatcactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatccttagttccggttcgaatgctgtcaggacctgttaggcccccccgggatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacacttttttttctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaagactgcgaaagtgaaaaggaggcccataaattggacaagatgttggaggaccagagaacttcgttgtacccaggttgcgagcaggggcacaaaaagttggataccactctggagttgttgcaatggaaggccaaaaatggggttagtgacaaggcatttggcgatttattgaaactcgtcaagaacattcttccggggggaaacaaattgcccgagacaacgtacgaggctaagaagatagtctgcccgttaggactggaggttcataacattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggtgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccattacgatgtgtatctacaacctccccccctggctatgcatgaagaggaagtacataatgatgccgattattattcaaggccccaagcaacctggtaacgacatcgacgtgtacctaagaccactggtagaagatcttaaacagttgtgaaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatgatcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaataacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttcgatgtattgattatccatataaatcaattgatgtatggcatatgttaattacgcacgattattagaggtttcaacaagtttaaatcatgtatatgttagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtacatatgatgattacaatttttattaattttaaatcatgcagtatgtacattaatatcttaattagagtttttaccaatataataatatcattcatatatatgctaagaatatatatatattggaatttttattaattataagtcatatatttgcttattacgatttatccacttaatttattacagacaaaaataatttttcgaagtaattgtcatcaatctttgtactttaaataatgttaatgcattaacttctattttataaacacatatgtaagcgaaaatcatatgcaatgctataatcttcagtcccggttcttaaccctaaccgggtttaaaaagaatttcgaaatagcgggaaaagatatttactcccggttgttgaaaacaaccgggactaaaaatcttttctttact

SEQ ID NO: 33586 - DNA, 12535 bp, Oryza sativa
tcgagctcggtaccctatatatatatatatacatgtatatatatatatatatatatatatatatatatatatatatatatatatgttacttcgcatttatcctaatacattttttttatcttgcagaaaagacgtgttgtcggagtcgtccgtcaagcctgagtggaagagctagccctaaaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggatgcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctaaagaaaatggcagaacaatttcagagcttcaagggagatctgtaccagaagtatatactgaaggggcagacaccgaacttcgacacattcccaaagctaagggatcactgggacgagttcgttgcatataagacaggtgaacaagggaaggcgatgatggaaagaaacaaagaaaatgccgccaagaagaagtaccatcaccacttggggtcaggaggctatagtgtcgcgatgccgaagtgggagcagatggaggctagcttgattgagatgggtatcgaaccggcaacagccaattggccggaacgatcgaagttctggtactatgctcacggtggaacgctcaacccagctgatggctcactggtcttcggctatcagatacaagaggctgcgcgacgactaacagatgcagtggaagcctcctctcagggcacgttccgaccagacagagatagggacgagctgacactcgccctgcagactccagagcatccaggacgaactcgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggagatggcaagggaggtcgatgaacgcatggccgcacatcggtcccatgatccccagccgaccattcctcctgcaatggtgagcccatcaggaaaccgtagcagctgcgcctcaacggggcaggtaggatcacagagcatggacgccatgcaaacacaagacgaatcgacctgtcccgtgatgacatcactcagcggacaccatgtgagctgcatattcctttgaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactccaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccaccatctcctcctcaggatcctgcaccgtctcctcctcatgctccgccagcaccgtctccaccttaggctccagcatcgactcctcaggatcctgcaccgactcctcctcgtgctcctacacctactcccccgcaagctcctcttccggcaccttcaaagtcaagggcccccccagctccaccgcttgcccacacaagggcaacaaagaaggcgaaagttgacgccgccaagatcaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagagacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtaggacttggtatcggttccgtcatttggtccgcggcaaatagagagaaagacttaggcggaagttcaaatttccagtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatatatgtatgcatatatatgtattgaaacatatatatgcatggtttatatatatatatatatatatatatatatatatatatatatataaaccatgcagcaagaggggcatgcaaaaaaaaaaggtcagctctatctttagtcccggttatttcacccgggactaaagatagcgatctttagtcccggattggtactcccggtttggaaaccgggactaaaggggggttacgaaccgggactacaaagggtttctccaccagtgtatctcagctacggaaaacggagcggtccattagcgcgtgactaattaagtatcagatttttttttcaaaaatggactaatttgatttttttaaaaaacttcccatatataattttttttttacaaaaaacaccccgtttagcagtttgaaaagcgtgctcgcagaaaccgagggagaagggttgccaaaatggggtgccaaacacacccataagactatacaaactaagggcccctttgaatcgtaatcgtaggaatgaaaaaacggaggaataggaaaacataagattctgacaggaatgtaagtataaaatagagaattgcaaaacacaggaaaaatacaggaatgatcgtttgattggaccccaggaaaaacacaggaattagatgagacactactagaaaaataatttgttgccatgaaaaaaatcgtagcatcaatgctaaaattgtggcaatagatacatgttgccacaatcttaaaatcgttgttagccgtggtaataaatagcgtggtaacaggttattgcaacgatttttatttagttgtaataaaatttgatattgccataaaatggatgtggcaaaaaatatatattgcaacacttcacatggttgtaataaataactattgccaccactctatgtgtggcattagttatacgtaccaaattaaatgtctcaatattaatttatcatcctaactatcttcttttgatatcttgtcatgttcaggattcgaacccaagatctctcccttacgcgcgctctccatgaccaactcacctacgcatcagttttgtttaaaaatgcatacaattccatttgagactgcctaacttagatttgaatcatgaatttgagtatttaaaagatttcaaataaaaaatttaagttgtagatctcatcgagagctataaatttcatataaaatttatcctaatccgtgtccatatgaaaagaataagtcaaattatgagatgataaattttttattgcaacgaactaaatgtgtggcgatagaacatgtttttttgcaatagtaatgttttttttggcgatagctcatttcctattgcaacaaaaatactgaataaaacaacgattgtaaatcgttgcaacaaaatatagttatttgccacagaaaaaatatcattgtgatagtataatatattgccatgaattatttttcgttgtaataaattggtggcgatagctcaaccctcttgtagtgagagagatagactcaaagaattcttaccaagaggttggacctcttgctaagctttctccaaaacctatatgcaataagccattccatatgaattttggaggatttggaaaacttcaatcctttgaattaaagggctacataggaaaaattcctataggattcaatcctatgaaattctttcataatttctttgattcaaatgggctctaaaatcatataactatttttttatgcacttctcgtacgtttgttgcataattcaagacccaaatcaactatatttaacaagtaactttggactagctattggacactcgagacacaatttttagggaaatcatagagtttaaaacacttgattgatagcacctagcttatattagaacatcatgaaacacagagaattaattaataagacttaaatattaagtagtagaaaaaatatatcattttggttcacgaagattatatttatgtttaaatatatataactctaaacggtaaatccgttaattggatctatctcaatctatccgtagcctcatctcccatataatttatctgttaataaacaatgatagtctatatcaatcttactgcttaaagataaaagattattggatttattttttttagaaaaatgacacataaggtgtaacactatcactatgtatcatatagtaaaatttgaactgaaaataagatttgtataaaataacatagaaaatagaaaaatctccatagagtgtaaattgaaccaatctatctatcactacaaacgttctcaagccaccacgtggcattctacaaacactctaaactcgccatgtgtcatgtcctaaaaatcagaaataatcttataaattctgaacaaaatgaaacctatcagcatcagttttaagttccattatttatataagttagaaaaataaatcgcatgcacctcctcgcctactcatatgcacataccactacctgtcccctccctatttttagctattaaacaataaatatataatcaataatttatatgttagaaaaccataatatttaagatgcacgtttgatttttttctctagttataattaaaccaagaatttaagatccgtatgcttatattttcttatatacaaagtatgccattcgcccatattcgacctacatgctttgtatattatacaaataaaattgaaataccttaaacaaattggctgcatatattacgtcattatacacgagtctgcaaacaagctaaattaaataaatagtataactacaaaactatttttgtagggtgaacacccctgcccttttacatgttactggaattgccgtaaaagaattatgaaataatccaacaacacaggttgcatcatcatatgttgtttttgcaaacttgcatagctaaattaggtagacattatctaagtaaatagaactaactaaaatatgaatagcaaatccaatgcccatagttagagaaaacaaagtccaattatttcgtgaattttcttaaatgtgctgaaataatgcaagccagctaaatgatctttcgtgtatttgctctaaactatgttaccatcaaattaacattgtgtgtggttgtggctttctacaccttcctggtaattctgtttattttctttgtgcatagaccattcaaaaggtaaatcaactatatgagcattaataatctatgaatatacacttgaagcattaactttggagtccatttagattttaatgtgagaaaatcgtacggtaggggaaaaaggaacaatgagtttagctaggtcttactttttcactaaccccaaaaactaatgaaaataaaaaccaccttgattttaatatacaattaatttgttgaacatgttctaaacaaactaagtctactattttttatatagtgataaagattatagataattggttatactgataaattaaatattatatagtatatgacttagaggaattatcaaagtgatgttgacgaagaatatttatcgaggaaacgtacttccgaaagatggtagaggctatctggttaatatgatccgttctcaacgcagcccacaatacatgccagcgcgcgtgcttgggctaccttcctagttttttaccaaaacgaagaaagctattttccaacaaaaaaaagaatacagaagtacgcaaaaagtcaacgtagcaaagggatacctatgaaaatagttttttaagtagttcaattgcacattacacaccccagcgtatagagaggacatatagatcgatatgtaagttccctgcttcaaaattattatgaaacaactcattctttggtgaactagtagatttttactgtcagtcgaccatgataaaacaactccatcgatacgccaaagatcgtaataatttcaaacaaaattgaaaatatgttccagaaattatatgtacagtaacatcaccaaagggaatatataacctgtattttaatttcttgccatgattgcactgttgttgacagtacgttccatcatcccacatgcatgtagccttgttcctcgtctactcagttgtttatttttattctgaattaaaataaattgaaaagttgttagtaccatcgatgaagccccggccaggagctgtcgaacctgaaaatcatgatcaatatggtggggctgaccgtcttggcggacgattccgtcgaatggtcgctcctcacgacgctgtcgcggttgcgtatcgtgctgcccaatccgccattaattccaatcagcatcagctaggctgctacgtacatacgtggttagcacatcccgatccgttgatataacttgagataggataggatacgtacagatataggtggactctctatacacgttaggttcacttaaaaatgccaatgataacacatagattacaatgtacggtcaagattttataatccatagatttagatttttctagttaacatgcgagctaaaaaaatgtccagttagtatgggtatacatagatggttggaacaccaggatttgatttgtgttcatagataaaggtatatgtatataggtagtattgattggatctgttgattcaatcaattttaattttagggttaaatattcttaatgacatacatttttatccagactacccattgttgacattctaatttttcagcaagtttataatcttctaaaagtttcaaatttcactaatggtaatgataaaatgtactacaccaatgttaatgcaaaatgaattgtccatggcagtttcaacagtttcttaggatgttagcttgaggagttgattttgtttactgaaatagagtagtttaaaccttaaatcagtgattttagtccagccattcactttatttgaagatatagtcattgatacagctggagtaaacattaaattactacctcggctgccttaatatgctgtggctgtgaagcagaacatatgcatgttctttggagtagtatatgacaagaattggggaaagaaacttattagtttttctttactactactctcacataggcataacaaaatagtgatattagctgttgttttaacgcaaacttccaaagcaggccgctttactaaatgttattactttgtgataccattactttcaagtttcaactatatatttatatatttattatatactccctccatctcaaaatataaaaagttttagggttagacacggttattaataaagtacgtagaagtgagtggtggagggttgtgattggatgagtagtggaggtatgtgggaaaagtgaatggtggagggttatgattggttaggaagagaatgttggtagagaagctgttatattttgggataaatcctaagagctaaaagttattatattttgagacgggtgagtatttattattcgaatgtgaaatgaaccgtacagaataacagtggggctcttaccgctgtggaaaatgcccacggcatgattgatatgggagggtatagctgatcgcatccattcagataacatatttgtttgcggattcagtcaaggtatggaaaactaagttttccagagctgtgggaagttgtaccatcaattaagtattgaacatattgtcttgcatgtgctctcacgttagtaattgtttactctatgccaagatgctacgtggtgagtcacataggtgtttggataggacttaaaacttttaaaactttttagtccctatcacaacggatgtttggacactaattagacgtattaaacgtagactaatgacaaaacctattccataaccctgaactaattcgcgagacgaatctattgagcctgattaatccatgattagcctatgtgatgctatagtaaacattctctaattatggattaattaggcttaaaaaaattttctcgcgaattagttctcatttatgtaattagttttcgatgtagtctatgtttaatactttaaatcattatccaaacatccgatgtgacatggacaaaagttttatccctagatccaaacaccaccaagactttacaataatcaaggaaggtatgcaactctgtcgatcccttttattcatctagtttagtttattgttcatatggtgtaaccgtgcaaccttaagagttggaactacgttactattcgaaaaacaacgaaccaccaaataaaattaacccaggataaatttattaggattgaaatgtattattatcttatatgaactaatttaccaagaatatttttatatggaatctgcacatcttatgtagtcagcttaatgtctttatctgaaaaaaaaagctgaaatgaattctgaagattttcaatgaatatattttaggcaaaatcgtatgaaattaagcaaagtttgaaactggcagcacatatcgagggtatcaaagttagcgagatgatgagggcatgtttttcaatcctgtatcaccttggtgcttgcaaatattcaactgtatttaccttttcttttctttcagtgaacttgataacatcaagagcagtaaactcaattactgatttatttatttattttgcatgtataacatctaaaaaaaagattggaaactactctgaatgaagcaaggtatgaaaagcacatgcagtcagccttatttggttaatgaaaaataaaataaaattaagggaaagctatcattacagacggtttggcttacatgaaagtacatgaatttgaacctaaatcgtattctatcatggaatttgacttgctgtttgtgctcatataaagctaaattagttggaagtgtaggatcgaatcataataactaagccaaccagagagggggtgaatggttggtagagaactcttttttctgcccctgcaaagctaattatttgtaattattttggttcataacttgtatatgtatcaatggtttaggcaatgaacacaacaaggcagagcggattacagagggaacggttggcttgagagttaatcatgtgaagtatgacggtggtaagaatgggcatcaaagaatgacaagatatagtgtgactgtttaggaaatatagtagtgatagtctttacgaccccttctttttagcaagaaacataattacaatgaaggatcacatcaaaacaagtcacctcctatattaattcttttctaccttcaacaaatgattttactcattcatcatgtgacacatccaacgatcgaaaattatctgatgacgtcgatcaaacggctccccacctccctcccgattcgatccagatcacatcgcttcgcctcaccccagcaaaatcaccgcgccctccctcctcctctttctatctttcacgcgctcctgcccatccgcctcgccttccactgccctccatctcaccgcactcctcagctcgcttcttcgtcaatccgccttgcatttcgccaccctctatctcgccgccgccaccccccatccacccgccggcccctcctcctatcgcatcggtctgcgcctccgggacagttaccggccagttcgctattgccggagtcaccatcccgcacccgccgcatcctccctcccgcacctccctctctcccacacccgtcgccaccgatccagctctctactggtagtagaaaataatctagaccgttgatctcaattcattaaaaggttgagatttatttctattaccacctcacttaatggtagtagaattgtggaaaaaatatctgtgcagggtataatcattctttacactcgctaactgctctctctctctctcgttcattccttagtccccgaaatccc

SEQ ID NO: 33587 - DNA, 2680 bp, Oryza sativa
  unsure (1)..(2680): unsure at all n locations
ccgcaaaaaaatgaaaaaaaaaacgcagtctggcctatgccgccccgccccccctctcctgcgtgcgacacgtgcccagtcgtgtgcgcgaattagggatcgctccatggcgaaaagttcaggacacacgcatgggtttttgctatataagaatctagatagatacctcccctgtgatgtgcaggaagccactcgagagctttctctttctgtgtgtagtgtgtgcaactaggaggcttgttccatactagtttgctaggtcatggaaaagagcgagattttcgtaggagcacactcatatgcagctatatgtgcttttacactcatcataggatggttagctcactgggtatacagatggataaatcctccatgcaatgggaggcttcctccgggctcaatgggcttccctattgttggtgagaccttccaatttttcagaacaagtccatcaatagacatgccaatttactacaagcgaagactggagaggttaggattcaaatagttaataattaactttttttggaatcagtatgctatatatagttaaactttaggagaaagaacattgttgatatgaagacactattgctctaaatatgaacaacacacacaataaatctaagttcggtgtactgaactatcaggtatggacctatattcaaaactaacataggaggccagcacgtggtcatatcccttgatcccgaggtgaaccagttcatatttcaacaagaggggaagttgttccaatcctggtttccagaaaccacactaaacatctttggaaagaagacactcaccacgtataatagaactgctcacaagttgatccggagcttcgtatgcaagctctatggccctgaaaacgtgaaaaaatcactcctgccagaactagagaactccatgagggaaagcttggcgtcatggataggaaaacctagtgtcgaggtgaatgatggcgtgtcaaatgtaagttaacatctgcatttctacataagtattcacaattgcacagtgctcataaaatcatcatgatgttttactatgattaatttctattgtgcagatgatcttcggcctagctgccaaacatttgattggcctcgacatcaccaattcaggagaattgaaaaagaactttcaggaaatatttcaagtgatggtttccatcccattcccaatatattttccagggacctcgttttaccgatgcatgcaggtaggtctttatatcatccaaatagctttatgaaaatacatattttaagaatattaataagctctctaaagttataaaaattgtgattcagttaccttgattttttttttcattcctaatgaagggtaggagaaatgtatggaccacactaacaaatgtaatgaaaaagaggctaagtgcacctggaaacaaattcggcgaccttgtcgatctgatagttgaagagctacggagtgaaaatccaacaattgatgaaagttttgctatagacactctatctgggctcttgtttgctagctttgcaccgctatcgtgcaccttgactacaacttttaagttcctcaacgacaatcctgaagtttttgacaagctcaaggtatgtatagttctttaggagtgaatattttacatgtatattgaataattaaagaggatcaaacattgaaattttgggctgatcctaaacaaaaaaattcgttgcatctaccattccaggaggagcacgaaatgatactgaagaaacgagagggtgcgaattctgggttcacatgggaggaatacaagtccttgaaattcagtactcaggtgatttcaagttaatgtatgcttggattgaagcatcattggtgccaccctgatgcatttggcaattgcttttaaattgagcttgtttcaactgcaggttgtgaatgaaattaatcgaatcactacggttatacctggtggtttcaggaaagcactaacagacgtgcaagtaaacggtaaaaacttttttttacaaaaacaataaggaaaatgttgtgcatgtaggtcatgcaattgattattagagtatttgcttttgcacacaggatatacaattccgtctgggtggctagtcatgattagccccatgggagtgcatctaaacccaaaattgttcgaggatccactcaaatttgatccatggagatggacggtaagtgggaatattacattctaatcttctcaatgggatttattaaatcggtctacgcttaggttatatcataacttatattaaaactaatcacaaatacaggaggagaagagaatctcgatgcaaaggaatttcatgccatttggaggaggaatcaggatgtgtcctgcggcagagtttaacaagctttttatcacactctttctccacatcgtggtgaccgagtataggtacatacacaagctcgcattcctttgttgtacattatattatgctcacttttcagcaaacacgcaagaaagttgcacaatttttattaaggaagaacattgaataggctgggaatgaacgacagagaagaaataacctagaaaaaacagaggaaaacagaaggctataatcttatgccatgaattgaagtgctcgactatggtctatctccgcggtcctcgcaccgggaagnnnnnnnnnnnnnnnnnnnnnnnnnnnnnnnnnnn

SEQ ID NO: 33588 - DNA, 8318 bp, Oryza sativa
catacacaagctcgcattcctttgttgtacattatattatgctcacttttcagcaaacacgcaagaaagttgcacaatttttattaaggaagaacattgaataggctgggaatgaacgacagagaagaaataacctagaaaaaacagaggaaaacagaaggctataatcttatgccatgaattgaaaatgctcgacaagatgatcacccattcattaaaaaaaaacttccactgaaatattctaacactattttcttttcgtcaacctggtgaatagatggaaggatatcgacggagggaatgtaaagcgtatctccgaggttttggtcgctcaagagtatcatattcaactagttcctcagacgtaacatacctatgggatattcatctataaaaaaccaagtgtcaatggatcctacggagctattcgtacatgtacttcaatattttcatcatatggtcctcttatgtgtgtgtgtgtgcaagtttgaatttccatatattgttccatacttccattaaagtctcatatgattttcctcgaatttgatgaactagccgccaaaccgtgcattgtatcacttttcatatattgttataatatcattaatgtattggttatctatatcacttttcattgttctaagtcagatcgtgataaagtactggtagtttcattcaagttatacgttgaaagcatgtcacgagggcctttgactgaacctgccgaaacaacactggcgaacaaggcagagccattttggtgaaacaagatggcgaagcaccaaggagaaggcaaagacaaagctctttgccatcgccaccaccgtgccgaagatatacggtgccaagaatgggccgaaccgtcaaggacggcccacttagcagcccaactaggggcccatgaccaatttgtttttaattaagagcgtctgcagcataaacataaaatcgattttacagcaaaagaactgaaccatgcacgttgtagctatcgaactgtatgtgtcggataacaaatcgaactccagattggagtcgaaaggaactagtacaaacctattttactatgcatacgtgcgtgaaaggtagactagtgattggttgattcattttttgcgggtcccacaaagcaattttaacgctacagctatcaaactgaaattttattcggctcttggatcagatcagtcgaaccaaatactacagatgccctaaatatcgctatcataagactaaccatgtaaattcctctataatatgtaaccctagggcatgtaatctataaataggcccaaaggggcatgtattagggaaatcccaaaattttcaatcttaataaactgcttttgcttttccactatgtgaaccctgccatttagtaaacacagttgttattcgacaacagctggtgacgatcatggggaaccctagccgaaatcactgatgccaccaaataagtctgtgagtgagaaagtggtgcggatgaggtgtgagagcgaaggagaagtcgaggcgagcaagggcaaattggccgcaggggccgaagctgaagccgagtcatgaagagtcaaagctgggattcagcctgccagagcagagggcgaagctcgagtcgaagcgaccacaactcaagtgactgcttcaaccatagctgcggtgactactttcgttagtccagaagtcgacgcttcagcagccccaaccatagctgcggcgactactttcgttagtccagaaatcgacgcttcggcagcccaaggagcggagatttttttagagaaggatattttttacccggcctctatatcctaccggataaatgcagtatttttcaatttagaacttagcctatcaaatagggaacttaaccctcaaataacccaatctgaaatttgctcttatgaagatttgaactcagaaccttatggtgctacccaggtcactgcaaccactaggctacatgcctaaggaggggagatgaaaaccatgcggcaagacacactacgccgaatgcaggagcaacaccaggcgtacgaagcagctatacaagccaagtcaacagcttctaccaggccagctgtcacttcattggcaacgaccactgtggcattgactgcttcgacgccacaagtttcggctgcaacaacttcatcgctattgccaatcaatgcctcaagtctctccatactccaaatcactatcgcgcaatcgaccatggcaacatgcacaacttcaatcgaccacatcttccgcattttcacttctgaaaattaactagtaatttctgaactaatttgtgcataaaattcttgtaaaggaatcattgagataaacaaatcgataatttaatatatagattcatcaataactaaaacgattgaatgcttacaaagaaaagaaacaacagcgaacaaacgatatagcgacggcttcaactccactcccacaggcatccccattgtggtataagccaaacgtgttctctttcacaactttcttcaactgaggttgattgattattgcaaggtgagtacatcgaatactccgcaagccacacagcaaatatggaagtgcacagggatgcaaaggatggaataatagggttcatttgtaaaagcaacatttggcaaacatttgagaattgtaaaacattagagtaattaattatcaatattaatcaatcattaagcatcacacccatactacataggcccaactatctatgaacaaccattcccgattgcactgatctaacctctaaactaagaattatccattccaaaccatgagctaacagttatcatcaattaccatcttattattattattactagtaatttgcccgtgctaacgctatggaattttttttaatcattcgggtataacgcacgttatgaattaaatttaacatttgcaagaatttattatcttttgaagaatcaatgtctagactttgaagttcctaaaaagggataatacatagaatccagaataatcgaccaaaattcataaatattagatagacgagtttctgatttgttgtttacatagccaccttaaggactctattgtcaggttaaggtatgtcagaatatgagacaataggatcacagtatctagaatttctaccatcatatgtaacaagataatagtacaatagttataattcttttttttacaaaatcaaaacataaaatcattatagtaaagacttattagccatcaagctcatgccgttcgtcactgtacatctacaatactcaacaagtctaaaattataaggaacttcttttagccttgaatgcccagtagaatttctatagaaaaacgcgcatctgctgtttgtcatagtagattggatttggcaaacaactaaaaattctatccaaaaacacacatttgctaaagcacaatacatgttaagattgttagtgatatgccctagaggcaatcatagagatgattgtatcacatactatgtttaaatatttatccgacattgttccttgaaatacataactcattattggttaatgaatatgtgattctttcatgagactctttatgttgtttgttactatttctaaaggatccttgatcaaatatcatatgtggaacaaatatgtttaaatgatcagcacatgtattaattgatgatcatgtctcatggatcatggcatagagataccaaattaataatgtggacacatgttggtgaacatgttgttggatagacccaacatgagacactgcaaaagccatatgtgttgtgtcatcagtgatctcatcatggttcctaacatgtgtagtagcttacttagggactgctaaacgctactctaattctagaggttaaatccagtaagttattactgaaattctagaggttaaatccagtaagttattactatctctaattaactatttatgaaatcaagattcatcttacagggtcttttggtctttactgaaccttaccccacataactatttatatatctagttttgaagcccaacagcacaattaccatatttcttagcaatataaaatacttcttgctgctagctacatgatgatacaaataattttgaactataactaatctttctacttgtgagctaaatcaaaatatttataccctattgtttacacatgttctgcagctgaaattattatatgatccttttactgatttcagagatattcttgttcatattatgatggatgagaatgcaacacacaactcctacacatactagtatatgcatcacacaagaatcatgtcatgatatgatttcacttccattttaatcttctaattacctgccatgctttagggtgactgatatgttattcccttctgactttgcagctgctcctctaaactatggttcaagggttctcctgatggaactctgctggaacaccacttgctccttcttcaggttggtttctctgctatctcacttcagcatctccttgctgctttggtttatatggtaagataagtgaaaatcttgattggcatctggatttgctacttcccttggttttcctggagtttatcctctttcttgatttctgctccatcttgcttgagctactaatggttgcttctcctactactcctctgacctctcattcactcaccctagcctctcctggctgtacacacaaggctgctacggctgtggtgaagcatgggtgagatgttgaactactgatttgctagctgtgattatttctctttagcttgagttgaatccctagctgaactgctggtgttgatttccgttgcggcagctgctgctattgctctactgcggcaggtgcttgaggtggttttccaaccgatgcaaccgaggctggggttcactgaatagcttggttgatgtatatgtgaatttggtgaagactaggtgactcacctactttagttttgatggttgtttactgactgacacctaagcagtgcttgatcggtggagtaatgtgggatttcactaaattttttctagttagataaattctgatacaattaggtacttttacacttgagtccctcggggtctctaaaattgaagggtactctgagattagggactgatttgtaattgttctagaactcaagagtttttctgaaaactaaatgattattgaatctttgactgaggtgtttcagtttatgatatggtatcaataaacaccttatatatgcacaatatatgcgatgcatactgtataagatttctagagtacaattatatgcatatatgtatgcagacctgtagtggtaaattgtaaataacgaactgtggtttctactgtgcacatgtgtagctcacttcgtgacgactaatctatgctataatttaaccaaaactaaattatcccactcctcactaggtctactctaactaaaaataatgatgcatatggatatgacttgataaataaatgacaaggaaacgatcgaaaaatcatttaagatccataatagaacaacaatcaacatatttataggtcctagccagcatcgtggctcaatcgacaccgctctcagccagtgtgaccaagtcatttgcgtgactaagactatagctgatatgatctttatgtatgtccggtgggtcaatacgttctgctaggggccgctgttgacatgtggaccgagaaggagttttcggtttacagccgagtgtacatgaacctacagggtcgcacgcttaatgggccaaaataaggggattggatagagatctaatatgagcttaattcggatagggatccgaataggagtcctacgggccttggaggcccgagtgatggattctatatattcgtgaggggtgtgaccggcggaggtattgcatcacgtgagaaaccctagctgccattttcctccctgagcaaaaccctagttgcgcgcgggtgctagcacatctgcgcgtggcattccgtccctatacgtgtggataccggtagaggcaccgctggtttgcggtgctgatcggcgtgggagtacggcgaggaggacgcacgaggaggagaaggtcgagccggtgcgattgactacttcctctacatcgacgcgcgctacatcgcgagggttccttcgactccttagcgctttcttccactgcgcagcgcgtcgagtggtaacgatctatgatctaatgcttgcatggttcctggtttacgcggtagaaaaattttgatttatgctatcgtagcctacgcatatcccaacagtggtatgagagccgccttgtattgtttatgatctagatcattgcatatagttgatatgcgggtgtagtagatgagatctattatattgtatatgagttcttagatgtcacgtcctgataaattcatcccgaaataaaaatcattctctaaaaggaataatagaattaattaaaattcgaaaagaaattggcaaacactaaaatacgtacaagaaaaattcaaatgtggcccggagaatttttgttaaattctccttggtctaaaaggagccctcaatttttggtggaattttcagagcacaaataataattattaagaaataaacaaagttaaaatggtttcataaaaagaaaaaccctaaaaagtctttcccccccccttttcccctcttgggccggctcggcccatccctttctctctctctcctcttccccgcggcccatccggcctcctccccgcgcgcgcgccgctgacgggtgggcccgcccgccaccctcgctgacgggtggggcccacctgtcatccctgtcctcccgccgctcccgccgcctcgcccgtgccctagcgccgccgccgccgcgaatcccgccgcctcccgtcgtccacgcgcgcaataaagtggggggaaatattccccgtgattccctctctctttccccccatttctccctctctctcccgcgttcaaacgggcggatttgcccccgcaaatctcgccggcgccattgatggcggccgacctcccgcgccggtttcctcccttccccggccaccctctctcacccccggctctatttaaaccctccccgcacctcctccgtccggttccgcctctcgccgcccttcctcctcgccggatttgagctcgcgacgtcgctctctctctccgccgtcgccgccgagctccggtccgccgccgtcgtcgccccggaccgcctcccacctcggcgccggctccttcggcttcgccgcatcctcgccgacctcgtccacccctccgtttcggtcgccaaccgccggagcgccgccgaccccgttgacccgagccgagccaccgcctccctccgctccggccgcctcctctgtcgccgccatcgccccggggtgagctgtggaccaccgcctcgtttcccccttcccttcccctctctcggccgctgctccgccgtgcctatggccgccgccgggtgaccataggggtgcgggcgcgccgcctcccgccggccgggccgacgtggccgtcttcgggcgcgccgagcggctgccgcgtggggcccggccgtcagccgcccgtgccctcgggtgcggctgacgcgtgggacccacggcgctggccggtgtgagcccgggtgcacccggtccaccgtggaccgtgaggctgccgcgtgggccccactcccgtggacccggtccgcgcgccctctcccctcggctgacgcaataaaccctttttaaattaaaatttaaataaagaaattcgcaaatatccatttaaagagcatataaacttcaaatggccataacttggccatttgaactcggaattggaccgttcaagtctctaatttttccttaagaagtcaagaatccatttttgtgctttgttcctgctttttatatggagtttattagagtaaaagccttttgcttttccgttggtcgtgtagacactgcagcttcggaagatccgctcttcgtggaggttgaagccgacgtttgggaaagcgagcaaggcaagtcacatcatccttgaacatattgaattccagtttataaaattattttgatttaaattaatgcattatcgctttatttaaattcccgcgttatcactgttttatttagccatgcctatttacctttgttatgaccttattattatttctattgttattattaccttgttcaccctagaataaacaaaaccccaactactgtgcactctactcaaggttcccctagtatgaatttaggtagatgcttcgctggttaattaggcaacattaggtggttttacaactctagactttgggaatattcatatcacttggacattatggaa

SEQ ID NO: 33589 - DNA, 3586 bp, Oryza sativa
tcgcaaatatccatttaaagagcatataaacttcaaatggccataacttggccatttgaacttggaattggaccgttcaagtctctaatttttccttaagaagtcaagaacccatttttgggctttatttctgcttgttatatggagtttattagagtaaaagccttttcttttccattggtcgtgtagacgctgcagcttcggaagatccgctcttcgtggaagttgaagccggcgtttgggaaagcgagcaaggcaagtcacatcatccttgaacatattgaatcccagtttataaaattattttgatttaaattattgcattgtcgctttatttaaattcccgcgttatcactgttttatttagccatgcctatttacctttgttatgaccttattattattgttattgttattattaccttgttcaccctagattaaacaaaaccccaactagtggatactctactcatggtaccactagtatgattttaggtagatgcttcgctgtttaattaggtatcattaggtggttttacaactctagactctgggatattctcatcacctggacactttggaattgttggattattgcggaattggattcacaccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggattagagatggacgaagtcgggggtcgatggacatctctaggacaaatgaaggctacacgagctgcggcccggtagtcgagatgtcatggcacagggctggtgtcctgctgctaggggctcaatcctgcctacctgtcccggaggttccggccgtaggtggggttgggtcggtactcttgtctatggctaggatgggttgaaaactatgtcacgtcttccgtctgtataccgtggtggtatgtggcacgtggttgcacgtgagggagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctaggacccagggtcgggttgccagttcggtctgaatcatcgtaggccttgggttaaggcaggttcgtgagggttcacggccttgattaataatactgtgtaactctaggatcgtctctataaaatggctttgggcaactaagtgacttttaaatgctgttttctgtaaaacttaacccctatattattatccccttgtactcccttgcattaattatgcatctccggtgtggcttgctgagtactgtggttgtactcattcttgctcaatctttctccccctttcagtaagagaagctttggagaagatgtcttaggtggagtcttggcttataccccagttgagcgcctgtgaagttggagccgtaggcccgcaagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggaaattttctcggtcgcgacattagatgatcggaacatgagatgaaccgatagccgcttgggttgatgagatcaatcggtatgtgtgttggtgacttcactggaatgtctagtactcaccaaggccgagcgcaattgtgttcatcggatagtccgatgtccacaagaaccgcacgccaatgagaaaaacgagccaatgagattgacttggtttcggcataattcgattactccgttaaggttttgacatggcgaatcgtagatgagatctatgtacacggctagcgggaccgccgtgtgcgttgccccttagatttcgcttagggttttatatctatcttattttattgctgttgtatatttgatatgacatggtaggatagattccctcagaaaaattaagtgtaatttatgctcttccaataattgcacctattacggttgtgatcataagtgataggtttgccatagcaaagtgtcactttttatcatgataaaataggatagatgtcggacatctatctgcggagattattggtttacttgacaaggagatgtcaccccaacagcacgagagtcacatatgatgtgattagcaaggtgttgcttacctattttgatagttatctagctgtgatgccaaagctcactagacactaataaaaatgaggatcttgactcactatgttattagagggaattttgtttcacaatacatagtgggagtatctttcgttaaactgtttaatgaaaggttaaatgtagacatggtgctgattttgcctacatatatttctattgtagatcatggcagctcctgcaccatccagttttaacttgcggtctattcttgaaaaagagaagttgactggaacaaacatcatggattggtatcgcaacctgagaattgttctcaggcaagagcacaaagagtttgtgcttacacagccttttccagctgacttgcccaacaatgctcctgctgctcaacgtagggagcatgaaaagcgatgtaatgattatcttgatattagctgtctcatgcttgctactatgtcccctgagcttcaaaggcaatatgaggcattggatgctcatacgataatcacgggactgcgtaacatgtttgaggaccaagcaagagctaagaggtttaatacctcaaagtccttgtttgcgtgcaggcttgcagaaggtaatccagtgagcccacatgtgatcaaaatgattggttacaacgagactctggaaaagcttggttttccccttagccaagagttggctactgatttgattctccagtcgctccctcccagctttgagccgttcatattaaatttcaacatgaacaacatgaacaggaccttgacaaaattgcctgggatgctaaagactgccgaggaaagcattaagaaaaactccaaccatgtgatggttatgcataagcgcaagcccaacaacaagaagagtggttagaagagaaagctaaactctgatgagatcacgagtactagcaactctaagaccaaggttcaaaggacagggcctgctaaggatgcagagtgcttcttttgcaaggaggcaggtcattggaagagaaactgtaagaaatacctagagcagctcaagcagaagcagcaggatggaaagagttccacctcaggtattaatgttatagaaattaatcttgctacttcctctactgattcttgggtatttgacaccgggtcagttgctcacatatgcaaatcgttgcaagggctgaaaagaagtaggagcttagcaagaggcgaagtggacattcgcggggg

SEQ ID NO: 33590 - DNA, 927 bp, Oryza sativa
  unsure (1)..(927): unsure at all n locations
gggcgaattcgagctcggtacccgttcttagtgaggtgcatcacgtcgattgcatggcggacgtctaagaattcccaatagggtaactcccaaaatatagagttctttttccacatcgccgcgtgactatcttcgctctctataggctggctggcaggcccctttccaaacactactttaagatctttcaccatagcaaattgttttcctgctgcaatgtttaggcttcgtacggtggtccgccttatgttcaaagagcttgcctttcttccgtactgggtggtttgcagcaaggaatcgacgatgacctatgtacacaaccctcctacagtgcttaagatacgtactttctggttcatccatacagggagtgcaagccttgtaccccttgttagactgtccggatagggtgctaagtcgaggccaatcgttgatggttacaaacagcagggctcgtaggctaaactcctcatgtttgtcctcgtcccacacggagacaccttccttcttccacaacagtttaagatctttgaacagtggtcttaggtacacattgatgtcgttaccatgttgcttggcgccttgaataataatcggcatcattatgtacttcctcttcatgcatagccaaggggggaggttgtagatacacatcgtaacgggccaagtgctatggccgctggccgttgctcatctctccaaaaggattcatgccattcgtactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33591 - DNA, 798 bp, Oryza sativa
  unsure (1)..(798): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggatgcttcagtgcttccttctacgacttctcttgccgggcaggggatttgatatcccttctctctgtactatgcgatcatcgtcgtacttcgccgttgtaccgctgttctttcgccgccttagtgttgcagtagcgatcgtgaaattaaagcagggaaagatggaaagtggaagaaggtgtgcgcgcttttgccgccaatgtggcacgagacaactccacccgtgggctgcgctgaaggcccacgataacgagaaattgagcgcatcacgagaaagcgtaaaaactgaataggagtggaaaattggaagagaaattaatttatgtgtagtgttttgaacaatattgagttgtggggggagagtagaaagagcagtgacttgtagggggggggtatttggattttcccctttcagcaatgttctgtgagatttttcactgtgacaggaattatactagcaaatcatacatcctaattcaaattatctcctttggattataaactcaaattaaccatgacctacaaaaataaaacaaattagcatttaatagcctttcatcgttggctctatggctgataaataagtggaaaaatcaatgtagcaaccaaaaaaaaaaaacttgtcctagtttcaacaagttggccaccgccggagggcctagggggaga

SEQ ID NO: 33592 - DNA, 651 bp, Oryza sativa
cattcttcaatgttttttgtggttataatacttttggagctatgtttcacacattttttttttgtctctaaaacgttgttgtaagttgatgagagagaaaatttttgtggggaagatgaatatatagaaattttggtttgttacttaaaaagttttattctcatagtttaaaatataatgaaaattaatcttaaaaatagaaaataaaataaattgaaaattaaaagaagtacaacattaatattagtttagaacttcaaaaataatataatacaacattaatattagtttagaacttcaaaaataatataaaagaattgtttgttggattattttataattattaattgtatgagtaatgatatgtcattattgtatgactgtttaaagagtttttaattattttatcattattgtatgactgtcattattgtacgaaaatttatttatgtacgattttttttcatttcatgtaagatggatcggcaatggatgtacgctgaccggcggtccaaagagtttatcgatggcgtgcattattttttgagagtggccgaagctaacaagcataaggcttttatgtgttgtccatgcaataagtaagaaccagaaggagtattctgcatctaggactattcatttccacttctt

SEQ ID NO: 33593 - DNA, 530 bp, Oryza sativa
  unsure (1)..(530): unsure at all n locations
nnnnnnnnnnnnnnnnnnnnnnnnnnnnnnnnnnnnnnnnnttttgagcgtccttttttccctgtgaaagcagcacattctcattcatttaaatgcaggcaattgcaatagcttgttgctacaaggatgagggcccagtgttaatagtgtgtccagctgttttgcgttatacatgggcagaggaattggaacgatgggatccttcatttctgccaaaagatattcatcttggtaatcattcaacctctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33594 - DNA, 566 bp, Oryza sativa
  unsure (1)..(566): unsure at all n locations
gcctgcaggtcgactctagaggatccccaatttaaataaagcgataatgcattaatttaaatcaaaataattttataaactggaattcaatatgttcaaggatgatgtgacttgccttgctcgctttcccaaacgtcggcttcaacctccacgaagagcggatcttccgaagctgcagtgtctacacgaccaacggaaaagcaaaaggcttttactctaataaactccatataaaaagcaggaacaaagcacaaaaatggattcttgacttcttaaggaaaaattagagacttgaacggtccaattccgagttcaaatggccaagttatggccatttgaagtttatatgctctttaaatggatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33595 - DNA, 628 bp, Oryza sativa
  unsure (1)..(628): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcttacagacgagaatttcctcggctttgtcggaacactgccaccgctagtggtggcagcatcagacacctccttgacgaccttaactttcagagatgacgccacctgatggtccgcgagcggtccgatgatatcagtcaaaggaagggcttacgctcaatcaagtcataaagtgatttcgaaaggagaatgcgggatgttcatcaaatatacttacattgatggcttcatcacgttccgccgcccccttttcacaaaggggcatagggatgtcactcgccgtggtcgggccactgatcatcacttggccgacgcggcgctccacggtttcgccgctcaaacctgttaatcgagaaccaaccttcgataagtcaagaggaatgcgagcacaagtatgtcannnnnnnnnnnnnnnnnnnnnnnnnnnnnnnnnnnnnnnnn

SEQ ID NO: 33596 - DNA, 10444 bp, Oryza sativa
agctcggtaccctttcaaatgcattctctgcactatgttcattggttactggtcattacttgttacttgcaatatcttcctttttccatatttggctcgaagtctggctgtttgtaccgtagagatttagagcactcaagtacatttttgtcattcctatatgtttccttctttacttgattaatctgatttcttggtacttatgtatggtttacttatgatagccttgattggagacttctattttgcttgtcagatctatctcacagtttgttttctcctaggagacaatagaccttttgacatctatcatcagataaatatgctatggtaaggaaaaggtgaatgccattgtattgtgttagtcttatcaaacttttctgatcacacttccctggcttttcaggccccatttgcttggcagcaataaatttgactttgcgaacaaatattgcttgctacatactgttcaaggctgcaatgggagaacttaccaggtattttgagtgtccggtttctcaaggcagagttccagcttttctattgctaagctctactaggttgttactccctctatttcacaatattgttctggtgtacatactaagggggcacaatattagataaatgtggaattgaactattgtttttggtggaattgaacaattgttgctttattagatagatgtacaagtactctatctaatggcatcaaatttggtctgattttatcaactgtattacgattttatgttttcttgattattggaccgaggaccagatatataatgcgaaacaaggagtatttgcttttgtgtaccatctatgctgcttatacactaatcaatcagtgaactgtgaaatagtttatgaaaaactcagaaaaccagtgcttccaaataatttttgttccagtagtaggagcatatgtagataaacatttgattctgttgagggctgtcaccatttttctctctgcaggatttttcaaagggtgctcggttgacagagttaaatgttttgctcagtcagactctcatggtctgttctttctctctattatttatgcctgctatgcatagcttgtttcgttcattttattcatgatatgttatctgaatgtggtattcagactatccataagtattattatgggaaatatgaagtgttccaaatgtgttatgttgatgatatttctccttgaatttgtaaatggaaaaatcagtactgtgacacgggaagttcacgagtttagatttgtaagtacacgataatactgccacaagttttcaaatttcccttttataccatttctgtttattattaatatgcttgcaaatattgtagttgttttgtcgccacaacccatgctaaccacatgatgtttttgtctggtaattgattgttcatcgaccattctatgtcggatataacagatgatgtttacttctgtgctgtagattaggcgcttgaaggagcatttgttgaatgaactacctcccaaacgtcgacagattatttggttgaagctgaatgcatcagatatcaagacagctatatcttgtatcaaaggggtgaacactagtgatgagattcctacaattgcctcgccagacaatagcaatgactctgaggaggtgaacatggaagaaggtaacactcattgagctaatggcagatatgataatgagacctccttgtatcagttataattttatgtgcctttgttatgctgaaatatataatacacaccttgttgcatttgaatgtttgatattgttagatttcagaactataacaaaatgcaacaacttatatggaactgtaattttgttgaagcttgcttggcatttgtggcatatgcaatgccaaacatgtatgggtttacagctttgcatattggcagttggttatgacataagcaatgcaatatggcgcagtatggtattgtacttgacactgtctgaatcgaaatttatttacaacttcttttcaaaaagagccattttcttatctatagtaacagagaacatttgtcaagaaaaagataaccagcatttttgttgatttctgttctgaagaacactatgtatatcaagtagaaatgttggtgcaactgtgcaatatcctgttgtactttacaggtgaagaacattacttgccatttccaatcattgtacttatttttttttaaaaaaattctgatatgttaaacatgaactaccatgatcaaaacattatgtttctttttgacaaacaaccaggcaaccacctctttttaagagtagcgtgccactttaaaggagacaaccttcctctttttatccttatgtaacatgtttctttctcataaacaattattaatgtaacaatgttaaatgtaacactggtattaacacttgggataaagcacatgttttctactatttcagggttcaagattagtaagattggtctgtctgctccttataaacattgtgctcatttccttgtatttccttttcatttgcccacagctgatggttgcaagaaatctccaaggaatctcactacacaagaaattggtattgtgaaaatacctgggttcagcgagtggttcttaaatcatttcatcatgaaagaaccagctgataatggtagtctggactctcagtctaattgccagaaaacaataattttcgcccatcatttaaaggtcctagatggagttcaggtaaattctgaggtttcttttctgtattttttttgcgagtttatcatgctatgtttctcacgattgacaatagaatcttgaacagtaagaaaagatttataatcacaactatgttactttatgtaattttgattttgcaagtatcatttcaactatttgtagttctatatatcttgtaagcttcacttcctcctaatgaaatagaagtttcatctttagagtaaatgaaacaaaataaatgatgtgtcaagaagctggactataggatctcatatgaatagaaacactggtgtatgtgtaaaattggtctggccatgtacatgtcattggcaccgttttttagaagccaccagtaccatgtccagcattctggcattctctagcatataatactctttctgtgggactgtagatgttctcgtaatggtttggaagttttttttgtcgaatacgcaagatgcatatcattgcattaataggagtccaaacacgccaaagaacagcaagaagtacaagacctcaccaccgcaaaacaacccattgcaaaggcggttacatgaccaaaaggaactaaaactaaaataaaatgccctagctggggtccataattagggagagccccttagccccgccaaattacataggccagcttcctcacttgctaacatcaagtcggttgataaacttggagatactccattgaagacaatcatcccattgccgccatgttcaagatagtccattaatcagttgaatacatggaaaaaatcagactaatgatcaatcggatattcgggtgcacactttcactttataatagttagatagcattatatcatattaaactataccatctaactttatgaaaaacatttgccaatacttttgactgaagtttttcttcgtacgtaggtgtttgtcacagagcagaggatcaagtatgtccgcattgacggaagcacatctcctagggaaaggaaagatgctgtcgattctttccgtttaaatccagaggttgtcccttcccttccattcggttcgattcatacttggtattccatgttaagctctcaagttttattctcaaactgcctatccattatttactattttactagttcttttattttctaccaaataggtaatggttgcaattattggaattactgctggcggtgttggtttagatttctcatctgctcagaatgttgttttcgtggagctcccaaagtcagcttcagagttgcttcaggtccttagccttctctcttgcacatacattttcctcatccatagggtacaagaagacttttgagttttttttcaccatcctgttgtgtagcccaccattcacaattcgcactatgatattatttatatgtactgtagcaactgcagtattattcactgggcctggtggtgtagctttaattggaattcagagataagaataattagttttattgttgggtttatttctttatatatatgtaagtttctttacagatatgttttccatagggatcaggtcaagtcatcccctatcagtcgagcaagaagaaatgtttctcctctatttgcttaaaaacacttattcctatttgctctcttttgatccctttacgcctcttacccaatctgtctattgcctgcttcaaatgcaattctgcatggtctttatcccgatgtggactaagattatctggtaaatgaaacaaatcaataatgcacagtaaattgctacatttcatggttcatgcgcatgagttttcatgctttcgcacacttaatgtgtgtgctctcttggacgcatgcatggtgcaccctactgttagtgtttgtttattgtgtttctaactgtttggtacatttgattgttgatgataggctgaggatagagctcataggcgaggtcaaacaaatgctgtcaacatatatatattctgtgcaagggttagttccttttttttttcctgtagcgtactttgtaattttgtcaaattataactataaattgttctgttttgtcttggtcacagaacacattagatgagtcacattggcttcatttgaaccagagtctgttccgtgtctcatcattgatgaatggaaagaaagatgctataagagagattgaggtaggccatagggtcatgtaatttttgattttatactgttccttagggaggttaggatgggcactacaatataagtgtagtattgtttggattgaggtgcttccatggtccgtaacaattgacaaaatgtaagtatgcacccattgtttggagttaggtttttctatagtttataatgcgacacaccacataactttagaaatttatgctgaatttgtactgaatgtttgcatattcaatcttttccatttcatgtttggtgctgtaaaagtagaaaataatttacaaaatgaaccaaaatagtttaccagtactataaaagtctgatgccattaaacttcaacatttaacagaagggattgatatactactcaatatacctttgcagctgagacatagtttcttatatcactgctggaatcaattggcttagtagaatcttgttggttaacagaccaattaagggactgcattgttctacagtatttggtgtttattcattcaatatagtttccttctttctaaggttgatcaagtttaccaccttgaggaaagcagtaaatctgagggaaaatcacagcttggatttcttcctttggagaatcataatgctggtaaaacatctgaacatcgttaacagagaattcatgcattggtaccaatcattattacatgcttgtaagtgaaatgaaaggctgaattttttgaacctcatgcagattgtgggcatggaccaggagagaatgtagaaagtgatgatatgtccattgagaattttcctggcctcaacgatatgaattttgagtcagatttcttcagtattaggacaattcctcttcactttgaggtagaaaagaggcgttccttgcaaattttggtacatgtttactacttgctagttgctacttatcagtcagtagtcctatgaaatccttcaactgattctttttctatgcctcctcaggatgatagccttcatacggtaatgcaaaattgtccatctccaacagcacatgaagagatagcttttgatagttcttctatctctcaagcttcagttatttgcccttcaatgtcaagcgctaaatcagtaaaggtaataaaaagttcttgcttgtattatacaatgttttgcactatatcctatgcaacatcacctcaaatatcgcaggctcgtcggaggctttctgaaatttttcagactttaggccttccagcaactacagactgcaatattgaagagaagtttctgcgatttgaggtttaactgtcctctctgttcatattctgttctcatgacttgtctcattaatgtgaagttaatttcattttacattccattccggtcttcattctttgaattcatttgatttatcttcgtattttacaggttagccagcacacaggccgaattcatttgtacatatgtgttccagggcatgattcaagacccagaccactttttgaaaacttcctgccagaagaagtagagtcacctttatgttctgataataccatgaaaacaagtaatcgtctcttgaagagggatcctgcattttgcaatacgttcaaagcgttcgtgaaggaatggttggcgcttagaccaattgagcagaagagactactgggaaagcccttacagcttcccttgagccttgagttgtgctacctgaaagataccaacaaccacagcacaaaagtacgttcctcttgattttgagtgatcaatttgaatattggtttaattccaaatattgcagaaaatatgcaaaagcaacgcttccatgatattaagcatatctatgttctatctatatcattctttatgcaagtttttcttatgttctagaaattgctcaagttctatcaggatttactctaatagaggatattgcaatgtttgacttttactctaatggaggatattactctaatggaggattcaattggtgatttggcatatacaaaaaaaaagcaaaataaaactgcagcttttaagctgctaggcccaccacagtgccacactaccctaggcatctcattgtagctaagggtttgcttgtgagctgctatcatatcatcccgatgtattaatttttcatttgaaatacagtttaaaggatctgattttgtaccaaactaagaacatgaaatgaaaaaaaatatgtcttggcattccttggtttaatcatgtttattttttgtcaattgtgctctacttcataggggttgcttaaaggaggaagtaagaggcgtgtaacaccatggtgtgatattagtaatcctttgccagaaaatgctgaatggagaaaggtggttttgcataatggtacaagtagagagagagagtacactcaaggctggactgttcacgatgaacctctctgcaaattatgtcaaggaccttgcaagtaatatgtctcatttgtgcactttatttccagtagccatctgtgttttttttttgaaaaaaaataacaatgttgttatttgtgatcagtggaaggcttgcaaagtcacctgaatattttgaagacctgttctgtggtctgccttgcttcgaggtgttcagatcgagaactagtggcaggtttgcacggcaggtgagatttttctttaatcttctgcaattagcattcataaacaaagtgttaagttgcattatttatgaataaagctggtatgccagctatatgtgaaaatatggaagttatatgtactaaagcaatgcttgcctgatgaataggcactatttgaaattgaacatggtatatgctccaagtgtaaacttgactgtcacgagcttgtcaagaatatcagaccattatgcaagaaaaagagagaagaatacattaggaatgttgctccaaatattgcaagtagattgaaattgtaagtgccatactttgatattatgcttttcaatgttttgtgcttatgttaacttctctttgcctatttaggcaacttacaggctattggggacactattgtggtctgaactcacaaaatattaatgaatatgagtagttctcctaatttgtagattgatggtgacactgtttttttcactatattttaccacaggctagataagcttgtacatgagccaaatgagggtaatgcttggcacgcagatcatatagtgcctgtatataaaggaggaggtaaagtgtgtgcataatttttgcgtgcttttggctcttaacattatggtctaatttatctgatctcacgcaggggaatgcacacttgagaatttgagaactctttgtgtggcttgtcattctgaggtcacctgtgcacagcaaaaggagcgaaaagatttaacaaagaaagctaaagagcttctgaaaaacaccgtcaataatcagcagaaggatgaagttagtagtcctgccctatttcaaactttttttgaaaacatttttcctctgaagtgatgccatctctgaaattattaagattacagtaacacagtgactctcctgtgcttactgttgatactttctcatatattagcttctgttactattgccagttggctgtcatgccatttcttaagcatggtgaagaatgataattttgcgatcattctacaaggcaaatcatctactgtctccgttcagaaatataaggcatattttgactgtccaattttgagctttgaccaactattaatctaataatatttacattttgccatgaaaagtgatattataggattttgagtatgcttttgtatccgtaagtgaaataatgtaaggaaactttacagtcaaagcttgtcttttggatcgtcaaaatacaccctttgtttttgaaaaaaaaagggtagtaaatagcttgatctggataatgtctatccctttatgctatgtaagattgcactcactgacttatttcctggactatggttccaattgttttttttttctttttcccattgtaggcaagtgaagcagcagaagaagatgataagtcgttgcttgtcgttgtccctggtagtgcctactcctgagttgggtagcgtggttctggctagagcatatgtatgtagattacagttggacattcttccaaagggcaccaatattttgtgcatatatttgttgcgtgtggccaagattgcaattgcactcatgcattatgattgcgatctgcaaccgtcttctgtttagtcggggcggcattttgggctgtgtaaggaatggttgtgaaagaagaaaggaaatgtcaattttgttttcagtttttacccacacgaaacattggagaactgccacatgtttgtttgggaacttttttatttttaattttattaatagacttttacaaaaaaaacatttccaaggttcagatttggaaatgcttgttgggatgatctattaataaaaaaaaataaaaaagtctaaaaaataaaaaaaaaactttgtttggaggcaaacttgtttgtacattatgggtgcgttcgttctgggggattgggtgagaaagggacatcgtattccgtgcgcacgcttcctaaactactaaacagtgcattttttgtaaaaattttctataggaaatttgctttaaaaaatcatattaatccatttttgaaatttaaaatagttaataatcaattaatcatgcgctaatggctcacctcgttatcttctcaatcttctctatcctcctctcctcaaactcaccctatatataggctgtgatgtactctcgctgtcccaaattataaagtctatatttttttacacggtttttaatgacatactttaaccattaatttatctcatattatgtttccaacaaaaatgaaattagcatcacatgaaaatactttaaaatataaatataaatctagtgatattggttaagtgtaaagttatcgagtctgattttcctttaaaggatgtcctataatttgcgacaaatggagtaatatgaaaacacaggttacaatcgtaactgaaaattattgatcaactggcacaactacctccccgatttgcgtgcaactataaactacatggacgatttgtacgtactcaagtaaaaaaaatctctattagaaatgatcaaatctcactgacttgccttcactgatcggtgcagaatgtgctttaataattttacagtgatcaaaccagaagcaaagctgataaccacgtctccatttctcagagttatcaaaaacgattaaactcatgatacaatgcaaatgttgttcatgtctgcataatctacgaactcgcgattactagcacgtgctaattaagcctaggcggctaggccgcgcatgcgggagccttgaattccgtgaacctaacgaacgcgatgccgcgcgccgccacgcgcagcggcgccgcgcacccgtcgccgacgacggccggccggagctcggggatctcgccgcccgggccgagcgccagcgcctcgccgttgagcagcaccacctggctccggatgtcgccgccgagcgggctcaggtggtactcctcccttcgcccgccgcacggcgccgcgccgagcgcgccgccggccaccgacacgtcgaacgccgtcgcgttcgacaggttgatcaggagca

SEQ ID NO: 33597 - DNA, 7400 bp, Oryza sativa
  unsure (1)..(7400): unsure at all n locations
ggcgaattcgagctcggtacccctccacggcccggagccccgcaccgtggccgccatgtcgcggaacgtcttctccacctggtcgaggtaccccgggtcctgcatcttcctcgccaggtccctgtccttgccggagccgaggttgtagatgtggtgcgtcacgccgtcgacggcgccgcgccccgacacccgcagcatctccgagaaccacgcgccgtcgtagaacccgcccggcgcgagcaccttcggcacctcgccgccgccgccgtacacacgctccaccgccttcctcagcaccgccacgtcgcggccgtactgcgccgccgccaccctcgccgcgacgccgctgccggacagctcgttgccgagctcccacgactcgacgcggtagcccttgccggcggtgtaccgcatcaggtcgagcgcgttccgggcgtcccagtcgccggagtacagcgtgtccttgccgccggcggccttcctccggcccttgagcgcgttcagcccgaacgtcaccgtcgtgctgcacgtcaatcaaatcaaatcaaagataattagtcatttaatcctcctcgaaatggcgattaattagccgataattgcagtttaattacttggttcttttgaagaagacgttgagctcgtcccatcggttcatttcaaggcagccgtcggtgaagccgaagaggccgccgtcgtctcgctggaagctccggcaatcgccgtagttgctgccgactttgtacgtcacctggtcctgaagagaccctccgagcctaatcctaagcgagttgaacgctgcaacatcacataaaactctggttaatttcagtacaattttttttgatagatcagtgatctgcaaatgatttacctttgacagcattgttcagaatagtgttgttcagatcctgtgagggaagaagagtgacgtgctcagtgtcagttagaagtagattgatccatatatgaaatgaaggtgattaagtttggctaatcaagtttcaggggtggtaattaccaggttaatgatggaggcgttgtaccaggggcacatgccgtagttgcacttgtccctgggccaccagtcgagcgtcgcgcagacgaagttgtcgtcggtgcgggagacggccgccgccgccttgacaaccacggtggccgcctcgccgccggcggcggcggtggaggcggcgggatgcaggccggagaagaggacgaggagggcggcggcgagcaagggaaggacggcggccattgttccacagagtgtttacttactgctcgtccagtgatggtgtgaaatgagatggagagctacatgtatataaaagagagattttgaaaagggataagattttggcgagatttggatttgttattaggtgcagagttaatagggatgagctgtttctcatgcatccatgcaaacggtttttggatttggatgcaaatccatcggagcttagcttacgcaacaacacacctatgagttagggagaagtggttggatcttgaatggatggatagatggatgaatcgatacatggatatgctgttcagtggaaacgcaaagagaggccgaagaaggttggcgaaatatcatgtgaaaacatgggtttagtggaagtttttgcttcacttcaactctcaaacgattgtgagatgagcgtttgttatgcatacgtgcaaaatcaagatcaaaatcatctacattttgagtgattttggctctacgatcgttataactcaagcaatataactattgctgagaatcccagcaacatacttaaagtgaccaatcgagtgataacaagttcactcaggtactcaggtacagacaatgttaccagaactactgtatgtcagataatatctcattttggttaccatcccccacccacattctcctaaaaaagaaaaaaaaacgagaagaagaaatgcagcaagaacaaagtgtcagtgcagaccaaagagcagccttgagagctcgtgaaacattatcttcttcatcatagtgcttacactgcatctttaaccttcttttcttctctcattcgagcccttgacaaagcgtcagtcatatctgagttcagtggcacagcaactttcagcagatcaacgaaaatttcaacctcctcgacatcaccttcatctccaagatacttaagtatcatctcaatcatcccaggcctagggatccaaccagtatttggagcatatacacatagggcattctttgtcagctcatatgctttcgcagcatcacctttctccgcatagccagctgccacaattgcccagctggttgaaggaggcatctttcccttcttcaagaaatcatccagaagtgcctcagccttgtccagcaagtccttctggcggtatccagtgagcaggacatttggaacttggaagtcaaatgcatttccgctcgactcccactctttcagcaacacttcagcttcttcaatctcattaagtttcacgagcactgcaagcattgtagtgtaatccttattaatatgcctattgcagttcgacatttggagcgcccacagcctattgacctctgatttgtcccccagatgtccatacaaggaaatcaggtggttataggaatctgaatcttttatatttatttttgcttctgctttctttaaggcagagaatgctttctcccttatgttgcccttaatgtagttgcttgccacgacagcatacgtgttccaatcaacaacgattttaggttcacactccatctcttcaagggtgttttccatcccgaaaaaatcagcccttgtgccataagagttaatgcatattctgtagctgaaattgtcaggaacgataccattgcttttcatctctgcaattactgaaggaaccttttcatgctgccctaggttcgtatacagacccatgatgttgttgtaggggagtgtggaaaacacaaaacccaactctttcatcttctgaaaatgagccaacgatttttcaaccaggagttcccgtgtgtagcagttaagaagtgcaccatagggtttttctgtcttatctttatctggcaggttgttgaagtaagtctcggctgcactgcttccatgaatttcaccaatcaaatccaggtgaacagcgtgatcctttggcagaaattttacatgtcccttggcattcatccattcagagacctgcgcaaagtaaaaggttacagagaaatcaaattaaacatgccaactaggaagtgcacttgattattaaaataagaagccccaatggtgataagctcttgaggtctggagtgtaaattatagatatgaatcagtgttgcaaccataattgataagcacattatattagtgcttttaactattgatcaggtttcatttcttggggaaaaaaacatacaatcccatcacagagactaaaccacgtgcgactgacatttggcgctagttccagtacagcctgtgtctgtcatgaggtcataaaatagtaccaacggtcacttaccactgtcatgcaagcctcctcatgatgttcagttgtacacagccaatcgccagttcttcataacgcccaaactatattaacacgacgctactacatctctcttcttgttcatggtgcagcattacatcatacacctcacatgcatgaagagggccaacaatttggcgagtgcaactcaagaaaccaaacagcggttgaggccgcaacggcatcgaacgccccataatagtctactgatgatgagctgagctgaggtacgggccacgggggggggggggggggggggggnaaaggtnnanttacctcgagggcctggcggtggcggcgtcgcttgcggagctccttgacgatgcgctcgagctcgacgtggcggaggcggttgcctggcttggccgcccaccgctcgatctccggcaccaggagcgtgcccgggtggcccagcggccacagcgtggactgcaggctcgggggccgcgccggcttcctccccccgctgtggccgcgaggagaggcgggggaggaggcggcggcggcggctcgaatgagggcaggggtggagccatgggatcgcgcgtggccggcggggaggagcctgccgcagccgaggcggatcaggcggcggccggcggcgaggaaggaagaggaggcggccatgggggttaactggggttttcctcccttttgggcctcttgggttgaaggaggtgatatgaacttgtgaaggttgctcaatttgcggaaaaagtacaccgaaaggtccctcaacttgtcatcgaattacaaaatcgtccttgaaccgtaaaaccggatataaagcatcccatcttataaaaccagtacaaactaggtctcttggtctcttgatggttttaactccggttttgtctgatgtggcagctgactcagcgtgggacccacgcgtcagcctcttcttccccctcccctctccacctctcttcctctctcctctcttcttcacgggcaccggcgggggagcagctgcacggtcggcaggcggcggggcaaggagccgcgcgcgtccttctccggcgcggtgttcaacctgtccaccaccatcatcggcgcgggcatcatggcgctcccggccaccatgaaggtgctcagtctcgtgctgggcctcatcctggtgatgctcgccgcggtgctcacggacgcctccatcgagctcctcgtccagttcagccgcgctgtgggcgccacctcgtacggcgaggccatgggcgacgccttcggtgctttcggcagggggatcctctagctctgcgtcgtcgtcaacaactgaacaacgtcggcgtgatggtcagattcactgaacatttcattgtgactctaatggcttgtgttctttttccctgggatgagttcagatccactgaaatacacgccggccgtgtcggttgctctggccatcgtgttcgtggtgatcaatgtcggaatcgccaccatcaagctgatgagagggcagattccgatgcctaagctgttccctgatgttcatgactggagctccacctggagacttcacactgcagctccagttcttgtgagttgtgaccgcctacatttgccattacaacggtacattttaattaccagctaagtttgcatttttctgtgggaatgtgattaacttgccactgcattcagtgcacacaattcacaacgagctcaaggaccactcccagatcaggccaatagtgcgggcgtcactgctgctctgcttggtcgtgtacaccaccaccagcttcttcgacttcctcctcttcggcgaggcgacgctggacgacatgctcgtcttccccatcgtgttccacgcgctgcgattcaacatggacggcctcctcttcccctcagcgaggcccctctcctgcgaggctgcgacaaccggaggttcggcgcgatcacggcggcgctcctcacggtcatcttcctcgccgccaacttcgaccccaacatctgggacgcgttccagttcactgggagtagctgcatgggcgacgacgtcgactgcggaggcggcggcgacagctgcctcgcggccgtaatccttgtggcagcagccgtgtctccgatgaggccgcgctcgacgccgtaatccttgtggcggcagctcgacgccggtggcggggaagaaggagaagacggcgacgaggtggtgctcgccatccgctgcgccccgatgcgacaaggctgcggcgggtcacggaatgccgccgccagcgccgccaccaccaacgcccaactctgtctgggccatcgctggcgacacgacccccctagcccctccaccagtggctcttgcccctgcttcggccggccggcatgaccggcgaattagaagagaagagaagagaagagagagagagagaggaggggagagagatgacgtgtcatcctgtcatgtggggcccacgtgggtcctacgctgactcaggcgccacgtaggataaaaccggtgtcaaaaccaccgaaggacatattgtaaccggttttgattagttaagcgacgtcggatatctggttttgcagttgagggatgattttgtagctcgatgacaagtcgagggaccttcggtgtactttttcctcaatttgcggttgtgcaaattttcttaaatttgggaaatggtttacgcggtgacaaaataatttctccgctgtttgtttgttactccagcttatctccgctgcatccgaactttaaatttcgaaaaattttagagtttatttttttcacattagcaattaagttgctaagaacatcaccaagtttttttttaacgacttgcacaagacggtgcaaaattttattgatagaacaggaaaaaattacaaagattacaaccatgtaaggtcgtaactaggaaaaacgaaaaaatataccaccacccacacaccggtagcgccaaactacaagtcttggagaagactagcatcggaccgaccgccgctaagctaacaacggaaacaaccaagatcgcccaaaaccctatccttacaaacaacataaagcccaattcatccacgtcttcaggatctagggagaaagggtgggagagaagatggaacacctctccccctaggccctccgccgtggccaacttgttgaaactaggacaagttttttttttttggttgctacattgatttctccacttatttatcagccatagagcaaacgatgagaggctattaaatgctaatttgttttatttttgtaggtcatggttaatttgagtttataatccaaaggagataatttgaattaggatgtatgatttgctagtataattcctgtcacagtgaaaaatctcacagaacattgctgaaaggggaaaatccaaataccccccccctacaagtcactgctctttctactctccccccacaactcaatattgttcaaaacactacacataaattaatttctcttccaattttccactcctattcagtttttacgctttctcgtgatgcgctcaatttctcgttatcgtgggccttcagcgcagcccacgggtggagttgtctcgtgccacattggcggcaaaagcgcgcacaccttcttccactttccatctttccctgctttaatttcacgatcgctactgcaacactaaggcggcgaaagaacagcggtacaacggcgaagtacgacgatgatcgcatagtacagagagaagggatatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33598 - DNA, 1255 bp, Oryza sativa
aggggaaaatccaaatacgcccccccctacaagtcactgctctttctactctccccccacaactcaatattgttcaaaacactacacataaattaatttctcttccaattttccactcctattcagtttttacgctttctcgtgatgcgctcaatttctcgttatcgtgggccttcagcgcagcccacgggtggagttgtctcgtgccacattggcggcaaaagcgcgcacaccttcttccactttccatctttccctgctttaatttcacgatcgctactgcaacactaaggcggcgaaagaacagcggtacaacggcgaagtacgacgatgatcgcatagtacagagagaagggatatcaaatcccctgcccggcaagagaagtcgtagaaggaagcactgaagcatcctgtacttcgatcacctcgtcaattcattctacaggttccttttttctccctggttttggtcggatcatgttttatgcatgtaattgttgtattactagattcagataatcgaatatttgctctttgatttaggttgcaaaccaataaattggtataatctctgcagatgggtcgaactagtatttccttcattgttcatactggttgtacaactagtggaagccctaggaaatctggtggggaaaggaattgttcatcgatctatcttttagacagggattctctgaaattcatcgatttggaggagtcattgcttatacatggatatcaaaaaggagatggtgtatactacttgaagccttcttatgtccctccacaaggtcttgtactgattctaaatgatgaaaaaatcaagatgatgttggatgatcataagacggaaacagagtgctcactgtacatttttgcaaggccgcaggaattagtgactgataatggaagcacatcaaggtttgtaagcccaagtagtatcccattaatcggacatcataacagtgtcccaggtgattttgataaagatgatttgacattgcatgaagagtatgtacagcaacagttgagggaaaagaaaaaaggcaaggaacctgctattggcaaggagccagtaatgttcttccaaggagactctgatactgaggacctatatggtactagtcagatagatgcagaggttaaccaagcagaaccacatccgggaaaaactacacaggaaaaagaactagtagggaaaaaaactaacaagagaaaagagaaggatataggccaatcagctgaggtggattat

SEQ ID NO: 33599 - DNA, 6448 bp, Oryza sativa
atagatgcagaggttaaccaagcagaaccacatccgggaaaaactacacaggaaaaagaactagtagggaaaaaaactaacaagagaaaagagaaggatataggccaatcagctgaggtggattatttgtcagatgagcccaatgatgacacaatagatttcaatgacgaagcacctatctatgtgcacagatcaagaggaattgaagacatcatttttgatgagtccaccctacggcgtccacacatgcaagttggcatgttgttcagtaatgttgatcttttcagagctgctttgaagaatatgatcatcaacgaggggagggaggtgttcaagggcaagaatgataggaatcaagtttctgtcaagtgtaaggcagataattgtccttggtacatatatgcttcaaaattgcctggtgaagacacctttaaaataaagaagtatgtttcaaaacatagctgtgggaaatcacacaatatagcacagcttgactggagatggcttactaatgaatacatggaattctttagatctgagaagaaatgggatgcacatgcctttcaagattgtgtcaggcgagataccaatatagaagtcagcataagtaaggcatatagggcaaggagggaggcctacaagaaagttatgggcgatcatgatttgcagtttaaaagaattcaagattatgctcatgctgtgctatctgctaatccgggaagcaatgtttttgttaagtgcgaagtatcacctgagccagaaataaggcctaggtttcaaaggttgttcttgtcatttgatgctcaaattactggcttcttaggtggttgcagacccttcatcggtatagatggatgtgacatcaaactcaacaatggttctcaaatactagcagcacaaggcagggatgccaacaataatcttttccctattgcctttgtagtagtggagtctgagtgcacaaaatcttggacatggttcttactatgtttggagaaggccattggaaaaggagaagagtttgggggctgggtattcatgtcagatagacaaaaggtaatggctatcatatatgtctactttgcattaatacatgtcaactgttttttttaacattttgctgccatatatagggactacgcaaggcagtggctgaagttttcccaggagctgagcaccattactgccttaggcacctacatgccaatttttcccaagcaggatttagaggggaatatctgaagggtttgatggaacgagcagcatatgcatatagacaatctgagttcaatgctgctatgcaagaactaaaggttaacaatttgagggcatgggagtggctaagcaaggttccaaccaagcattggtgtagatatatgtttagttctagagcaaagacagatcttcttcttaacaacataagtgaaacatacaattcaaagatactgggagctagagatgaacccataattaccatggttgagcacataaggacaaaaatgatgggtgatttcaataataagagggaaggtgtagaaagggacaattggcaaatcccaccaaatatattaaagaagcttgaggcagagaagagagaggcaagatattgcaaatctgtgtgtgctggtaggggcatttggcaagtgtccgcatttggtaatcaatatgtagtggatttgaacaagcacacttgtgggtgtagaaaatgggatttaactggaatcccatgtttgcatgttgtttcagctattcaaggtttcaagcaaaggccagagagctatgttgatgacatattgacaaaggatgcatatgcgaggacatattgtgggatgatttatcccgttcctgatgagacacagtgggaaaaaactccatttccagatgtagacccacctgtggctaggacacaaccagggaggccaaaaacaaagagaactagagcatctgatgaacctagggttcaaggaaggtcggttgcaaagacaacaattagatgtagcgtctgcaaagagtttggtcataacagcagaaagcatggaaaagacaaccaaagttcttcatctcaaaatgtgagtacactactaatttatcatataaagacattgtactttgctacttctcacaatttgttgtctgtttctctcagtgtaaaacacaaataactaggaggaagaagaggagcaattcccagcctattagttctagttcaagagatgatattccaacaacatccacacagccaccagtatatatggacaatgcatttggtgttggtctctaccatcatgtgccagatgggccttatatcggtcctactggaagaaagctgcaaattaggagaaactgatctcctatttttatgcagtagtattatttacatcaaaattcttagctacaattagtgggggatgctgatcccttcttaatctcagtaccatcttttttacgacaaataattttctgtacttctaactatcagatttgaattgtgatttttaaggggattctacttcaataagcatgtcttaaatattctggaatgtgtttttgacttggtgttgccattcttcatattgatgtggaatcacgaatcaggaggcagacacggttgttttgcactggtggactagaaattgttttcctgtgtttatattagcgtcatgtcgtcctacccatatggctcgcagaattaagagcggatggagatgcgcgcgcttttgccgccaaggtggcacgaggaaacttcgctcatgggctgagctaaaggcccacgataacgagaaattgagcgcatcagagaaagcgtgaaaaccaaatagggtgggaaattggaagagaaattaacttatgtgtagtgttttgaacaatattgagttgtagaggggagagtagaaagagcagtgacttgtaggggggtatttggattttccccttgctgaaaacacacacagcatcaccaaggtggtccgactgcttaagatgcatgttcttctagcattatctaaggaaaagatgcagcattcaacttgctgcacaaatggcacacccaaaatttcttgggaaaaaaacatgaagtttaacatacatttttcactactaattggagctcaacaccagagaaagctagaaaaagcaaatcaacacccagagaaagctagaaaaagcaatctggaaaacaaaacagctaactaagatttacaaatacatgtgcatttaaccccatttacatataacaatgttggtacaaagaattatctacaacaactgcacgcatgagtgcaaaagtgatcatctagcactcctatgttctagccggcttcaccatccgcatcttcatcaggacgccattctagtagagcttggttctgtggcttctcattggaagatctaacatcaactagtccttcgatagagcagttagacagctctaacaacattgcgcagaacccgcaggagcaagatctgcaaactgtcccatggttcaacgcagagttaaacctctggaatggacgcgtacatatcagtataccatgaagctgatgatggagcatcagaggaataatgtaaagactaagaaaacatgatggagcactaggccactatcgccctggcaagcacatacccctaaagaatccttcaatttctttatctccatagattgcttctgagctagttcatgtgattcctgcagtttcctcagggctccactcaattttctctgctctttggaaacctgcttagtgcatcaggaataaaaaataaaaagtaaactagataagccacagatatatcaaaacaaaggtacaagtcaaattcacttatatttatatactaaaacatacttggttttttaaatcatggggcaaccatttcacgtagtctatacttacgtttttctagctacatttacacatctaacttatttatttatcagtacctgagcctctagttcctggatttgttggatagctgcctgctcaatgcaagaccgacgcttgtattcttcctcaagcatgccagttatttggtaccttagttcagccatttcttgggtgagatcttctgcatcctcctttgccttcagtttttgttctcgaagctcttcctaacatatttaaaaacaaaatgcttacattacaccaaatgatcgaagctattcaaataaaaaacaaatggaacagatacatcctcaaattagctacttttggtacagttaacacaccggtaggacgtggcagcgggagaatagagggagggaaagcaaaagtgccgaagtacatttagtagacataaactaaccttgagctgctcaatcagtagttcagattcttcacttcgctttgccatattttcaagtattgcaccgcccctctcatagtattgaccatcaatcttctcaattgttttgtcaacttgctcatcagatgttaaagcagtggcaactcctccagggaacaaccgttttagttctttattctcaagtaaaagatggtcaatagtcttatgtgcctcttgcagctggagctcatactccctcagtttattatctgctatggctttatcagcagaaacatgctgaccaaagctgtcagcatcaaacagtctctgttcaagtgtagttaaatcaagttttaagctctcaatctcacattgtgaatccaaatttacattctcaagcttctctatttgtaaggctgcctttttcaatttctcttcttggcatcggacttcttccatcagaagccagcactgagaatcagaccgcatcagctcatcatctataactctaactctttcaggaaacttttcaagttcagttagtttcagttcaagactgtggatatgctctcccatgatgtttgcttcaacatttcggatatttagctgatcctgcaaatagtctggatttgaaaccaacaaaaactgttcaagtcattgtgttaacaatagcacggactaacagcaaatagagagagtagaaacaaaggaatataccaatttcctgatagcagttcctcagttctgtttccaatttctcgatgtaatgcctgtccttctgacaggccctaaaagctgcatttttgtctagcagcattttctgcattaattaataaaacaattagctccatcggagtgctaacaaatcaataacacaattctctcttatgatacattgttttggagaacatgcgcaatactatcctatgttacattgatttggaaacatatcaaaatgtcacatgatctggagtgtcacttcgaaatgagatggaaacattatcatgccagtacatagaaaattccatgaaggagcttgcaccttacaggcttacagtttgtcatagttatgttcaatttacatgttttataaacactatatgaggattctatcaaacaactgtttagctaaaatttccactttacagtgatagattgacacatataccaggtggaaatatccaagacttctcaccttcttaacaataacaaggaacagttttcaagcataggaaagctcatgaagctacttaggttagataccagactaccaggagtggtaacttaagttcacatgaatcatatgaactgacacctgagtgtaaataacaacctaatcctcaatgcatatcaagaaatggttaggtaatttggcattacacatgtgaccaagtgagtagacaaataggctgagaagaaagtgttctggaaacttgagaaaaatctctctttttttttgtatcaatcattaatttgcagggtaagggagaaaatcttccaagtgccaatatcagagttaccattgaacaaaaagaatgtcagattactggtttctcacaacactaaaaaataccagtgctcccaaaaaattaagttttacaacgaataaatcacgaaacacatgtcaggtacctcttgattgttctctcttttttgcagaacctttgcaccattaacaggataatgcccattgccattggagctactagacatctgcaaagaaagcaacggataagccctactgacagaaaatttggggaactcaattaagatgacattatcctgtgatatcaagcacaagaacatatttactagagtagttactacgctgccatatcgaagctagagattggcaatcactccaacatggactctcatgctactatagttgcaaaccaagaaaccaaaatgcggatccaatatttacatagcataccgaagccgtgccctgaacgaaaacagcgtgtacctctgaatagattcagcaatggatagatacagtacaccaggaatcactatgagcaagcgacgaaatcgagagctactcgggagcaagtttgggctcccaccgctgcctccgaccttagctccgggaagcagtcaagcaggagggttcggccggcggcggaccgcgagttcagttcccggccgcgggcttggcgtcggcgac

SEQ ID NO: 33600 - DNA, 6292 bp, Oryza sativa
  unsure (1)..(6292): unsure at all n locations
aaagcgaaaattcatcaaattttggacaagctaagctactactgctcgatttagttctccgttctataagggaggaactttcagggacagtagctgcaagaaagacatatccaaaacttgtgcaatccacttggtccaatgctaagctttgcgaccaaggttttgtctcacagacagatcctcctcattatcaatggacaaccccaaatagcacattactactcaatacgcataaggtttggggtttgcctttcgttgtatgggtcaaacatgagactatatataccaaattctaaactttgcaccgttaaaatgagatgttgatattaaacagtcagctaaaagaataggtataaaagggatcaaaataaaaaaaaaattcaagggtatacaaaggaacgagcaaagctcaggataattttctattactattactaagggtgtatttgtcatttgctactcaatctgccaatgcaactgcattgtgcatttgtgtttcttcatgaatgcagctcattagttaatctagtagtactagtcctgttcttgaatgtctcacagatgtaggcacacttgtccccacttgttcttcactatgacagcatcacccatccgggaaaatcattacccagcactgctggtcaacagtttaagtacgcactgactaaactcactaaaaacggtataagtacaatttgacacttctttgctcaatagctcacacacaaggtttttcttttagataatagctcaacatacacaagtagcatactaataaaaaattgttagttctagatttcatacctcttatcccagtagtaagatcatgaaagaatttaataaagttgccaattgccaaccatgccaaggactactcaactagtgctagatttctgaattttctttttttttcttttcaggttgatcagtgtagcctctatgcgttgtcaatgatacttctccctttattttcttcaggaaggaacagaaagtcaccttctggagttcttgttaatgatccttctggaagaattaatcttgcatgaaaaaaattggctaacttgcaacgatggagaattaattaattgcagggatcgatgtgtgcacccaagggaaaagccggccgtatctatgcaagataagcagcaagcaaagcaaagttgatgccttgatggccgtagttaagtacagggagacatgccagtagaagatgcagcaaatggggaggctgcagcaaagatacgacgtgtttggatgttccaacaactccactgaaacagtttaccaatcactcgctggtcatctcacactaataactagttttaatttggcgccacataatgctggtccatgcagatgcaggcatgcagagcgtgatgattcactgaccaggcatgtgggtacccggcgattctactagtctgattaatcaactttgttaattgagcaacttttgttgtttcagtatttaaacacagcagcaaagttagctgtttatgtgttcaggactggatgaaggtttaacaaaggactttgggctactgacctaatggctaattgacagaaagtgatgttcatattgatacctacagtttatcaagcagttctttaattatatgcatgcagttaaattacgtagtactagctttgcgtattgtactcccttttgaagagctgcacagctattggcaaaagcttgattaggtttgtttttgatgcccaaaaaaatgtcaacatgaagcactagtttattcagcttgctgtcctgtagttccatttagtggactcagtgtttcccatgactagataagttcccatataaatttgttgcttgttccaaacagaaacaatttctttttttgggggggaagaaacatttttttaataaacagtttacaatcttgtaattaactgtgtcattctatcttccttatgcctaggttcataaggagaacctatttacacctcagttagcctagcctgaatattattttttctcacctgaatcttcaatttgagttgcacaccaaagttgtgttactcaccaatgtcctttggttgttaaagtcagtatatgcacgttctcagacagccagacaagtaaaactaaagtgccatattgatagaaaatgttgctccattcgtatgagacttttatggttgatggattatcaccgagatgtattctaataactcgagtggatgttcgatcgtttattgcatgtcaactggatggttatgaaaaaatttcaaaaaaattgacaagatagatcaatatataatatatcactttacaaacatgcaagttcaaattcaacttctataagttgtaacaaaaataacaaatttagttgtaaatatacatatagtaatttaatttttgtttattatttttgttacaatttgtagaagttgaattttaacttgcatgtttgtggattgatatattacatattaacctatcttgttcatatttttttaattttttttataaccatttagatgacatgcaataaactggtggacgtccactcgagctgttaaaatagtgtcccggattatcactgcacacatcccaatcttctaaatgttatgattgttactaaaactttttcatgagcatttcttatggcagaggccaggagtcctgtctcggtataattgtatcgtctcgatgtaattgattaagtttaatagaatcttctgttatcttaatataaaaacagagcatttcttaagaaaaattgatctttttattttactttgtaatagctaattcatttgtttttaactcagattcatccatcatccacattcaaatgtaccccttattaccttgcataggcgcatagttgcatgcattgagaagtaagcacagcactcaacggtatagagaatttttttttttgaacgaatcggcaagctgccaatttcattgaatagagaaggagtaaactttacaagtaagaaaaaccaggcccaggaccttcggtcctactgagctaaaaataaaaagcaagccagctaccaagatgcctcgcccccgcccgagaccatgttttggcctcctctttaattttggctaacagacttcctgtagatagctctttgtgctggaaaattctacgatttctctcgttccagattttccagttgaccagaagtgttaacttgcgaagtgctttctttgggacttccttcaagttggcggtggcctcccaggtatagagaatttgcatttcttcgtctttcttgtttccttttggagtcttgaacaagtgtttgatgggtgtgattgatcactgaagctactacatactacatgacggccaaatctgccgacatccttgtgaattaaaaaaaaactgacagacttggttagcaacaacaactgggaaattaaacggcaatttgggtaattataagcagctagactgattaagaaagaattaagtgtaaataagctgtcactcgcacgccataacatttgcaactatccaggagatcatccatataaaacacatatgtatgcgttatattgccgtgtcactgtgcggtaatagcgtactgtacattactaattcattattattgggtacaaggtacaagaaaacgatggatacgcatgcaattgctacatagtccagcaccatattttagaaaataatcatttggtatatctaccagacctcactggtaaactacgtggtagcttctattgtttaccttgcagtttatagatttgctccggtccaacaaaaagtatctcaaggtaccagtacctctcggtatcaaatcgttttcgatcgttggatctaataatgcccattaagatccaacgataggaaatgattggtactgtgaggtatcggagcaaatctcttcagtttataagccactatcaaattttaaactttaaaacttaagcttaaagttgatattaggtttttttcgttatagtttgttttttaaacatagattttagaagtcactaaggacacgtataaaaatattactcataagttatttattttaccgataaatcgtaaaacaacttattagttgtaggccaaacgataggtaaaactcagtggtaaactaatagtgttatgaataattaaatgtatccaaacaataatgaaaaagctctaaattctttcctaccactcagaaaaaagcctgcaatataatctgcaataatcataaaaagaggtccagtggatgaatttatcagctggcagcaaagagacaaatatccactactttattataagacgatgtatgcgatgttaccatatatcacgccattctatctccaatgaatattgtcggcttacactagcctacccatgaacaactagcgatgcgtatgtgtcattgtagatagatagacaccatctggtcatcgccattacttataggtgtccaaacgggcggcacggcccggcccggcacgggcacgggtccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcctgcggcccacgggccgttcggggcgaaatttgagattttttagaattttttcgaaatttttatgaattttttagcctcccaacggttattttcaaatttgaacggtcaaatagccgttagtgtgccacgtggcgccttcccattcgaccgccgcccgcccacgtggcgctttcggcctgacgggccgccggcgaaacgggtcgtgccgtgccgcgggccgtgccgggccgtgccgctacagtagccgtgccgtgccgtgccggcccgcgggctcggccagcggcccaagcacggcacggctactcgggccgtgccggcacggcccgttactgtagcaggccgtgccgggccgtgcctgctacaggttcggccgtgccccgggccgcccgtttggcccggcccgtttggccacctctaccattactgctccctacagatagctatatacagttgctcgagaaaatctatatacggtggtatatatccatatcaccatgatcagggttcacaaagccgtctccttggtgggtttccaagttttcacgaaaagtgattaaattttattgaaaaaataaaattcagtttgactttctttaaaaaaaaatcattgatttaccgagtggtttgtcaactccagccaacttaaaaactgtaaattccgtgagagaaaaagagagatgatttttatagattgtgtgaacacttaccaaggtatcatttcatattattctcgtgaagtaagcataactcaattgattagattccttatgataaaaccagtccacttaaatcgaagtcctaacttaacatgagtgttgttatttacgactaattattctgtcgacagcgaggcgtccaaatttgataaaagatatgggcaggttatgtttctaaaaaaagaaaaaaatgtcctcgtagacttgacacgtcatcaaagcagcctccacagcggaccagctttctctctccaatgtaacccccttctttctctctcctcttcggcccatgtgactctctcttctccgtctgtttttaactttgcttccatgcatggatttctcctcccccctctccctcaacctcaaccgcaccccccgctcgatcgcgtcgcccctcgccatctctgcagattaaccacaccaccaccccaccccaccctaccctacctttcctcccctctactcctccacctccacttcgatcgaatgctcgctgccgcctcagatcttcccgcgcgatcgcgcccagctgggtcaggttcgttcgttcttgatccccggatcctgaattccggggtttcttggaattctttcttgggttcgccatggatgcggggggagtggagctctctggcgtgatgcatcggtgtagggtgtgcgggaaggggttctcgtgcggccgctcgctcggtggccacatgcggtcgcatatctcgtttggggaggcggcggcggagctcggcgccaatggcggcgtggttgggtacgggctgagggagaatcccaagaagacgaggcggctgtctgagtttgatggtgatggtgatggtgagcaggtggaggtggaggagggtggcgatggcggcgagctcagggcgtgccgggagtgcggcaagctgttctcgtcgtggcgctcgctgttcgggcacatgcggcgccannnnnnnnnnnnnnnnnnnnnnnnnnnnnn

SEQ ID NO: 33601 - DNA, 8327 bp, Oryza sativa
ccgctacccctcccaagaaacggctacggctacggctacaactccgacgaggattcagctctgctccagtacgccggcgacgtcgcgaagagcaggaagcgaagggctagctaccactctcccaattccatctcctcgaagaagaagcagcagccgcgcgcggcggcgccggcgaagcggacacggtacgagtgcccggggtgcggcaaggtgttcgcctcctaccaggcgcttggcggccaccgcgcgagccacaagcggatcaacactagctgcagcgcccccaaggtctcccccgccaccgccgcggcggcggcgcccgcgccggagccgagctcggagacgtacgcctcgctgagcaccctctccccctcggcgtcgccgggctcggcggccgccggcattggcgaccgcaaggccaacaacaagtcgtcagcggaggaggagaagttcggcggcgcgtgctcctccgacgagctctacgccgagctggagctggagcagcgctcgccggcggcggccgcggggtttcttgatctcaacttcccgccggcctcatcggaggttggcgtgaactgaagcagaattggccgcgtcagcagctgcacggagccaaagatttcttgatccgaaaatcgaggcgatcaatggggaactgtacagattcaattcattccattcattccaatctcgagctccaagctttccaagatcattgaggaaaaaaaaatcgacaagtgatcagagttttctcaggttattccaaagttttcttcatttttgtttcttcttcttcttttttttttaacatttcctttatttagttttctctcctttgaacttctttgaaggggctaaatcacaataagcctatgatgataagagctcacagcatctgaactgattcagttattaatagcttaagattagctcaaagcaactgtttttaactctgttatctgcttgcttttagcaactatccctgtgtcagtatactaactgaatcccccgtgaatttctgggtcaatgctaacctttgctctgctcctacttttgctgcactaatccgagatctgccttgggggaggcaggcagcagcaaagccagcaacagcttggttgcctcaaagtaaccacttgcttcagttgctgcatgcttagtacatcagtactgtcatgccattggttggtgtggctgtgagtgaacattgtgcagcagagaagcaagcaacaatagcattggacccccaagaaccagtacattatctctatctgtgacagagaacacaagaatgcaaatgctgataaagaatcaagaaagcattgtgcaagcagcaaggtgagtagagagtgatggaagcagagagaagctgcagactagtgatgaaaatgattggtgagtacagtgtaacaactaacaacaagtctctatgaagaagcaggtactaagcatgcatgtgtgtgtgtgtgtgatggcatgtggtatcaatgcttctggggttgttcacttgtccaccagagcaaccaggacaagtcttctcactctaccattccggtgtcattttctctctcaacccctcctcttgttgctttagcaagcctgcagcttaaactagattatgttttctttcctcaataaagattaatagtattgttaatcatgacatctttccctcacctgtttctctctcaagagagaggaggaggtgcacaggcacagacagctcacacaaacattgtgttgttcatgtctctttcttgcctacctttgttgaactggtttgccttgggagacacacaggacactcgaggctgcctggctggcctctttgtcagggagaaacctgctaatctgctataatagtgttgcttataattctatgattctatccatcacaaaggacacagtatagctgcatcctttaactgcagcttgcaggcctttttcatcgtttacttgttagcttatcagccgcgaccaaaatttttagtactaaaactcaatattagagttgatgttagggtttttttcatcgtagtcaattttccaacattggctttttaaactcaatcttgttactctgcaatagtatatgccttgcttcagtttgagatattcagtaaactgtgctgctggaaaacaattttttgtaggtccatatgtgttgtggtgttggttatcatgtagctcttgtcgaaaattgaggtgtctgaatataatgccaaaaggcaagcaaaactgcaacgcttgatagttaagaattttgggacggcagaggctaaatagggtgtgtgatatcaatgacaatcagatgtggaccattcttgtgctgttcttctgcggccccatccttatttggtggagctctcgatgtatgttggcgatccacttgtcaggcaaagtctctttgtttcttttgtggtgctaactttggatgttggcctgaattgaccacaataatctactagcatgtctgatcagtgatcagttcgtggtttgatggtaattaagaagctcaaatgtgcacaacatagttgaactgaattatggctgatctggtactgttctactgaactcaattctcagtttagtcagtgattaggcacaatttgtcctgatgtcagatatgagtagcttccattttgcttttacgaagcacataaattgtgccatagtcttacacacactcatcactaactaaatttaaagttattgccagtgacacatccatttgcagtttttgcattgacttgaactgaaggccccaatcaaacaaaaccttttgtttttcctcaacctccatccctgaatgagttagtttacaattccaatttcgatccaaacaaaacagcacgatccttgaccagtaacagcaagtccctagaataataatgccactgtttttcttttaagtctcagaacgagcatgcagtccatcacccccttggaagatcagacacaacaggccaaaatctagaaaagaaatgagctgtcacaaagcttcttctgcatctaatctagccaaagcatcaggtcatcacattccacaacttgtgagaaagatatacacctgcagagaagaaacaaagatctcccggattaatgaccatcattgcaagaaaaacaatgaaaagatactgcatcaataaagccatgagaggtcaggtgatgtgcaggccacacctctatctgtgggctgtggctcccacaaaagtttgcagcttaaccagcagaagccattgctctcctgcatgcctgcattgcattgcaacaatgcagccacttaaccaacctttctttggtctcaaaaaaaaggaagaaaataaaagagaaaagaaatcttttattagcagtcagcacagatccagatctgcctgcctgcctgcttaggtgatcagtacaatgttgctaaaattagccaagtgaatgctccgaaagataagagctctaattggctgtatgtgaccaggtaagtaagcagccaccaacttaacctgacattaattgtagctaaccattttagcttgtttgtgttttttatttgtggcctaaattaaagtcgttaataattcggtacattatttgatgatatactggtctaccagaaacaaaggtagactctatttgtgaattcaagaatgtaataattgggaaggccgattaattagttagtataatgaccaagatcacaccagccaagcttggtggttactctttcacagaaaagctgaagctttttacatgccctgaaatatgtgacaaatcatagctctatctagcaatcagcaaatgctgccttaatcagctaccatctcatgccatgctacttgctttcagtcactgtagttgagatgattaaagaaatacatatttagtgttagggaacataagctttggattcaaagaggatgatctagactaaatcaaaacaaacagacaaaaatggaattccgtttttctgttatttttcaacttttgagatagacagaaatgttaccatatagttagcctatgatctcttcatctcttgattccaacttgatctcaccaactaatcaccaacaacacaatattgcaggaaaaaagtgcagaacttggtgtcaatttcggtgcattgcaggtgttgcactgttgacgtcaacttcttactaactagtacgtacagacgtactacaagtactcatttagctttactagaaaatctgaaacatttcaggtcacactcttcttgtaaatttgacaagatttggaatgcatgaaaaatctgttattagacaaatttcctcgtatgatcgcatccgcacagtaaaaattcagaggacaaagtacatatcaaatccatcttgtcgcctttgaggaaaacgcatcaatttccactatagagcaaaagatcggcagttaaagggaatatcatgaaatctctgatcagcaaataggattcgaacagctttgatggaaaaaaaggaggcaaagactgatgttagaagtaaagtgttccccactagcatctatcaggaaaaaaaatgtcaaatcaaattcaactctgtttttaactgcttgatttggctatgttcatccgtattggacgtagtgaccaggttttaatccattatctaagggccccttcgaaacaaaggatagaaaacacacgggaaaaggaaaaacatagaaattaaagtagcatgttttactagtcttacaggaatagaaaacacaggaaatatttttttgggaatacacgagacacacattttttattaagaggaataaatgtatttacagagcgggcctgaaaaccaaaaagaaggggacagggtacaggagaggggaaaagaaaagcataagcctaatctcccgaatgatttggcgacccaagaacaaacgaatggactgtcatggttggtatggctgatctagccatccgccagaggtccacttccccatcatagccctagctatcttcatccaaggtctgctcttctggttgaagacccgattgttcttttccttccagattgtccacgctaccagtgttgcaattgtgtcgaaccctcggcgatgatccttaatcatccttttgcgactgtcacacagccaggcatgaaaggactgctcgttgagaggtagacattcggaatgaccgatagcactaagagcaatccaccaaagctgtcgggactccgggcatgcgaccaggagatgatcaatcgtttcgtcgcgttgatcgcagaggggggcaatgatccgggaaatatgaggagagtctatatgatagcaccataggaaacaaacaaagcataggaaagtttccaagaggttggacctcttgcttatttcctatgaaattgagctataggaatgcaatcatatgaaaaatttcctatacttttatgtgaatcaatgggtttcataggaaaaattccttaggaaattgaatactccaaaattcctatggcaatcctccaatttaagggtcctaaaagttttcaaattcttagatatttttgaacaccaggatgtgtatctcttgttttgacgacacgtgtgtcgtactacctccattttcatttactcatcacttttgattgtgaatatatgtcactacgcacttaaatatgtgattcctcttttgcccttggtgagcctaattaaggtgatatatgtgcggcatatgtatttataaacctctagattctatatcccactaagttaggggtattttgatcattttatatagaaaaagtttattgttttggtctgggtgcatggtcaaaactgacaaataagtaaaggggagagaataattcgaatagtaatttgaatattctaactcatgtgctggagctcagacagagcatgcctaagagatacccaatactatccccaatcctgaagtatttgagttatatagggaaaaagtggatctaatagacctccaatctagaaaaaaaaaaaagaaaccctgatctcggttctcgctctccacaaggtgatgaagattgcaaactcccatttcactgatccatggaagtttgcgcgtggtagatcatgtgggaaggggaatgaccgttgtgtggtagttcggggtggacctacttctaattattgggtgttaattttgagttaatttttagatatctgttggagaaaagagtctattcacatctaaaaaccttcttttttagaagagtgttttttttactcggcctctatacccaaccggatactcaggctacatgccctttcgctcacgcctaaaaacctatttagggatcgtaaaagcataattttaggaatatattttttgggttttttttgtaacatacacatttacttctcttagccaaggctcaaatttgaacatatgaatgaatttagcagaaatttagaggaaatttactccagaataattagggactgaatttcaaatggaaattgactaattaatattaagctcttgattgtcaaaaggataaaaaaaagagtgtcctgaaatatttcagattttcacaatgtgtggcctaaactttttttttttgagggtaatgtatagcctaaactgataaggcagaaatctaattttatccacgagactatagtgagcctactcttcaagctgggcttcaatttatgtgggccaagtgttaacgaagagacattttgggccatcatattcggcttgtatgggccatcagatgtaacacctacgcttctctttacggcccaaaaacacctacgcttccgtagttctcgaggcttctgtttcctcgtctctcgtcgtcgtcggcggcggcggcggccatggaggacgacgacgagtgccctcccctcgccgtcgagctctcgccggagaagccgtacagtcctccgccgctcggtccctccgcggcgtcgccggtcggagtcaccgtcatcactggctacctcggcgccggcaagtccacggtgagcttttctccgcaggctgtgccctccccgcctccccgccccatgctctccctgcaaagtgcttggaggattgggggcgtcagattactggaactatgtaggatccgagattggtctacggaagattcctggaggactggagttgtggctggtagtttgatccgatcgagttgcatacttgcctgtcgccatagctcttgctgttttcttaggtttaggtagttctcaacatgctgggttggttggagcagtgtccttttctatttggtgagctgtcatgtgactcgaactcgcttcgagggcttcgtttctcataggagctcattttcaatttatttgtagttctagtagtatataagaaaaggttcatcgatctacatgttgaactagtaaccaatcaattttgaactgtagttgaatgttatatcaccaagtggagtaactagttctctttctttttttagactaaacttaacattaccgagttactcatggataaacacctttttcacagttgatgatatattgaggatttatacatgtgtttagtactattttatcccgtgcttttttatcaaaatgaatctgtcagtggctgtttactatttagcttatgttgacatttgtttctactatgtctcaccttaccactctcctagcagaacctgtacttattgaccaagtgtcctgtgaactttataatccagtttgttagttcaactaattggtatgttatgggataacttatctcccgcacatcaaattttcagttagtcaactacattctaagtgcgcaacatggaaagagaattgcagtgatattgaatgagtttggagaggaaattggggttgaaagagcaatgatcaatgaggggcaaggtggcgcgcttgttgaagagtgggtagagctggcaaatggatgtgtttgttgcacggtgaaacacagcctggttcaagcacttgagcagcttgtgcagagaaaggagaggtaaatacggatgttgctgtcttgcatggatatgtagcatacaccatttgatcctataagtatgtgtcctactattatgttttattccctatgattttcagtacaaagtgatgtcatgatgtataaagacttagtgatatgttctgatttgctattgatattctggttttagctcaaaactatgtttacactctggcattttttggttagtccacatggttgtttgtttgttctagttcttctggaaatagtaaaattttgattcactttcctgtgtatgctatgtactgatgcaaaaatgtaaagtggatcatgctcttactttgatctttcattaaagaagattggtgttttttttttctgataacattagtagtttcattatactaca

SEQ ID NO: 33602 - DNA, 2362 bp, Oryza sativa
tttggataacagtttgaaggactgcattgtattggacaattttcttatatatatatttactggtcaggttattgatgcaaaaaacttcaggctgcaaattgatgagcacaataagtcatcatcattccctgaagcatttcatcaaattgcatttgcggtaacttggtcctcagtgttatcctatttgtaccattttgtcttcactacagaatttggaattctttgtgctgattttgtggttctgaaatttgtcttacttgatgaatcccaaaatgcaaacaaccataataacaaaagtgtcaaaactttcctggaccaggatgttgtgatattgaacaaaattgacctagtagaaggcagtcttgaggatttggaaaggcagattcatgaagtcaacgctcttgttacagtggtgcagtctgtccgctgccaggttgacttaaataaaatatttgatcagcaagcatatggtgccaaggtcaatacctagctcgaaacttgcattttgttatttctttgtattcaatgcagaggaatctgtctttgattttgtttttggacaaaaaaaagactaactttgattagttaattgattaagtatgacatcaattagtcatgtcaacatatgggcactaaatctagtcatgccaagacatggaaactaagttattctcaggtcattaaactctatggcacttcttaacaaaagctcgaatcattcagcacgaaaaatcagtgttggtgagacgttttttcagcatctgcttgctcatgctaactagcaatacagaaatttgcttacttgcttttggtacttattttgtagttattgcttttgctggcgatggcaccttgtgctcaacaaaatctgaacaccttattcagggatttgattctgacatgtttttaatttattttccatagaattcatcgcagctgcaagaacttctggagtacagtaaatcagtaccacctaatctccgtcatgataacagtatttctaccttgtgtatttgtgagcaggatccaatttccctgtctaaggtactcttccattagagttttttttaactgcagttaacatttagaaaacatttcccttggacaactttgaaagggtatttattcattaatcttaaaaacatagattttggttgacaactacatcattgggatttgggatatttagtttttttttctgtactcacccattgttctgttagtactttgaagtacatgctcttatgtttcacctacttttctaaaatatgtcttcacattccatactgcttaggttgatttgaaaagttacaatgaacaagtgattgcaagctctacactcacttttcctggttgatgctacagcaacaactggaaacattatttgattaatattgccccttgaagtcttcatgttgagatagatgtgttatatgtcatgatttcaaagatgatcatttattgggatctgtgaaggatgctccatattctgctctactatagagaagagtagaagtctgtttaatattcaagcacatacactgcatttcctaggtttctccgttcatgaccaatgaacaccgatatacaattgtgagatatatgcatttttgtttgatttaatttgttctgaaggtggaatcatggctcgaggatcttctttgggaaaggaagttggacatggatatttatcgttgtaaagggattttacatgtccataactcggatcaagttcatacattacaggttggtgcatcataaaaagtattctcaagaatcatacattatgagttttcaaacaaatattatcccacctgtttgctctcatgcaggcagtgagggaagtttatgaagttctgccagctcgagaatggtccaagacagaatctcgcacaaacaagatagttgtcataggtatatttcgtaactcactagtttagcgatggcaacttatgaattgtttattaattatcatatgcctgtggtgctgcaggtcgcaacttggatatcaatatccttcaagattcatttagtcgttgcaagcactgatatcgaagggtttgttcatcctgtaccctgtaagttacattctgttttttggggttgtttgtgtgtgtgtatatacatacatacatgcatgcatgtatgtatgtatatatacatacatacatacatacatacatacatacacacacacatatatatatatatatatatatatatatatatatatatatatatatatatatatatatatatatatatatatatatatatatatatatatatatatatatatatatatatatatatacacacatatatatatatatatatatatatatatatatatatatatata

SEQ ID NO: 33603 - DNA, 868 bp, Oryza sativa
ttctgtcccatcaatatacttaggagtatttgctgcttgggacttgcagctgacaaaatattagcattttaatgttgttcctgcactcaacaggcacctccatgcaatcaaatactgcaaggagtttctatggctccccgaagtaatgtgctttatgtttgtctgtatatcttcaaaggtgacagtgctgacagcttcttggcaatgaagttctgcacaacggatgcgattatccgacgcgccatgttcaactttggaagaggaacatgcatccagttacaagatgatgaactacttgtagaagattttagttaagagtagtatgcaaactgatgatcggcaacatttctcgttgtatggaactgaccgaaagcaatctttttgtaagaaaccgattggcaacaataacatactgggagttgaaatctgatcctcaaattcatgtttgtaagtttgccactctcttgcaaaatgcaaaacgcagctacgtgctgccaaggttcttacaaagccccatctctaacattgatctagtatagacaagagccccatttgcatcgctcaaaattcaggcgaacttcacaggaatttggcacaaacaatttcgaaattcgtactccgatgttaattccgtgggttaaaccgtttttatcgcagtgatacaccgtcgaactgaatgcaacggtcgcacaaaaatttacatattcaccctcgtaacaagtcaaaattacgaaacacaccctccattctccgctccttccgttccattccatctccggtctgagccgccgccgccgccttcttcccctctcactcccacctcactaaaaccctagcccaaaccccacctcctctcccgccatggctg

SEQ ID NO: 33604 - DNA, 11078 bp, Oryza sativa
gctcattgagcggtgagtcttttgtttttgttgtggctttgtggaatgggagatcgccattccctgattcattgttgtcataatgtgcatgtacaactcacccatggaacctcgtaggtcgtttgcagcaaattttaaggcctgaattgcgtctttagtgacacgactagtttactagatatgcacgcctttcattcttctgatgcttagtgggtaacatagatacgatgtaacgttttgttttataaaggccatggatccattgcacttacggtttctctgatgtaacatatctcagatgctttatcaacattgcatacataatttataatatgtagttagtgcataaaactaaaagatgccttacagattgtgtataacattcaggaacttaagttttttttcttgcagctgtaagaacgttattattgtcaatgaattgtgcagaatattgtcaaatgatatacgatagcattttcatgtattatgctctaagtgcttgcattttgtttttgtctatatgttgcctatactgtggtcactactgctacagatttcacattgaaaatgattttatctgttgaaatcaggatgttgcaaacaggaactcaaccagatgacgaatcctacaatttggttgtaaatcttctgattaaactgaaccgggtggactctactttgaaatatttggatttgatgcttaaatcaggctacacaatatcttcctctgtttttgttgagtatgtccgggcatgtgtaagatctggtagattggatacattggcatcagtcatagagaagtgcaaggtacttattattcttttagactgacaagtctgtttactgtttatatactgttagttaggactcctaatttccaatgctggaaattctcaattgttataagtttgtgggctaccaatgggccttcaacattcttcattttcgaatatatgtttcaatcttctcggtgtatgtactaacggtgcacttattttgtttcaggctacagatcagaacaaagtcttgtgtccaccatggtcctggtgtgttgaaatagcagaagctgcttttgaagctaacaacagcaagctgggtctttttgctttggaatatcttgcaagatggattgctcgttctgagcgtgttattcctcctcttcatctttcagttgatgaaggtttagtactctcagctctaagtgctgctgccagaacttgtagcactgatctcctgaatgctgcttggtcaatattacgtaagtccttgcaccagaaaagggcaccgacgccagaggcatatcttgccaagatttatgctcattcatccattggtcatcttcagcgggcttttggtaccctacgtgaatttgaaaatacctatgggaactttgaggatattgattcagagctcttctcaccgttcacttcattgcgaccactcgttgttgcttgctgtaaggatgggtacaccacactggactcggtatgttctctttacgctatgcataatacatcaaggcgcaaaattcttatttggagatcatgtttaaaatcatccatgatgagctaatgatgaaaactctgtatgtgtagttccattggtgttatgaatttatacattatgccttctgtggcactgaattattctttcttgacgtttacctagttattcacttatttctcttttcaacataaaattggtgctttctttcttcactgttgatgttttatttagttatcatttccaccagagtatttgaggcacatttttttctctcaatgacaataattcctcatggctatggtagccttttgtattttggttcctctctgcaagcataccatgtatttcttcaacattcttatttctttgtggcccagtttcatattgacagttcaaagaattattgacacagtcctttttcagtgctattaggaattcgtcatagcattgtccccgccaatttgtcttgacattatgggaggaatgttttattgcctgttatgcatttctttcaccaaatatgatggaatatcctaacactgtaggctcctgcctgcaggtctatgtgcaattggagaatttaagttctgcagattcgccatacaaatctgttgctgctcttaactgtgttatattggggtgtgcaaacatttgggatcttgagcgagcatatgaaacttttgaggcaataaaagaaaagtttggacttacacctgacatacattcttacaatgcgcttttgcatgcatttggaaagcggaaaaaggtattattattacctaatggatttgatactttcacaacatttatcacctttttgccacttaccaacaatccattcaacctatgatgcccatgtgtattatacagactgaagaagcttgcaacgtctttcagcatctagtaagccttggtgttaagccaaatgcaacaacttatggccttcttgttgacactcatcttgtaaatcgggacgcaaaagctgctcttgctgtaattgctgagatggtatggtcaatttacttttgcacatttcctgtctatctatagtttctcaatgtgatgtctggttcaggttgatgcgggctttactccttcaaaggagacacttaagaaggtccgaagacgctgctcccgtgaatcagattttgatagtgacgagaaagtgcaatccctggctaagcagtttaactaccgaatgggtggtgaaaaccgcagggagatgctctttaacattgaatacagcgctgagttcacaagtactcctagtccaaggtactgggctaaccttttctgaatccaacattttctttatttttcatcgcataccagcaatggctctttttttttttttttgctttatctaatgcatttgctgactgatttgcttgatggttttgttttgcaagttgattttgatgatgccggtgcgctctagtagacgtaacgtgtaccctcgctcactttgctggtacctgaagggcacggaagctgtagtctgtaaattatacttctttgtaccaacttccctaattatttcaagcatctcaagctatcatttttgttggcagaaccctcaacaggatttatgttaggatttcagaataagggtcctaatagatttttttttttgcctgctcaaagcaccatgttttacaatcaatggatgtttgctcaacttatctctcagttccagccttttttacggctctcgtgttatttattcctatactgcatgccatgtcaattatgtatactcttgatgtttgtttttttggaattgctatagttacttcaaacgaattagtactagcacattgcattggagagcaatattgtttactgaaggtaataatagaccgctcatcgtgtaaatgcatcatgatttactgaagataatattgtttacttaaaaagaaggctccgtgcaaaataacgtgcaaaataagagacgcagttcgtaagttgtagatcatgattggcttgtgcaatgctccattaatttccttgagaacgttgttcagcttagtttcattaaatccaatatgaaacccaaataataccatacaacccaaattcataatttgaactcataagaaatccgcattgtagtaccttgccgctatgctatacatcacacaagacgtcatgcagcttctgaccatcgacaatagcaccagatcgaatagagtacaggagagactcaagcagcagacgatagcattacggacacaagaagccaagcaggagacgatagcattgcggacactagacacaagaagctttacccggttaccccgcctgggcatcagtcttcgtcgaaagatgaagatagtaggtttcccatgtgatctaaaggaggatccgtccttgacctcatcggcacccactgtttctcctcgaaagtgacgatgggtttgttgatgttcttctcggcatcagccctcagagaggtagctatctcttccacattcacgatattgctgtgacaagcacgaatcgagacttccttcagactcggaaggaactctatgccagtgatctcttggatggaggcttcttcgaacagagacagctctagccttgctagctttggtagtgccccttcttcaaatcttgcctcccaatcttcagacatgtcgagatgaatgacaagcagtctaagagatgggaattcccctgctgaagcagaaaattctgttcctatgtatgcattgtgatgcaacctgaggtatagcaggctaggtaaacttcctagtaccttcaggtcttcctcggcgcttagttcggttgcgcgaagggttaattctgtgatgttggaaagcaaaggaaaccaacatggtagttgtgttaactgacctcgaaggttcatacttttcgtaaatattggtggactggataatgaattgacaatgttgaagttcatcgcgccatcaggtcgccaaagtaataacgagcgaaggctgccgctgagcttctcaagagcagagatcaaggatgcccaggtgctgtcgtcatcaacaaacatcagtactccaagtttcctcaaccgggatagcttcgacaactcgctgatataatgtgatgtagaggtcgtgatttctacctgtgcaagtgttgtaagtgaatccatttttcgaagttcgttagggatatgtaaaccccagaactcagaaataggccaccgcccagtgtggttataggatcttcttcctccaagtaagtttgctaaatgtggaagattggttatgccaggaggcaaatgctttatggctgtgtcccttatatccagagtctccaacttcttcaggtttcctatttgtgcagggagttccgtaatatgtgttcttctcagattaaggtattccaattgaaacagcctgcacaagtctttgagatctctatttctcaggaattcgtagccttctaagtccaatattctcattaatttcatccaaccaaactgcaatgtttctccatcggcaaatatgctcaaggaccggacatggcataatatttctcttgtggcaatatatttcacacctctgctatgaacagttagccgccttatcttctcttgcggaaacaaagtgttctgttctcctactagagtgataaaattatcttcaattgactttgacacaatgatctccaacatcacatcatgaactcggaatgttttaaccttccctgtaaagctagtggtcactggctgaataatgctccggttaatgaattcatcaaagtagctttctgccacctcaaaaacactcagtccacgtttgccagtcacaaagcgttctgctacccatcgcctgagtatagttttccttctgatattatggtcctcagggtaaatgcttaaatataagaagcaagtcttcaagtggtaaggaagatcattatagctaagctcaagtattttcttcaatctatcaagtgatggattggtttcaatctctgaaccaagagagctataaatcttctcccaaagatctttactgtgcacaggcttgctagccaagaggcctgctatactgactatggataaaggtgtgccaccacattttcccagaatcttagctgaaatatcttctaagtgctcaggacaaattgagctgccaaatattcttttgaagaataagtctctggattcacaatcagtgagaggtttgatttcgtaagctcggtcgtactcatggaaacaacaggtgtgtgctacagctctgattcgtgtagtaaccactattctgctaccattatttgagtccggcaaagaaaaccgaataccttcccatgcagtcatgctccagatatcatcaagaacaatcagatatctcttattttccaattgctgcctgaggatgctcgcaagttgtaccacattccatgcttccatgcccttgagtaggccttccatgggacctttgccagctccagttgatggagaactcggttgattaactggttgagtgatttggagaagaatatctctcatcagaaccttgacatcaaaactctgggacacagttacaaaagcttgacattgaaaaggtccatttcttccagatagactttgatatgttgtcatagcaagtgttgtcttgcccaaaccaccaaaaccaaatatagacaccacccgtaattgttgcacatgtgcctccaataaccagtgcacaagatttccctgacgtggttcaatgccaacaagctgccttctctctggaaagagtgcagtaatgcgagtatcaacatttaaaagattagcttggctatcatatgcagccatgctattcccagcagttccagagatgagatgattggcactatacctgcatgcaagaacaactaagtaagtttgctgggtgatgaaatcgtactacagaagtagaaaagagattaaaaaaaactgtatatgctcagaaactgtactttatagtaatactacggagaaattgctaaaagaagaggtttctttttgatgacatgggtcattcatgggcaaattgcacaaccgtggcaacaaccaaacctctaagactaaaatacaactgcagattggtgcataaagcttgctcatacatgcaaaaggactggaggcgtagattaaatgccctagtgatttacagttgttgccttgttggaacacttggaaggagtggaacaggcaaacttttcaagaccagagccttcagtcacaggacatcgtctataagagcttttctagctagtttgtacgttttttgcttttgtgttgctcctccttaaagttatattttatcctcctctaatgcaataggcagagcacctgccttttcattcaagaaaaagaagacgacatgggtcatttcaagagtagatacttgaacccatgatctccaccttcacaaccatgtgctctactaggctatatgggtctccccaaacgtttttggcttatcggtgcaacatatttttcaacatataatttgtggaaagaattcaagttcataagcaaatctatttacagaagggacaactatagataaacaagagaaactttgctgccttttgtaccagattgttggtgtcctgctagcacctaaagctatcaaaaagcaaaacggcaatagtccagaatttgaaccatcattcgggaaaaagggacagaaatagcacagaagttaccttgaatttcgggcactgatattcatagtacgcctttttagttcttggatttgtttggcaatctgatgcctcactctggtggtctgcaatatgtgggtggccttgcggaaaaacactacagggccgctgccaccggcactactgctgtcaccaagttgatgtttgaactcatcaatacaatcctcgatatcatatgcaatctcacgcacatgcttcttccaaatcttaacttgcttgccgcattcatctctcccagaaaggtcctgaagaaaggctgtcatgctctccagttcatccttcaagtgttgcagttcaccccgaatacctcccagaagctgggcttcttggaggacgattgtgccgagctttcccaagagagtgtggatcgcaccttccgcggcactaacaacagcatgttccatctatctaggatagaagatgaacaaagaaccagaaacaagctctaccgcacttctgacctcaaatgaaagctgggagagaaaatacaagcttagagtcagcaaaatgggattcaccttttgaatcctttccacagtccaaagtcaataaaactgtagcctacgtcacttgagtagaaaatggagactgtttccagctttcttttgaaaaggagattgtttatagcctactcaaagataacctgatcagttgacttttgagttttatattgttcaggatggaagctttcttgacgaagttaacttagtttacttatgagtgtattattttactgttttcacttttcaatataatttgcacacaaattattattgggagacagtgctgtagtcatgtttgaccaaaaacctcagagtagtgctaatgaatcaagctcaaacttgcaaatctaaaatcttcaagcaacatagcatgaatacatctaaaggaaccctcagattatcataccatgcatgacactgcacaatggtaatctatccagcttcttgaatcattatcaaaagttcaaaaacgaaggcaagaatggactatttgctatacttcactaaaaaagaactattccctccgtttcatattataagacgtttaacttttttgttagtcaaaattctttaggtttgaccaagtttataaaaaaaatagcaacatccacaacaccaaactaatttcactaaatttaacattgaatatattttgttacaatgtttgctttgtattgaaaatattactatattttgctataaactcggtcaaacttgaaaatgtttgactaagaaaaaagtcaaacgacttataatatgaaatggagggagtatctgctattcctcccacaaagtcctcactatatgagcaggtcatctatacaattaccttgtggtaaaaaaaagaccaagctcctgagatgattatgatcaagtattatcttaaacctctgttagaagtccattcatcgctcttctcctcctatcccttgtggccatcctctcaccataagtcagaaagatgtccccaagatcaacatgccccacatccttcaacctccttccaacttcctcaaacatcgacaccccatcctcatttgaaaagtagtacaagaacttgttatagtcgaaccttggcacatccactccaccccacatagtcctctccacaaacttagttgcctccaatgtcctcccggccttcaccaacccaccaacaaagatgctctcaaagttcaccaatggatccctccccttccttcccctcttccccaagtgcccctgaagcagcataatgtatgtgtgcatgttcggctcgcaccccgtggcaaccatctctctgaaaacctccgtcgcttctcgagctcgcttgatcctgatcaatcccttcatcaacccatggtacagtgcaatgtccttctccttaacaccatgaaaaaccctgtatccttccctcaccctcctcctcaccagcagcccatacaccaaatcccccatcacctctccgtccacctccacacctctcttgaacatttcggcgaacaccatgtacgcgccccacatcctcccttccttgcacagccacgacaccactgcccggtagcacccgcctctgccaccgtctgaaactcccctcctccgcattccgtcgaacaccttcatggcgtccgcgacgcggttattcttgaacagcgtcaccacgatctcctcgtacgcggcggcgcccgggtcgagcccgcgcctctccatcccgttccacaccctgcacgcgtcagagagcatccccgcgcggcagtatccgacgaccagaagctcgcagcacctcccggtccgcgacacgccgtaccggtgctcggcctgcttgatcaccttctcggcgacgtcgggcagcttgcagacggagcaaacgacgtcggtgatgaagttgagcgtgcggggcctgtcggcgtccgggaagagggcgagcagggaggagaccttgccgacctcgcgggccggggcgaggccacggatggcggcgcggagggcggcaagggagcggagcgcaggcgggaaggagagcagggtggagtggagcaggtcgacgttgcgggacttggcgaggacgtcgaggaagcgcgcggcggtggccggggagtgcgcgaagccgtgggcggcggtgaggtggtcgaggaggcggcgcacggggcgccaggagagcgggaaccgcgcggaggcctggaggaagagctcgcggaggtcgtcggccgcggcggaggggagcggcagcgcggagaggcgccgccgcagcgcgtcctccggggcgtgctggtgctggtagagcaccgtgcagaggcggagcagcagcgacgggtcggtggggcgccccggcgcgggggcgggggcgggagcggcggcagcttccgcggcggtggagaggaggaggcggcggcggcggcgggagagtgggaggaggaggaggaagcggggcagcggcggcaacggcatggatcaatggaggtggccgccgtcacgccgattcgcggtggcgaggtggatggcgcgacaagattgagaaggggaagcaggccgcaacagaagcgtagggaatttgggctttgtgggccgtgaggtcgtcttgatcttcgcggtgtatgagaaataagatcactttgactccctcaactgaccaccgaatctaaatcgtatctctcaaccgcaataccagaaatcttgactccccaaatttacaaaaccggtgcaattcgactccctgggcggttttaggaggcggttttgctgacgtggcgccacgtggcgcctacgtggcaatattgaccgagtcttcgttccacgtggcgatgacgtggcacctacatggcggtagaattaaaaaatatgcgtgcgacccattagtcattcacaccaaaaaagtgggcccactgacatgtggggcccacatgtcagtccttcttcctcctccctctctcccttctctctctccccttcttcccttcgaccagaggcgcctatctctttctctcaccctcttcccttcgggcggcgacgggtggtggaagcgagcggcaagcggcgagagcgagcgacggcggcacgcaagtgaggcccggagcggcgacggcaggatgggcgagcgagcggcggcgggaggaggctgagcgggagctctggccgcgttctcaccctgcttcacgatggcgttgaaggcaacgctgcccttggcgtcgacggtgagcgcgaggatctccgggaaggccccaccgtcgccgaagtcctccagccgccgcggcacgaacccgccacgcttcccgtacagtggcacgggcttggcagggcccgaaggcttcggccagcagcagccgacgctggtgcagtggcgacggcggggcggacgatgctggggcagtggcggttggcggtggccgacgcgggagaagccgagac

SEQ ID NO: 33605 - DNA, 10813 bp, Oryza sativa
  unsure (1)..(10813): unsure at all n locations
cggccggtggcggtcgatgttaggggcggcggtggccggcgatggccgacgcgggagaaggggacacgacggctcctcctaccgcgggtgggaggtgggagaatgagggagggcggccggcggcgatggccgatgctagggtggcgatggcggccgacgctggggcggcggcggctccggcttcgatttcctccgctctctcctccgccgcatccttccatcctccccacccgcctccctccatccctccgtctgcctcctcacctccgtccgccttcccgcgcgggagagaaagagagagaagggagagagagaggaggaagaaggaaggaggactgacatgtgggccccacatgtcagtgggcccacatttctttttgtgtgaatgactaatgggtcccacgcatattttttagttctaccgccacgtaggtgccacgtcatcgccacgtggaacgaagactcggtcaatattgccacgtaggcgccatgtggcaccacgtcagcaaaaccgcctcccaaaaccgcccagggagtcaaattgcaccggttttgtaagtttggggagtcaagatttctggtattgcggttgagggatacgatttagattcggtggtcaattgagggagtcaaggtgatcttattccggtgtatgacgacgtcgtggtttgggaaaaagtctactttacatccctcatcgttctaaactgcaaaaaattacagatttttccccggtttccgttaacatgcttttcaaactattaaacggtatgttatgtgtgaaaactttctacatagaagttgctataaaaaatcaaataaatccatttttcaagtttttaataattaaaactcaaataatcatatgctaatgacttgtcttattttacgtgcgcacttaatcttcatccttccatcatattcgaacggggctagctccctgaaccgcaatatcagaaatcttgatctcctaacttgtaaaactaggttaaattaagtcttatggtactatatatatatatatatggctagtttttgttgacgtggagagttgattgtagtcaacatagctgagtaggcttgagcccccacatgtaaggctcctatcttcttcctctaacatctttctcgcccctcttctccatctctaatttctccacatctcccttctctttctcctggcataggccgtaaaaggatttgaaatttgttttctcttatcccatttgtcatttgccagtaacctttcacttcttctgattatatatattgacgtttgaaattagattcagttaaatatttatttaaaaataataataaacatatattactccataaatatgcaagcataattatgacaaattgcataattgcataataaaaaacaaaaatcaaacatggctgtgatcacacatatgctattttgttacaatttatggagatcgaatttgtgtatgaagttatatatctcatatcaatatatcttattatttttaaaaaatatatatatatattaatagttatttaataacatgtaagaacaacgggatatcccctcgaattattagaatccatgtccgccgtatacataagacaaatatcatattcgccaacacacctttctttgtgggacaaacaattaagctatgatagatgtttagggaagtacttagatgcaaactatactcatccaaataaacatacataagtaggtccggtacaccgatctatcaaagaaacaaagcagtacaatatacaccaccatacgtacatatatatccatatatacaacgcgctaaacaaatgctgaaacatcatactccctccgtcccataatccggttctaggttggtttttcatgggacggagggagtactcctctagcggaaactaatactacaaatcatcaatgagaaagatactgtatatagcaagcacatcatggatcatgccatcatcgatacatatgtatatataccagtctatagaactgtacacacatatatacgtacgtagaatcataacgtatttatcttatagatatataacgtatttggcaatgcgatgagtataaaaaaaatatagattggctaggtggagtgtgctctgcaagccaaagaaatgtggggggctaggaatccaggacttagagactcaaaataagtgtatgcttagtaaatggatctttaagttaattaatgaatagggagtgtggcagaatttgttgaggaaaaaatacttggtaaggaaatccatttttcaggtccaaaaacaaccgggggattctcatttttgggctagccttatggcagcaaaagaacccttccagacacttggccacttcacagtgaataatgggaaacaagtaagattctgggaggaccgatggttgggaaaccaaccccttcatttggaatttccaaccttgtatagcttggttagaaataaaaacttagtagtggccgatgtgttaggaagggtccctttgaatgtctcttttagaagagcaattgtagggaaaaacttggaagattggcttgaaattgtttcaaaggtggtgagtatcaatttgaatgataagcaagaccaattcttttgcaagagcaataaaaaaaagggttgttttatgttaactccatgtataaaacccttatgcttaatggtgtaatacctgggaaatctttaatttggaagctaaggattcctttaaaaattaaaattttcctttggtatattgaaaagggggtgattctaacaaaagataatcttgctaaaagaagatggaagggtagcttgctttgtagcttttgtaactctaatgagtcaattcaacctctcttctttgattgcataatggctagatacatttggaatgcgatctatcttacttttggagtcaagcaaccccgtaatagttcacacttgtttgaaaattggttaagaggttttgaacctaagcttaaaagacaaacttgggtgggtatagcagcgatttgttgggctttgtggctcaatataaatgaattatagtctttaatggctacaaccacgtatttttcttacaggtaattttcaaagtaactcagttgtcaaggctttggtctttgcttcttaaggaagacgaaggcattgaagtaatcgcgaagtgcaagcttttagagaagtgtatgatggagctgatcttctctacttttgggtggaactttagaagaatgatggaagcttagcttttagttcctcttgcttgttatccatctttaaaacttatttatgttttacccatgtaacgggagagtcttatagtcttgtgtactcgtgtttgttacttttaggctgtgtacatcctcacaaggtgtagaggccaggttttttataatccattgtctaaaaaaaaaatactgtgtgtgtatgtacgatcatggctgcttggtctccggctccgggtcgtgaacctcgtgctccggcggcagctccgccgtgggcaatggcggcagctcaggcttcggtggcagcccgtgctttgggaaccccggcacggccgggtagtgcggcagctccggcacgacggggtgcggcagcatctccggcacgacggggtgcggcggcagctcaggcttgggcaacggtggcagctccggcacggcggggtgcggcggcagctccggcacgacggggcgaggaagctcagggagcggcggcggcagctcgggctttggaagctccggcagctcggggtgcggcggcagctcgggcacggcggggaagtgcggcgccttctcctcgaggtgcctcgccgtgctgcccatggcgccgcacgagagcagcagcgccgccatgagcaacagagccgacgacgacgacgacgacgacgacatggcgttcctgctaagcttctgatgatctgatctagctaagctaagctagttcttcttcctcgcagccagggatcgatgactagaacacaagggaaacctggtacttatagcatgaacagtgaagtgcagatgatatcatatcatatctaaccaggggtccgttgccattttcaaccttaccgaattttggtaaagttacccaaaaaaaatggctacatttagtttgctgtcaaattttggtaactatataagaaatcctaccaaaattttagcaagtcgccaaaattttggtaactacaccaaaattttgataataccaaaattaggtaaggttgaaaatggcatcaaagtgaacatgccccagatcttgatgcgtacgtgttgtttggtacatggcaggtgaactgctgctgcatcacacatctctgatccttctggtttcctgaatgcgtgttcgaactctcctgatctctatctgttccttcgtgttatggttcagttagttgggaattccgaggattgttcagagagagatcagtgatcacctaatcgctagctgcctagctgcgtatatgcaccggcaaacaggtgtgcaaacagcagagtcattgcgggcaacacgtgtttcaccgcgagatgtttatgaattatgctgctgtttggccacctgaaaatgcctgaactctgaaccatcccggtccatggtgacgaactgcttgacttgctggttacaaatctagttgaaaacgaccattgttgtacaatccgtacacggcaacttgcttaatgttgcaggttgccgtgttgatataggccgattttcaaacggcttacgttagaagacctatagaatatacacggcactgtgagtacatgactaacgtgggtattcagttgacaatcaggtgcagtgcaggtaagcagcagctatgtgcagagtaggtagcacatcttaatttcttaattaattaatttttctccatattttagataaatataggttcctcgatgtacttgctcaataactataaatgttttgataaaattagaacaaatttgccttgtttgttatgccttaataaatgatgattgctaggggacggcattccgcccattcgacatgatactttacgaaggtgatgtcatccgcacctccgctttatcctcgcaagtctacgactccgtcccaccccacgccacgtgctcatggctcacaccttgagcagaaccattggtcgacggaggagcatggtgaggcgaatgcatcggcgccaatgcctaggatgctaggaggtgtcgacacacatggcaacgctagccacagcaacactagggaaggaaagaccagagccaaggagaggcgttgaatggagaaaagacattagtgggaaacggttcgccagccagccaagcagcgatggcgagtgtcctactgatcaggcaccaatggttataagatggtatcggtgcccgaggtaccatgcctgatatctgtgcataccagccatgataccacgagtatcagacttggcacctatcggtatcaagcgagaattacacgctgcacagtgtacctacacacaatattgacgagcagcacgatggattggcaaacagcacaagctgccaatcgaagctctagatctagcaccttcgtcagcctttccctccatcaccatcggtaccagccttgaaggaagactcacaccagacaccgtcctccctgatggcttgtatggagaaggaggccatgaagccagcgtcgtccatcgcctcatcgccaacatgcactcagaatggatctagcaatgagaatggcctaggcctccagatctagtgacagaaagaggaaatggtggtcggcgagaggggggagcagcgatgtgctatttttgccagcacgagcaaggaggaagagaagagggcagagggaggatgtgaggaggagggtggcggcggacgtatgggtgtgtggctcacaaagatcaacgagtggatgggaagcacttagggtggatggagagcattaattaagtatctcgtccctaactccctagatgggataccatatcgtagtttttctgttaataaatagatgcactaggagcactaccattttttcaggaagaataataggcatcttgttatcctgattcactctgattctggtatatatatttacaaaattcaatagactaggatatattattcataaaatccgacggatgtagattatttgactttttatgtggattatctgatagatttgcctttttgatataggatatggtattgataaaattcgacggatgtagattatacgacgttttatgagtattattgcttcgggataatccaacaaaggctgattctatcatgtagggagccaaatagtttgatgcacatcgtctcttgctctttttcaaatggaaaagcttgttagagcataatccaacttatcaactatgggccaccgagatcacattaggcctgcgctccaatagaagtcacaactttatgttttggacctacacaatccaaaaagactaaactggtaggtgtgaatctttctcaccttttaagttatgtttctccaccatcaattttcgatgtaggactaaatctaacagttgtcccatacggggctagtagtacctaggctagacggtcagtgtggcataatctattcttgcacacaaagacctgctgtaactggcattcttaataatttttttaagactagaaaacaagtatatattgtaaagcacataataatgcataccacaaataagcaatattataggaagatagctattttattgatttatgaagcatgtatgatacaagtgtagatcgtgtgtgcacacacataaatcagcacatacgataacacaataactcatccaagaacaaagaaagctgccacaaaacaaaacacaacaacaacgtacatcatctcacacactcacacagctagctagatcatcactgaaaatatcttaggcaaacatcgatcaaagcttacacatgaacatacacacatacagcaacacgtagtaatttcaggatacgatacgaccggccgatcgatcgatctctggatcgatcatggcttctcgggataatggctctcaggcttgggcggctgttcatgctctggcacggtgggatgcggcacctcgggcttcggcaactccggcaccacagggtgtggcacctcaggctttggcaactccggcacgacggggtgtggtggctcttcgtgtttcggcaactccggcacagcagggtgaggcacctcgggcttcggcagctccggcacgacggggtgcggtggctcttcgtgtttcggcaactccggcacgacggggtgtggtggctcttcgtgtttcggcaactccggcacggcagggtgaggcacctcgggctttggcagctccggcacgacggggtgcggtggctcttcgtgcttgggcagctccggcacggcggggtgcggcggcggcagttcaggcttcggaagctccggcacggcggggtgtgggtgtggcggtggttcttcgtgctttggcagctccggcacgacggggtgcggcggcagctcaggcttgggaagctccggcacggcggggtgcgccgccgggtactccacctccaggcgtcgtgcagcgttgcccatggtgctgcacgagagcagcagcgccacgaggaagagaagaaccgaggaagacatggtgttctcaagctctcagtggcttctatctctatatcttttagtgtgagctagctaagcactctgtgatggctgggagaaaggcaagcaagccagatatttatactgctaaactgcaccttacttaagcagttaagctactaatgcatgattatatttgattacagtgagcctgctgattaattactggtaggtacgtaggtgatctgcacccctttttggttgtttgacttgtttcgatttagtcagtcagtgactcagtgtgtgatctccccttatctttgattgtgtatgcatggtttgattaattagttgggaaaaattgagacccaagaaatttggttggtgaatgctatagaaacctagaacggacggtgtccttgtgggtacttgtgtggccacatgatatgagggtagtgggaagtaagtgaatcgtgcatgacaaggacagagtactacatgcatataattcctacgtcgcaaagtaaaccaaactcgtacgagataagatagatgaagtatatattatctttccaaaaaaaataaaaaagagagtagcatatatattagctatacatcgtacagccaatgctgacaaattaatgcttagcttttccagttgtaagaaaagatatgaatatactgcttttaaaccgctactacatatggcatacatgtgagaacaatttagatttaaatttgaaaactaaaacataaactttaaattgtatgtgtataagtattaatgtgttctatatgttgagtcgatgaaaaattatgcgttattagtcatgcatgccaatattgaaatctaaatttaatattaaacccggtaaagtttagtcaaatctatgttaaatatcaaacatttatgattgtagggagtatatgtttcgttgggcctgcttgattactcaaagttttatttttgatccttaattgacaaagtacgggagatgtgctgcattttctaccgttaacttaaaagcacggtatatatttagatatcttctcagggaaggtaaaaaaaaaccattcttactcgtaattaattaagtcgttgaagaattcagtttcacacatctcttgttcatattcaaattcctatatatggtaaagtagaagttgttggcccacagtgttatagtaactgaaaaaaatgtcctatgcacataagctttgcgcataggtataacactaatgaaagtatatacacattatttttctagaattttttatgatatttgttagttagtgtgcatagtgagtgcataatatgcataattcattcttacacacaaagacctattgttactgtgcattttcaatcatttttttaagaaactaaaaacaactatttttcctgaagcatattatgcagtctgcaaataaattgtaggcaaataactatttactgatttatataatactagaaacataattcaaacataaattaatgaagcatatatggtacatgggtagatgatgtgtgcatagatataagcgtagcacacgcaagtacatcctccaagaacaagaacaactggatggctgaaacatcaagcatcactcacacattcctagcaaacaccacagtttacatgatcatatcatacacacatatacaaataaacccatgattattcaggatgcgatatgatgggcccgatcaataatctctgcatcgccatccgatcatggcttggccatcggcacctcggggtaatggctctcaggcttcggcggctgttcatgctccggcacctcggggtggtgcggctcttcaggcttcggcagctccggcacgacggggtgcggcggctcctcgtgcttgggcagctccggcacgacagggtgcggcggctcttcgtgcttaggcagctccggcacggcggggtgtggcggcagctcaggtttgggcaactccggcacggcggcgtgtggcacctccggctttggcagctccggcacgacggggtgtggcggctcctcgtgcttgggaagctccggcacggctgggtgcggtatctccggcacagctgggtgtggcagctccggcacggcagggtgtggtggctcctcgtgcttgggaaactccggcacgacggcagggtgcggcggctcttcgtgcttgggcaactccggcacgacggcggggtgtggtggctcttcgtgctttggcaactccggcacgacggggtgtggcggcagctcaggtttgggaagctccggtacgacggggtgaggcggctcttcgtgcttgggcaactccggcacgacggggtgcggcggctcctcatgcttgggcagctccggcacggcggggtgcggcggcacctccggcttgggtaactccggcacggtggggtgcggcgggtactcctcctcgagccaccgtgccgcgctgctcatggagctggacgagagcagcagcagcgcggcgaggaagagaaccgaggaagacatggcgttcttcttaaagaccatgctggcttagctagctatgctacctcactgtgtgagctagtgtgctttgatggtttggagaaggcaggcaagcctggtatttatagtgctaaactgaacattaatcaagatcaataaattaattaatgcatgattaattacaggagctagcctgctgatgtgttgattaattacttgtaggtaggtgaactgcactccattggttgttcgacctgtttcgatgtgtgagtgtgatctcccctgagccctgatctatctctgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33606 - DNA, 2340 bp, Oryza sativa
atctgtgtgattagcacgtggcaatcgtgagacttcattccaaccagctttggatcctctaatttaacgtgcttacttattctcgcacaatagcccgaaggaactttaatatctgccagacatgatagcattgcgatcttctcatccttcgacaatgtgtggcaagctggtgggaggtacactcttcctgtcttctcatctgtaacaggctgaagttcactacgaatgttcatgtcctatagatcgagacgcgcattcaacccgtcctttgtcttgctaggcatattcaacaatagccctagcaagctatcgcacacattcttctctacgtgcatcagatcaatgcaatgacggacctcaagatcttcccaataaggtagccgccaaaatatggattttttcttccacaacctattcttgtcctccttgctacgttttcttttcttcccaaactcattagtaatgtccttcaccatattgtgtacctgatctccggacaaatccgcaggggcagacccaagttctttcttaccattgaaaattttcttctttcttctaaaggcgtgccgtagggggagccatctcctatgacccatttaaaccatctttcttgatttctttagccacctactgtgtgtatgttccatacagtcagagcatgccttctttcctttcacggtttgtccagaaagattacccagcgcgggataatcattaatggtgcagaacaatagaacttgtagtgtgaaagttttctgaccatatgcatcccaagtttccacaccctatttccacagaatctcaatgtcatcgataacaggctcaaagaacacatcgatgtcattgccgagttgtctcggaccttggattaataagcccaacataatatattttcttttgaagcacaaccatggcgggaggttaaagttcgcaatgagaactggccaagtgctgtgagaactgctcatgtctccgaaaggattcatgccatccgtacacaaacatatcctcacgtttctggggtcggcagcaaactctttgtgctttcgatcgatattccaacattgaatccaatctgtagggtgtcttagcaaaccgtcattccttctctctgtggcatgccaatgtactaactttgcttcagtggggttggcaaatattctcttgaaacgatcaatgattggtagataccacacaaccttcgccggaccaccccgctttgacttctttccctcgcccgcgctcttctttcgcttgtatcgagaagccttgcagacaggacaagcatctaagtccgcgtattgcttgtggtacaatatgcaatcgtttggatacgcgtgaattctccagacctctaaccctaggggacagagaacctgttttgcttcatatgtcgtctcgggcaatgtgttcccctgaggaagcatgtccttcagtattcccaaaagttttgtaaaactcttgtctgaccatccactactagccttcaacttcattaggtctaatgttgctgataatttggtgtgctttggcttgcatcctgcgtatagaggagtctccgagtcactgaccaacctgctgaacttcatggaatctctctcgttcatagctaggtcatcaacgtcacgtaacatgtcttgccgcatatcagggtccacatcaaccaattcaccgcccaatggagatgggacaaacatgtcatgctcttctcatctacttcttcatgattgtctgcaccacttctgtctgctgctgcaccattagtacccagatcttgctctccatgcatcacccaacatgtgtatctctccatgaatccccggcgtatcaagtgagcgtgtacttccttttcatcttcccacaaaatcttattcctgcaatcgctacatggacaacacatgtacttggtggttcttcttatcctatccctctctgcgggtttcataaaacttaatacgccatctctatactccttgtaatgacgccttaagccagtcgtgtacatccaacttcgatcccatcgttgacaatgaacaaaatattagttaacatctcataacataagtactactaaattaataggaaatgattagtacccttttacttacttttatgatttttcctgtttttgtttgcaaaaaaattacaaaaattcgcccccttcaacctcccaccaaaatagtgaacagtgggataaactacagacaacggactactggagtatatatagtgtgcaaagtatatctcaatcgggccaaaaaaatgtcatttctaacgggcgcacactaatctctaactggtacaaatagaagcccgacaccgataagagtcatcggtgac

SEQ ID NO: 33607 - DNA, 13990 bp, Oryza sativa
  unsure (1)..(13990): unsure at all n locations
aatggaatacccagccgatgcgcagtccgtatttagtaagattcaatctccttcaattccgcgtctatatctaactccaaattcgagtctatcttaccaaatttcctgttaacagattcataacttgaaaaacgtaagtataattctagagtactattttttcctccaatcacgcatcatttaaatttcaccgtgatctacccaaccacagtccaactcccaagcgcgctcgttaaatttcatgcaacagactgatagagacaagtcatgtaacaatcttcgttgtgcgggctttattttttttttgaatcgattgtgcgggctttattcagcttagcactataatagtttcaggagcagtactcaagccagtttccatgatcgatggaaaacaatacataatgatggtttcaatctgtaatgtaaatcactgactctaccaatatcattgctccttgttgcataactcactacaaagattcctatataaagaaactgtttaattgtaacagtaaattataatccttgttgcgagtattccttggcaattatgccaactgattttgcgatccaacgcacatcttttcttagatggttattcatcttctgattttaatcgatgaaatatcatttttcttttaagcatttcggtgtacatctaatttgttcacactgcaatgggacaatcattaatctcattatttgggcactgtaccataactctttttaagtagttgtttggagagctaagaaaatacacaagcaacaacatcactattgcgtactatgcttgcacctaacaaccacatggaatgattgaaccaggtaaacacgctttggcagtggaacatccacaccatgctttgctgggggcttaaaacatgctcatcagtgaggacctacagtgaagatttttttaaaaaaatatggtacaaacatatttcatctaacaattatttactccctcgctcctataataataaattaactgtaattccatatgattaaaaacaagtaaaaagtaagtccaattctagagtactattttttcctccaatcactcatcatttaaatttctccctcatctctccaaccactgtccaactcccaaggacactaattaaataagggatatatatctaggttatgtttcttccaggatattttttattttcaatcatacaatcacattaatattagaacagatatctataatgcacttcttagtcgctgccagttgtcttagttgctttggatctattgaccgtgtttttcttctacataggactagtgtctcaattggagactgcagagggcatttagttttctgcatagatatataatacaataactgccgagttgccactgtgaaccaaaagtcctatgatcactcttggatctcagtgagttgttcccactcgagggtttatactgtgatccaaaagtgccaaggtactaagctatatgaaagtattcatagtgggaacaaccctcctagcagaaactcgcgttcacattaaataacttcaaaaaatttgactaaaatttagagggatgatttattatatggaaaacaaatttatacaaattttggtcgatttctatatgtggacccacatatttctatgtggcaggcctaattccaacccccaattattttctgaatgattatacttacataaaaatgggcagaactagtcatcaataaaaataaataaccggtagcctaactcactcaaatccccaataaatattctacgagcaagtacaccaaccgttatagaacagtgatgcagccacaattattcagctcttgccgatagattcatcaatcagctggtcgcttataacatatcgtgaagccttatagattgcatgcttaaccagcagccacgactcttaagcatgtgtagatggatggtacatgtcctttaacctatccggccatacgatgcacctgcgtatggtactgtcacgtttgtgccatgtcattgaagtcgatatgtgctattgattacttgtttctcttttttaatctcgattacttaatcagctcatcggttgcctcaatcatggaacagtggccttatataatgtgtgtttaatcacagccacgtctgtagaacatgagtaggtggcagttacatatcctaataacctatccagccacaagatacaactgtgtatggtactgtcacagatgtgccttgtcattgaagacgatatgtcctattgattgattgtttctctttttttttatctcaattacttaatcagctcgccggtaggctccatcatggaacagtggtgtgacctcaatcatggaatagtggtgtgaccttaatcagctcttgtcggtacgcctatcaaccggtcgttaataacttatcatggcccaatacatgtccatattttaatattgtcctatcagcgctatatatttcatgtactgcaacttgcatcatcatgttccaaatcttttaagatgtctttagttttcccagttacatccacgcctacttaatgtgaaatgtttagatcagatccatttgatatctaccatatgatatcttgtatatgtatgcaacaaaactaaaaacatgcgtgtgatatgtctggtattaattccctcagccagctaaaagcattagattaagggacaagttgttggaacttgttggtatgagtattctattaatcctattaagccctaggccaggatgtcacaccccaacacccccattcatatacacaaccatcaatatatttaacacaaccatattcacataacattcattttgatcacatatttcatatccattcacatatttcacacggccttaatgggagcagctcgatgctctgacagcgaaatgaattgacatatatatttgagacagaagccaatccaatctatttctaagattgaagatatcctcaccaggtaaagatcagaactgaaatacaaattagaaaacataattgggtgaacatacccatccaatttgaaagtgttactcaacttgcaaacttggtgagttatattcttcttagatctgaatatgtagatgacaaatcaaccaattgatctacgtgatattgttggccgtatccttcaactggaataatgaaaattgatctgcagttcaggacaaataaaaaaaagaattgactcagtatcaagtatctggatcctgggacaggaaacggaaggaattgaaatgcatgggaaaactgtttgataacaaaaatgggaaaataatgctaatatgtattgggccatgcttgcataaacactgaacacatacaggttcaaattagaatgctggtcctattttggggaaacaaattagatgaatcaaccaaaggcaaagaggaagttggtaacctgtgctagatcgttggagaaaattgaagaggatggtgcagtgatgcatatttttccagcgagcaagctccagcaacttgagcgaaacaccatcggcctgatagattaactatcccgcttgataatgattatgattttatgaatttataagtaaatggaaagaggggataagaagagaacaaaaggcattagagccattaagaatgaccatctgtctgcctatcatggtggcatcggttttcagaagtaattgttcttgccgccgtcgatggttactcgtggtgatcggagttcacatcgaccactcgcatgccgcaagaggagaaggaagtgaggagactggatgggctggatcaatcgcttaagctgggttgggcctcagctgctgcaaccgagctatgtaacggagagctgagggagtttgcaaacgttgagatcaaatctaacggttctggaatttgtggtgacgtggcttcatgtgagggctgctttataggtgttaatgatcttagtaggtaccaactatatagagttgggagttttgagagacgatgctatttggttgggagatattggagttgtggtgggatagggatgggaatttataaaggaactctctcctttctaatatctggatagtggtggtaattgagaggaaatttctcctatactttatctaaaaaaaaatctcaaccacctgttttttttctaacttctaatcttcaactaaactaccaatcatctatcaattcccaccacctctaccaaacaaaagattgggactaaaaatcaaatttccatgttaatctcaccatcaatttactcgttgaaactaccaatcatcttccctcgagttttcaaacaagtcgtaatcattttattccccattccaccactacactgagttgcttcatacactgaattttttaatacatttaggtcattgtaagtttcgctatgtgagtaacggttttgataagaaactttcatatgcaaatgttatcaggatttaggaataattcctatttctagcgtcttcaatgtaagaaagattgtaaatgttattaaatttcatgcaccaaatagttcaacctaaaagattataaactgatgagaaaacacgtgatgcggatatcactccttcggatacacacaacaatcctccaccggtcattcaaggaccgataacaagcgctcgcgcgcgacaattgaatttagaggtgagctcgttcctatgtgctttttttgtacgaatttgagaatagattgctacctaatgattatattgtgattaggaacaatagaaggggaaaggagacacttgggaaaggacttagagtcatggaggatcatcgaggacatccaagtcaaggtggaggcccaaaccaagtcggcttcgagtgcaattcagagtctaggatcagtctgcactaaaatgggcacgcaggtcgcatacgtgaccagattggggcgttctctatatggatggaaagctaagaagatatcctttccaatggttttggacacacgtccaaattctttccgagtcaacgggaatcgactgaataagttgacatccaaaatatatcccggtgctgcatcatcctatttgggctttcgggccgtgtatcgtgttggaacctattagggttgcgttaagggttggttgcatgaccctaaactcttgatatcagtacctgtcgtcatctttagggtttgggttttgcttagattattctgtcgagaacagtttcaccgctagatcggtttgtaagacccaacttgtgagcttattcattcatctgcatttttggttgcgtccttctttgttcctgtgtgtgttcttcgattcgcaaatagggattagccttctcggcgaggtcatccgcgtttcgacatgggtgataaccagaggagacgtggtgctgcgattgcggggctcaatagtgtgttcgttcaagaagccggatcgatttgtgtcgcgactccgcccaaatcgttgattatcagaacctttcgaaagatcgggaaacctagtcaacatcaagtggtattagagctctaggttcaccgtcaggttcgctcggattctttatcctagtttagtttttgttttcgcatttatcctagagtctaaagaaaagccaaaaaaaaaagttgtagtcgttagtgtccttaacccaaaccgtgtttggcctttgcacaatccttttcagagtttgtagtgttgagtttgagtcctagcttaagttcttgttgatggtctagtgcatgttttagtctagtcgtgtgttttcctttgtaaccatagccgccacctttcatccgtgtgttagggttcatcttttgagatccgtttctgccatcataaacacctatccagatcaccacacctcactagaacatcctacatactccgttgccaccatatcccataccaccgctaaacagactagtttatataccctctggaaaacctacacggaagccccaacttcaaacagccataacttttgcatacggactcagactcagaaaaaaattggcttgcaaaattgtctgttcgagctcacaagtttctgcacattctttatagtggcttcagaaaattccataggccacatatcaactctgcttgagctgtaacttcgtggtgtgcttatcagccttgcggttttgctgtttttgctgagactcgctgaagcttgcctgccagtccttcatttgcgccatcattgttaccactactgtctaggacacgagtagaccagcaactagtggcaagtgacttgggatttttatttagcattactatctgtcattggattgtgtaccactcacatatatttagccttcctagctccacatattacttctggacagcacatgttcttgatccctacaatcgctgactacgccttccaggtatccattgcttggtaagggcttggtaaggttcttcatattgctgagagtagttgagaggcaccactgcacctgcctggtagattattatggataaccttcacatttgttgttgttttggtgtttcaatggcaggtgacgatgatgagaggactgcccaggactttgctgactgtgtcagtgttgacggtcgttatcgatcaattttgaccgtcaatattaccaaaatagaggtgaactagtgatgattgtaatgcatatacatgttagagtaataatattccactagtacttggttcactaaccttttgcagagaataaccataaagtggaggagaatcgacattgagtcaaacgataaatcattcggataatatcgagaatcagacttatgcatgaatgggccaagaactcagaattgacacgatgaattgggccaaaattcacaagtctgcataaaggagcaatagaggaggccgccagccgaagatgggctggggatggccttgcccatggttcggccgaacccatcctggtgtcgttggatgcaggtttcggcatggacgtccaggattgcatcccaatgacggttggagggcacttcggacaattccccttccaaaaccgtcataactacctctatataaggacttcaccttctcccttcactcacatacctcacgcaaagctctctcatattctcttaagtttagtttagtagtatcaagctggtggaataggaatagagtagaaaatcaggagtctggaagcgttcggaacagttcaggtatggctctagtagctttcctttcctcttttataagctttgtactattattagaatactcttctttatacatttacggtattgaaatactttccgagtatatgaatgccaactttacattatgttcatgttatactgaatatgctgctagcttatctgggagatgctttggtgcgggtataatgtttgcttatgccattactctatgtcatgacgatgatattagagtattatctggtagtttagacgtagtgtctagattacgggatatcattatttggggttatatgctgcggatgagaggtgggccgctaatggtgacagcttagtacgggtatacctccgcgcgtttatattgtcctaagttaattccctagggagggtactcctccatttttagcccaggttatatggtcatgacgggctgtcgtaagaaactcggtagtcaggggtggcttctcgaagtaccagaagggcatcggatagagggtattagctagtatatcagttaactagaatgtatgtatactatgtatactagaagtataggaatagatgatctcttttttctttccacttagcttagataatatattatgagaatgagtagctgatgcttgtgtgtcactctacccttggattatcttaacccctgcttagaacatgattattacaagtaatatataaattattagtcaagttctctctacatgatcttcccacgggataaaataaatatgatacccttggaatactctcgggtgatatgctacaattgtatatccgtgcgcttgcggataaactttttaaccataatataccaggagtatttctgcgccaatgctgggaattatatttctagtaatgtcgttaagaaatatcgacagtctgtcaagagcaactacgaactagtgtagaaaattgctcaaaatgacatgacggaggccgttacaaaggctgtccaagatgccatcaataaaagtggcttcttaaaccacatggagaggctggacaagcggatatccacgctagctaatcgggttgctgcgttggagacacaagaaccttccagtgaggaagtgagtggcagcaacgctggtggccatcctgaggacacgatgtatgatttagtggcaatattgatgcagaagctacaaggcaagcacgactacgacgtcgtctatgcacataccgcacaggtatgggtggcacttcaaatgaccaccaccaacaaggtaataataatcgtgtgcccgatgacccttatgctaaggttaagtttaaaataccatctttttcgggttattatgatgctgagaaataccatgattgggagatgacagtggagcaaaaatttagtgcccatcttgtgcctgagtagcatagagttcgacaagactgatgaaggagtcttggtatttcttaacgacattactagaaatataatctccagcaatggcgcagaaatactcttggtatattatggttacagagttcatccgcaagcgcacggatataccattgtagcatttcacccgagagtattccaagggtatcgtatttatttaatcccgtgggaagatgatagtagagagaaatgtactaataatttatatgttacttgtaataatcatagtctaaggagggattaggataaatcaatgggtagagtgacacacatgcatggagctactcattctcgtactaaattacctaagctaagtggaaagaaaatagaaaagaatctattcctatacttctagtatacatagtgtatatacattctagttatacgattaactagctaataccctctttccgatgcactcgtggtacttcgagaagccacccctgactgctgagttccttacgacagcccgttatgaccatacaaccggggttaaatatggagcagtaccctccctaggaaattaacttaggattatatacatgcgcggaggaatacccgtactgagctatcaccttcagcggcccacctctcatccgcagcatctaaccccaaataatgatatcccgtaatctagacaccacgcctaaactaccagatactactctaatatcatcatcatgacatagagtaattgcataagcaaacattatacctgtacctatgcatctcccagataaactaggagtataatcagcataacatgaacataaagtaaagttggcattcatatactcggaaagcatttcaataccataaatgtataaagaagagtattctaaataaagtacaaagcttacaaaagagtgaagcagagctactagagccataaccgaactcttccgaaggcttccggactctgatttctattctattcctactccactagcttaagaacactaaactaaacttgagagaatatgggagagctttgcttgaggtgtgtgagtgaagtgaggatgagagctccttttataacctcctaatgacggttgtgacggttggaatggtcggaaataccctccaaccgccattgggggctgatctacaccatctagaaaagacctggatcaaacggtgctgaggagggttcggctgaacctggggccggcccaaccagcccagattacggctggtggcatcctctcgtgctcttctccgtagacttgtgaattttggccccattcgtcgtgtcatttccgagttcttggcccattcatgcataagtctgattctcgacatcgtccgattgatttatcgtttgatttgatgtcgattctcctccactttatgattattctctgcaaaagtttagtgaaccaaatactagtggaatattattattctaacatgaatatgcattgcaagcataactagttctcctctatttagtaaatattgacgttcgaaactgattgctaacgaccatcaacaaaacaccccaagattgaacctttgctcgtcccaagtaaaggacgaaaggaaacaaagacttggttgttaatcaggagttgctactatgctgaatatctcaaaggtatatgtaatctctcttaaattaaataatctttggcacggtggcttaccctaacccctgattcccaccagacactgcttctccttgccttgggcggttgaaagacagaacaacaattaaagcagtaatcacccaatctttgttcaacttttattccggaagttttcaaatgattttgcaaaagaaagccgagttcctcaaatgattcactcagtctctctaagtgtatcaataagaattcctcaccattttgccattttgattcttactctaaggtttgatatgtggtgcttggtagggatcaaacatggcatatttgcattcacatttattactaagtcaaaaactcagactaaaatagatgactaaacatacttaggatcatgcaaagtgtgtgtgtgtgtgatatatggtggaaatggaatatgaagaaaaataaagaaaatgcttcttctttgtgcttacgtcctcccaaaaatcacactacaagagggttgagctatcgccaccaatttattacaacgaaaaataattcatggcaatatattatactatcacaatgatattttttctatggcaaataactatattttgttgcaacgatttacaatcgttgttttattcagtatttttgttgcaataggaaatgagctatcgccaaaaaaaacattactattgcaaaaaaacatgttctatcgccacacatttagttcgttgcaataaaaaatttatcatctcataatttgacttattcttttcatatggacacggattaggataaattttatatgaaatttatagctctcgatgagatctacaacttaaattttttatttgaaatcttttaaatactcaaattcatgattcaaatctaagttaggcagtctcaaatggaattgtatgcatttttaaacaaaactgatgcgtaggtgagttggtcatggagagcgcgcgtaagggagagatcttgggttcgaatcctgaacatgacaagatatcaaaagaagatagttaggatgataaattaatattgagacatttaatttggtacgtataactaatgccacacatagagtggtggcaatagttatttattacaaccatgtgaagtgttgcaatatatattttttgccacatctattttatggcaatatcaaattttattacaactaaataaaaatcgttgcaataacctgttaccacgctatttattaccacggctaacaacgattttaagattgtggcaacatgtatctattgccacaattttagcattgatgctacgatttttttcatggcaataaattatttttctagtagtgtcattcttttattaataaggagagggcatggccattttattcctttttttatataatatcatgctcatgcttgaaagagcataactttattattttttctttttttctcataaccatgcctttccctccttcttctttttttttccagaaagaattttctttttaggagaagaaagcacacaaaagcatgaagaatttatttagtggtagaatggaaatggaatggataattgctagctcagtgtaggagtttagcatgtgcatatatgtgggtatatgatcttgatcatagagcatgaaaagtatctacacaagtcacaagaatttgacaaagttcaattgaatggcaagtaaccaaaatttatatggttttaatcataatggcacatttttggctctcgtaagaatttatatcaaatgagaaactttcaaatttatcattttgaaaaacaaacatccggaatttaagtcaaacttggactaggatcatagcaacccttatttactatctcttatgttgcaacaacttagacttagattagcaaatgcagctcatttacctcaggttctcaaataattgtgggctacttacatttaatttgtgagagagcacttacctatgaatccatacataagagatataaaacagagcaactattcatcatttcaacaaagagaactagtttgtcttacctagcatgataaaacctaacctatctttttggtatattctattttgcaaattattatgttgttttcaggtgtatagaatgcaattggaaagggaaatacgcaatatgatacaagttacctcagtgaggggagagatgtccccccctcccaagcttggctttcgctctggttccttgataaagattgaacccctgaaagcggaagtacgcttgagggtcctcatgttgttgctgcatcaggttgttgatgttgatgaactgagcatcagtagtctgatgctattcttgcgtttgtgctatgtgttcctcgaggttgtattggatctctcccatctaaatatcaagggtatccattctcctggtcatttcaccccagtcccaacgagatggaggcataccacttggtacgggggactgatggctctagcctccccactgtatgtcatgaggcacccgccaccggtcctcactaccgcttgcgcagcttgagactccgatgctgtggcgtggagcttgggtccatccaggtgcatccccagttggctcccaacttgcctcatacatttgcacgggtgttgaggatgatgaaccttctcgttcattacttgccatgttgcgtgtctccctgtatgttccacctgcacgagattcttctatggtatgcaagggaatggttagttcatggtagttgttcaaataatatcccgcattaggcaacaagatttcatatgtacaaccggggaagaagtaaatcaaagatccatctactccatgtttaagaatgttcccttgcactagataattctcatctatacagggacaagcggctaagacataagcaatctaatcattgttaataacccctagtccctttgttatccgagtaatcaaggaagtgcactccacaggagtagaaaatcttatactttctagcctttgccttatcatacatttcacagcagcaactttgatcttcctaaccatgacaaacatgacaattaattcatcccctctaatgggtcgtagatcacctctaggaaacaaagttatagcaatccatttatgcataagcctaagtgtaggattatggttatcattcgtcctagttttcttgcaaattggagcattagaaatgtcttcccaaaacctatttttctcgaacctagaaattcctttctggagatcgattttacaggaatcgtgaaaaccaagaagtgtacataatccttcccatgaaagtgtatatttcttatggaaaaagcgaaaagaaatcccatcttgtatttctttcaaagtgcacagaaattgcaaagcaagtgttgtcgaattgataactgtgtcacgtcgaaggacctagttcttttaacagtggttggaagtaaagacaattgtattgcttagtaaaaattttttcagatccccctgttacatggccctagactctccattagggtttaggctctacagaggaatttacgtggttgcccttatgatagggacatctttatgggcatacaatgtcttttgctcgtatgggctcctaatgggccaagtgactcggcccagtccatggtgaagcctctggaaggcgtgttggcctgctgggccttctcctggcaaggttcgatacttggcgaaacacatgccctccggcatggtccatctttggcgaagcttgtcaacttgatgctacggcttttgctgtttggctttcacctatgttgtcccttcgaccttcgccacttgcctccagcctacgcctttgcctatgtccttggtttcggtaagcccggccaaaggtccttgtggtatacctccaacaagcccctcaagggcaagnnnnnnnnnnnnnnnnnnnnnnnnnnnnnnnn

SEQ ID NO: 33608 - DNA, 540 bp, Oryza sativa
cccgtgaacagtaatgggcatgatgggccggtgtgctgttactttcgtcgtttcattgttcggccagccttaacgggaaattaccgttccgtacaccctggcgacacgtggcagtcccttactgggtggcaggcgaaccgtcacgcgggtgggttatatatacacttaccccctagcgtcactttcacttttacctctagtcacttttaccatctcctctgtggctggtatcgctttgtttctccttgcgttcacgagatttcattgcctacttcgaccagtgtgacctcggctcttataccgggctttccagacttttcatccatggacccttgtaaacctgctcctgcttcggccactggtcctgatccggggaagattggtgaaggtcacatcaggtatctcggcgcttcgcttatcgataagacggagttggcgaagctgttctcggccggggtcatggccgaaggataggcctttgctcttggcaaggcggtagtgccgaagcctggggacaaccaaaccgtggtctttgctgca

SEQ ID NO: 33609 - DNA, 535 bp, Oryza sativa
  unsure (1)..(535): unsure at all n locations
nnnnnnnnnnnnnnnnnnnnnnnnnnnnnnnccccaataccctctatatccggtctacgggtatcacccgtcgacaaatctatgatccgatcacaccgttgtattcgttgtaattaaatctttacaacaagatatcgcatgattatattttgataaaagaaaaacatatgtttcaatctgttaatacttattgtttcacatgagtcgtttgaggacactgattcttgccaagattaatgccatgtgacatcggtaagaaacctttcttagaatcttgcatgttgaacctcttcaacaccttgtcaatgtatgtactctggcttaatccaattagcctctttgatctatctctatagatccttatgcccagaatatatgctgcttcccctaagtccttcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33610 - DNA, 885 bp, Oryza sativa
  unsure (1)..(885): unsure at all n locations
nnnnnnnnnnnnnnnnnnnnnnnnnnnnnncacaacacaactcaaaacagtgcaccgttcctggatcataatcaccccctctacaatcagaggcatggactccccagcgacccccatggacttctcgccacttcacagtctggcacactataatgaatcatgctatacaaaagataaagccattgcccatgctggcttgtggttggtacggttaatgtttcacaacagtagctcgcgaaccggtccttaattgtcatgagcacgactctcaaaaccatgtgctcacaacccaccattaatcatattttaattaccaattaattatcataacacgattaaccatcgtgagctaccattaaaaataaccataaataataatgtagtatatatgattcatcccattagtgagctaatgtttctaagcatggctaagcaattatatctaacatctagttgaaccaatatatataaagctcaactagtcaagttataataacccaaggtatcaaggaatagggtaatcaatgcaaactggccataataaaggaataggttcacaccacccggtgacattcaaaaataaatgcacagttgaaataaatagagaatttaaatatagaatcaacatgctcaaaggattgtgtttaggatctgtgtgacttgccttgcaataatcggtcttcaattaatcttcttgatgacttccgacgcactcacgaacctttgcaacgacggaaacgacaagctaacacgtaaaacgaagaaaaagactaataaaaaccaaataaacagtacataacaagtaaacaaacacgtagatcataattttagatgaattatgagacttgaacggcctcattctgaatgcaaatgaatttattatga

SEQ ID NO: 33611 - DNA, 412 bp, Oryza sativa
  unsure (1)..(412): unsure at all n locations
nnnnnnnnnnnnnnnnnnnnnnnnnnnnnnnnnnnnnnnnnnagcttgtgggcgagtaggctgaggcggtgaaccgttgtgagcctagccgagtctagcgcccttgagctccgcgcgtctgggtccgacgggggacgcggtgcggtttggatggggaggcagtatggctagggagacgaggagcctgctgccaaggcgcgatggataggagtcagaggcggcggctgcaggcggcggtggcggcgaggggatgcaaaagtggcggtgtggagagagcagctaaggcaggagaagaggagccgtttaacactggtggatgggggagtggaggggaaaatagtaaaatatcaaatgaatagaattttcaagnnnnnnnnnnnnnnnnnnnnnnnnnnnnnnnnnnnnnnnnnnn

SEQ ID NO: 33612 - DNA, 446 bp, Oryza sativa
  unsure (1)..(446): unsure at all n locations
nnnnnnnnnnnnnnnnnnnnnnnnnnnnnnntacgttgtctcgggcaatttgtttccccccggaagaatgttcttgacgagtttcaataaatcgccaaatgccttgtcactaaccccatttttggccttccattgcaacaactccagagtggtatccaactttttgtgcccctgctcgcaacctgggtacaacgaagttctctggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatnnnnnnnnnnnnnnnnnnnnnnnnnnnnnnnnnnnnnnnnn

SEQ ID NO: 33613 - DNA, 671 bp, Oryza sativa
  unsure (1)..(671): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtcgcggagtgcaagtaaagtgtacatccactgcagtgtgagtaaaccaaatctattcgaatagccgtgctcacggttattgagcaccgggacatgtattacacttggctagactctaaattcttaacttgtgtgggatgggatattgcatgatgatttctatactgatgaaaccacttcctgagaggcgggaatgtggacgtcctcagaaaaccatgatgactcacaatggatggtggacagaaccgtcattgtttaatatgaacactggtactaaaatttgatcagtttgtgataggtcttaggtttgtgaaaagaattataaaacttgctttgcgcaaaagaaccatagccatcctnnnnnnnnnnnnnnnnnnnnnnnnnnnnnnnnnnnn

SEQ ID NO: 33614 - DNA, 1436 bp, Oryza sativa
acatgactacattccgatgattttttattttactttctaaatgttacacacattgttactgaaatgtttcaacaagcatttattgatgtttcattaatgcattagcaatgtttcagcaaatacattttttatgtttcaacaataattataattcgatgtttcaatctaaatataaaaaatgtttcactagtcgggacttaatgtttcatgtaataatgattattgttgcagtcaatactttttatttgttgtacctctttggaacaatttgtgaagtgcgttgaaacatctccacaagtgatgaaagaattatttttaaatagttcaacataagtttgtttttttctagaacgcatatatatttttatcaaaatatattcatgtgagatcttgttataaattatagattggatatatattttagaatagaattttgtttaaagtttgattaagagagagagagtaatggttcctcaggccaccttggcaaccagctatactcctgcatgcatgcacgcgacaacctcactcctccaacgcgttcctgcatacagacgagaaacagcatttgatatttgaaaaaaatattgaacgtatgatttgtagcgtctatttaaaaatatttcaacataattaagtatttgtgcaaaaatctaatggtataattgaaacttagatcagatatataattttggagaaaaatatttaaaatttgaggaaaaaattaggcacatgtaataggagggagagggagagggagagggagagggagtatgcaagcagcaacgcaagcaacacatgcaggacaggcaagcaacgcggcacgggagcaacgcgggcgcacgacagtgcggggagagcgttgaccaacaagtgaaatattaagttatatatggtgaaacaaaaaaaacagcaattgaaacatttaaatattttatgaaacatggtgaagatacacattgtaacatgtcgctgtcacatgtgaaacaataagtattaacagattgaaacatatgtttttcttttatcaaaatataatcatgcgatatcttgttgtaaagatttaattacaacgaatacaacggtgtgatcggatcatagatttgtcgacgggtgatacccgtagaccggatatagagggtattggggtacgttgatacaaggatctacgtagtacgacatcaagcaaacaaaagacaagaattatactggttcagaccccttgataggtaatagccctagtccagttgatgtggaattatatggtagaaaacacagggtaccaagagaacaagggaacttgtctgattcggcgagattggaatcgagttgattcgactagctcttgatgacttggcttctaaaaagctccggcttcttaagctgcggaagttgagttggctttgagattcgatgactaaaccctccccgggggg

SEQ ID NO: 33615 - DNA, 2834 bp, Oryza sativa
  unsure (1)..(2834): unsure at all n locations
nnnnnnnnnnnnnnnnnnnnnnnnnnnnnnnnnnnnctcgattaacaggtttgagcggcgaaaccgtggagcgccgcgtcggccaagtgatgatcagtggcccgaccacggcgagtgacatccctatgcccctttgtgaaaagggggcggcggaacgtgatgaagccatcaatgtaagtatatttgatgaacatcccgcattctcctttcgaaatcactttatgacttgattgagcgtaagcccttcctttgactgatatcatcggaccgctcgcggaccatcaggtggcgtcatctctgaaagttaaggtcgtcaaggaggtgtctgatgctgccaccactagcggtggcagtgttccgacaaagccgaggaaattctcgtctgtaagaaaatggaccgtcatcttctatccatgcaaattctaccatccaaacatacctctcactgactcactcatttaacgctcctccacttactcgctcggcttcgtttttatgaatttttaaagtcttataaaacgttgtcaacttactgctttaagactcgcccgctatccccttccctttttattagattttaaaaattagacctaatcatcgttgggttctttttttttcttactttttcaaaatcctatcaactgccaggacactatggcagttgacactacgcctttgcccaccgcccctcctctttatcgtctttgaaatttcaaaaattgaacctaattgttattgggaattctgtttttaagtttctggatatcccgtcaattaccaccacctactcttttatggtccggccgctgtcctcctttcttatgttatttttcacctcctcagctcgctcttatgttatttatcggtcatccacttgtctgcatgctccatcatttagtttttttctcgacatcttattcttcccccgtcccattttaaatgcagttatgggtttctatgtccaacgtttgatcatccgtcttgtttaatttttcttataattagtatttttattgttattaaatgataaaatatgaatatcactttatgcatgacttattatttttatttttttcataaaattttcaagtaagacagaacagatacacttaaaatgggacggagggagcactattgaacaaggtaatgttgtaaaagctatgaagttggtggtgggaactaaccccttgcgcatgcaagacgaagcgattcattagcacatgattaattaagtattagttatttttttaaaaaaagtggattagtatgaattttgaaagaaagattttttttgttcacaatacacgcgagagtagaggttgggaaagttgagtgaagaacgtagcttagtcatgcacactacgctagctagctggttatattttacaactgcatatacattcgtggatctgtaaactattttgatacctcgaggggatgtcccctcgttgtttatatgtcactcaaatggttatgagcttgtgtcgaatatatttacgtagttcgttatagtttaggacttagagttgtaataggtattaggattagactaagaatcgaactctatcttagaatctatcttaaatagaggggcatgcctactgtaatcgtatggagacttagcatagcgagagggagcggatgccgacagcgaccggctgtgagtcgttgtaactctgatatgttgtaatatgctgaatcgggaaagagcgctagtaattagtgccccggagatgtaggctacggctgaactaccaaatatcgtgtctcggtgttgtcgtcatgtttagatctcatatggcgtttcttccgcgtttagctaccgatttcggggctggttttataacaacaagttcaaaattaactactacatctcgctacgaaaaaaagcaaaacaaattaaactacaactaattaacatatattcacagtcaaatttgttttttcgttgagagatgtagaagttggatttgaaattgtatgtttgtagagtgatatatcacatgttaatacaaatttccaatttttttcaaatctttttataaccatttgagcgacatataaacaacgagaggacatcccattgaggaatcaaaatctactctctttgtggatcgtgcagtgcaatacacataacgttgctgtgggtcggagaaaggaacaccgactcctcagaggttgggtatatggatcgttctcctcgtggccggcggcctgtgtgctccatcgtatcaacgtacagtggcgattactttggagcactagagacgaggatcaggatcagatcaggtagcctgttaattttcttctccgacccaccacaaaaccatccctcgacctctgaatttatgcggtcatgcctggcccgatgcatagctagtgacaagacggtacattcagtaatgtgtcgaaacaatatttcagcaatactaaaaggggtggctgtcaagcaggaaaagtggatgaattagagcatctctaacagcctctctaaattgaactttccaaacacccatataaccaactctccatctgatttggctagtcaaactaattgttcactccaagagcctctccttttaccatctctactttgactttatgacaccgaaacccataggtcagcctctcccttcttctttctcctcttccttcccctcttcctcttctctcactttggcaggaagcaggcggcaagtggggaggggacggcggtggtaggtgcggcggggagcgaggaggagcgaggttcagcggcggtcgtggttggctaccgcgtggaggacagcggatgtcgcggcgggcaatggtgcccatgacggcggtgggcgaca

SEQ ID NO: 33616 - DNA, 4777 bp, Oryza sativa
tagaggatccccaaataaagtggccaaatttggctagtggagggagggttttggctagccggatggcttagccatccggttgaagaggctgttggccggagcacgtttttttagctagaatagctaaaatttaacttggagagtgggatagagaggctgttggagatgctcttaggagacgaaagatttatacaggttcaggccctctcaatgagaagtaataccctattcctgtccagggattgatccgccgagtgtgttattgatcgtataatctgggagaaaagttgtgcctctagaggcacccgaacccctcattatatagggggaggagtccgtattacaagatacagctcatattactaacggaatatgcaagtaaagataaactacaatcataaccgactaggactatcgaatgtttaattattattatacaagttaacataacaaccgagtcctttactaaagatattctaaccgtatatggtacccctatacccagtcggatatacatgccgtgtgggtacgaggtatccataatctctacagtatgcacggtgcattcactaggaaccatccattcgtaacggttggagttgttacaatccgttggtcaccgatgtgaagactcatatataactatggacctatttgaaaaagccttaaaattctaagaaatagctgatcggtaactatcttgtgagatcctggagaagctgagcttttcattttctgaaatctacaactacaacgtctcagaatctaaaaaaaaaactatttggtagaacttttgatccttgaagaaactatagttgtcaaaagctactttagtcatccggtggctatgcacctgggccatcctctacaaaccgggacttcgggatactattgcggtggtatcacaacgtttcgaccaggtagcacaggagtttttttttttacccagaagcatgggtggcgacctagtctctacggattgataaccactagtttctatgttttgtgatggggaagtcttcttaggtctagtgtttttggctgtgtgaattctatgcagaggctgggggtggattaagttagaatgtatcatcttggtgtattttactgactattaataaaacttccattatcttttaaaaaaagttgtcagaagcttccattatacgtctctgcttctctgcttgcttgcggcgctcgtgatccggcgaaggggcctgagccgctgatcggttggcaacgcgtcgtccgccatggttctagttccagccccatgctaggtagctatagctagctgctgctgctgcgtcgtcatcgcgagcccctgcctacacggaccacgctgtgagtgacgaccgttggctcagatcagatggtctaggttttactataggtttcgggcacctatatatcctgcttgatctgtttggtttgttgagtccatcctcccgtctcctcctcgctggttccattcctgcaaatgcataattaagcaagccagccactgtttttcctagtacatatatagagacaggccggccgggccatccactcacgtgtgtaggaaattaaacggcgaaaaacattggatgcactcagctaggacaggggcacagggctttgatgtaagtttgtactacaacttggggaggatacagttgatccagacactgcggagaggtacaggacaacaacaggatatgtgtgagccacacatcccacacaggatggatgaacagttggatgataacttgatcgcaatccgtcccatttccaataatgttctcattccaaccaatcttacttatatcatttttttccagatttacaaaaataaaaaccctgagacagacaactactgcctctgttgtaaatcaatctatgtacaggacgatatctagccaaacttttaaagcgttcaacaatttatagcttcttaagtgcttaatttaaataagcaaaaatatgggtagatttggctaaaaaagtacgtacattgtatttttagagagaagaccttgcggcccggtttatattgaaagccacattacgtcatacggtagagttggtaatgggggttgccagtttacaaaagatgaacaacttaaccaagtgactcaacgagtttggagaaacaccatgcgatcatcatgcaacagggataaaacctgcagctctaaagtagcaagcacctgatgtctcttagatctattacaaaacaggaataatacagaacattagcagaggtataggctacccaacccctgttcttcggatcttcaaagcggttgtcacatttttcaacttctctgcaaccatttccatctccacaacatccttagtgtgacaaagggctctccgcagcaaaagagagatgattcgaaaaggtaggatcagtggagagtacaacggcttggatctggaaatcatattatttctagtggtccataataaccagcaaacaaccacaaatacagcagtaaaaactctagattcaacttggttagaattgttaattagcaaaaagaactcatcaaaatctcttgttccccacccaaaagaatctctacaaatgcaccaagttaaagaggccatgaggtaggtaaaaagaatgtgggtggtcgatacaagtgccccacctattgacaaaattctgagcactcccagttttttttaattcttctacacactgcattttcacatctctcacacctctaaaggccattgcttcatagagtgactttgtggtgtatagtttattagctgataatcctcagatcatgaggtctggtgaattgactagtacaatctcttcaattatatatgtgacatcatactttctatgtcttcaaaagatcttataaaagataaacaactagcactctttgttaccaactttgagattgtgatgtctcgttggttacaaatctaaaaaatctttgggtatgtggtcttaagggggcaaggatcatgccagaaccatatatgtcttccatcctctagaagccactatgaccctagtttcatccattttctggtattcagaattctttctcgaattgtgatcccttttgaccattacattgggaaactcctctatcctaaagatattttttttctcaacaactcaacacacagactattgtatgaggactcaattttcataactcatttggccgatagaacagtgttcagcattctagttttagtcaagccaatacccccaaagtcttttgggaaagccaaatctgtccacctcaccatgtggtattttccgccctgtttgttaccagctagtaatacctcgccataataacttttgatgtaatccctcgaaaacagaaggtacttgtaatatcataaagtattagttttataagtttactttaatataaaatttatggtcaaagtttaaaaagtttggtaagaacttatctagtcaaatatttatggttggcggaagtaaaagaaatggtgcgcattagagaaattacagagcaagtttaacctttatggtgtaaacgtatgtactccactatacagtggaaaataaaaaagacatttcttacaataaaaaatataacgacataaatagatagtcccttcgactatttgagcgatggtagagagggccatggaactaaatattccacttgactagagcccgatcgagaggaacagaaagaagggaaataggagctatggtaagctgcagggtgtgtgtcaccggggccagcggctacatcgcgacctgcctcgtcaagaagctcttggaacgaggctgcatcgtccatggaacattgagaaatcttggtacgtacaacgtactccgatccatctctagctagccagctagagacctctcccaatcactccctgtttccaattgttggagatatggagataatatatctgacaggagatgagaagaaggcggcgccgttgagagagctccccggcgcggcggagcggctggtgctgttcgaggcggacatgtacgacgccgacaccttcgagccggccatcgccggctgcgagttcgtcttcctcctcgccaccccgtttcagcatgaacccagcagcaaggtatacgtagtcacaagctcgatcggaacacgcaggaaaaagatatcaatgtcatgtcatcatgtgtaacgtgggtaatttgttgattttgcagtacaagaacaccgccgaggcggccgtggacgcgatgcgcatcatcttgaagcaatgcgagcgatcaaagacggtgaagcgcgtcatccacactgcctccgtcaccgccgcctcgccgctccgggaggacggcggcgaggggtacaaggacttcatcaacgagtcctgctggactccactcggccagtctcacccatacagcagcgacatgtcggctataaatcaagtaatcaaccagcaaaaaaaaaggttatttttaaataattttttttaaaaaacaacaagatatatattgtgataacataagttagtacaacaaattagccctacacttaaagaaagaaaataacaaattttcatttacagtgtatttttttgttattttagtttctccgactgcagatacacgttggaagaatgtgtgcttaaattgctcctaggtgtactaatatcaatgtccatcaactaatggggtgtttagattcaggggtcaaaagttctagcgtgtcacattgggtattatatagggtgttgcatggggtgttcgggcactaataaaaaaactaattacagtatccgtcaataaaccgcggacgaa

SEQ ID NO: 33617 - DNA, 18621 bp, Oryza sativa
tatagggcgaattcgagctcggtaccctttgttattttagtttctccgactgcagatacacgttggaagaatgtgtgcttaaattgctcctaggtgtactaatatcaatgtccatcaactaatggggtgtttagattcaggggtcaaaagttctagcgtgtcacattgggtattatatagggtgttgcatggggtgttcgggcactaataaaaaaactaattacagtatccgtcaataaaccgcggacgaatttattaagcctaattgagatgttcaaacgttcgatgtaactgggtgtaaaattttgaggatgggatctaaacatgccttaagtattccaatactgaaaacacatgcttcctagcgaaaatattcagaatataaatctgtgcttcgtaggtttacgcatcatccaaaacgctatccgaaaaggcgctgctgaggtacaacgagtccgagagcagggcgttcgaggtggtcaccctggcgtgcgcgctcgtcggcggcgacgccgacaccacccggctctaccacctgctcagcgtcccggcgatcgtggcgccgctcatcggccaggagtcttaccacggcggactcaagtacctgcaggcgctgctcggctccgtgccgctggcgcacatcgacgacgtctgcgacgcgcacgtcttctgcatggagcagccgtccatcgccggccgtttcctctgcgccgccgggtaccccaacatgaaggacttcgtcgaccacttctccgccaagtatccggagatcacgatcaagctccgagagtatgtgtgcccatgatcaattaatcattttcttgttttctcttttgatttttgtttgtttgtttgtttacatggtttattaattgtggaaattgctatgcatatgagcatgctcgtctttaattgatctataatttgcatatctaaaaacatatctctggttgtatataagttgtacaactagattggacgtataatattactcattaattttatatgtgtttgtttgtgaactcgcagggtggtaggggagggcgtgagggtgggagctgatacaaacaagctcacggatttggggttcagatacaagtatggggtggaggagacgctggaaggtagtgtggaatgcgccaagagaatgggattgctgtgatatgcggctgttgcgttgctcgttggtgtttagtaatttgcgtatgtgtagttggcaccgatttggacccagatgtgtttgtgcctttatgctaaaaaaaggttaattagatccataccattattattttgctagttttgaaaaataccattataatttatataattgaaaccatatcattgcagttattctgagattggaaccatgccatgttatacatccttttgtgtaatgtattctcgtatggaccaatatgcccttgtcttcttccttcctcagctcctttccctcttgttcatcttctctctctgtctcttcctccctcaatatgcagcaggtagagcttgaggtcgtctcgcctcttctcttgtgttgctgctcgtccatggttccacggtggtccagctcatagcgattccacggcagggttcactgataggcaccaaaagagaagcgacggcggcagggtcagggcgtgcgcagccgtcgccactggggctgagccagtccaaggcgttgttcactcttcttcctcctcctcccatgtcgtttctactgttgttgccgctgttggtcccgtatggatccataccttcacgacgagcttgttgctacagctcgcagccagatttgcttgccgctacacagctcgttgtctctgtaggatcagctctctgacgtgccgccgttgcagtacccgccgtctccgagaccttgctgctgttgtgacgagctcaccgctaccgtcgggagtggtctcgtgcaccattgattgctagaggagagagacggggcgatgaacaccgccgaatcctagcccctcgcctctatcgtcaccggatccgtgaccccccgcctaccccccttgcctggacgcggccggatatccgcatgtccgatctgccaagaaccgccgccggagtgaggggagcaagcggagtcccggagcaatgcccgacgctggtgagagggacgccgagctcctgcttgccgagagcgagtgagaaagaatgctcctgctgctctacggggaagagaaggaggttgaagacgggggcatttctgtcaagtgtatgtaaaatatatagatcaatggcatcattacaattacaaacaaacaaaagtggcatattttcaattaactgaatggtaatggtaaatttcaaaacaagcaaatttatactggcatgaatccaattaacccaaaaaaatactacctgtatctaatcgatccaaaactgcgaaatattaacacgagataaccatgtgtaatcgagaaaaatgtattgttgttgcttggttttgcattgaccggtctgacttctagccctatatgatttggcctctagtttctctaaccaaacagaatccaaaataagatcaacccaactgtttcatgtcatctcaacctaaaggttgacagattttgtttgtttattgtaatatttttgtataacaagaccataaattaaagagattcattgttcattttttgtttatttaactcagtattcaacaacgatttgttaacgtgattaatatttcacttattacaaacccaacaacttatataaaggatgtataccttgggcttataaaaggatttcttcatgcaaacaatcctcaccgcctcgaagtaggccactgtgttgatgttgaaccagaagtcatccactcttccctgactggttttcgatgtcggcgatgcggggggggggggggggcggtaggaggctctgcactggcaggcggcagcagatcttgtcctcgtcgacaaagcagacttggacgaggaaaaaaattcttgcagcagtgtcgcaccatgcctcatgtgcgacaccgcgtagacagctgacgcatgcatccaagccttctttagagttgagccgatgtgttgaaagactcaaaacaacaaaccaagccgaaaacttggggagccgctgaccccccccccctgtctagggatacatcgagccatcctcttcccgtcgcacagccgccggcgggggcaccatcatctctccaccctgagatccactgccgcctccatgcgtatagcttttgcacttctctccacagcctaaaatccaatccatcgattccaatttcacgcctccaacagaagggaagaagaccatgaaagggagaagatgccagatctgttgaagcagatctgttgaagcgaccttgaagggtgattcatggcttgtctttgcaatgtatcttcttgaaactagatttggaattgacgttctcaacagtctagcacatatataattcgcagaaggggcgctgtcgatatatccacattactcactatcttaaccttctccaactattttggccactcgggagatggtgttgtttctgaatttctggtgtgaataaagctctttggaaattttagtggtaatttgctgagtgttgctgaaaatggtgacttgttacacaacttttttattatgcaggaaaagagaaaggaaagctagcagcggccagcggcaattgaggagctggagactctgatagtctgtccagtccaggtaggtggccgcacggcccgatcaccagttcaccaaccactccaagggctccgtgcacaccccgctgcatctcgtcgcagtatgggcctgggccgtaatgtgccgcagctaaacttgccagcccagcccgttctgatgagcgcgagacactccagcctatcgagcggtcactactcactagcagttggaatttggacagcagcagcagcggtgagcgcggcggcggcggcggcggcgacttgctctcctcctccccacagtccagttcttacaggagacgaacgccggcgagccgcctccgccgcagctatggcttccaggacgctctccgtctcctccctcgcctccgccttcgcctccatcccccgccccaggccccctcctccgcctccatctcgcatccgcgcctcccctctctccaccgccgccgccgccgccagtgacggcgacgccgccgacggggtcgacaccgtggagcagctcctcgttacgaagccccccgcctcctcctcctcctcctccgcgggaaggggccggatcgaccggctcatgaagctgcagcgtcgcgcggacggggacttcccccccggcggggcgggcggaggtggttcccttacctggacgcgttccgggcggcggggggcgtggagctgactagccgggaggtgctggaggtgctggagccgcacatcatggaggcgcggcgggagcggatccgccgcgccgtcgagaaccggagctactccgtttgcctcgtcgtggaggggctctctgacttcgggaacgtctccgcggcgttccggtccgccgacgcgctaggcgtgcagtccgtgcacgtcatctcctgcgacaacaacaaaaggtgcagaggtgaaaccaaaatgtttaacttactcttcatgacagacattgctattgctcggtttggttgagcgaagtagccaagtagggaactatgaatagttgtagagaatgagaattatactaatctatttggatggatggttttagtttgatcccatgaagaaattgttgttgtgaacttctgataatgctcaaccatctaatttcagcatacagtttgccagtttgcatctaataatattctaatacactgaatctgcaatacctgattacctcaatactgcatggtattattctttttttcattgaggtgcaaaataaatgagaaatattttttgtgacctgtgcattttatttgtccattcagtagtttgtacaaaaatggcagaaatactgaccggaaggaaatgatccctcatctagtcatgtagttctaatatccaacacaaagagagtgattccttatgctaaattttttcctaattagaccactggattggtactgaagaacacagaacatttttctttcttattagtttttttatacataaattctgatatctgattatctgaatgaaattatatacgtattgcatcctttaaaatttgtatatatttctcaacttgcaagaccattgaatgaatatacttcttaactattgcaggtatagagacaataggcatgtgagcatgggtgctgagaaatggcttgatatcgaattatggagctcaactgcagaatgctttgatgctttaaaaaagcgtggttatcgcattgcaactacttatttgggaaatgattcggtaatttgttgttgctcacctttttagttttcgctcgtattttgaacagtaagccaaaaaagagtgattgtgatcattacatgcattgtcatttgttatccgcagtgaaagacaactctttttttttcttttcaagtaagaacattttcagtgacttacatagacaagataaaaacatttgttgtaaaattaggctagaaaagccttgaaatagattggtgtgtggtcgttgccaccaccaatgttgttgatcactgattgcagaatgattattgtcatctcctatttgagagtatattagtgaccgtttaggttagaatgaaagatatatttatctgtcccaaatacacattctttagtgaattggtaacttcagccttttgtgggattttgcaacaatgtaatactacactgtcattttctcaatatactttttttccgctctgtattgcattgaaagatgctttatcatttactgatctaagtaatacagttcaaggaataactatgctcgtaatggatctgtaggtttgtgtgtacgacatggattggtcgcaacctaccgctattgttgtgggcaatgaacttatgtagggctcttcctcttctccagatgcacatcttctcttgcaatcatgttataatgagtctcaaaagtatttaaatggaatgatcagatacgatgtcctcttttctacttcatgtatgttgtactttatcattacttttctacatcttttttaatcactttggggtaactaatctgacatctcctcttgcaagaaatctgcttaatcatcttgatgtatgttgtacaaaatggtttgcttagaagttttcctattacaaactagaaatgccatgtttgtttttactacagaagttccaaatagtccactgtgaaatttatatggatttataccttggaaagtaaagagagtactcagtatatcacactaacttaggggaatttatttttcagtatacttgtggagctacttgtatattaactagccattctacttctatggcaggggcataagtgatgatgctttaaagttgtcagacttgcactgcagtgttcctatgaaaggcatggtggattcttttaatgtatctgttgcagctggaatccttatgcaccatgctgtctgtgatcgaatttcccgcatcgtaagtgtctcaagcattactactaaatataccagcaggaagaataaacaccaaattcagtttctgctagtgggttgaacttgtctccaaactcatatataaattatggaaatgtataacaaccagtgaagcattttgtcagttttttatcctgacgatttgcagttaatatatccaaatggcttgaatcatcacttgttagtttcagtttcagctcactgatggattttggaatggtctgaacttactttcttttaagaaatgtgtctttataaattcacttctctgttcattctgtccaaatattccttcaaacaagggcactgccaagtgcatattctgcttaaaagttctttgtaaaaaatgtataacgaatactatcttaccagaagtttttttttttttaatgatagggtcatcatggtgatctcttgcctgaagaaagtagaatattgcttgcggagttttatttgcgccacagacagagcacagctggcatagttcacgaatatgccaaaagaaaggcaggaaacttcatggccaaactttgacaactatcattatagttactgaaggagaaatatacacaacctaggtattcattcaaagagatttgctttggcaattggagtttctggctctggcatatcatttttgacagagcagctggtaagctctttcatattccttatagttttccttttgctgtcatattatcgtatcagcattattatcaaatgctggaaggatgccacctacaatttcttttgtagttcccagtgttttgttattgtatatttgtattcctcaaaaaatattggctattcgcctattgattgtagtcttctctaaaccaagttgatagagatggtgtggaatatgcattcttttgtggtttccctttgactgctcaacttctctcttaactcatctttgtcagattggtatccatttaacatagcatgtgtttgttaaatcattttttcatgggttctaaatatcctcttttgaatgctttcaggtactccctccgttttttaattgatgacgccgttgatttttttctcacatgtttgaccattcgtcttattcaaaaaaatttacgtaattataatttattttgttatgagttgttatatcactcataatacttcaagtgtgatttatatcttatacatttgcataaaatttttgaataagacgaatggtcaaacatgtgagaaaaagtcaacggcgtcatctattaaaaaccggaggtagtaccatttttctaatgtttgcacatggtaatctgagctgttgccctcctgattactttttcttgacgaaggctttttacggagaggaactatcaggctgcttgaccatcatggtgcctcaagatgatgacttcagaacagaattttttgacaggactatgatctatcagagtatcaagctatcgcattatcttaacagatgacattactatttcagtcacattgcttgctacccaaatttggaagttgatgcaaaaactaagatgttgttttggatgctgacatataagaaaggatcgatgcagctttctctccgttcgctagaaccccagttgataatttttagagtttaactactgccttttaccgcgatgtgagacactgcactcagaactcaactctcttagcgatttaatgtcatgttttctctctcggattgttcacaataacagagctagagggttattttttggttattcaaatactctgagcggttccagaatttctgggtttttttccccatctcttgccttagctccataaataaatgctggtactataatgaacaaatttacttgtagtattgccaatgtgttaataataacaacaagaaaaaaaaatgttccatttaatatgatcgatcaagttaattattatgcacagtacatttcacagggccgatcgggcccacgcccgtacgtgggcctgggctgcgggcagacaccgcgctatgtgggcccggatttatgggcctgacatggctttcggctgcacgaaagatatcgacaggaggggcgcgcctccctttgcaagttgccaagttggcaaggtgagacgctcaagtggccaagtgggatcggagcaagttgctgcccgtggccggcgcatctccagatatacggatataccatgctcccgtggatcactcgtggatttattttctttattttttttaatggtataggtagatttcttttttagataataatggtataggtagatacagaaccgattactatattaccatattaccactactattgttatagacatgcatatataactatatatctgtctaattaattaccatacttcctcagttacatactaaataaaattataagatttggctaacttatttttgaacaaacgggaggaaccaaaaataaacttattctgagatgaaggtaataatgacatttttgacaaaacaaatatacaatggatttaatgaaatttgttcttctacaaacttgtttgacctgaaagaagtttgagataggattctaaaagttctgaacaagtttgaccacatttaggactataaacttgatcaacttgaagaattctaaaatatttttaaaagaaattaaactaactttgtaaaaatattacatgagcgtactccatccgtactcatttttctgtcactattaagcatcaatgtttcaactttaatcaatgtaataacttttacatatttaatttgttattaacgaggctatggttccaagtttatactacatttttttttgaaaaaaaaggacgagtggtaaaagttaaaagtaaatggtatggagtacatgtctacacaacccttgttataaaaaataaataaataaaacgtctgtacaagttgaagaggcatcaaccaagttggtagcctggttgtaggagtatttttcttatattgtattaatttcgtattataatacaccaggtggatactaccttagtccatgccaaaaaaatgcctagtacatgtcgctatcgccataaaccagagagatggaagagatgcatcagcaataaacattgggccgtacgatcttgcctgccatttacttttactctatttaatttaacaagctgtagttaaacaaactcataaatatcctgaggtggcccccgctcgacctcatctcgccgactactagtcgccgactggcccaggggtaatctcgtaatccctgagtcctctgcctcgctattccactaataaatgtttgtattttcaatatctggagtttaagcaattattaattttggcatttgaaacgaattaattttggagtagtatttattcctgtctagcactggtgggaggaaagatggatttagacatgaatttttaaattttaatcgaacaaataaaagaaaaaaatgatataaacacaaaaagaatctcataaacttttacaaaacaatgttactacatttcaattttccataagaaccaagtgaataaatcaaatataaatatttgtttgaagcactccctccatcataaacaaatctttaacatcgagtatatgatttgataaattttatattaaaataaattaataaaatatactcctaagtttgtaatattatgtacctcttttcgaggcaagtctacctaaaaccatttatttgttattattttttaaacaaaatattaatatgtggaattttgtggtaccaaacataaaacaaattttgattggagggattgatatttataagaatttttaattactctctctttcaaaaatataaacctaagattgaatgtgacatagcacctgtttgaattgatgctctacaaaaatattgatagcgccaaatcttgatcaaattttgatactaccaaaactttgatagggtaaagttaaaaatgaactggtttgaaacaaaaatatgctcataagagacaagttcatgggcaaagatagtgtttaatagagatgtttgctttgctactctcttggtagggcaaattttggtaaagtagcaatccaaactactttatccgttgccattcaaattttgtctaacaatacttgtcactctaaaatactacttatcctatcactcacatcttatttaaattctttttcttctacccctcaacgacctttccattttcaacaataaattatttgataaagacattatagtattttatttttttcaaatcttaatatgttaaacaactagaaatatagatatagccctgctctaaacaaagtgaggaaaatggcgatgaccaaaatgcccccgttccccttccatctgtcgtctccttcccctctctctatctcccctcgcctcgcttcctctctcccccggcggtggctcggctggttcctccccgctccgcctctcctcctcctcctcgcgcggcggccggcgagcttggccgctccggcacgcacggttcgggcagcctccactccttcccgactcccgcccttcctcccgcgcgcgcgcgcgcgcgccgcgggccggtgtgaacaggttttgggaggggggcggcgcggcgcggccggcctcgctcgttccgccgccgccgttggcggttcggcaccggaggtattccttcttctctctcagctctctccctccgcttcatgagccggcggcgtggtggtagcgtggagatccatcccggcttagtttgattcggatttcttcgttgcgtggcacagtactaaaatcagtttttgtttctttctgaaaaaattgggggttatggtgaatcccacatgcgtggtttagtttagatcgttagaactgtccaaaatgattgggtatagtttagtacctgatctatctgtatgaaaggcttgaccatttttattgatttgttgcgatgttggtaaccgattgctctgcatgtaactgaaatgccaatgtgatgcaggactgaagggagtatgaggaggtgagcattgtagctggagtgattcggttgccggaaatggtgctggtggtgaagcagcaccggtgcatgcactcggcgagctgcgtttgcatcaagggacacctcagcgaggacgcgctgttcctggtctttcgtcacatgaactggaaccccaggctgatcgccgtgctctcgtgcgtgtgcaagtggttcgacgaggtcgcgaagcaggtgctctggaaggagttctgccacgccagggcgccgaagatgatgctggatttgcattcgggtggcagtcacattgtcgacgggaactggaaggcgctcgggaagcttctcatctactgcaatggctgcacaaaagggggcctctttaacaacattcatgtccctgggcactttgtgttcaggacacgcttttcgaggaccgcgggcaagagtttcctgccccagcagtgtaggaatgatgtcttatatgtctcagatccatgcgagcatcttgatcaaggggatgaaggtgacttgggtttcttccgtggtatcttcatgtcgttcgccacctcaaaggttaagaagatgttgattgagaagcgggcaaggttccatccaagcgagtcatgtccctactgtaaggctaagctgtggagcatgttggaagcaaatatgtcgccggggagttcttctgccaggcttggtgcttacgaggattctgtggagtattttgtatgcctgaacggacatgtcattggaattggtacccttctacctctgtctgattctgaggaagtaccagaggagtagtaatcaggaacttgaatcaggtgatcatattttacattttctcttttgctgtcttgcaaagtataactttgtttatatttactgaattgaaactgcaaagcctgactttttattgactactggtcaagataaatatataggtatcttcattatgaatatacaaaccgaagaatatccagacattttttatgtccattcgttgtcagcacatttcttcattctgaatgccaatatcacttttcatggttggatatctagaatgactaatgttcaacagtagattgtgtatgtcaaactgttacatgcttaagccttttgtattcaactcatgaatatatgtggcttgctccatatgtgataactgatattactcctagtagctccaaaagaattaactaacatttgttggaaactatactatagttactttcatgtctgaaaagcttggttgatgatctgggaatatagaagttgtttgtttatggtctgtttaagggttgggttatggggcgctgatagcctgatactgcttttgatgttgcctccctgtgtagagaacgggtcctgaactggttagctggaatccccatcctttttttacctgttttcagtagctagttgtccctgttgtttagttttcgtttcttttgtataagaccttgttatgttttggctttcttcaaagggccaggtaatgaaatttgcctattgtctaaaaaaaagcttggtagacattactaattatacttattctcatttgtttacatggttgtgttatgcagtattcatgatccctggaccgactctacctaatcagttgccactcttattgcattcttttaagggttaattagatccatgccactgtaactttgccaaatcaaaaaaataccaccactattcgtcatatcggctacatgccactgaaaatttctaaaattggaacaatgccactgccgtccctttttccatccacctctctcacgccatcctcatcccgtcctcatccccttcctcctttgttccatcgtccatctatccatggccgctggaggttgacgcgagggaggttgcgaggaggtcggcgcgatggtggcggtggaggaggaggcgcgcacgggctgccgttcctggtgctcgcgcgtacggcgttcggggtgcgcagcacgcacttgctggcggtcatcagcgtgctcatcggttgcgggtggttcggcatcgaatcctggatcggtggccgcgccgtgttcctcctcctgccgtccaggctcaagtcgtaccagccgctgctcgcgccagtgccaggcctggggctgcgccgctggagttcgcgtgcttcctcgctttctgggccgcgcagctcggcgtcatcatgcacggcatggagggcatcagcaagctcgagaagtacttggaccatcacgaccaacattcccgccaacgtggtggtgccggcaaacgcgctcgtcagcttgagcccgcggaagttcacgttcgccaaggtggcgctggtcactgcgttgctcggcatcgccttccagccatggcggctgttcggctccagcgagagcttcatctacacatggccgttcgagctctcctccggcaccagcggccgctcggctccccggcgacctataactctgacggccatgagggcaaggtcgtgcacctgcatcgtcgaggacggcggcggcggcagctcccgagaccgagctcatcgtcgagcacggcggcgtcgccatgtgcgacggtggcgacgccacgttgcgccggccgggcacgtagcagctgcggcgcgacgggggtgggtggatgtcggcgaccaggaagtcaccgtcctcgtcatcgtcgtggatctccagggggaggaactccctcctcgtcgccatcgtcgtcgttgtctccggcgagctcgaaggtggcttacggctggcgttggccgtcggccgcgacttccactcctcgacgctctcttgccgcggtggagcacgaggagcaagcccgggggaggaggcagccggcggcgtcggcctcctcgccgaagaagaggaacgaatggtcggccggcggatgggaggccgttgaagctcccggcggatgcggaggccgaccaggaagccgccgcgcgctcccgcacctccgcgacctcctccgctccctcctccactcccccgcgggcgtcgccgtacgtcttcctctctgacctcctcagccctcgagcgctcgctgtggccgccgagttcgcaggaagaaagaagagggaaataacgtgatatgacgccacatctgacgggggaaacgagacggcgtgagataggagatggaaaaaggaacggcagtggcatggttccaattttataaattttcagtggcatgtagccgatatgatgaatagtagtggtattttttaaatttagcaaagttgcagtggcatggatccaattaacccttcttttaaatgccattagaaccatgaatgctctttattaaaccatagtttgaggaactttcatattcaaaatgatccatgaagtgggatgatcttatccatgtcagcaatcttcaagttcattaattattgttttacaaagctgctagctaagataacaaagcagatgtacaatctgaaagtcaaatgcagagctatttactttagtgatagtagtatgaacagtggctagaaaatcaatctacaattgcttagcacaagtagttctgtccttctgggaccataattttcccaattggttgaaaatatgtttctctcaagaaaaaaaaacaagagtgttctgaacaagcgtttgttgctgacaggtttgcaagactgaaaccctggattcgtgcatgctgttcgttgctgaatctttggttgcgactaacagtgggagaatgcatgcgcaaggcgacctgcaggtctgcaggatgacaagaatggctttgcatcgcagtgttgttcttcctgaaactttgcatcagatggggaaaaaaagctatttttatactgttctctcctttatcattgatgcctcatccctgcttcccctaattgtaaccgagacaccaatctcctgtcatgtcctatatgttcacagcacgtaatgtggtgtttatttagcttaattggactgtcaaaaatataaaactggtgctcatcacatgcatttcattttcctgtctgttcctgctgcattacttttgagaattaaggcatgctggttcattgccatacatagccttgccatttttttcggtaatggcaaacattggtcattgcaaaaataaaaagaaaaattggctaggtcttcattcgttttgcaaccaaagtcgtattcccattcgtttgagcaactcgggtcagattagaaaatgtcattagcgaatgattaattaattattaatcattataaaatttgaaaaatgaatttactttacttttaaaataaaattcttacttataatttggctcggttgggtttgctgtctttggaacacccattctgtcctttagagtttgaaacgttttctttccttttttacttcgttcaccacaaattaccagggattcaaacattcaaaattttgtatgaactactttgtattatctcctctatttcccgaacccaaacgcagctttggacgcgagattcctaatgggcgatcgatcgccccgagcgatcacccctcctcatggttttctttttttggcaccgcattattttcctattttagtaaatttatgcatttaaaatttgtacacctcaaatttacacatcaagtttagaaacccaaaatttataagttaaaagtttatatatcctattcaaatttgaatttgaattcaaatattttttatatatagtattttctatacatctaaagtttatacacctcaagtctatagacccaaagtttataagtcaaaagtttatatatccgattcaaatttatatattcgatttaaatttaaatttaaattcaaatatttttttatatatagtattttctatacatataaagtttatataccttaagtttatagaaccaaagtttataactcaaatgtttatatacccatttaaatttgaatttgaattaaaaaaaaaagtagaaacactggtcggggcggggggagctgggggaggagaccagcgagacgacgcgacgaggcacgtgaggtcgagtcgaccaggatcgtttgatccgatgtagataaatatagagcgttggatggatttgatgattgaagtattacgtaataacatgtaaaattgtgtgtgtgtgtttttgtagaactatgtaaaattgcgttggtgattcatttgtgtttagagagctctgctcaatactctgattcatgtgttttcttttacataattctcacaaattttacacagatctgttgattcatgcgtgtttttttttagaactatgtaaaattttgggcctatttggacggttacctaccaatttttttgtagtgccaaaatacaggcaagttttggcactaccaaatttttggtaaggtaatattgtttttgatcatatttggtttgctaccaacctagagccaaaatgtgaaaattatagtgaagaatattctagatgatgccaaatctagattaggtattaccaatgaatgtgcttcaattcaaatcaaacacatgtactattcaaattaccaaaatattggtagggcatgtttttggtagcaattcaaatagggcatttgtgtgtaagaactctgtagctcttcccctcccgtccacgccctccgagagaattttgcatatgtacctcagttaaaaaccggcttcgctacaatgccatcgtttaaatgggattcgctcaaacgccatcctcaagatgtgggtgttcgctacaatgccattttcaccattggttgcaattccaaaccattttctactaaaataattttttcgcggaccgttttgcccctagatctagttgaactgaaccacacataggggacgctaccactgctgcctagacgcgccgctctcctctcagcgcgacgacgcgacctcctctaccgccatccatgccgtagccttccccacctcgcaccgtcttccctcagctcgccgctgccttccctcacctcgtcgacgccttccccacctcgccgccgcccaaaccgtagggtgcaccgggcgcctcttccctgtggtagcagtcgccgccgcccaaacagagtatgtccattgagacactttgtgcaatgcatcgggggaggtggcgtgctagcaggatggagacggtgttgacgaggaccaggatgaagacgacgccgacgaggaccaggatggagacggcgtggttggggtagctgcgccgccgcgcagggaatcggctctaggaggagaagcagctcagctggggagagaggagctggcgccgcgacctagcttttggaggggtgagttgttccaggggcaaaacggtccgcgaaaatattattttggtggaaaatggtttggaattgtaacaaatggtgaaaatgacattatagcgaatgctcacatctcgaggataacgttgaagcgaattccatttaagtgacggtatcgtagcgtagccggttttttaaccgtggtacatgtgcaaatttcttgccctccgacgaccaaaccaaaagcccgcccatttcccgaacgccaaaccctcctcccgaatcctcatgaatccgcacactctagggtagtgtaggaggtgtagtagggtagtgtaggaggtgtagtggagtactagttgtagcccatggggatcacggaggagcagcgccgccgcatcgaggccaaccgcctcgccgccctcgagaggcgcaagcgcttcgcggaggccgccgccgccgatgcctcggtggggtggaggctcgccaagtgcccaagattcgctccgcctcctcctcagccgacgctgcctcctcctcctccgcggacattgcctcctcctcctcctccgccgccgccgcagccgccggtggggttcaaagtggtgctggaggtgtgcggccccgaggatttctcggtggcggtggggcccgccgagggcttcgcctaccccggcgaggccgagtgcctccgcgccgtccaagattgcatctcttcggtacggttcatccgttcttcatccctttcttgataatatatatgctgctcgacaaactcggtgctttcttggatacctcggagcgtttctttctcaagatttcgttaatttttccccgtgtttcttggcgacagcttagcaagtccgtggatatttgcaagcatttcttgaaatatcactccgagaattcgg

SEQ ID NO: 33618 - DNA, 3247 bp, Oryza sativa
atatacacctaagttttatgggtaattaaggccttattggtgccatttgagtctttattatgaataacagaaatttatgcgtcttctttatttctattcgatcttttttcaataataatgaccatgccactaatttttctgagcaagatgaagagccttcaaactcaatggttataagcacaaaatggggatgcattatgatgtgagcgatattacaattcagagctatttttttctaggtgtaaagtaatgagtagatttcaagcataaaagaacaaatatttactgttctatttaacctattttgattggctttctgggatgttatgttcttgatctagaattaaaactgatccttcccctgtattgttggtaaggctgcaccattctctacaacacaaagtcaaagtggccatattttctccgtatttaagctcatggactatgagcccgtgttaaaatgcctgaagaagttgcctggagttgctgtgcaagatataccttacaaaacaaggaatgttatcaagaatctccctaagttctttgccgaaagctgcgcttctgataaagaagttgacgggcttctcatgaagttgccacaacacttacgagatgcactcctaccctttcaacttgaaggtgtgaagtttgggcttcgaaggcatgggcgctgccttattgcagatgagatggggcttggtaagactctccaggtgagcattttacatgagagcatgcaaccattgctattctgtatgactattgtgcacatgaataaagtattattgttgaaaacaaggttttggagcctacataatgctgaagtttgggcacactgttaaagcatgttactgtttacaacactaataaattagacttatatgaatattaaactgcctgaggcattgtaaggggtctttttttcttcttctttcgataatacaaagaagcacagctctcttgcgtttttgagaaacacagcttatatgaaatagcaacttccattttagtttcatttccaaacaattcttaataaaaaaatgttttttagagcatatgaataattgaatgaataggcttttgagcgtccttttttccctgtgaaagcagcacattctcattcatttaaatgcaggcaattgcaatagcttgttgctacaaggatgagggcccagtgttaatagtgtgtccagctgttttgcgttatacatgggcagaggaattggaacgatgggatccttcatttctgccaaaagatattcatcttggtaatcattcaacctctaatagtctttacagtttgttgatgtgaaatctggtattatgattattgtaaagctctggtgtataaaactcattttgcctttgatagttgtgaagtgctgattttatctttgcccgcattttcattactgtaatcatttagggtcttcaatgctttctctttactctagtttgattccagtaaatatagtttttaaatgaaaagtatagtatttttcacttttcaattaaaaagcatatacattctatttctccaaagactgtagattgtattatttttaataaatgttgcatattttatatttgatgtattgaaaattctgaatggtggacattgagaaagctacattcattgcgtcaatccagttgaaatgcttcaatatagagtaacattacagattagatgacctgcttctatttgttgattgattcactctactttttttttgtttagttgaattaacttgagattttactgaactcattgtttcctaggatcagctagaggttttgtaaatcttgtagtaaagttgcactagctaaaaatgaaatgctttcatgaacagtatgaaaggaattataatgcagtaaccaaagattgattgtattgacctgagttgaaaattgtgaacttcagccctaaacttaggtaacataagtattttactcaagtttaccagtgcgcttgaggtttaaatagtgcctttaacttttggctgagtcacatatgcaatataataatttgattcttctatactagtgaagaactgaagatactgtttaaaaaagtatggctaatatcatatttcttgtcacttgtccttcaattgtatattactactttatttagcctttcagttttgttatatacttatttttttaattaggagcacaattttaacagttcggttgtcactgtataattttcagtgtttggtcaccaagacagtcttgaacgtttaggagcttgcccaaaggcagtggtcatttcatatcagatgctaagccgtcttcgcaaaagcatgatgaataggagatgggcactgatgattatcgatgaatcacacaacatacgctgcacaaagaaaaaacacgaaaaaaatgaggtgtttaaattattagcttgtcatgcaacaatcttatgtatcaatacaattaacataaagtattcagctcttgaattctccaatccatgagaccatgatggtgatttggtgctttgtaaatttggtagatcatattttattgtgctagaaacgcctcacttttttttaaaataaaattctcccagttgattttattgatctggttatatttttcagcatttctccctgctttctaaaatattgcaatgcacaaatgttgaaattatctcaaactatttattccaactacttcagtcaccttgtgtatcaatattgcatttgatttcactaatggtaagtgaccgttggtactattttatgacctcatgacagacacaggctgtactggaactagcgccaaatgtcagtcgcattgtgctgctctctgggacaccctctttgtcaaggttgtaactttaaagatattggttgaatttctcttaaagctccttatgctattgtgctattttactccttgatatctggatctccaatcatgcagatagctgctatgatatatgacatattttgtgtacatcatctaaacggttttaaaattccagaggtgggtgtggatagcaatatccaagctacctgcgccttgtaattgagaaaagggaatgatgaaaactttatcatggcccaattttctgaaattttacagaaagtttttttttttgtctattactctttcaaccattttttgttcatctagtgtatttgtacttacccatattattttcaaatgcattctctgcactatgttcattggttactggtcattacggggatcctctagagtcggcctgcaggcatgc

SEQ ID NO: 33619 - DNA, 896 bp, Oryza sativa
  unsure (1)..(896): unsure at all n locations
nnnnnnnnnnnnnnnnnnnnnnnnnnnnnnnnnnnnattagtgatgtctggctcgatctctggctcggtgtcggtcccctctgtctcggagtcgacttggatcggagtctccaaactggaacccagctgcggagaaggtgtagggatcagtggagtgtgcacaatctccggggcaggtggctgtgtcactgtcgggtccaccaagtaaggtgctgactcagtagccagcataccaacctctcccaaaagagcgtgcaacgctggtgggtatggcagggtgaggaaaaagtagcggtcacgtcctactgttgtggaagtagaagctcctatggtgctgaccgtggctgctcgaagctgctcctccagctagctgacgtgctcctgactctctctcagctgctcctcaagtgtatccatcatcccgcggctgtcgttgtactggtcagataactgctggaactggtcgccgtggacctggagctgtgcctttagtgagtctatctcactgccccaagcctggtgctcctcttccagctgaagctgctgcactgtgaggtcagtcacctcggtctctaactctcccatatgcctctgctggtcgtcgatctctaacagagcctcctcgtaaaagtcgtctactgcctcagcccatcgtgacagtagggtcactatcgggttgtagcagcaaggtgtgtcctgaactgtgcagacggagttgctctcctctcgaaacaggtggtgagcaaactcagtactcaccaactcagctcggtggatagagctaagtccgaggaaggcctaccgggctgcatgctgcatcgcggtctccggtaagacctgacagtggcccatccggaaggcggagtctgactctgaaggaactcgcgtgtgaacct

SEQ ID NO: 33620 - DNA, 620 bp, Oryza sativa
gtacccatttttcgatgcggggcttcgatttccgtgcaacgtcttgctgcccgagatacttcttctcttcatgatcgaattgccccaacataggcccttctgctctggttcgggaaggggaaaggagacacttgggaaaggacttagagtcatggaggatcatcgaggacatccaagtcaaggtggaggcccaaaccaagtcggcttcgagtgcaattcagagtctaggatcagtctgcactaaaatgggcacgcaggtcgcatacgtgaccagattggggcgttctctatatggatggaaagctaagaagatatcctttccaatggttttggacacacgtccaaattctttccgagtcaacgggaatcgactgaataagttgacatccaaaatatatcccggtgctgcatcatcctatttgggctttcgggccgtgtatcgtgttggaacctattagggttgcgttaagggttggttgcatgaccctaaactcttgatatcagtacctgtcgtcatctttagggtttgggttttgcttagattattctgtcgagaacagtttcaccgctagatcggtttgtaagacccaacttgtgagcttattcattcatctgcattt

SEQ ID NO: 33621 - DNA, 614 bp, Oryza sativa
aggccctcgcaccctcagcactgcccgcaagagcacccgacccccgagcaagaagcccaagccagatccagaggccactacttccgagccgtggggactcaggtttgcccgtgccagcgaccaccctctacctgccccaggatcctgcggatggttggatgactagactggaggattattgcagcttcgatctcgcttcagatggtttttggatagtatgcgagacacacccccccttacctagattgacgagtagcttgatggttagttcgatgcatcttttggatgaaccttatttggactgcgtatgtgtgcagtcgattgcatcatgatttatgtactatttgtggaactctatgatgttatttatgatattattgttggtgtgttataaatgagtttattccaccatgcttgcaaaacaaagttcacatcgaaacaactcccttaatgggataaaaccataagagctagttagaaaattaggatacttacttaatcggcctacacagatggcaagccgacgtcgggcgtcaaccagcaatgaagaaactttgacacctgacctaaccaccctggccagaagtatggccactgaaacccaacttctacaa

SEQ ID NO: 33622 - DNA, 549 bp, Oryza sativa
cgactctagaggatccccggtttcctatttgtgcagggagttccgtaatatgtgttcttctcagattaaggtattccaattgaaacagcctgcacaagtctttgagatctctatttctcaggaattcgtagccttctaagtccaatattctcattaatttcatccaaccaaactgcaatgtttctccatcggcaaatatgctcaaggaccggacatggcataatatttctcttgtggcaatatatttcacacctctgctatgaacagttagccgccttatcttctcttgcggaaacaaagtgttctgttctcctactagagtgataaaattatcttcaattgactttgacacaatgatctccaacatcacatcatgaactcggaatgttttaaccttccctgtaaagctagtggtcactggctgaataatgctccggttaatgaattcatcaaagtagctttctgccacctcaaaaacactcagtccacgtttgccagtcacaaagcgttctgctacccatcgctgaggggtaccgagctcgaattcgc

SEQ ID NO: 33623 - DNA, 454 bp, Oryza sativa
  unsure (1)..(454): unsure at all n locations
nnnnnnnnnnnnnnnnnnnnnnnnnnnnnnnagacacatgccatgccattattctatggcgcaggcggtacatcatcctccctgggcgacaagcggcgtctcgtgcaccatctcctccggctccaccatctcctcctcaggatcctgcaccgtctcctcctcatgctccgccagcaccgtctccaccttaggctccagcatcgactcctcaggatcctgcaccgactcctcctcgtgctcctacacctactcccccgcaagctcctcttccggcaccttcaaagtcaagggcccccccagctccaccgcttgcccacacaagggcaacaaagaaggcgaaagttgacgccgccaagatcaaggacccggggtacgattgcacgcaagaggagcttgacgcttacgttgcatcagaagtcaagagacaattcaaggggatcctctagagtcgacc

SEQ ID NO: 33624 - DNA, 11367 bp, Oryza sativa
  unsure (1)..(11367): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatttgtcctcacttgcattgagttatcttcatatgcatttgattggagttgttcctgaatcaaaggtgtgcagaaaatttaagatatgtgagcacacatatatatattataggaagataatgagaaacttgctttgttcaggtgaggatctacagtgtaatgaccggtgtcaggcgacaccgatgatttttagcaaaaactatagcgaaattgcttatccatataatataacaccataatctaaatataattagcatattatgacactaatagacacgttatgacaccaacgaattgattttttggatccgccactggctttgttgatcttaaggtggattgtgaaggtccatctgtttgtgtattttctaatgccgtaacatcttttcctatgagattaaaatagagaacaaaagtataagttaacaacaaaatagaagagaaggcataatttagtttagagaacctacttttctttcttgttttcttatttgaagtatttcttcctctatcaagtacactttttgatcttttagaatttagaccttttttgtgtggaggaactctaaaagagacacgtgtcttcacaacatcttcagtgcactgaattgtacatttaggaagatcatcatctaaactgactttgcttagcaagttatctattgtcaggcccaaaaattcactagtaatttccgaactaatttgtgcattaaatcctcatccaggaatcagccgaggtacataaaccgacaatttaatatacagattcatcaaataactaaatcgacaaatacttacataaaaggcactttagtccttaccacgaagaaaactgcagcggaaaaaaaatctagcgaagcttcatctccacttccacaggcagctcaactgggatctaagccaaaggtcttctccttctggatcctttttcttcaattgagatttgatgatgattgcaaggtgagtacatggaatactccgcaagccacacagcaagtatgcaagtgcacaaggatactaaaggatggcataatatagtgttcatttgcgaaaacaacatttagcaaagatctaagagtagtaacacagcagagtaattaatcatcaatattaatcaacactgaacagcgcacccatgctgcttaggcccaaccaaacctgaacaaccaaccccggtcgtacagatcaatcctccaaactaggaatttaccattccaaaccaagagtcaaattaattatcacattattaacattaatgagtagtgtgggactaatcacgaaaacattgttagaccttgccataatcgcgggcacggctattcgaatagttttactctggccagagatataccactgtacccacaagacacgattccacacatgttgccatgccccgaagtacccccacggcactaaaagggggaaatcgtgacaatacccttcgcataacacaactcaccacagtgcaccgttcctagatcataatcacctcctctacaaccagaggcatggactcccagcgacccccacggacttctcgccgcttcttagtctggcaccccgtaatgaaccatgctatacaaaaggtaaagccgttgcccatgctggcttgtggttggcacggttaatgtttcacaacagtagctcgcaaaccagtccttaattgtcatgagcacgaccttcaaaaccatgtgctaacaacccaccattgtcaagttttaattatcaattaattatcataacacaattaaccatcgtgagctaccattaaatataaccataaataataatgtagtatgattcatcccattaatgagctaatgtttctaagcatggctaagcaattatatatatatagcatttacctgaatcaatccaatatataaggtctaaactaatcaatttattacccataggaaaataaagtcatcttcggccataattaattgggaaaggctcaccacccgatgacattcgaaaataatgcataagttgaaataaaacaatagctttaaacagattcaacatgctcaaagggttgtttggaatttgtatgacttgccttgcaaacaagcgtcttcaattcgtcttcaggaacttcttcaacgaactaacaatccttcgaaatgatcgaaaactaaacctagaacgcaaaaaaggaaaaacacaaataaaaaccaaataaacagtaggtagagtttgaatttagatgaattatgagacttgaacgaatgagttcgtatgaattagctatgaattttacaagatttaatataatttagcaaaaggaattacgatttatttggaacagaaaaatagacgctgacgtcagcgatgacatcatcgccggcaacgcaccggaccgcaaggtcgcaagcgctaggaggctcggccgggctatccgagtgcaccaacgcgaataggacgacgagacgaactcaccgaggggcggcacgaccacagacgatgacgggagatggccggcgacgagattgagacggcgaactccggggaaaaaggatgggtggacgggcttcctgaggaccttgcgatgccgacgcaggcttctgcgatgaccagcggagacggcaacggcgacgcagcttggctgaggatcgaatagatcggcctcacggggacgacggtgtactgatcgacagcaacgtcgaagctccggtggtttgcagcggcagcgcatgggtgaacaggcttcggcttggcgctgcgataccaacggaggagacggcggggttcggcgaccacggagtcgacggcgatgtgcggctggagaagcggcaaaggccgaaaccctcgggttcgcgtcggcaagcggcttccggcgggatttggcgaaaaggaaccggtggacggggtagagctcttcactgcgaagccgaggaaggcgacggcgcagttctgggatgaccgaggaggcggcgcgacgtggctggagcggcggccggcaaaggagagagaagccgagcgtggcggcggctctagggctagggaaaaattcaaaaaaaaaggaggaaacggatgaggaggccgaggggctgccaaaggagggggggatcggctcggatacgaggggaatcggcggcgaaagagctagggttcgtcggcaaaatagaagataaactacacttcgaatccacgcgatataccacgggagtcttgttcctctagatccggtttctccccttcttcagtggttgttcttccggtggtcactggcggtgcggcgcccgctcccctcttcttaggtgctcctcccttcttaggctagggtgcttccagtcgatgccggggaggtccttgtttcggtagggatggcgtgcgggattggattctggcgtcctgtctggtcatcggccacgccgtaggtttgctgcagctgggttcctgtgggtgaggtggtctttggtcgagctgtagtgtgattgaatgttgaggcggagtcggagctgtttgtcttgcaagctcggcaacgatgacccccaacagatgtcccggcaatgtgacgagggtttggaggtggagcattttgagagagcctcgggtgaaaaccttgcctagtgtatcctaggttgatgatatcgacgcctatgggcgccgtttcctccttggaggtatcgtcatgttggctctctctcccttcaggtgaaaaccgggttcctttcggaacgggtgttgatagcatccttgatgttgttcccttattgaaggcttcgcttagaaggtttctgctccactagaggatgtttggtggttctggaggcctcgtttgcattatgttatcgaagctgcttgcctttggtaagctcggcaacgacgacttttgtgaggtctcaatagttgtcttctttttccttttttgtataggttttgccggtttcccgattaattaaccgtgcttgttcggtttttgggtccagtttcccttattaactgggccaattctcttcctctatatactccggcaagagaaactcctgccgtcggttcctcaaaaaaaaatataatatgcatatgcatgatttaaaactgttaaaaactgtaattatcatatataactagcatatgcatgatttaaatttgttaaaaattctaataatcatacataattaacatatgccatacaacaattaatttatatggatattcaatatatccaaaatagtttacatcgtgtacacaacaattacggcaatacatcgacggtgacggttgaccacacgtactttctcctcactattgttccttccttgtgatcgctacgtgagtaaagggtgtcttcatttgataggaggatgctagcgtcaatcctcaccgtgaaagagggttgcccatcaaactgatcataatcctcgtcaatcttgtcctctactccgacaattttccttttgcctgggagaaccacgtggcgcttcggctcgtcaggcccttttcccttctttcctttgctagacatgtccttcacgtaaaatacttgcgttacattattggcgagaataaaaggttcgtccgagtatccaaccttgttaaggtcaaccgttgacatcccactgtcatcaatcgttacgcctccaccggtcaacctaacccattggcaccagaacagagggaccttgagaggtccatagtcaagttcccatatgtcctcgatggcaccgtaatacgtgccagttgtaccatcgtgtcccatggcatcgatatgaatagcactgttctggttcgtggatttcatgtcttgggctctcgtgtagaatgtgtacccattgatctcatatccctggaatgtcgcaattgagccggatggtctcctcgccaggaaggccagttgttggttaatcgtttcgttaaccatgagatgttgtcgcagccacggggaaagtatcaatgtgatgccgtgtaatccatgcatcggacttaccgatgtttctggcgcgaactagagccaagtgctcctcgatgtaaggagccaccaatgaagattgctgcagaaccgtgaaatgggctttacggaataaattgttgtctaccgtcattattgctttccttccgagagtcccctttccctgtagtctccctttatggcgtgattcaggcaccccgattgggcgaaggtcttcaataaattctacgcagaattcaatgacctcctctgctccataccccttggcgatgcttgcctctagacgagcacggttacgaacataattcttcagaacgctcatgtacctcttgaaaggaaacatgttgtgtaggtacacaggcccgagaataccaatctctttgacaaggtgacaaagcagatgcgtcattatattgaaaaatgaaggtggaaatatcagctcaaagctgataagacattgcaccacgtcattttgaagggcttctaatctatccggatcgatgacctttcacgaaattgcgtacatgaaagcacatagctttgttattgttgcccggacattgtctggaaagataccccgaattataactggtagcagttgtgtcatcaacacgtgacagtcatgagactttatgtttgtgaacttcttctccttcgtgcttattattcactttatattcatagagtatccagacagtaccttgatgctctacaagcatttaaacatactttccttctctgccttgctaagagtgtagctggctggactcaagtaatggcttcctttctcctttggttccgggtgaaggtcgccgcgttgttctatatgcttcagatctttacgtgcttccagtgtatctttcgactttccatatacagctaggaagccaagcaggtttacgcaaaggttcttagtgaggtgcatcacgtcgattgcatggcggacgtctaagaattcccaatagggtaactcccaaaatatagagttctttttccacatcgccgcgtgactatcttcgctctctataggctggctgccaggcccctttccaaacactactttaagatctttcaccatagcaaattgttttcctgctgcaatgtttaggcttcgtacggtggtccgccttatgttcaaagtgcttgcctttcttccgtactgggtggtttgcagcaaggaatcgacgatgacctatgtacacaaccttcctacagtgcttaagatacgtactttctgtttcatccatacagtgagtgcaagccttgtaccccttgttagactgtccggataggttgctaagtgtaggccaatcgttgatggttacgaacagcagggctcgtaggttaaactcctcatgtttgtcctcgtcccacacggggacaccttccttcttccacaacagtttaagatctttgaacagtggtcttaggtacacattgatgtcgttaccaggttgcttggcgccttgaataataatcggcatcattatgtacttcctcttcatgcatagccaaggggggaggttgtagatacacatcgtaacgggccaagtgctatggccgctggccgttgctcatctctccaaaaggattcatgccattcgtacttaaaccaaaccgtatgtttcgtgcgtcctttccaaagtctttaaatgttctgtcgatgtttcgcccctgcgaaccatcggcggggtgtctcagcatcccgtcctgttgacgttattcagcgtgccaacgcatcattctagcattccccttgtttctgaacaaacgccgtagccgtggtattatagggaaataccacatcaccttagcaagaattttcttcttcattggctgcccgtcaacttcacctggatcatctcgtctaatcttgtatcgtagtgctttacaaacagggcatgcttctagcttctcgtactcctcaccgcgatataggatacaatcattcagacatgcgtgaatcttctgaacttccagtcctagagggcagactatcttcttagcctcgtacgttgtctcgggaaatttgtttccctccgaaagaatgttcttgacgagtttcaataaatcgccaaataccttgttactaacactattttttgccttccattgcaagaactctagagtggtatccaactttttgtgcccctgctcgcaacctgggtacaacgaagttctgtggtcctctaacatatgctccaatttatgggcatccttttcactttcacagtcctccttggcgtcctacaacatctgaccaagatcatccgcaacgctgttatcgtcatcatccctgtccacctcgcccgtttgatttcattcaaatccagcgtactgagcctagtccggaatgttctcatcctccacttcatcttcttccatttcaaccccttgctcaccgtgggatgtccaacaattatagcttggcatgaaccccgactcaaagaagtggaaatgaatagtcctagatgcagaatactccttctggttcttacttattgcatggacaacacataaaacccttatgcttgttagcttcggccactctcaaaaaataatgcacgccatcgataaactctttggaccgccggtcagcgtacatccattgccgatccatcttacatgaaatgaaaaaaaatcgtacataaataaattttcgtacaataatgacagtcatacaataatgataaaataattaaaaactctttaaacagtcatacaataatgacatatcattactcatacaattaataattataaaataatccaacaaacaattcttttatattatttttgaagttctaaactaatattaatgttgtattatattatttttgaagttctaaggggatattaatgttgtacttcttttaattttcaatttattttattttctatttttaagattaattttcattatattttaaactatgagaataaaactttttaagtaaacaaacaaaatttctatatattcatcttccccacaaaaattttctctctcatcaacttacaacaacgttttagagacaaaaaaaaaatgtgtgaaacatagctccaaaagtattataacaacaaaaaacattgaagaatgaagttactaaccttttagacacctccgatttgtatattatcactaaaaaaatttcgcaagaaattttggcatgacctcccctcttttttggagaaattttgaagcttgctcgggctggaggaggaagaagacatatataaagggggagatcttttgtcccggttggtagcaccaaccaggactaaagttaggatctttagtcccgattggtaacaccaaccgggactaaagatcccggggggcctgacaactttagaatcgggactaaagatcacatatgcccattgtagccccaaccgggacaaaagatcatctttagtcccggttttttgtggaaccggaactattgtggatttcgggcgaccaaccaaagatggtttctccaccagtgcaattgtaaggattctcatgtacagtaaggtgcaggtctcctttgttattcttgcctcttcacctgatctcatatatcatatatattgcagaaaatatgcatttctctatacgatttgtggacagtagatagcacttagaaggatcacagttatattgtatttcatcactggtgtgtattttgtaagtaaaatttccttgctattattatttagaaagctgaagtgtagtaaaattagaacatgtataacttcaattagttctaggagccaaattaaagttgttgttaattaactggtaaaattatttataaaggtttgcaaccatagtgtcctgattgcctgccttttgattgattgtgtacttactatttagcagctcagagaacaaatttcttttagcaaataagtggctcagagaatggaagttatgcttagaactctctatattggatagtgcaatgtgattcactggtgcaccttgcttttggggtttgacagtttgctattttgcacctgtgaactgtgaaaacttgtgcaagtgatagttcatgtgtttctagctgccacctgataaggagttcatgacttgattgcctcatttacctgacataagacgtgaaactttcttcttctttttttctacggggagacgtgaaacttactttcagcttctgaataaatccaacaaccatcttcttttcccttttcttcatctaggttttcaacaaaatgaattaaatattgttcagttattggagcaatactacagcttaaccatgttattagaaactctgtaacatgtatggttcaatggatatatagtgttttctgaccaataacagtcgcaggtcacaaccaaattaaggttgtctagcctccatccttggtaaaatagatcatcttccgtagtatcttatctctcacatatacaaaactttaacacatttctaaagtttcaatcgatctatttttcgggctggtgaatgtggatatgggtttttcgtttaaaaaatgtggatgtgggcgaggtggcggtgctggtgcacagaacaaaacactttttttttcttttcattctcatgcttgttttcaatgggaatgggtgtaaaacttgatttcttaattctttagaaagagttttcttgatttgttcatgaaagtctcagttggggctggacgctcatgaggtgacagcttccattatgcctcatgaaattttcccttgttccgggaatctgatatgttcatagcaacaacctctggcttgtgttatgcgtttctgttttcagttctacaagcaagcaaaatatgcatgtatggagtaggctggcagctcttaccaggtgcattgacacttgaacaagtttatttgatcaatgatgtggtctttgttgggatacacgtaggctacgatagcataaatcaaaatttttctatcgcgtaaaccagaaaccatgcaagctttagatcatagatcgttaccactcgacacgttgcgcagcggaagaaagcgctaaggggtcgaaggaaccctcgcgatgtagcgcgcgtcgatgtaaaggaagtagtcgatcgcaccggctcgatcttctcctcctcgttcgtcctccttgccgtactcccacgccgatcagcaccgcaaaccaacggcgcggcgcctctaccggtatccacacgtatagggatggaacgccacgcgcagatgtgctagcacccgcacgctactagggttttgctcggggaggaaaatggcggctagggtttctcacgtgatgcaatacctccgccggtcacacccctcacgaatatataggatccatcactcgggcctccaaggcccgtaggactcctattcggatccctatccgaattaagctcatattggatctatatccaatccccttattctggcccattaagcgtgcgaccctataggttcatgtacactcggctgtaacccgaaaactccttttcggtccacatgtcaacagcggcccctagcagaatgtattgacccaccggtcatacataaagatcatatcggctgaacctctagtgtatacttgtatgaacccttttgccacgatatcaattaagctcaaggctagatatgtgccatcctctaatagctcaatcattcactcgaacctgtgatagattatataacttgtgattgactcctcaatcacctttggcatggccatgcacttttataatctataacatcgagaggcccaaagatatctctccataggaggggcaaatcccatcttgattattcatatcccactacatgtttcatagcatacccaaaaactacttttataactatccaattacggagtagcgtttagcagtctctaagtaagctactacacatgttgggaaccatgataatctcaggtctaaggattcaacaccaacactaaatgagatcactgatgacacaacacatatggctcttgcagtgtctcatgttgggtctatctgtaacaccctgaaaattcgaccgacaaaaatcaaaactctaaaaatacggaccttcaaaaactttttaaataaattgcatcatgccgattttattcgcctatttcattggattttgatctcggaatttattaatcgtgaataatgaataactaactaggaataaaccctaaaaatcaaattggctaaataaataattaaaatataaattaaaataaag

SEQ ID NO: 33625 - DNA, 5800 bp, Oryza sativa
  unsure (1)..(5800): unsure at all n locations
nnnnnnnnnnnnnnnnnnnnnnnnnnnnnnnnnnnnagccccgcgcgccaccccgagccccgcaccgccatcacgtcgccgcccgtcacgtcaccgccatcgtgtcgccgccccgagcccccgcgccgctgtcgcatcaggccggccacccgtccccctctctttcttccccctctcccctataaatactccacaccccctctccatttcccccactccatctccctcgttctcccctcttccctctccaccgagccaccgccttcgtgccgccgcgccgccgccttcgtgccaccgcgccatgtgccgtcgtcgcgccgccgcaccgccgccttcgtggcgccgcgccatgcgccgtcgtcaccgccgccgccgtcgtcggtaagcctccgcctcctccccatgctcggtcgccgtcgctagagagccgacagagagaggagggagaagaagccgggagggagagaaagagagaaaagaagaaagaaagaaaaaggagagaaagagagaaaagaaagaagggaaaagaaaagaaagaaaagaggagagacaaagaaaagaaaaaaaaatagaaattagagggagattagggaagttagaaaatttaaaataattagaatttaattatagatcaaatatagtcgtagaattgcaaaaatttaatataattatagattattttggtaatctctataggtgatcaattcacggtaggtactcggatttaattaataggaattttagacgtatattatatttaatcgtttagtcatagactaaattaaatcgtataatattataagataatttttggattccgtccgatatttagctcgcgatagaaatttctaacctattatatggatataatactcgggtagattaaattaaaaacttaattggtatggatataaagatttgggtggtgtccggaaaaggctagtgccgtccttggtcagttaaggaccgagccatgaagttaagcatgaaacgacccccgtacaaccgcacttctcgtatgggtatagacctagcggagtagatagctgagcggaggtagtatctatgcatagtggtttcttgatgtgtgaggcaggggctctacggtggggcaaccattggtagaaccgcgaggcgggtgtctacagtggtgtcgccatcggtaggactgccatgtgagaatctaaacataattataacttaatgcatgtgtgagtcttcccttcccgggtgcgccagaactcctctcactgctagaaaccgtgtacgcctagagtgcatgaggatgtaaagttcatggagcgggtactgccaatgcgaggttatcgaaaagctttgccgtgacgcatctcatgtgttaggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtgtgggatgggatattgcatgatgatttctatactgatggagccacttcctgagaggcgggaatgtggacgtcctcagaaaaccatgatgactcaatggcaggaagctatccttgggatcacaatggatggtggacagaaccgtcattgtttaatatgaacaatggtactaaaatttgatcagtctgtgctaggtcttaggtttgtgaaaagaattataaaacttgttttgcgcaaaagaaccatagccatcctttgaatacccctgtcatgtgcattgttgctgtggtggcttgttgagtacggttggtactcacccttgcaatatacaaacttaatcagaggtcggagatgaagctttggaggatccctacgcttactaccaggagggtgatgaagacgatggcgctcgctaggtcttagttacggttgttgcctgtggcaatggcgtgccgctgccttaactccgctgctttatctacttctgtttttggaatgtattccagaccgctcggtccgatgatttaagactatgcctgcgggcttttgatgtaataattcgcactagactttcgtgtgtgtatttggtattttgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaataacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgaacaacacacccatgctgcacaggcccaaccatcctgaacaaccatacccagctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctgatcagaggtgtaccactgtacccacaagacacagccccacatcatgtcaccatgtgcctcaataccaccacggtacctcggaaaggagcttgcataacacaatccactgcagcgcaccattcctggatcataatcaccccctcaaaaaccagaggcatggactccccagcgacccccgtgggcttatctccgacacttctcagtcgggtgccccgcaatgaaccatgctatacaaaaggtaaagccgttgcccacgctggcttgtggttggcacggtaaatgtttcacaaccgaaactcgtgaaccggtccttaattgtcatgagcacgaccatcaaaaccatgtgctcacaacccaccattatcaggttttagttgacaagtaattaattaaccaatcacgatcaaccgtcgtgaacttccattaaatatccataagtgatagtgaagcatgatttatcacattagtgagctattgtttctaagcatggctaagcaactataaataacatctagctgaaccaatccaatatataaggtccatactagtcaaattataacccatagaaaaataaagtcatcttcggccataattaaaggggaaaggctcaccacccaatgacattcgaaaacaatgcatcagttgaaataaatcaatagctttaaacaggttcaacatgctcaaagggttgtttgggatctgtgtgacttgccttgctggccttggaactcttcaaattcttctcctgcgaaaacggactctccggaaacatcggaatctaaacagaaaagagcaaaaacaccaaaacagcacataaacaagcatgaacagtatatgtggatatttttagcatgtagatctcaattttagaaaaatttagagacttgaaccaactaaatccgagctaagatgatttagttatgaatttctgaagatttaatctattagaaaaacaggaaaaagaaaaacgatgatgacgtcatgatgacctcatcaatggccggaccaagatggcgacctcgccggagattggatggtcggctgcgactttggaggacatgtacacgtagaggacgacgagacgaacccaacggtactcaccctcgaaccaaacgacgaacgacgacggccggcgacggggtctagcggcggcgcggcttcggtcgacggcggcgacggggctccggtgatcagcggcttcgggggtcaggcggccgggcttctccaccctcccgcgcaccttacggcggtgacagcgaccggcggcgacgacggaggcgacggcgcgacgcggatggagctcggccggcgacgacggcggggtggagcacgtggcggcggcgctacgaggcacggaagatcacgggagagggggcaaacgaaagaggaggactagggggtcctttttatagccttggattgaagagatcggactcctcccgcaagaaatcgatccgggaaatcaaaaactcggttttggagataaactcgaaaacgagttcgattcggatgagatactcaacgattagctccgattttttgggggtaaagatagaggaggataagaggaatatttcccctcaactaattttagaaaaacacaaggggaaaggtcagatttggaggagaaaaaccgagccaaatcggtctcagttcggctgctagaggtagaagataaacagtgtcgagggacgcaaattagacttttcgtcttgggctggctgaaaacaaagcaaagaaagaaagagaagggggaaactcggctgggccgactagggctgcacggccgtgcacacaaaagagggagatcggccggaaagggcccaagactaggaagaggattattattacttttccaattaaaataatcacttaaatgatctttgaattgttaaaaatacttccaatgctcaaataatttcaagaaaaatcctgaaaatacttggacactcaaagtacttaaaaaaattataattagagcatttaatgattaatttaatatgtgggtaattactgaaatgctctttgtatgattaaaattaggaattgagctccgaaaaatctgagaaaattccagagagtataattaaccatggataatttaataaaaattaaatccatccatgctttatatttaggaaattttatttcccacatttaacttcacttgtaaattaatgaacatttaatataaattctaataataatttattaaataatttataaatcctgaaacaaaaatcaggatgtgacatatttcagctatgaactcgtgtgtaccagactacttgatccagggaaatggtactgtttacacgattgattcctgttataaaaacgggggtccacagagctggtatcagagccatacgactgtaggaaaagaccaaaaggcgccccaccccttttctaagttggcgaagggagaaattcccatttagtaatactttcaaaaataaaaacgctatgcttacaaaactttgtatgattttcatcttactcttaactattttcttcacaaaacgagttttactcttagttgaccttgggttttttaaaattagatggcagatcaggattcacccgctacctgggagatgggcgtacctcgcttagagggatacgtcattgagctacaccggctgatgaggcatctgcgataccccagatttccgatctaccgagtgagacagtgtggatctgtttgggaggctcgggtcgaggttcacacacgagttccttcagagtcagactaccgcttcccgacccgccaccgtcgcgacttaccggagactgcgatgcaggatgcagcccgggaggcattcctccgacttagctctatccaccgagctgagttggcgagtactgagtttgctcaccacctgtttcgagaggagagcaactccgtctgcacagttcaggacacaccttgctgctacaacccgatagtgacccgactgtcacgatgggctgaggcagtagacgacttttacgaggaggctctgttgagnnnnnnnnnnnnnnnnnnnnnnnnnnnnnnnnnnnnnnnnn

SEQ ID NO: 33626 - DNA, 2805 bp, Oryza sativa
tggagactccgatccaagtcgactccgagacagaggggaccgacaccgagccagagatcgagccagacatcactaatccttcagaggatgagacccctgttccccgcatcaccttcctcgaaggccctcgcaccctcagcactgcccgcaagagcacccgacccccgagcaagaagcccaagccagatccagaggccactacttccgagccgtggggactcaggtttgcccgtgccagcgaccaccctctacctgccccaggatcctgcggatggttggatgactagactggaggattattgcagcttcgatctcgcttcagatggtttttggatagtatgcgagacacacccccccttacctagattgacgagtagcttgatggttagttcgatgcatcttttggatgaaccttatttggactgcgtatgtgtgcagtcgattgcatcatgatttatgtactatttgtggaactctatgatgttatttatgatattattgttgttgtgttataaatgagtttattccaccatgcttgcaaaacaaagttcacatcgaaacaactcccttaatgggataaaaccataagagctagttagaaaattaggatacttacttaatcggcctacacagatggcaagccgacgtcgggcgtcaaccagcaatgaagaagcttcgacacctgacctaaccaccctggccagagttatggccactgaaacccaacttctacaagccattgcgaataaccaaggcaaccgcggcggatcgagctttggagagtttatgaggaccaagccacccacgttcgctacggtagacgagcctatggaggcagaagattggctacgtatcatagagaataaactgacccttgtccgggtacgcgaagccgacaaagtgatcttcgcagtaaattaactggagggacccgctggtgattggtgggatacttacaaggaagctcgggaagaggatgatggagaacccacttgggaagagttcactgcagcatttcgcgagaacttcgtgcctactgcggtaatgcgtatgaagaggaacgagtttagaaggctgcgacaagggaacacaacggtgcaggaatatctgaaccgattcactcagttggcccgctatgcaattggagacctcgcagatgaagaagaaaagatcgacaagttcatagaagggctgaatgatgagttgcgtggacctatgattgggcaagatcaagagagtttccagagcctaatcaacaaggtcgttaggctggagaacgatcaaaggactgtagagcacaaccgcaaaaggaggctttctatgaatcgcctacctcagggagtgcctcagcgactcaaggaagccacttcgtctgggtggaaaacccctattgtggcaaccaaccgccccgctgcacctagcaaattcaacaggtcggttgcgattcagaaccgcacccctacaccaaccctggctgcccctggagccaagaagaatgtggactgcttgaactgcggggagtatgggcactacgccaacaactgccctcatccacacaaaactcctgtccgtactggcgctaatgcaatgattgttcgtggaactactacccctactaccggacgaggtctattcaagactccgcaaactaacaggaccgctaccggatttggacgcggacaagtgaaccatgttcgagctgaagaggcccaggaagatcagggcgtactaatgggtatgttctctgtcaattctaccccggttaaagtcctcttcgattctggtgcatcgcattcattcatatctctgaaggctagtcaaaagcacaacttaaccctagtgggacttagaaagcctatgatagtacactcacctgggggcgagataactgtgagtcatgcttgcatagatgtacctattcgtcttagggttgtggtgtttccctccaaccttatggttttgataccccagaccctggatgttgtcacgcccagaaattcccgaatagaattccaagcagaatgtgcattaaaatccccgtccaggaccagccggggtacacaaacgacaatgttgacattcagatccacgtcttacaaacatcataaagtcttacataaatgcagcggaagaaaagaaagacaacaggagctaagccttgactaaactgcagcgggaacaccactccacaggcatcctcgacggcacggacgaagcctactcctcagagaaaccttcatctgacccgaactcgaactctggggttgggaaaagtagagcaagactgagtactacccactatactcagcaagtcataccggaataggggtatgatgcagggaattaacaaagaagagctgaagtggttcatttgcataaagcgagcatttataaacagaaattgaaagatttaaacagttgtaataattaattcatattaatcatccgttgtccaacgctaacccacgttgcgacaggcccaaccatccacctaaactatccaaattcaaaagattacactagggtgagactaatcacggtgaatctggttgaccgcccataaccgcgggcacggctattcgaatagttttactctgatcagaggtgtacaactgtacccacaagacacagccccacgacatgtttccgtgcgccgacatgtcaccacgacatacccgaaagaggccgtgacaggacccttcgcataaccccctctaaccaagcacaccacacctcaggtttcacccccactcctcgcaaggcagcgggcagtcccctctcgtgcctaggtgaatccggaagccg

SEQ ID NO: 33627 - DNA, 2741 bp, Oryza sativa
  unsure (1)..(2741): unsure at all n locations
cgcccacccttgcctagatgcgtcggctagaggaaagctacgctacaagcccagccgttgcccacgctggcttgtggtaagtacgttaagttcttccagggcatcccgcgaaccggtccttaactgccatgggtgcgaccagcaaaaccatgcacccacagcccaccatatgattcattttaattaaccaacaccagagcggtggtactaatccaacattaccattagaaccaacagtctaaacattaatatgattttccccattgtgaactagttgaactaagcatagctaagcaattcctagtccaaactctaatcatgtcataaccccaagctaacaaaggagcatggtatccaaaaagcatggctgtgacaataggtaaccaacccataggatcccctataaaacaatgcaatatttgaaagaaaacaatagagcatttgcaatataggatcaacatgttcaagtgacaagcatgacttgccttgctctgctgctggaggaacctcggcgactatctcaaagtacaccggagcgtcggaggaatcggaatctagcgacatacaaagcaaacattgcaaacaggctataagactactgaaacagggaacaaaaccatttttaatggattctacacatttttcttgatttactgagacttgaatgggcttaaacggagctcggatgaattagttatgaattttagaagattcactgtgtttattactataaaagaaaaaccctaaatcatttattgcgcaatatattccagggctgacgtcagcacaagggaagcggcgccgacatgcggggcccaccggtcagcggctcgggagagggaggaagggcgccggcacgcgggcccactggtcagcggctcgggagagggaggaagggcgccggcacgcgggcccactggtcagcggcggggagaaagaaaaggggcggcggcacccagctcggcttggctcaaggccggccgaccggccgcggcgacggcgacggcgcgcgcgcgaacgcgttgccggcgacggcaaccggcggcgagggcgacggcgcaaaaggcgacgcgaaggcggctacgctaagcggcggctaggaaggggaggggacgggcggcgttaaaggcgaccgccggctcggctcggcatcaaagccgacctgccggccaggtctagcggcgacggcatgcggccaacgacggcggcgaccggcggcacgggaggcggcggcggcggccgaaggcgacggcatgcgactcgaagcggcggcgcggcactaggaggagaggaaggggaaaagaggggagggatgcctcaccgagggtggccggcgcggaagaagatgatggcgaacggcgacggcaagccacgggaggacgacgtcggtgggcggacgagcttcggggtgccctaaggaaggagaagagagggattagagagagagatggaccacggcgaccggaaaccatggccgaaggcggcggtggaggtggtgctcacccgagtgcgagggaacgagggctccggcgacgaacctcgacggaggaggggtggacggtgtcacatcctgattttttcaggatttatagattatttaataaattattattagaatttatattaaatgttcattaatttacaagtgaagttaaatgtgggaaataaaatttcctaaatataaagcatggatggatttaattttttattaaattctccatggttaattatactctctggaattttctcggatttttcggagctcaattattaattttaatcatacaaagagcatttcagtaattacccacatattaaattaatcattaaatggtctaattataattttggtaagtactttgagtgtccaagtattttcaggatttttcttggaattatttgagcattggaagtatttttaacaattcaaagatcatttaagtgattattttaattggaaaagtaataaaatcctcctcctcagcttgggccattttcggcccattctttcctttccttcctctctcttccgccggcccaacctgagccgcctcctctcctctcagcccagccagaaaagtctactgttcctccctctactactgttcatcttccagctctggacagagcccgagctgccgtcctgtgccctgtgcagccgccgctttctccaccaaatccgccgcatcccgagctccgtttgcaaaattagttgaggggaaatatttcctttatcttcctctttcgtttcccccaagaatcggaacctaattccttgtattttatccaaataaaattcgttttgagtttatctctccaaactaacccgaagattttccggcatcgattcctctcgtttggagtccgatctctctagtccaagactatataaagcatcccctagttctcctctttcttttgccccatctcccgagctctctcgtcaaccgtagagctgccgccacgtcgtcttagccgccgccgtcgccggccgacgaacagccggctcgcgccgtcgttttggccgtcgccggtgtctcctctcgccgccgtcgggtgcgcgtggaagaagggaagctcggncggccccttcccgccgtcgccggtcaccggagagtcgccggcggcgacgaccgagtcgccaccggcgcacaagctcggcgccggccgtcatccgtcgtcgttcgttgcgttggtgagtatcgttgagatcgcgtcgtcgtcgtctacgtgtagatgcc

SEQ ID NO: 33628 - DNA, 7417 bp, Oryza sativa
gtgtcttgtgggtacagtggtacacctctggctagagtaaaactattcgaatagccgtgcccgcggttatgggcgagttgagcaatgtttttcgtgattagtctcacacctctcacaataattatggatgttatacctggtaataatttgtttagctcctggtttggagattagatctgtacagccgggtatggttgttcaggatggttgggcctgtgcagcatgggtgtgctgttcagtgttgattaaaatttctgattaattacttcactgttttatttctcttaaatgttttgctaaatgctgcttttgcaaatgagcttgtattatgccatcctttggaatccttgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagctgaagccatcgctagaccgttaattccgctgctgttttcttttcattgtaagtatgtaacgttattattaagatggatttgtatattaaattgtcagtttgtgtacctcggctgattcctggacgaggattttatgcacaaattagttcggaaattactagtgaatttccgggcgtgacagacggggtggatctcggccacacgaacccgacggcggcgacggcgcggcttggcggcgaccctaacggcggctagcggcggccggagcagcggaaaagtcggcggcaaggggttgcacggcgcgggagcgatgggaggctcgagagagtgcggtgaaatggggaaaaagtgagaggggacgacggcgatgcttaaatagggggagagggaaccggacgtggccgggagaggcgggaatcgccggccgacgtgggggagtgggggaggagagagaggcgggattcgaaaatcgaatcccggccatctcgggcgcgggcgcgagcggtataggcagaggagtgggcgcggcatacacggcgcacgcgcgggcatggtcgacgtggcccggaggagccgtagacgagggcccgtcgacggttgcgggctcgccggcgcgagcgagatcggtgggaggtggggaaaggacccgacaggtgggccccacctgtcggcgaccccgagatagcaggcggcgggccggcctgactgggcctcggcctgcggccggcccagcaagtaggagggggaggaaggagggaatgggccgacggcccattcgaaaaaaagttggcaatagagaggactaagataatgcaaaaggtaaaaggattttccctggaattaaaatattgcttactcttttttaattggttaaaattatttctagagctctgaaaattccactaaaaatcctgttagtgaatttcgacatgtagaactcaagaaaaattccacatgccaattccgattattatttgcattgatttaaaagggtttactcttgctttgcaccggcatctttatagggtcatttataaattaaaattttggcttggggggaaaacttcggggtgtgacagtaatcgactgtagacgtagggaagttaccctgaccacaccttggggatcggatatgacagcgaccgtggatcaagatcctagactaaccgaacgtgccagaggcatatttaccaagctacccctaaagggaatgcccgtagtgaagcgatttcctgatgtgttcccagaagatttacctggaatgccaccagatcgtgacatagagttcattattgacctgatacccggaactgctcccatatccaagagaccatatcggatgccagtcaatgagttggaagaacttaaaaagcaaatcagagagttgcaagaaaagggatttgtacgtcccagttcgtcaccttggggagccccagtgttattcgttaagaagaaagatggtagcatgagaatgtgtgtggactaccgctcactgaacgaagtaactttcaaaaacaagtacccactaccacggactgatgatctcttcgatcaacttgaaggagctaaggtgttctctaagattgaccttcgatcaggataccaccaattgaaaattaggaccggggatatacctaagaccgcgttctcaacgtgttatggattgtatgagtttgcagtgatatcgtttggattaaccaacgccccggcatactttatgaatctcatgaataaggtgttcatggattacttggacaaatttgtggtagtattcatcgatgatattttaatctactccaaggatgaggaagagcatgcggaacacttgcgattggtactcgagaaacttcggaagcataaattatatgcaaagtttagtaaatgtgagttctggttagaagaagtcgcttttctaggccatgtaatctcagccggtggagtagcagtggatcctgctaaagttgaggccattacggaatggaaggcacccaaatctgtgactaagattcggagttttctaggtttggccggatactaccggaggttcattgaggggttctctaagatagcccgacctataacacaactactcaagaaagaaaagaagtttgtatggtcagaacagtgtcaagaaagctttgagcagctcaaagaaaagctgacctcggcacctattctgtttcttcccgacaacaggaaagactttcttatatattgtgatgcatcgaggcaaggactaggaggagtactgatgcaggacggaaaagttgtggcctatgcgtcgtgacaattgtgaccacatgaggaaaactaccctactcatgacctagaactcgcagctgtggttcatgcgctaaagatttggagacattatctgatttgaaatcattgtgatatctacactgaccacaagagtctgaagtatattttcacccagtcagatctcaacttgaggcaaaggcgatggttggaattaatcaaggactatgatctagaggttcactatcaccccggcaaggccaacgttgtggccgacgctttgagtcggaagagccattgcaatcatctgaggacggaagggatggctcctgagcttaaggaggaaatggcccaactaaacctacatatagtacctcgtggacagataaacaccttggacattcaacctcttctgagaacccaaatagaaaaagcccagaaggacaacgaggaaatccgagaggtgaaggaacgcctagccgcaggatttgcaaaggaattttcaaccgacgaaaaagatgttctatggtataaaaagaggatctatgtacccgaacagggtggactgagaggattaatcttaaaggaagctcacgaatcggcatattcattgcaccccggaagtaccaagatgtaccaggatctgaaggaaggatactggtggcccaatatgaagagagatgtggccgaatacgtagcgctctgtgacgtatgccagaggtgaaggctgagcaccagagaccggcaggtctgttgcaaccccttaggattaccgaatggaaatgggatgagataggtatggatttcatagtcggggttgcccaagaccgcaacagggtacgattccatctgggtgattgtggatcgactcaccaagacggcaagattcatccccgtcaagacaaactatagcagtgctaaactcaccgagttgtacatgaccaggatagtgtgtcttcatggtgtgcctaagaggattatatccgatcgaggcacatagtttacctcgcatttctgggaaaaagtacatgaagtcctaggaagttatcttgcttttagcacagcttatcatccacagacagatggccagacggagagaacaaaccaggtcttggaggacatgctgagagcttgtgcattggattttagcaaagactgggagagatgtttgccctacgccgaattctcctacaacaacagctttcaagcaagcctaaagatgtcacccaatgaggcattgtttggtcgacgatgttgaaccccactgatgtggtccgagacagatgaacaggcagtatttggacctgacattatcaaagaagccgaagaaaaggttcgcctgattcgagaccatctaaaagtggcacaatcacgatagaagagttacgccgacacccgaagaagaaacctggaatttaaggaaggagattacatttatctaaaggtttctccgatgaggggaacgaaaaggtttaaggtcaaaggaaaactagcaccaagatatgtgggaccattccaaatcatcgctagacgaggagaagttgcatatcagttacagctaccgaaaaacatcgccgatgtgcacccagtcttccacgtgtctcagttaaagaagtgcttgcgagtgccggaagaacaagctacattggaagaaattcgtattagcaatgatctcatgtatccagaacacccagtccggatattggatgaagctgaaaagaggactagaaccaaagtgtggcgtatgtacaaggtatctcatgtcgccgtcgcgtcgtcgcctcgcgccccgcgccccttcccagccgtgcgcccgtcccatcttccctgctgcgcgcgccttacgccccgagccggcgcgccgtcatcccaccggcccgcgcgcccacgcaccccatcaccggccgtcccgtcgccacgcgtgttccatcgccgcctcgagcctgcgccgctgtcgtcgtcgccattccatcgccgcgcgccgagccccacgccgcgccgcgccgttccatcaccgcgcgccgagccctgcgcccgcccaagccccgcgccgacatcacgttgccggccgtcgcgtccccgccgtcgtgtcgccgccccgcgccggcgtcgcgtcaggcccgccaccccgtcccctatatttcttccccctctcccctataaatactccacaccccctctccatttgccccactccatctccctctttctccgatcttccctctccaccgagccactaccttcgtgccgccgcgctgccgccatcgcgccgctgcaccgccgcctttgtgccaccgcgccgtgcgccgtcgtcgcgccggcctcgcaccgtcgccttcgtggcgccgcgccgtgcgccgccgttgcgccgtcatcaccgccgtcgccgtcgtcggtaagccgccgcctcctctccttgctcggtcgtcgtcgccagagagctgagagagagagaggagggagaagaagccgggagggagagaaagagagaaaagaagaaagaaagaaaaaggagagaaagaaagaaaagaaagaagggaaaagaaaagaaagaaaagaggagagaaaaagaaaagaaaagaataaataaatagaaattagagagagattagggaagttagaaaatttaaaataattggaatttaattatagatcaattatagtcgtagaattgcaaaaatttaatataattatagattattttggtaatctctataggtgatcaattcacggtaggtactcggatttaattaataggaattttagacgtatattatatttaatcgtttagtcatagactaaattaaatcgtataatattataagataatttttggattccgtctgatatttagctcgcgatagaaatttctaacctattatatggatataatactcgggtacattaaattaaaaacttatgataacaaaatatttatccccgcaaaaatagtttaggatgtataaattgaaattaggtttgccctagttcgcgaatagtaaagttaatataaaagaatcgactttcgcattcgacttccatttggatttatttggatttttatttgaattctaaccgaattcaaatcaatttttgcacgtaactatagagcccaagggagttgcggatccaagtgaaggccaagacccgcaagactttgagcaaggcaagtcatcactattccttgaacatgttgatcccaattgcgaaattattttgtttacaaataaactacatgcaatgatgaacatcctacttgtgattatgccatgccttgattcttgtttaccccttatggcttcgtaaccatgtttacgtatgagtccctagttaattatgacaattgcttagaaatgctattctagaatcatgcatactcatatttatcaaatgctatatgcttgggcaattacctttgggaaggtaattgagatgcggcatgtggggacaggagcgccatattgccatgatgttgatgacatgatttgtgaaaggagaaataaaattaaacaactgttttcgactgaggcggacggaagatttgggtgttgtccggaaaaggctagtgccgtccttggcaagttaaggactgagccatgaagttaagcatgaaacgacccccgtacaaccgcacttctcgtatgggtatagacctagcggagtagatagctgagcggaggtaatatccatgcatagtggtttcttgatgtgtgaggcaggggctctacggtggggcaaccattggtagaaccgcgaggcgggtgtctacagtggtgtcgccatcggtaggactgccatgtgagaatctaaacataattataacttaatgcatgcatgagtcttcccttcccgggtgcgccagaactcctctcactgctagaaaccgtgtacgcctagagtgcatgaggatgtaaagttcatggagcgggtactgccaaggcgaggttatcgaaaagctttgccgtgacgcgtctcatgtgttgggacgaggctcatgtgttgggcagtcgcggagtgcaagtaaagtgtacatccactgcagtgtgagtaaaccaaatctattcgaatagccgtgctcacggttattgagcaccgggacatgtattacacttggctagactctaaattcttaacttgtgtgggatgggatattgcatgatgatttctatactgatgaaaccacttcctgagaggcgggaatgtggacgtcctcagaaaaccatgatgactcacaatggatggtggacagaaccgtcattgtttaatatgaacactggtactaaaatttgatcagtttgtgataggtcttaggtttgtgaaaagaattataaaacttgctttgcgcaaaagaaccatagccatcctttgaatacccctatcatgtgcattgttgctgtggtggcttgttgagtacggttgctactcacccttgcaatatacaaacttaatcagaggtcggagatgaagctttggaggatccctacacttactaccaggagggtgatgaagacgatggcactcgctaggtcttagttacggtcgttgcctgtggcaatggcgtgccgctgccttaactccgctgccttatctacttctgtttttggaatgtattctagaccgctcggtccgatgattaaagactatgcctgcgggctttggatg

SEQ ID NO: 33629 - DNA, 3693 bp, Oryza sativa
  unsure (1)..(3693): unsure at all n locations
nnnnnnnnnnnnnnnnnnnnnnnnnnnnnnnntttcgtgtgtgtgcatttggtatttcagctatgaactcgtgtgtaacagactacttgatccagggaaatggtactgtttacacgattgattcctgttataaaaacaggggtccacagagctggtatcagagccatacgactgtaggaaaagaccaaaaggcgccccaccccttttctaagttggccaagggagaaattcccatttagtaatactttcaaaaataaaaacgctatgtttacaaaactttgtacgattttcatcttactcttaactattttcttcacaaaacgagttttactcttagctgaccttgggttttttaaaattagatggcagatcaggattcatccgctacctgggagatgggcgtaccccgctcagagggatacgtcattgagctacaccggctgatgaggcgtctgcgataccccagatttccgatctaccgagtgagacagtgtggatctgtttgggaggctcgggtcgaggttcacacacgagttccttcagagtcagactaccgctttccgacccgccaccgtcgcgacttacgggagactgcgatgcaggatgcagcccggaaggcattcctccgacttagctctatccaccgagctgagttggcgagtactgagtttgctcaccacctgtttcgagaggagagcaactccgtctgcacagttcaggacacaccttgctgctacaacccgatagtgacccgactgtcacgatgggctgaggcagtagacgacttttacgaggaggctctgttggagatcgacgaccagcagaggcgtgtgggagagttagagactgaggtgactgacctcacagtgcagcagcttcagctggaagaggagcaccaggctatgaactcgtgtgtaccagactacttgatccagggaaatagtactgtttacacgattgattcctgttataaaaacgagggtccacactatccaacaacatgttcacaaccatgtgtctacattattaatttggtatctctataccatgatccatgagacatgatcatcaattaatacatgtgctgatcatttaaatatatttgttccacatatgatatttgatcagggatcctttaaaaatagtaacaaataacataaagtctcatgaaggaatcacatattcattaaccaataatgagttatctatttcaaggaacaatgtcggataaatatgtaaacatagtatgtgatacaatcatctctatgattgcctctagggcatatcactaacagtctcccacttgcactagagtcaatcatgaatgtatcttatacccattgccctagtgtgtgcctcatgcttaggctgagggagtggctttgtcaacggatctgcaacattcaaatccgtatgtattttgcatatcttcacatctcctctacccactatctcgcgaatgaggtgatactgccgtaaaatgtgtttggacttttgatgcgacctaggctccttggcttgcgcaatggcaccactattatcgcaatagaggtccatagagctagaagcactcgtcatcacacccagttgagaaacaaatttctttatccaaacagcctcagaagcggcaatgtattcggcttctgtggtagaatcaacgactatatcttgcttggaactcttccaactcacagcgcctccattcaggcagaacacaaatccagactgcgatctaaaatcatctttgtcgatttggaagcttgcgtcagtgtaaccatttacaacgagctcttcctgtcctccataggcaaggaacatatccttagttcttctcaagtacttcaggatattctttacagctatccagtgactctcacctggatctgattggtatcggcttgttgcactaagtgcatatgaaacatctggacgtgtacatagcatagcatacatgatggatccaattgccgaagcatatggaatcacactcatcttatttcgctcatcagtcgtttgaggacactgattcttgccaagattaatgccatgtgacatcggtaagaaacctttcttagaatcttgcatgttgaacctcttcaacaccttgtcaatgtatgtactctggcttaatccaattagcctctttgatctatctctatagatccttatgcccagaatatatgctgcttcccctaagtccttcattgaaaaactatttttcaacgatgtcttaacggattcaagcatagaaatatcattcccaatcaacaatatgtcatctacatataagattagaaacactagtgcgctcccactaatcttcttgtatacacaaggttcttcttcgtttctgacaaagcccaacgccttgacaacttcgtcaaaacgaatattccaactccgagatgcttgcttcaacccataaatggattgatgcaacttgcatatctttttagctgattgtggatcgtcaaatcccttaggttgtgtcatgtatacatcctcatccagatttccattaaggaaagcagttttgacatacatttgccatatctcataatcgaaataggcagcaatcgctaaaacaatccaaataaattttagcatggcgactggtgagaaagtttcatcatagtcaacaccttgaatttgtctgaaacctttcgccaccaatcgtgccttgtagatgtgaacattgccatctacatctgtctttttcttcggatcttcgcgaaaccggtgcttccacaactggttcaacaacaacttgttcaacctggtgaacaacatcttgcttagcttgttgtggttgtgtggacgtggaagcattttccggtgtttccttaatttcttcaagtcgcaccatgctcccaatatcctttcttgaaataaactctttttccaagaaaacaccgtgtcgggcgacaaacactttgccctcttcctgattataaaaataatatcctttcgtttctttaggataccccacaaagaagcatttatctgatttgggtgtgagtttgtccgattgcaaacgttttacatagacccacatccccaaatctttaggaaagacaaactgggacgcttccctgtccatatctcgtatggtgtcttatccaccgatttagatggaacactgtttagtgtgaacgcagttgtctctagagcgtaaccccaaaagcttagcagaagattagtttggctcatcattgatcgcaccatgtccaacaatgtacgattcctccattcggacaccccattccattgaggcgttcctggcggagtgagttgtggaacaattccacactcctttagatgattgccaaattcaaggctcaagtactctccaccacgatcagatcgtagatacttgattgtctttcccaaatgattttgtacctcattatgaaattccttgaacttttcaaaggactcagacttatgcctcattaagtagacataaccatatctactaaagtcatcggtaaaggtaaaaaagtacccaaaaccacctctggcagttgagctcattggtccacatacatcagtatgtactagtgccaatagttcacttgccctttcactttgacccgtgaaaggtgcctttgtcatcttgccaagtaaacaagattcgcatgtctcaaatgatcaaaaatcaaaagagtgtagaagtccatctctatgaatctt

SEQ ID NO: 33630 - DNA, 1239 bp, Oryza sativa
gattatagatccaaaagacctagatggcttgcaggccgatattgttagtaccctgagtcacttggagatgtattttacactagctttcttcgatatcatggttcatctcactgttcacctactgaagcaaacaaaaatatgtgggccagcttttatgagagaaatgtggccatttgtcatgaccggaaataacccagcgggcgttccttacgtgcgtgtattattccttgtcccaggaggcaaggtacaccaaaaattgatacaatacagagtttaacaagcggaagcgtaaacaattaatttattacatgggcggtgaaggcccagcacacaggaagacaaacaaaaaacagcggaagactacggcgacgaccacaggcgcttgacggcaggcacgagctagacaccaaagccttcatcttccaggaactcctcttctgggtttgggaaaaattgagcaagactgagtacaaccaccgtactcaacaagacacacccacgagtgcagaataaatgcaagggagtacaagggagttataatataagggattagggtttgtagtaaacagcattaaaagacacttagttgctcaaagctattttgtaaatacgatcctcgagctatgcaatattattaatcaaggccgtgaacccacacgaacctgccttaacccaaggcctacgatgattcagaccgaactggcaactcgaccctgggtcccagctcgtcccaagccaacccaggccaaccattccacattttagtcgttaagaaggttttaagaattgaaacactaacttgggtacattgctcggcttgcccataaccgagggcgcggctattcgaataggttatactctaatcaaaggtgtacatctttacccacaagacacatcttcctcacgtgtaaccacgtgccacataccaccacggtatacggacggaagacatgacatagtttccaactcatcctatccatagacaagagtaccgacccaaccccacctacgggcggaacctccgggacaggtaggcaggactgagcccctagcagcaggacatcggccctctgccctgacatctcgactaccgggccgcagctcgtgtagccttcatttgccctagagatgtccatcgacccccgacttcgtccatctccatccgtgaacttttgttataaccagactgagccacaaactaagccttaccactagacatgtggaagtacggtagtgctt

SEQ ID NO: 33631 - DNA, 673 bp, Oryza sativa
cggtataagtacaatttgacacttctttgctcaatagctcacacacaaggtttttcttttagataatagctcaacatacacaagtagcatactaataaaaaattgttagttctagatttcatacctcttatcccagtagtaagatcatgaaagaatttaataaagttgccaattgccaaccatgccaaggactactcaactagtgctagatttctgaattttctttttttttcttttcaggttgatcagtgtagcctctatgcgttgtcaatgatacttctccctttattttcttcaggaaggaacagaaagtcaccttctggagttcttgttaatgatccttctggaagaattaatcttgcatgaaaaaaattggctaacttgcaacgatggagaattaattaattgcagggatcgatgtgtgcacccaagggaaaagccggccgtatctatgcaagataagcagcaagcaaagcaaagttgatgccttgatggccgtagttaagtacagggagacatgccagtagaagatgcagcaaatggggaggctgcagcaaagatacgacgtgtttggatgttccaacaactccactgaaacagtttaccaatcactcgctggtcatctcacactaataactagttttaatttggcgccacataatgctggtccatg

SEQ ID NO: 33632 - DNA, 856 bp, Oryza sativa
cgactctagaggatccccggtcacactcttcttgtaaatttgacaagatttggaatgcatgaaaaatctgttattagacaaatttcctcgtatgatcgcatccgcacagtaaaaattcagaggacaaagtacatatcaaatccatcttccaccgttgcccaagcctgagctgccgccgcaccccgtcgtgccggagatgctgccgcaccccgtcgtgccggagctgccgcactacccggccgtgccggggttcccaaagcacgggctgccaccgaagcctgagctgccgccattgcccacggcggagctgccgccggagcacgaggttcacgacccggagccggagaccaagcagccatgatcgtacatacacacacagtattttttttttagacaatggattataaaaaacctggcctctacaccttgtgaggatgtacacagcctaaaagtaacaaacacgagtacacaagactataagactctcccgttacatgggtaaaacataaataagttttaaagatggataacaagcaagaggaactaaaagctaagcttccatcattcttctaaagttccacccaaaagtagagaagatcagctccatcatacacttctctaaaagcttgcacttcgcgattacttcaatgccttcgtcttccttaagaagcaaagaccaaagccttgacaactgagttactttgaaaattacctgtaagaaaaatacgtggttgtagccattaaagactataattcatttatattgagccacaaagcccaacaaatcgctgtatacccacccaagtttgtcttttaagcttaggttcaaaacccctttaccaattttcaaacaagt

SEQ ID NO: 33633 - DNA, 2421 bp, Oryza sativa
  unsure (1)..(2421): unsure at all n locations
gatggcttcatcacgttccgccgcccccttttcacaaaggggcatagggatgtcactcgccgtggtcgggccactgatcatcacttggccgacgcggcgctccacggtttcgccgctcaaacctgttaatcgagaaccaaccttcgataagtcaagaggaatgcgagcacaagtatgtcaagataaatgcgagaaagataccccgaggagaaacccgggtcgcgtcctctggcctggaatagttataagctggatgggcccgagcctgaagcggctggatccgcctaccaacgaagtctgcaacgacttcatatcccgacaaaccccgtactcggagatcgtcgatgatgtcgataaacgattgaagagagggggtcaaggggggctttgcggtccaagacggaatcttgtccggttgatcttcaggaaccacgaagacagggttcgagttcttgatctcaagataaaaccacctattcctccacttgctgcgagaagaagggcactggaagggaacgtaacgcaacttcaggccatcccgaagtcggaacccgacgcaaccagataccctgttggattccatccaacgcagttcatagtaaaagcgaaaaagatcaaggaaaggctctaccccgatgtaggcctcgcaaagatgcacaaagatgctaaggaaggcgatggaattggggttcaaatggagaagagaaagaccatagaaattcaaaaccaggagaagaaattcagaaggtggagggagaaaaccgcagagaacataatcttcgatcgcaaccatgcgacccaagatgggctgaggattagtacctcctgcttccctctccatggttccacggccaggaagagcgccatcctcctggagtttcttcaacgttgcactggtggaagctgatttgccgaggtccattgctgatcgaaggtcgccggaaaacgagcctaggttgatgaactagggtttcttgcggcggcagagaaggcaaagagtgcatggaggtggtgtgtgtttaacaggtttggctgacttcaaaatagactcccaaaattcctttaaataggcgcactaccgacggtgcgaattccagggaacagagagatgcccgccggaaatttctggtcccgttacgcgcgacggttttttggacttcagtttaaaattcgctcgtgaccgttgggcttcaaatggcgtgctcgactatggtctatctccgcggtcctcgcaccgggaaggacaacagtctcgacacccgaagtcgcaaatggttacacgagttcattttaagcagaagtcgggggctactatcagggttacgggttaggcataccctttacccttcgatatacgttacatatcgatatggcatacccacgcgcatgtagatatttcctgtatattctaaggaaacctttcacagaatctacagatgggaagaatcctactcgggcagaaccaggtcgttggcgtatcgtatagggtctgatacctccgagttctatgaggaaatctccacatctgcgatataaaaggggccccccggggagggtttagacatcgaatctcagagccaacacaacctccacagcctacgaagccggagcttacgaggagccaagtcatcgagagctagtcgaatcaactcgactacaatctcgccggatccgacaagttcccttgttctctttgtaacctgtgttttctaccatattattccacatcaactggactagggctattacctatcaaggggtctgaaccagtataattattgtcttttgtttgcttgatgtcgtactacgtagatccttgtatcaacgtaccccaataccctctatatccggtctacgggtatcacccgtcgacaaatctatgatccgatcacaccgttgtattcgttgtaattaaatctttacaacaagatatcgcatgattatattttgataaaagaaaaacatatgtttcaatctgttaatacttattgtttcacatgtgacagcgacatgttacaatgtgtatcttcaccatgtttcataaaatatttaaatgtttcaattgctgttttttttgtttcaccatatataacttaatatttcacttgttggtcaacgctctcccccgcactgtcgtgcgcccgcgttgctcccgtgccgcgttgcttgcctgtcctgcatgtgttgcttgcgttgctgcttgcatactccctctccctctccctctccctctccctcctattacatgtgcctaattttttcctcaaattttaaatatttttctccaaaattatatatctgatctaagtttcaattataccattagatttttgcacaaatacttaattatgttgaaatatttttaaatagacgctacaaatcatannnnnnnnnnnnnnnnnnnnnnnnnnnnnnnnnnnn

SEQ ID NO: 33634 - DNA, 485 bp, Oryza sativa
  unsure (1)..(485): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaattcatcgtgtcaattctgagttcttggcccattcatgcataagtctgattctcgatattatccgaatgatttatcgtttgactcaatgtcgattctcctccactttatggttattctctgcaaaaggttagtgaaccaagtactagtggaatattattactctaacatgtatatgcattacaatcatcactagttcacctctattttggtaatatagacggtcaaaattgatcgataacgaccgtcaacactgacacagtcagcaaagggggatcctctagagtcgacctgcagg

SEQ ID NO: 33635 - DNA, 700 bp, Oryza sativa
tgcaggtcgactctagaggatccccaacttgaaaagtttcctgaaagagttagagttatagatgatgagctgatgcggtctgattctcagtgctggcttctgatggaagaagtccgatgccaagaagagaaattgaaaaaggcagccttacaaatagagaagcttgagaatgtaaatttggattcacaatgtgagattgagagcttaaaacttgatttaactacacttgaacagagactgtttgatgctgacagctttggtcagcatgtttctgctgataaagccatagcagataataaactgagggagtatgagctccagctgcaagaggcacataagactattgaccatcttttacttgagaataaagaactaaaacggttgttccctggaggagttgccactgctttaacatctgatgagcaagttgacaaaacaattgagaagattgatggtcaatactatgagaggggcggtgcaatacttgaaaatatggcaaagcgaagtgaagaatctgaactactgattgagcagctcaagggtaagttatgtctactaaatgtacttcggcacttttgcttttccttcctctattttccgctgccacgttctaccggtgtgttaactgtaccaaaagtagctaatttgaggatgtatctgtccatttggtttttatttgaataggttcgatcatttggtg

SEQ ID NO: 33636 - DNA, 538 bp, Oryza sativa
  unsure (1)..(538): unsure at all n locations
nnnnnnnnnnnnnnnnnnnnnnnnnnnnnnnnnnnnnntcatctatacaattaccttgtggtaaaaaaaagaccaagctcctgagatgattatgatcaagtattatcttaaacctctgttagaagtccattcatcgctcttctcctcctatcccttgtggccatcctctcaccataagtcagaaagatgtccccaagatcaacatgccccacatccttcaacctccttccaacttcctcaaacatcgacaccccatcctcatttgaaaagtagtacaagaacttgttatagtcgaaccttggcacggggaccgacaccgagccagagatcgagccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33637 - DNA, 656 bp, Oryza sativa
  unsure (1)..(656): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagaataagtaagcacgttaaattagaggatccaaagctggttggaatgaagtctcacgattgccacgtgctaatcacacagatattgccagttgctataagaggcattctaccaccacaagtccatcacacgatccaacggctttgtgccttcttcaatgcaatcggtcagaagattatagatccaaaagacctagatggcttgcaggccgatattgttagtaccctgagtcacttggagatgtattttacactagctttcttcgatatcatggttcatctcactgttcacctactgaagcaaacaaaaatatgtgggccagcttttatgagagaaatgtggccatttgtcatgaccggaaataacccagcgggcgttccttacgtgcgtgtattattccttgtcccaggnnnnnnnnnnnnnnnnnnnnnnnnnnnnnnnnnnnnnnnnnn

SEQ ID NO: 33638 - DNA, 411 bp, Oryza sativa
  unsure (1)..(411): unsure at all n locations
nnnnnnnnnnnnnnnnnnnnnnnnnnnnnnnnnnnnnnnnntgatatcatcggaccgctcgcggaccatcaggtggcgtcatctctgaaagttaaggtcgtcaaggaggtgtctgatgctgccaccactagcggtggcagtgttccgacaaagccgaggaaattctcgtctgtaagaaaatggaccgtcatcttctatccatgcaaattctaccatccaaacatacctctcactgactcactcatttaacgctcctccacttactcgctcggcttcgtttttatgaatttttaaagtcttataaaacgttgtcaacttactgctttaagactcgcccgctatccccttccctttttattagattttaaaaattagnnnnnnnnnnnnnnnnnnnnnnnnnnnnnnnnnnnn

SEQ ID NO: 33639 - DNA, 417 bp, Oryza sativa
  unsure (1)..(417): unsure at all n locations
nnnnnnnnnnnnnnnnnnnnnnnnnnnnnnnnnnnnnnnnnntccaataatttcagtaaatgtttgactgaaacctccaatattttcagccaattgtctgaagatgtgaatatcaagattccaaatgactagcgacaagatcatgtatgtgcagacgacccctgaggctgaaccaaactcatccaggcatggcatggggaaaaaacagaccatagctcatcccggcatgaacgaagaacccgacattttgcatattttttctgatgctctggattcatgtaagcactaatttctgatccctaacgtaaataatttgtcacagtttttgtttctgaaaatgatttttttcctaattttctcagagtgcaattagtcatgatgtcataatgcaggctaacgatggccagaagctgcacc

SEQ ID NO: 33640 - DNA, 375 bp, Oryza sativa
tatttttcttcttcgacttcccctttggaacgcgacgaacatcagcgcctgtggcatcttgccttacattgtacatgctgcaatctttacgggaatggttctccccgcaaagaatgcaagctttcttacgacgagaacgatctttcacttcaacttcatccataaggttcttgatcctgcgcgactggcgacgacccttagtatcaagtaataaatttgagtcaggaacccaattggcttgccctggaggaggacgagtgaaatcgcacacggcacgccaaccacgcaattcaccacgccaagttgcctcccacgattcctttctaaagtagggagaaacaaaaatgtttccatcaacacccccttttgcggaag

SEQ ID NO: 33641 - DNA, 899 bp, Oryza sativa
tttccgagcttttctcctcaacatcaagagacgctatcaacccctcaacgaagtattcctgtctcttgtgtttgagtgcagtactgaaacctctccaagatggaggaagtttcgcaataatgcacccggccaaaaatttgtcgggtaagacaacttaaggagttcgagttccttagccatggtctgtatttcatgagcctgctcaactacaaaacggttgttagccatcttgtagtcatgaaactgctgcatgatgtacagatcattgctagcatcagtagcaccgaatttagtattcagtgcatcccacaactccttagcgtcggtcatatgcatatacaccttgaccagacgatcaccaagcacgctaaaaatgcatcccacaaagagagtagtggcctcatcaaattctttctgctggtcaacattaagaactcccatagccttgccagtactcacccagaagcatttcatagctatcagccacagagtgaccctgatctgccatctcttaaaatgcacaccggtgaatttatccggcctcagtgcattggcaaaaccagccatagtaaaatcacagtgcctataataaggtttttggattgttgagattataggcatataatgatttaatatattccataaataaagcatgacatttcagatgtatactagcattaacccatcattagatctacacatgtaaactaagcagtaaaacatgaacagattaaatatgcgcaacatattgaacacgtaccgaggtttcggaacaaccggttgctcggcaggaatcacttgcggttgcggacgtcgacgaaggcgcgcagcacgcgagcgaagaggaagacgagccgtcgcaaacgaacagagagcagtcgcgcaaagcgcttcccaaa

SEQ ID NO: 33642 - DNA, 579 bp, Oryza sativa
  unsure (1)..(579): unsure at all n locations
agggcgaattcgagctcggtacccagcttggtctgcgcgactcgcttcggctcgcactgaatccatcccgcaattagttttgtcccacctggctgattttgcgacagagcgaccgctttataaactctggttgattctgttgtgttgcctccccggagacacccacaccgactagatacagcggtaagatccccaccgtggccacggtttggcggacaccttctgctgtaaaaattaaaaatggagcagtcataaggtcccctcccgttacggggcacggcaggcgcctgccggttaggctgcatccatataaatacgttaagatgtcaaatacggcatacatacagtcgggtctcccgtggaggcagcgctagacattagcgctttgctttttgaaattttgtatgatcaaattattatttttctgttgattaattacaacagcagcaatggaggcctgcatttgaaccccctatgcgtttgaattccaatatcctttgcatttgtatttgaataccatacttannnnnnnnnnnnnnnnnnnnnnnnnnnnnnnnnnnnnnnnnnnnnnnnnnnnnn

SEQ ID NO: 33643 - DNA, 563 bp, Oryza sativa
gaggatattacatggaagagaaagcgactgaattttcctgtcaagaaaaactcctaccagcttaactgcgccacttttctgttatctgagcaaacgcgatggaagacccttctattccgctgaagctagatattccaccaggttgtgatctctttctctctttctttcaatctttggcttgatacgagcgaaaacaaagacaccaatcagacatatattatactcgtattgcataggggataaaaccaaacttctgcaggcacaaatttactcccaaacattgacagtgaaatagcaatcttttactaaatttactcccaaacattgtgatttcatagggtccattgcacgcacatggtaatctgtgcagccactatcgatctattaaaaaaaatcctaagttaattttaatttttgagaggcaccaaacatagagaataacttgggaggagaaggtaattggctatggaacagaggaattccacttaccgctacttcatcgtcaaattccggtcgctggccttcgtcagccattaaaatctttgccttttcgcccacagttg

SEQ ID NO: 33644 - DNA, 641 bp, Oryza sativa
ggcttaattatacatgtacagtatgacaggcccccctccaaattaaactagcacgactatttcgtgattatagtgcctgctaattgccatcgctgatcgctgtcagtatgtagcagtactgtagctgcaagcaaagcaaagatgtgtttggtgtgccgtgcacctctccatctccatctcgatgctgctcgatcggaaggctatcctgaatgatggatagtcctaattgtttggataggtttctccacgtcgactttcacttgcttccactcaggtggggcaggacgtacgacactaggacactagctgaaaaaaaggcacaagtcctttggaattgtagggcataattttacaatttctgtatggctcagattgtttcttttgaaaattcattaaactcctatgcagcactaacttttttgtttgaaagaaaaaggaaattttttactagtattaaataattacatcaagataatacacagttattttaagaccactcttaacctctatatgcatcactgaatgtatagtttcgtcaaaaaaccaagtctactatggaaagggtttctatgagagagtttaactgatttgcgtgaaaactctacaaattactgcaaaaagattttagttttttctactac

SEQ ID NO: 33645 - DNA, 1715 bp, Oryza sativa
  unsure (1)..(1715): unsure at all n locations
gatacttctctgatacgcacggatacaggatacagtacgatctaatcctagcttctcatgggataccaatcctcgctgcgtccatctttttctacccaacggcgccgtcgttctgaagctaggcaaaggtagagccaccactccgcaacgcggggcctactaccgctgccgcacgccgccgagcgcagcatcgtcgccatgccccgtggagccaccgncgcacgccggacgccgaacgccccctagcttagcgcgcgcagcaccaccgctgctccgggtcagggattgcttcattcaagtgaggtctcgcgtattgatggttcagtgcatcctggatcttgatgttgtgattttggacaccgcaaagtagactacaaagccataagtgacttttgaagatccagtactactgcagtactgttggtctggtcaaagctatacgtgcgtatgagagagagagaggggaagagtgagacagagaagaggaatagtggaagagaatatgacatgtgggtcccacttttttttttataattagaatgctgacaagactgccacgtgtacgccacgtagaccaaaaccaccgtggattggatcgaggggggtaattcatccggtttgcatagttgggggtgaagaatgtccggttttgtggtttaggggggtaattcggacgaccgcgatagttcggggggctaattcgtactttttcctcaattatttgcatgttcattattttggcctcaatcaattctcccattttctttgaggagtgcattatttttcttaatttattatgtatatatagacgtatcctcgtatccatgtttttcaaaataagccgtatcccggtatccccgtatcgcgtatccgtatcctcgtatcggggtaacatagatgccagcaacacttctgcaggaagacaagagcatgtgcaaccagttccattggcaatggaaaagaagcttcttgtctgtatcagaagatcattttgttttagcaagaagaaacttgttgatcatcaaggactttagtattaactagtgagcgtgcacgtgcaaggcacgtttttcaccatttatgatcttttgaagctgaagttatcaattgtgtaaaattagaatcttaagatccatctaacatatgttgtttgttcccatctaaaatgttaatgtaaaaaatagaatgtgtcatttccatctcaatttcaaaatagaaaatataaaataaatactgagctctttttacactttcatagaaatagaataatttgtagaagtatctttctttccatttccgtttactgtccaacattttcacatattgatgaatcattgaatgataaccggaaaccagttcattattgaaaggctaaacttcattatagtagctacaatagcagactataagtcagctataaacatattttaagcaggtaaaagaggagagataaaagcagcaggctacaatgaaaggctaaacttcacgtcattagagtagctacaatagcgggctacaatgaaagactaaactttattagagtagctacaatagcagactataagtcagctataaacatattttaagtagataaaagaggagagataaaaacacatctctcctcttttatctgcttaaaatatgtttatagctgacttaattgaatgtttcaataattgaatgtttatagctggcattaattgaatgtttcatga

SEQ ID NO: 33646 - DNA, 8865 bp, Oryza sativa
  unsure (1)..(8865): unsure at all n locations
nnnnnnnnnnnnnnnnnnnnnnnnnnnnnnnnnnnnnnnnnnnnnnnnnnnnnnnnnnnnnnnnnanaataacttgggaggagaaggtaattggctatggaacagaggaattccacttaccgctacttcatcgtcaaattccggtcgctggccttcgtcagccattaaaatctttgccttttcgcccacagttgtccggatggaactcaacatagattcacatttgtcttacacaggagcagcaagggagacgtgatccggatgagtttgcggagggggcagaggagtcgcggcggacacaagatgtcgagggatcgacggcggccggactgcgggtaatcgacggcgaggtgtggtggagacgcgagggcgatgcggctcgatggagaccagacggcgacggatcgacggcgcccagatagtggggatccagccagcgaggcagcgagggcgaggcaaaggctagggtttacgggatcggggaccctgcttgtgggctgcggctgaggtgggcaggcgtgacgggacgtgaggagaggtggagagggcggcgcgggagaggagcgggcggagggaagcggcggtgcggcatggggagaacgacggtgcaggcggagggaatcggcggcgcaggcgtgcggggccaggcggaggttagcggcgatgcaaacgtgcgggagcggatggattttcgtttttgttttcttttttgtgcgcggtttttcgggtgtagagggtgaggggttggtcccacacgatagtggaaccgaaggattggaggattggggatgaactcgtactttttatattagtatagataaataaactaccctcaaaactagaattgtgacatagaagaccaagactccctttctagtcagtccccagcaggtacccacggcaatggttcttccagccgttcttgttttcctagtcgaagacttattattttgttccttccaaattacataagcaatcaggaccgcaactgtattgaagcctctttgttcataaccttggaatccttttcacacacctgcaactcaaatgtgacaacaatgaataagtaaattaagctagaggatgcattgcgacaaaggctaatcaattcaatcaaagtcaaaattttattgtaacaattacaagaaaagtttgctatctttgaggtaagtagcaaagaatacaattttaagtattccaccaatgttggtccactcaaaataccgtggagttaaacaggttatacaacaaaacagcagttcagaaaaaaaatgcatttagttacctccaaatatccatatgccaacttcatctattacacctagccaaccatcacaacacacgagctatagatatgcattttcaccacttgtctgcaccttaagattaataaagatgaccttgtcaaaaggatagaaatatgaggtttatcttaatattgccacatctaacaaaacaacacatggaaggcaattatctgagttaatgcatcccaatagaaatattaagaaacatgttctttccaatacccgtttaaggtatcggcaatcccttttttacattcacatcaagggaccaagcagctggtagatcagatagaaggctataactatacacatgctttgttgataactgtaatggagatgtcacggccaaagttcagaaaataggactatctctagatttgtcaggttcagataagaagttggcaatgtgggcggcgattagacgacttgacttaaagggaatccaatggctcacagcgtaaaggatgagaacgatggttcatgtgagacatgggttttctccaggctgtcccgttgacatcatgtttttatcgggatgtgtttaacccgttcttaatttcagaacttttctttcattacacttgattgtaatcaactaattaaacccggcctatatatatatcatgggagttgggtggaatgtgaactaagaaaatcatattcctagtccctttagtagtacaatagccagcttagaacactatgatttatccccaattctcttaattccaaatctgagcacaagctgataggagacctacaacagcatggtggctcaaagccagcggcagtgtgggaactcgagcccatgaagtcctaacttcagtatgcacagatcaattagatacggaaattcatgactgcatttaaaatggaacggaaggagtaaatgaaattttaacgtaacaaacgaaattttctccaccgcaacaatggttaactgaatgaagaacggataaacttataaggtcatgagatactgcggtaggcatccgagatactccctccctccgtcccaaaataaaccaacctcgtacggaatgtgacacatcctagtatatccagattcgtagtactatgatgtgccaaatcttgtataagattaatttattttgggactaagggagtaggcgcactgagatgaaacatgttctatctaaatgaccaaacgacaagaaccgtatccgagagtgacgtggtttcaattactaagcctccagtccacatgatgttgagtcatcccagccctttttacagcacatgatagttttttttctttctttttgagaggacaacatgataggtacttgtgttttatcccaaccaagaaaaggtctaatgcatattcgcttcctgcgtttctcctgaccatatgtatatctctaaccatttctggaagctatcttgtggagtgggaaataatatggaaaaaattcgtcctcacaatgccttgcaggattgaggccgatggaagaataagcagcatggtctaggatggtttctcatctcgttggcttcagttttattgattgagatgctgaagtcagattcataaaccatcactcattggtatacagagaataacaatgcaatcaccatcacaaatcacaaccacaactgcgaagctcattacagcagcatgagcaaattgcagtttcatactttcatgccagtagttctacttttttttttctaggttttgcaatgagcttgtacaaataattggcccatattttatacggatctgcctgatcctattattatcaactttgcatcatttgctacaaattgtgccatacattatggatctatccatatagcagtatatatttgtttcaaaatgtgacagtaatccacttcttttataggaaaaagagtttcttctggtcctcttggcgcagggttgagaactttaatgaatggtccaaaagaaggtacaatcaaatatggcacactgaattctcattgagaagcagttatgcagggttgagaactttaatgaatggtccaaaagaaggtacaatcaaatatggctcactgaattctcattgagaagcagttatcagaatgtgagtaacatacatgctatgtcaacatcttggaaggatcacaattataaagtatctatactgcattaaaagaacttgagtataccataacataaaaaggattatttcacatgacaatctcaggtttcaggatgcttgatttgatctctttgtgcgggagaataacaccgccgttggtatagacctcatcacctacatgtacgtcctctcctaggatagtcatattttctatccgtgcccattgtccaacagttgagtgccatccaataatgctgtttgatatgcaagcatgcttcttaatacgcacgccacgcatcaccgtgcaacgggaaagcctcacaccatcctccacgacgcatccaggaccaatagcaacatcaggaccaatcagacagccttcgccaatcttcgcactctcgtgaactagcacattcccaacaatgtgtgctccagtggctaacctgttggctgatctcttcctaagtgaatccagataaaggcgcaagcctgtaatgtaatcccttggttggccaacatccatccaaaaacctggaaggaccatagcaaagagctttgcatcagctgagattcgaggaaagacctctttctcaattgaagttggctttagctcgatgcggtccaggacagacgggttcaacaagtaaattcctgcattgatcttgttgcctacaaatatttttggtttctcaacaaatttttccaccattccagtggcctcctccataaccacaacaccatattttgatggttcgtccacctacattgaaataatagtcagtatacacaatcaacgagtttataatccaagaaagtggtcaaagaaaggatctaccttggtgaccataattgttgcctcaccaccatggttcttgtgaaattttatgagctcagcaaaagggtattcacttatgacgtcactgttgaggacaaagaatggctcaccagatccatccacaagcttgtcccttgctagagcaagagggccagcagttcccaagggctcagtctcttgggaacacgtgattgtgatgccaagcttatcctcaaagtccttcaggaaattgagcattacctaaaagacggatacagaacaaaccaattagaatgcgaagatagttatacttataccatgagacaacagtaaaatattatctcctttttacctccgggcggtagttgatggctaaaacaacttctgttactccaacttctttcaaggcctcaatctgcataaaccagaaaacttttaattcagagctcattactctcctcaatcctcatgctcatgtttgctggagccaacattttggatataaatgaagtactcttgataactgattggaattttcaaggacagaaaatttggtgtgataccaaaagagttctccaaaatcatgtaaccaaattgataaggaaagaaacagttgaatagtaaaaaggtgcattcaatcacatgcaaatgccacctatcatggatgtttagttgttacaccatgtttatgtgggggttataaacaaatcaaatagtattaatgttctttgaccagtttaacaccctctccctcctttcatggagaggccagtgtcagtgttggaatgttggtaaagaatactgtactaattaacttgtgcccaattcatcgattggcattgcaaattaagtgctcttattactccatcagagtactagcgaaaccacatattacctgatgcagaatcatgggcttgttcgcgaaatcaacaagaggctttgggaaactgagcgttaaaggccgaaggcgagtgccgaagcctccaaccagaatgagcgccttcatggtgaatcgcctcctgttcttccctccctaatccctactccggcggagggatcctcaagcaaggcttgggaaggggaacctgccattgcaacagacaaaatcaaatgtgaaactaggttggagcatcaataaaaaagaaagaaagatttcgatttgattgctcgcggtcgtggcaaagctccagtgagctgctttcgtaccaatagaagggatcagcctggaagatctctcttccttctccacgaccagccccattggaggtaggtagcacagctgcggtcgaaggaggagcctttgtgctgtgctagattgggaatcgagaattggatgggactttatagaggcgaagtggagaggcgacgcgaggaggggaagggggcccacagtagagatgcggttgtgtacttgtgtgtgtctcgctctcgcgaaagaaaattcgcgaccacaggtgacacgtgttccatcacaaatctcaaagcaaatcccatcatctccacaatcttgtgtttggtttatgggtaaggtatgatacgttaaactcatcaagttattggatatctatatatctatatagaaacgacggacgaagcggactaatggaagccttacgaatttttttattagatatagatatctatatacctaattaaaaaataagtaaggcttccggttaatcttttcgtccgtcattaagagtgggcccacacgataattcgtcgctaatccatgatccgaaagcgtggccacgatctcttacgcctgcaaataaaggagaaaagaaaaataaaaagagaaaaccttgtttgtggagcagcccatccaaagcagcccggattggattagtgacgaggcagcccacccaaagcagcagcaggccggcccagatagcagccgcagcccaccagcgagcccacagagcggaggagaagcagcccaccagcccagcacagtactgcacaacactgtagcaaccgaacacgaataaagtttggactcacgccaagcaggaatcggataataaaagaagcgattttattacttaaaacatgtagtcaccaatgtagtcaccaataaaatgaattatttaccgacaaaataaattattttttaaaataaaaataatcacatgtgtctttctttttttaaaaaaagaagtaatcaccaacaaaatgaatcgtgtttacatttggatttttttcccctcatcaattgctcattcgccataggacacctaatcacatcacttttttttccattcattatataatttcttctattatttagagtgaaagttattctgcgatataccacatttttttctttccttctaattatttaagtgaaaggttatgcaattggagtgcaatgaggttgatctgatagctagcaaaaaattatttcttgtattatggctactctttacaatatgaaaaaaatgcttatcaatatcgagtaccaaaaaaataacaaagtactgcaattgactcataataatacatgacaaaaaagtaaatattttttgtggtttcaaactttagtatccatgtcagtgcatttagagcagcaaataattatatcatgttagcgtcttatttgcactagaaagattcgattcgactataaagacctcaatttacctggtggttttatgctcccacacactaattactatttctgtcttcacccaatgcaacgcatgggcattttgctagtagatatagatatagatatagattagatatagatagatatctacctacctatattataattaataatataataaaaatataaatctatcatatacctacccctaattaaaaaattcagtccgcttcgtctgtcatctgtatgttttgagtccaagtcggtcttcaaggaaaaaaaaatccccgtgctagatacccaaattaatcaatcaaccaaaaacagcacgaaaataccaaatttaacctagatatcatgaatttgatcccaagaaatctaatcccccaattcgatccatctgagccaagacacaatacataaacgatagaaaatgaatcacgaaatcacaaatccaaaatcatccagggaaaattaactcacaaaaactaaatcagcgacgccactggtcatgggaggcgaggacgccgcttctacgaggagggtgccgccgccgaggctgtcgataccgtccgttgtgttgtggcggagaagagggtgaggacgccgccgaggagccagggggagggcaccgcggctgagacgccggctgccaagggaagggaagggcgccctgggtgagtggtaggggaagcgacgtcctcggtggggggagagggagggcgcgctggctgaagggtaggggaagcggcgttgccggtgggggaggagggggccggagagagggactgagggagaggaattaacgcgccgcggagagaggagagaaggtggggaaggaaagagataataaggtcgatggggccaagcattgagacgccgctctcttctctagtctagtctcatcccaaacacttgatttcctctaaagcgacacatgtcccccctccttctctcctaccatgtggttcccaattctttatttttttttctcccggtgagatgcagggtttcccaaaccaccagagccggggttaccgtgccccggcggtaagcacggttaccacacggtaaccgtggtaactgtgaaaaaccgtacaaaaccgtgcaaaatttatcaaaaatttaaattattttttaaatttatttaaatttaaggaggttaccgcggtatttatattaccgtatccccgcggtaagcccggttaccggcggtaagggaaaccctggtgagatgttgagcttgggtcggaccatccacgcggtgttgagcgccattgagctcatagtggcagccgggaattggagtcaaggcatcaagctaagccctaccaactttttcttcaaacttccaacttttccatcacatcaaaactttcctacacacataaactttcaacttttttcttcaaactttcaattttaagttaaacttccaattttcgcatggaacacaccgtgctgccgtcctactgaatgaaagataaatcacgtgcatgcgttatctttttttttcgaacagtcagaccgttgccgacgttttatataaagaagaatgtgtctcattttaagaagaaaacgagacaaaaccttacaatgcgcagttaattaggaaaaactggacgaaaaccacaacactctaacataagctaccaacaccgcgaaaaaagaaagaatggcgaagcccaaaacagccatcgataaagagcttgttgaaagcgacacaaaggcttcgacttcgcgtggcaagtgttatcgttgccgagcttgtcacctagcgacacagcagcttcgactccacagctatcacatcatcgttaccaaaggcatcgcagaaaacgagcaagacaccgactgtccactttgaacatcaacccaagccacttgagcactactacttgtacacagctaacaccaacctccctcgaaaacttcaacgtgttatcgttgtcaagcttcatcgcaccccgataaagtagctccgacttcacctagaagaaaacggagannnnnnnnnnnnnnnnnnnnnnnnnnnnnnnnnnnnnn

SEQ ID NO: 33647 - DNA, 2903 bp, Oryza sativa
cccatcatcggggcgagggtcaccgtcgttgcagccttcccgacacgtcgtcgacctccgcccagcgcgccgccggcctcctccatgcgcacaccgaccacctccgtgtggacaccagctgggacaccggatccgaccatgagaggcccagatctgtccccaccatcgtcgaagctagtcgccgatgaccaccacttggggtcctccctccgtcttggcagcgccccgagccgccgtgcctgcgagaggaggcaaggagtcccgccgccgccgtccatgcgcccgcccgactttgccagtggccgctcgggcggcggcgaggcggaggggaggaggagaagtggtcccgcccgtgccaccccgaggctgagcggcaggagggcttctcccctagggtacttgcctgcgttatcaattccaatctgcttcttgaactgcaatgcaaggagttgcctcatgatgaagttattcaatgattagattttgtatgccattgagtttagtttgtatagtgaatttcactaataatttttgctggtgactgaacttgactgagccttcaaggatttcttcgtgcagttgagccttcagggttataaataacgttgatgtttggacgattcttctcgataaacgtctcatgcgactatgcgagcatggatgctggtaagtttctctgctacattgagctcgactcctccgaggagagctaaagaatgggaaaccggagacgaagagatgagggggtaaacctgccctgagattttttcggatgagggtaggagtaggacttatatatcctacgtaatttccttccccgcatcaacgttcggatgggcgttagcatccataatttattatatataagtcaattctttttcgattttgctatatctcactcaaaagattttttcttatctctcactcgattttctcacttaaatttacagtgcattttcttgtaagttacagtgtaatttatgaaacttacactgtaacttttgtaagttacactataatttttgaatcttcgcatgtaaattttaaattttgtattggatttggtctttttcttgaggatatagtaatttagtgtccattatggtgtttcttaattgctttttactttttattatatctatcggattttaatccaaagattaaaaatctgtgtgatacgatcataaaaatctttcgaaagatgtataagtactcccattcttttttataaaaaccggtatatttgtcagtttttattaagaatcacatatatagagattcatagggatcggttttaacttttatctttcctaagagtaacatggattgaaaaatgttctataaatatcggtttcaaatgaatcggcacatatacgggtgcccttcattggtgtttctgtataatttaacatgtcaatgccattgtatatacatgcaccgcatataataaggatgggaaaatgtcacgcccagaaattcactagtaatttccgaactaatttgtgcataaaatcctcgtccagaaatcagccgagacacacaaactgataatttaatatacagaatcatcataataataacgttacatacttataaaagaaaagagaaaacaacaacggaattacggtctagcgaagctccggctccactccctcttctccttcgcaacttgtcttcaactgagatttgattgattattgcaaggtgagcatatgacatattcagcaagccacacagcaaatatgcaagcgcacaaggataccaaaggatggcataatatagagctcatttgcaaaagcagcatttagcaaacagttaagaattgtaaaacagtagagtaattaatcatcaattgctcaggcccaaccatcctgaacaaccatacccggctgtaccgatctatctccaaaccaggaatgtaccattccaaaccaggagctaatcaaattattaccagttataggatcagttattatggtgagaagtgtgagactaatcacgaaagatattgttagactcgcccatgaccgcgggcacggctattcgaatagttttactctggccagaggtgtaccactgtacccacaaaacacagccccacaacatatcaccatgcgcctcgataccaccacgataccttggaaaggagctgtgacagtatcccttgcacaacacaatccaccacagcgcatcgttcctggatcataatcaccccattataaaacaaggcatggactccccagcgactcccgtgggcttatctccgccacttctcagtctggtgccccgcaatgaaccatgctatacaaaaggtaaagccgttgcccatgctggcttgtggttggcacggttaatgtttcataaccgaaactcgtgaaccggtccttaattgtcatgagcacgaccatcaaaaccatgtgctcacaacccaccattatcaagttttagttggcaagtaattaattaaccactcacgattgaccatcgtgagcttccattaaatatccaaaagtgatagtgaagcatgatttatcccattagtgagctattgtttctaagcatggctaagaatctattataagcatctagctgaaccaaaccaatatataaggttctagctaattaaattataacccatagaaaaataaagtcatcttcggccataattaaataggaaaggctcaccacccggtgacattcgaaaataaatgcacagttgaaataaatagagaatttaaatataggatcaacatgctcaaaggaattgtgtttgggatctatatgacttgctttgcaataatcggtcttcaattaatcttcttgaatactcccggcacacacgcgaaccttcgaaacgacggaaacgacaagctaacacgcaaaacaaggaggaagactaataa

SEQ ID NO: 33648 - DNA, 15567 bp, Oryza sativa
  unsure (1)..(15567): unsure at all n locations
agagtattccaagggtatctgtcgacgtttgatgtcgcgattccggtatttgcatagtatggggatcataggtactaggatatatgcgagattgaggtaaaagagatggggatgaggatttttatacaggttcgggcctctgaattgtcaggtaataaccctactcctgttggccgatgccggtcattgctcttattcaccataatcacaccagtacaatatttgggggtagcctatctatttgttgtcgacgtgatggcttgaagtatcatcacgtagtcgacaacagggtagtcttcctcctcgaatccgtgcccggcgagatcagagatagtgctagatccctcctgacggtagtcgtaagtaccatacgagggtcctcctagacaaatctctaacatagatatccggcgtcttgtcttggcgtatgttggcttgtatattgatctatcgttcccctctcccctttcctcatagggggccttgtatttatacccataggtgtcccattgtccaaatagaactagggaaaccaatatggatacaatccgagtagtccttgtcgtttctatgtagaactatattcatccttccttatgcggaactcctcctatatccgaagattgtttctgtataagacatggtatgtggtgggtcctgctgagatttagtgaactactattaggtatgtggtatccaaaaccctgacagtattgtatttatttaatcccgtgggaagatcatagtagagagaaccggactaataatttatatgttacttgaaataatcagagtctaagcagaggttaagataatccaagggtagagtgacacacaaggagggagctactcattctcatactaaaatatctaagctaagtggaaagaaaatagaaagagaatctattcctatacttctagtatacatagtatacatacattctagttataagattaactagctaatactctctatccgatgccctcttggtacttcgagaagccacccctgactgccgagttcctcacggcagcccgtcatgaccatacaaccagggctaaatacgaaggagtaccctccccaggaaattaacttaggactatatacacgcgcggaggaatacccgtgctgagctgtcaccatcagcggcccacttctcatccgcagcatataatccaaataatgatatcccgtaatctagacactacgcctaaactaccagatactactctaatatcatcgtcatgacatagagtaattgcataagcaaacgctatacccgtactgatgcatctcccagataagctagcaagctactcagtttacctggacctttgcgaagtgggcatttctttacctgggaaagtttcaaatcccatgaaggtttaaagaaaagtttttttttaaaacccaaagcctttccaaaaagaaaaggggaaattctctttggcccatcccggaacttntcccgaaggcttccggactccgatttctactctattcctactccactagcttcagaacactaaactaaacttgagagaatatgagagagctttgcttgagatgtgtgagtgaaatgagaaggtgaagtccttaaataggcaggtatgacggttgtaactgctgtgaaatgtctgaaataccctgcaaccgtcatcaggagaagatctagagcgtccctgccaaaccccacatccaacggtggaggtgggtctggttcggccgaaccaggggccggcccaaccagcccacaatttggctggtggccttctggacttctcttctccgaagacttgtgaattttggcccaattgatcgtgtcatttctgagttcttaagccatttatatataagtctgattttcgacatcgtccgattgattaatcgtcttatttgatgtcgattctcctctactttatagttattcactgcaaaaggttagtgatccaaatactagtggaatattattattctaacagaaatatgcattgcaagcataactagttctcttctattttggtaatattgacggtcgaaactgatcgctaacgaccgtcaacgaaggcttcaaaattttcttgagtttgaggggatgtgctgccaaattttttggtgattttgttttggtgataatatacaacttggaggtgtcaaaaaggttagcaacttcatcctcctctattttgtggttagcatttgcatttagagatatgttttgtacactattttgcctctataaatttggaatgggagatgatgagagagaaagtttgtgtagagatggaataatatagaaatttttttatttagaatttgagaaaaaacttgtgataaaagagatgagaaagaaaaagatagaaaattaatctaaaagaatataaaactaagttaatttaaattaaattaagtacaacacattaaatagtttacaactttattgtggaattgaaacatgaataatttgtggtattattttataattattgtttgaataattatatataactattgtatgattgtttaattggttagaaaactaagttaatttaaaattaaaataattacaacacattaaatatttgtttacaacttcaaatataattaaaacatgaataatatgtggtattattttataatcaaatttgtttatttagaatttgaaaaaaaaaacttgtgataaaagtgatgagaaagaaaaagatagaaaattaatctaaaagaatagaaaactaagttaatttaaattaaattaagtacaacacattaaacatgaataatttgtggtattattttataattattgtttgaataattatatataactattgtatgattgtttaattagtttggctttagtgaattatttttctcgatttttgtgctttttgtgtagatggatcggcaatggatgtgcgcagaccgacggtcgaaagagtttattgatggcgtgcataattttctgagagtggccgaagctaacaagcagaataatggttttatccgttctccatgcactaagtgcaaaaaccagagggagtattttgcagtaagaactactcatattctcttgtttgagatgggcttcatgccaagctataatgtttgggcctcgcatggggagcaaggtgatcaaatggaagaagatgaagtagaagacgagaacattccggactgagctcaatatggtagatttgaaggaaatacaacgggtgaggtggaaagggctgttgaagataatgacgctgcaaatgatcgtggtcagatgttgcaggatgtcaaggaggactgcgaaagtgaaaaggaggctcagaaattagagcgtatgttagcggatcacaagacgtcattgtaaccaggttgcgaacaggggcacaaaaagttgggtacaactctggaatttttgcaatggaaggccgaaaatggtgtctgccacaaggcattcgccaacgtattaaactagtgaagaacatcttccgaaggaaaacaagttgcccgaaacaacatacgaaggtaagaagatagtctgccctctaggactggaggtgcagaagatacacgcatgtccgaatgattgtatcctctatcgtggtgagaagtacgagaacctagaagcatacccggtctgtaatgcactacgatacaagattagaagagacaatccaggtgaagttgacagacagccttcgaagaggagagttgctgctaaggtgatgtggtatttccttataataccatggctcagatgtttgttcaggaacaaagagcatgaaagaatgatgcgatggcacgcagaagaacgtcaacaaaacgggatgctgagacaccccgctgatgggtcacagtggcgaaacatcgatagaaagtttaaagactttggaaaggatgcacgaaacgtaagattcggtttaagtacggatgacatgaatccatttggagagatgagcagtggccataccacttggactgttacgatgtgtatctacaacctccccccttggctatgcatgaagaggaaatacatcatgatgccgattatttttcaagtcccaaagcaacccggtaacaatattgatgtgtacctaagaccactggtcaaagatctgaaactgttgtggaaaaaagaaggcgtccctatgtgggatgaggacaaacaggaggaatttaacctacgagcgttgttgttcgtaaccatcaacgattggtttgcccttagcaacctatccgaacagtcaaacaatgggtacaaggcttccattgtttggaagaaactgaaagtacgtatctgaagcattgtaaaaaggttgtgtacatgggccatcgtcgatttcttgttgtgacccaacctgtcctcaagaaaggcaagcatttcgaacagaaggcggactaccgtaagaagcctatatttcgcaacggtaaatacgtgttcgatatggtgaaagatctcaaagtagtgtttggaaagggacctggcagccaacccatagccagcgaagatggtcacgcggcgatgtagaagaagaagtctattttttgggagttaccctcttggacgtccgccatgcaatcgatgtgatgcacctcactaagaacttctgcgtcaacttgctgggcttcctaggtgtatacgggaagtcgaaagatacacttgaagcacacaatgatctctaagatatgagtcaacgcgaggacctctacatggaaccaaaggagaaaggaagccagtacttgagcccaaccagctacactctaagcaaggcagagaaggaaagtatgtttgaatgcttggagagtcgtctgggtactcctctaatataaatagaataataagtatgaaggataagaagtttacaaacctaaagtctcatgactgtcacgtgttgatgacacaactgcttcatgttataattcgaggtattctccctgacaatgcccgggcaacaataacaaagctatgtgtttcatgaacgcaatttcacagaaggtcatcaatccagacaaattagaagcccttcaaaatgatgtggtgcaatgccttgtcagctttgagttgatctttccacctttcttcttcaacataatgacgcatcttccaagtcacattgtgaaagagatcagtattctccggctctcgggcctgtgtacctacccaacatgtttcctttcgagaggtacatgggtattctaaagaagtatgttcgtaaccattcttatccggaaacaagcatagccaaggggtatggaacagaggaggtcattgagtttttcttagaatttattgaagaccttcgtccaatcggggtggcagaaatcacgacatgaagggaggctacggggaaaggggactcttggaaggaaagcaattatgactgtagatgtcacatcctgatttttgtttcaggatttataaattatttaataaattattattagaatttatattaaatgttcattaatttacaagtgaagttaaatgtgggaaataaaatttcctaaatataaagcatggatggatttaattttttattaaattctccatggttaattatactctctggaatattctcggatttttcggagctcaattcctaatttttaatcttacaaagagcatttcggtaattacccacatattaaattaatcattaaatggtctaattataattttgttaagtactttgagtgtccaagtatgttcaagatttttcttggaattatttgagcattggaagtatttttaacaattcaaagatcatttcattgattaatttaattggaaaaagtaataaaaatcctcctcctcagcttgggccgaatccagcccattccctcctttcccctctcccttcctctcagccaggccgaaagtctgttttgcctccctggcgctacagtactccatcttcctcctccagccgactgtctcccgtgccgtgcacagtgccgccgattcccttccaaaatccgacctccccgttgctcctatttccaaattggttgcgggaatggaatcctatcaatctcctcttccttttccctaagaaatcctcaaaattttctatggaaattctttccaatttcgcggatcaaatccttccttttccggcgagaaccctaaactttcccgagtttttcccgtcgatttgggcccggacccgagctcccatggctatataaaggacccccctagtcctcctctttcgtttgccccatctcccgagctttcccgtgcctcgtagctgccgcgccgccgccgtttagctcgccgttgccgccggctgactccatccgcgccgcgccgtcgcctccgtcgtcgccgccggtcgccgccaccactgttaggtgcgcgagagcgaggagaagcctggccgctccctccccgctatcgccggtcaccggagctccgccgccaccgccgaccgagccgccgccgccacccacttcgtcgccggccgtcgtcgttcgtcgtttggttcgagggtgagtaccgttgggttcgtctcgtcgtcctctacgtgtgcatgccttccaaatccgcagccggccgctctagctcccgcaagcttgccatccgagccggccaccattgatgaggtcatcgctgacgtcatcatcgtttttttctttttcctgtttttctaatagattaaatcttcggaaattcataactaaatcatcgtaactcggttttgagtggttcaggttgctaaattcatctaaaatcatgatctacatgttggtttactttttatgtattgtttatttggtttttattagtctttttctttgttttgcgtgttagcttgtcgtttccgtcgttgcgaaggttcgtgagtgcgccggaagtattcaagaagattaattgaagaccgattattgcaaggcaagtcacacagatgctaaacacaatcctttgagcatgttgatcctatatttaaattttctatttatttcaactgtacatttattttcgaatgtcaccgggtggtgtgaacctattcctttgttatggcctgtttgcattgattactctattccttgataccttgggatattataatttgactagttgagctttatatatattggttcaactagatattagatatgattgcttagccatgcttagaaacattagcacactattgggattacttatgactcattattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcatgccaaccacaagccagcgtgggcaacggctttacctttcgtatagcatggttcattgcagagcaccagactgagaagtggcggagataagcccacgggggttgctggggagtccatgcctctggtttttgagggggtgattatgatccaggaaaggtgcactgtggtgggttgtgttatgcgaggggtaatgtcacagctcctttccgaggtaccgtggtggtactgaggcacatggtgacatgttgtggggctgtgtcttgtgggtacagtggtacacctctggccagagtaaaactattcgaatagccgtgcccgcggttatgggcgggttgagcaatgtttttcgtgattagtctcacacctctcacaataattatggatgttatactggtaataatttgtttagctcctggtttggagttaaatctgtacagccgggtatggttgttcaggatggttgggcctgtgcagcatgggtgtgctgttcagtgttgattaaaatttctgattaactactccactgttttatttctcttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcatggtgaggactaagtgcctcttaagtaagtatatatcggtttagttattatgatggatttgtatattaaattgtcagtttgtgtacctcggttgattcctggacgaggattttatgcacaaataagtttggaaattactagtgaatttccgggcgtgacagtagacaacgatttattctgtaaagcacatttcacggttttgcaacaatcttcgttggtggctccttacatcgaggagcacatggcgattattcggtccaaaaacatcgttaagtccgatgcctggattgcacgacatcacattgatactttcccagcgtggctacgacaacatctcatagctaacgacgattaaccaacagcttgccttcttggagaggggaccatctggctcacgacatggcaaggatatgagatcaatgggtatatattttacataatagcccaagacagcaagagcacgaaccagaacagtgttgttcgtatcgatgccattagacagaatggcccaaccagcacgtattacggtgccatcgacgacatatgggaacttaactattgacctctgaaggtccctctgttccggtgccaatgggttaggctgactggtggaggcataacgatcgatgatagtgggatgacaacggttgaccttactaaggttggatactccgacgaaccattcgtcctagccaatgatgtaacgcaagttttctacattgaaggacatgactagcaaagcaaagaaggggaaagggcccaacgagtctaagcgccacgtggttctccctggcaaaaggaaaatcgtcggagtcgatgataagactgacgaagattacaatcagttcgacgggcaacttccgttcgcggtgacagttgacctgagcatcctcctatcaaatgaagacaccccttactcacgagctgatcataaggaggaaacattagtgaggagaaagtacgtgaggaaaaccgatgtattagcctagactgttgtatggatgatgtaaatttgttttaaaatgtattgaagattcatctctttctattgttgtatggcgatatctgattattagaatttaaaacaattttaaatcgaggatatggtaattatatatgattattagattttaaaccaattttaagttggggatagaataattatatatgatcattagaatttaaatcaatttaaaatcgatgatatgataattaatagagaaaagagagagcaagcgggcgacaaatctgtcgccgactacacgcaggctcctaggcacccaaattaactgcatccctgttgaagcaaaacaaagaacactgagggagagaggaaaggcaccatgcggtaaaaaaatagtaaaatttcttaatcttgtttaacgtgccaatagcctgttactgtattctctagctactaattaatttgctttacatgacgtggcacacttatatcgctagcagctggcttgtacacaaaaccaagaaaatatatgaaagagacaagtcggccatgtattaattataaagagctagctattatatgggtagtctaagagaaagctacaaagaatctttcaaccgacaaacatgctatattattagagtaagtttaatagtatatccaactactaacttcaattcatctataatcaatataatagcttattctacctataagcatatactacaccattaatatatagtcacacctttcatatacacatattgtattggagttcgtgcttcaggtagctacaacgcttttcttctctctcttctttccttctctttcttctcttctcttctctacgtgtgcttacagctgacctgtatcttgctattgtactctcttctagccttgctctcaattgctcgactactgcagggatcttgtacatgctttcctccgttcttttttgggcttgtttagttagggaaatggaaatttgtaggtgtcacatcggatgtttgaccgaatatcggaaggggtttttggatacgaatgaaaaaactaatttcagaactcgtcggaaaaccgcgagacgaatattttgatcctaattaatccgtcattagcacatatgggttactgtagcacttatggctaatcacggactaattaggctcaaaagatacgtctcgcgatttccccctataattgtgcaattagtttttatttttatctatatttaatactccatgcatgtgtctaaagattcgatgtgatgttgttgggaaaagttttggggaactaaggccctgtttaattcgcgaaatgaaaatcttttgatatcacatggacatttgaccggatgttggaagaggttttcggacaagaataaaaaaactaatttcataactcgcctggaaaccgcaagacgaatcttttgagactaattaaaccgtcattagtatatgtaggttactgtagcacttatgacaaattatggactaattaggatcaaaagattcgtctcgcgatttctcccataactgtgcaattagtttttatttttatctatatttaatgttctatgcatgtatcgatgtgatgtttttagaaaaatattttgaaaactaaacaaggcctttagagcagatacaatagcaggctataaaccagctgcaaacatattttaagaagataaataaggagagagaagagcagcgggctacagatttttagccagctgtagcacggactccaagacatactgtgtgtatgataagtaggaccatgtattaatagggtagtatgtaactattgtatgaataagctattaggttggttatagatgaattggagctagtagttggctatactattaaacttgctcttactgaacacctctgctcctcatcaacgatcagccagttgtgcttgtatggtcgttgcgtcaaacagtagttgcgtgaatccgattcgatatcgacaacgctgctgcacatacggcgggaaagcttcgggcttggaactggaaaagtgctcggtcggctcggtacgcttgctcaaggaacagatgatccacaccgtccagtttcaagattagaacggcaaagccagtatcggcggcgaagcccaagctcccgaaacaagtctgcatggggatgaaggtaatgtgctgatgttgagattataggcatataatgatttaatatattccataaataaatcatgacattgcagatgtatactagcattaacgcatcattagatctacacatgtaaactaagcagtaaaacatgaacagattaaatatgcataacacattgaacacgtgccgagattgcggaacaaccggttgctcaacaggaatcactcgcggttgcggacgtcgacgaaggcgcgcagcacgcgtgcgaaaaggaagacgagccgtcgcgaacgaacagagagcagtcgcgcaaagcgcttcccaaaaaccttattaccgccttctcccggtgcaggatgtcgaaggcagaggttccgaagacctgctctcccgatcgccagtgcacgccggcgagcgggatggagtagtctacgagcgatggcgcagcacagagtaggaggcaaaccctagattgatttcgcgtgtgttgcgtgaaggcggcggctcagtttatatagagataggtcgcttgatcagggcgcccacacgatctccactccgcgtaaccgaacaaaactgcaaaaggaggctgcatctgcgcaagagtgaggagccaattttgcggaccattaccttattaccgccttctcccggtgcaggatgtcgaaggcagaggttctgaagacctgctctcccgatcgccggtgcactccggtgagcgggatggagtattctacaagcgatggcgcagcacgcagcacagagtaggaggcaaaccctagattgatttcgcatgtgttgcgtgaaggcggcagctcggtttatatagagataggtcgcttgatcagggcgcccacacgatctccactccccgtaaccgaacaaaactgcaaaaggagcctgcatctgcacaagggtgaggagccaatttcgcgcctgccctgccaggcgaggcgaggcgagcgagagtgcgcgtgtgttccccctcttctctccaccacatgcttcaagtggctaggagggcatcctcccttttaaggaggtccccctctccaagaataaacaaggtggtactaaactccccatgcatgccatcccatgaggtgggcttttgtgattttccaaagaattaatcttcgagtgggccttagcccatccattaattccaataatcccccaccaaatctcaaaatcccactgagatttgccttttccaatgtactgtttatataccagcggttcgatgaagaccgattaaggttgaacatccacctagaactaaagctacacttactcacaacttgaacaatggactacgtcttgaattgcaagtcttgtgcaagcaagtttcacttagagtcttatctggtactagaccgtctgtagactacccctcgggtggagcgtataagacatactcctaggtctttagtaagcttcctagaagattcacccaaaatctccatagactgcgaccaatagtcaagctcacaaaggtgagttctttcaagaatgctctgcaggacaatatcttcgctagttaaagccaacagaactcattaaggtatagccaacctgccttgcagctcacgagagtacacgcatcttcacttagagagggtatagattggtactctcctctagtttactaatgtttgttcttcccaggttttaattcacgggatttccgatcacatagattgggttaccaccataatataactcacatgggtctcaaacccatctcctttgatgcattgtctatcacattttgtgatagtcccttcgtgaagggatttgccaggtttctggctgtttggatgtaatccaacgttataactccggagtttctcaatttccggatagacttcaatcgtcttttcacatgtctagatgatttcatattatcctcagaacaattcactttgacaattatcgtttgattgtcacagttcataaggatagtcggcaccagtttttcaacaataggcagatccattagtagatcacgcagccattctgcctcaacagtagcagtatccagtgccgtcatctctgcttctatggttgacctcgtcaaaatggtctgtttgcaagacctccacgaaacagcaccaccacctagtgtgaagacatatccactagtggctttgatctgatccagttagaatcactatattcctccagtaccgcaggatactcagtatagtgaagctccaatttcatagtacctttcagatagtgcattactcgctcaagcgcacgccagtgatcatttcccggattagaggtaaaccgactcaacttgctcacagcaaaggagatatcaggcctagttgcactagccaggtacataagcgagctaatgatttgggagtattccagttgattcctagcaattctcttgttcttgcgaagcaacaagctaggatcataaggtgttggagaaggcttactatcaatgtagcccaagcgattcaagatcttctccacataatgggactgcaagagtgtaatctcattcttacctctaattagcttaatgtttaggataacatcagctactcccaaatccttcatatcaaaattttgagacaagaatgatttaacctcatttatcacctcaaggtttgtcccaaatatcagtatgtcatcgacatacaagcacagaataactccctcacccccatggcgatagtacacacatttatctgcctcattgactgcgaagccggcagatgtcaatgttctatcaaatttctcatgccattgcttaggagcttgtttcagaccatacaaagacttcaacaatttgcacaccttgccatcttgaccttcaattacaaacccatcaggctgatccatatagatctcctcatctagttctccattaagaaaagttgtcttaacgtccatttgatgaacgagaagaccatgtgaggctgctagggaaagtagcacacgaattgtggtcaatctggcaacgggtgagtaagtgtcaaagaaatcttcgttttctttctgagtatagcccttagcaacaagccgagccttgtacttttcaatggtaccatcaggcctaagcttctttttgaacacccacttgcatccctcaggtttacatccatagagatgctctatcaactcccaagtcccgttagcgataatggaatccattttactaccgacagcgtccttccagtagtctgcatcaggagatgcatatgcttctgaaattaacttaggagtgtcatccacgaggtacacagtgaaatcatcaccaaaagacttagccgtcctttgtctcttactccttcgaggagcttcattgccatcctcctcagtgacatgttcatgtgtatgttcaatttgttctggtggtgtgattaaactgggaattattttagagggttggttagaactactatgtgtattctttattgggaaaaagctctcaaagaaggtaacatcacgagactacatagttataccaacatgcatatcaggtaccacatttttaactattaaaaatctataggcaacgctgtgatgaacatatcccagaaagacacagtccacagtcttaggcccaagtttgcgcttcttcattattagtacattgactttcgccaagcacccccatgtgcgcaagtaagaaagtgatggttttctcccaatccatatctcatatagtgttttgtccttatttctgttaggaactctatttaacacatgattcgaagtcaacaatgcctccccccaccatgccttaggtagtcccgcggtgtccaacatggtattcaccaagtcagtcagtgtacggttcttcctttcggcaatcccattagactcaggagaatagggaggcgtcctctcatgtataatgccatgttcctcacagaataagtcaaactcatttgagaaaaactctccaccacgatcagacctaagtctttttatctttttgttaagttgattttcaacttctaccttataaattttaaaatagtctaaagcctcgtctttcgttttcaacaaatacacatagcaaaatctagtagcatcatcaatcaacgacatgaaatatcgttttccacccttcatcaacaccccattcatttcacagagatctgaatgtaggagttctagaggtgccaagtttctctcctcagcagccttgtgaggcctgcgagattactttgattgcacacaactatggcacttagaacctttgacaatggaaaacttagaaattaaacacatgctataaagccgagacatcaagctaaaattaatatgacataaatgtgaatgccaaacattagcctcatcatccacac

SEQ ID NO: 33649 - DNA, 8794 bp, Oryza sativa
  unsure (1)..(8794): unsure at all n locations
ccagaagcatttcatagctatcagccacagagtgaccctgatctgccatctcttaaaatgcacaccggtgaatttatccggcctcagtgcattggcaaaaccagccatagtaaaatcacagtgcctataataaggtttttggattgttgagattataggcatataatgatttaatatattccataaataaagcatgacatttcagatgtatactagcattaacccatcattagatctacacatgtaaactaagcagtaaaacatgaacagattaaatatgcgcaacatattgaacacgtaccgaggtttcggaacaaccggttgctcggcaggaatcacttgcggttgcggacgtcgacgaaggcgcgcagcacgcgagcgaagaggaagacgagccgtcgcaaacgaacagagagcagtcgcgcaaagcgcttcccaaaaaccatattatcgccttctcccggtgcaggacgtcgaaggcagaggttccagagacctgctctctcgatcgccggtgcaagccggcgagtgggatggagtagtctacgagcgacagtgcggcacggagtaggaggcaaaccctagattgatttcgcgtgtgttgcgtgaaggcggcggctcagtttatatagagataggtcgcttgatcagggcgcccacacgatctccactccgcgtaaccgaaccggatatgtcgcgcgtaacttatccggactccacgccattttcacgcatcggatttttcggaatgtttccaaaacaaaacaaatccgaatttcccgcggcaaaacaaaactgcaaatggaggctacagctgcacaagggtgaggagctaatcttgcagaccattcgacacgtacgtcatgcacgcccgcccctgccctgccaggccaggcgagcgagcgcgcgtgtgttccccctcttctctccaccacacatgcttcaaatggctaggagggcatcctcccttttaaggaggtccccctctcctagaataagcaaggtggtactaaactccccatgcatgtcatcccatgaggtaggcttttgtgattttccaaagaattaatcttcgagtgggccttagcccatccattaattcaaacagctggtagctccagtaattgaatctgaaactcgcctggttaaattgtatctctcctaattggtttggatccgagtcagagagcaagagcttgtcgaagttgtcggtgacgaagaagtcgaaattcccgaagcgaagacgaagacggtgacttatgaagttgatttcatcgcacttgtcaataggtaactcgatacatccctacctggcgcactaattgtcgaaacaagattttggcaatatgaaaaggggtagcgtacgagacctaaaagtggatagatgcggagataaggaagataggttcagtccctctcaatgagaggtaatacccaactcctgtttggggatagtgtatattgatctgacgttctagttgagaatctctacaccctagagggcctcctacccaccttttattgtatgggagcaggttacaagacagaaacattaaccaatacggcatctgtcggtgatatgagcccgggggtatcatgtttagagggaggaggccgcccccaaacccacatggcgtcccctgaggagggtggcgcatgagtgagtggcggccgccccctcccagcttacggtactgagtttggagggaggaagctgccccagacccacgtggcacttccccgagggggtgacgcccggggtggagtggcggctgccccctcctagagattagatggaggagactgcccctcaatgccacgtggccctcccccgaggggagtcaggcccgaggtagggtggtggctactccgtcccagagattagccggaggaggttgcccctcaatgccacgtggccctcccccgaggggagttaggcccgaagcggggtggcggccacttcgtcccaaagattagccggaggaggctgccccccaacgccacgtggccctccctcctgtgactaggggtcgggctcccccgaccccctctgcgggttgccacgtgcggtgggttaggtggccaccttcgagcgctcacctacccgcattaatggcaacctgagcaggcgcgccacgccacatttaatgtggcgtgcagcgcgcccaaattggtctgtgaccggtcgaatgaccgataggacccggggtgtcaggtgcactaccgcatgggtcagaaggcgtgcaccccgtcctatcccatcagtcatgatggcgaaaggtcttaacctctcatcctggccagggtcggtccatcctccctggtcaattggggtttccatttcccggcgtaagcaggagcccagaagtcttcacccattaatagcagctgacatgggcgccctcccatgtcaggcggcaagatttgacatgcccccaacatcaagatgacgtgcgcccgcttcccaagtcaagaaataagacatgcatttaatgcaaagaatgtaatacttctccaccaaagctaggtttttgggcccatgtggtaaccccttgagatataaaaggaggtcaaacctacttggggaggggggtcgatggatggatccgggatgagccattttagacactagagcagtctcttacccccgatcatcagcaccaccttcttctctaacaaggagatcttgtaatccttcactcagtgagcatagcacaggagtaggttattacacttctcagtgacccgaacctgtataagtcccttgtgtctcttttgcctacgaaagaccttgctaattacccgctgcccccggccgaactctcaaagggggggcctcacggttccctattggaggagttaaccctccgacatctggcgcgccaggtagggggcgcgtttgtgatttttgaggttcttccgaccgccggcgtgattagcatcgcgctgccgatgcgggggaaggtgcagcctcctcaggagtgtcacgccaccctaggcagggggcaaggccccccacatccccaccgggtaaggttggctgccaggtctttgtggcgagtcttcggaatgtctgatggcccccaaagctccagccctgcctcaccgagaagtacgacggcgacgtcgacccctccgagtccctccagatctgcacggcgatcatagaggcggtggggggtggcgaccaggtcatggcgagcgtcttccccatggccctcaggggccaagcggggggttggcccatgaacctgctgtcgcctcggttcactcctgggaggactcttgcagttgagctctgggtgccgtcaaagcccgggaccccttgtgctggctcttccgtagtggctagctttgatcccgccggctggctacggtgcccggcccggctcaactgatcgtcctttcaagttttaagtattttcaattttttcaattcatcaacttgaaatcttatatttaaattccccctattttattctcatggccctgcgacgctcgcgtcttgtgcattatttgtatatttgaatgataatttgtcatgattcattcgaagggtatgctactgagtaattatccgaagaagtttatgaaatagttctgatagtactaagttaatcgtaaagtgtttctcaaatagtacggacagaacataaatgactaaaagtttaatacaaatagataagtcaaggacgatcagtgcccttcgcacgcttgctaggtcctcacttcttcctacgcctaatctgctcagtgggatatgtcaaattatcaggggggtgcctatctctagctgcctgctgtggtgtcacgtctggcccctgaccggcctccgtctcctgcgtcggctgtgtgacctgaggtgctgcgtgccagtaatccatccctacttccccctagggaggatcagtggaaaagaagtcctcaatgaatgctgtgcgaggggagtaagcaggcattccgtgatgcgtcgacgccgaaccgtactcatcgtctgtttgcacaagagggagaaaccaaaaaatatggcgtagttagtaacgatacatataattagaaactaaagcgtgttattgtttaaaatgacttacatgtgtgctgtgtgtggccctgctctggcgcacgcggagtgatatgaagtccccatgctggtgtgttcaacacgttgtcccccgttggcatgtaagcgaagtgtgccgacccagatgctccctgcgaggggtgaacataaggcggagtttggaatacctgcggacgtggtggtgccgtgctcgacgtgggtacccctgatccggctgaccccctggtgtactccggtgctggggtgtgctgaaaggaaggacgaccgtgagatgtgtgggccgcttcgtacccgcgacgtgaagaggatggaccactgcgatccacgctggaacgtcggggtagtgaaggtgatggccgtcggcccgacgtctgcaccacatctgccacgctccgacaggagacacgacgtagtagtgcggcagcacgtgcacggaagttgcgaaggatgctcgccacgtcgtcaggcctgacgactggaggtctcacctctagtctttgcaacagggtgtcagactccacgtgaacgtgctcaacaaattccgcctgttccacaagtaatcaaggcaattaaaattatttaaccagttgcacatttattaagagtatttaacaatatgcacatttgttagaaataatgaaccagttgcacatcatttataaatactgaactagttccacatttatgtaagaaaaggaactagttgaaccaattgcacatttattagacatactgaactacttgctaactttttaaaaatattgaactagttgctcaaattccacaaataaacacgtaccattgagttgtaagctgatctaggctgaggggcaaacgtgtcagtaatcgctgcctggtgggggacggtgctatctccttgtggaggaaaacacctccatcgtgtaacactgcggtaccaacgaaggtaagctccataataactcccatcgtctggaggtgtctgaagtgccaagttatcagctgcgtgctcccactcttgtaccgtcggctgaaccgtggtcataataactagctcgtaggaaagcccgagcccctttctggagtacctgcacaacaacaaattcacacatcagaaaaaatgttgtgcagtgatttattttaaaaaatgtaggattaaacaactgtgatgtgaactaacctatgaagactatcagccaaggacgaccatctctcgaagggaagtcctgatacatgcccaactgtttgagaaccctgtggacattgtgtggctcgacgtgcacgtccaccacgaggtgacaagtcgtcatccagagttgcatatctcgcgtgcaaagatccgcgagaccgtgcggtgcacgatcattgacatcgggctgagtgtagggagtccaccgaacacggtcaggcgtaagctgatcaaagtcagctacaaactgagtgtagacacgacgtgtcgtcccgctaacccactgcggctgtaacaagtagtagttttcattagtcatataaggaaagtttgtgaactagtattcataatgataacataaacgattttaacaaaaaatacctcacggtgtgtccacaaggatcccatagtgggacgatcgtcgatgtcatcaacaccagacctgtacatctctcgcaaaccgtagtttgcgtacgagtcaagctgaggcctcccaatgtcgaagcgctcgtgcgcccacaacataagtagcaacgggcatccagggagtgaactttgcttgctgttcctcacgcaagcatcacacagtccggcatatgtcgccgcaagtaccgtcgacccccaactgtactgtggaatctccgcgataggtaactctgcaatctgctccgcaaagtggatgaagtgcttgtccacggagtcagcgtgagttcccgtgaacatcacccatccaaacaaccacaacaggtaagcgactaagtgccgctgcacgatccactcctcctggtcatcagggaagacatcctgtcgaaactgatttaaccaacttttcgtaggcccgtgcccatctgtgagatcctccagtgcaacaggcagcacaccaccaaaactggccagaaggtcatgcgcccatccagcattcaccattgttgggccaactgcttgcccagctatcggcagccccaacaaataagacacatcctgcagagtgggcaccatctctccaactgtgaggtggaaagtgtgggtctcaggcctccatctatccacaagagcactcagaagcgccgcgtcaatgtggattcgttcggaccttgcacgtgaaggctcgaccaaccgtgcaaacgtcaacaacccagctgctctcagcctacaacatgacagagcgcaagttattaatacatgaaaatataaacaccttgtattagtaaaaacaatatattttcacacaccttgaaacccaacgaggatcaatacgccaatattgatccggtcctcgcatctttagcacattgcagaaagttcctgtactaagacgtcgcgatcgatggttcctatcgatctccttgtctataagctgcccatcatattgatcagcaatacctgcagatcgaaaaccacattagtacaatgcacgtatggtaccagtacagtaaatgtatgcaacataattcaagtaacaaatttgcatgccatttcaatttaaaattacagtaccagcacacatagatacagataagaacagttcagtacatttcaatttaaaattacaagcccacgacacatatattatgatattacaagtgcagtgcagttcgaaatttaaattacaattccaatacaaatacatgacgatattaaaagtgcagtgcagttcaaaataaaaattacaaggccattacaaatagattcgggtaataaaagtgcaagaaagttcaaattaaaattacagacgcactaaacataaattgaacgataacgatcttcaaaatagggagtccaccaaggataatagcgaactaaggattatttttcttcttcgacttcccctttggaacgcgacgaacatcagcgcctgtggcatcttgccttacattgtacatgctgcaatctttacgggaatggttctccccgcaaagaatgcaagctttcttacgacgagaacgatctttcacttcaacttcatccataaggttcttgatcctgcgcgactggcgacgacccttagtatcaagtaataaatttgagtcaggaacccaattggcttgccctggaggaggacgagtgaaatcgcacacggcacgccaaccacgcaattcaccaaaaaaagttgcctcccacgattcctttctaaagtagggagaaacaaaaatgtttccatcaacacccccttttgcggaagcagcaagaacatgggaacatggccgatgtaacaggtaaggcttgttgcaattgcattgcaaagcgtgatactctggccacaacgtgcattccaatgtgatgtcagtagtcccaatgccgacaccactcttgtcacgaagtcgtatctcatataacaactctctattcccagcaggccacactctgtggattcctcccttcttccttttctcatccatgtactgtgtaatagcggggctatacttaacactgggtttgctgaggttcagactagccatggaataccttttacagagatacttctgtgtacccctcgtgatgccctccaggatagcaacaagtggtagaggtcgtgtattcttcataacccagttatacacttcagcaagatttgttgtcatcacaccatacctcgatccatctgtatcgtacaacaacgaccatttctcccttggctcaaattctacccactccgtgaagcacttcgtggcccttccacgcttcctgcgccgagtaatacttggtgcttcattaggaatgggttcaagtccctccggctcctcctgtctggcaactatagggtttttcctaacctcttccatgtgtgtagtggtcaaacgatccagttgatcccatatggcatcaaactttctttgttgattctgcttgcataacttcttgaacaggtccatcaatctcttactcctgaattgtctataaaaattagccccaaaatgtcgcatgcaccatctgctatgtaaatctggccatggcacggactgtgtgacatcttcttgaagcttctgtatcgctgatagcaaaccggcgtgtcggtcatgcagaacacacacatttggtctgttttcaacaacacacattttaatgtgctgcaaaaaccatagccagcttgatgtgttctcgctttcaacaaatgcaaaagcaacaggaacgacatggctatccgcgtcgactccgatcgcggttagaattgttcctctgtacttgcctgtcatgaaagtgccatcaacacagagcaaaggaatgcaatttctaaaggcctctatcatgcacccaaatgaccagaaagcccgacgaagaacattctccccatattcattcacctcatcgagaatagccatgtgtgtgcccgggtttcttgcctgcatcacctccaatagtgggggaagattgtgataagaatcctcataagttccaaacctcatctccaatgctttctattttgccctccaagccttgtcgtacgatatctcatatccgtactctttctcaacgtcatgcattatggtgaaaggggnnnnnnnnnnnnnnnnnnnnnnnnnnnnnnnnnnnnnnnnnnnnnnnnn

SEQ ID NO: 33650 - DNA, 984 bp, Oryza sativa
ttgccgagcttgtcacctagcgacacagcagcttcgactccacagctatcacatcatcgttaccaaaggcatcgcagaaaacgagcaagacaccgactgtccactttgaacatcaacccaagccacttgagcactactacttgtacacagctaacaccaacctccctcgaaaacttcaacgtgttatcgttgtcaagcttcatcgcaccccgataaagtagctccgacttcacctagaagaaaacggagaaagttggacacttgccacatccaagagcggcacccaagagacgaaggcctcgccgaatagctaggcttatagagcttcgacgtagggggtccacgaacgaccatccttgcatggaaaaggttcttggtagtgagggagacgccatagcaacgcctccaaggaggggaacgacgcctaatggcgccgccgtcgtcaagccaaccaaaggccagccaaggctttcgccagcgtcatccaaaaccacacaacccacccgcacaacgtatgacgccggaccgccacatcatccctctagccaccaagcctagcccaccacccacaacttaggcaggctcacgagtccaccgtgctgccaacccgctgccatcctctgctgcactgacccgatctggccaaggcggccgtggatccggccgtcaaagcttgacaagccaacgtcaccgcgagcgcctacactccgctgcaccgctgccaccgtcaccaccgcaaccgtcggtgggcgcagccagtggctgccactatctccgcgccgacgagagcctcccgcaaccgccggtggcgcgcccgccccctccgtcgcagcaccaggcccccgcctccgtcacacgcgctcgattccctccgtggccggcctcccgtagccatccccacgccggcgaggccacgccggcccccacctcgccttggcagctcgccgtcatcatccagggtaccgagctcgaattcgccctata

SEQ ID NO: 33651 - DNA, 777 bp, Oryza sativa
ccgatcgcggttagaattgttcctctgtacttgcctgtcatgaaagtgccatcaacacagagcaaaggaatgcaatttctaaaggcctctatcatgcacccaaatgaccagaaagcccgacgaagaacattctccccatattcattcacctcatcgagaatagccatgtgtgtgcccgggtttcttgcctgcatcacctccaatagtgggggaagattgtgataagaatcctcataagttccaaacctcatctccaatgctttctattttgccctccaagccttgtcgtacgatatctcatatccgtactctttctcaacgtcatgcattatggtgaaaggggacaaagatgtttttctaaccacctttgaatataccatttgtgccacaaataccgctgtcaggtttctgtgcaccagacaggtattctccaacaaacacgtatgttgctcaacccttgaagctacccataaagtgtcatgttgtggcttgtaaccatgcactctccaaggacatccaccctgtatgcacttcacgtcatacgtcgtcctatttgaaaccttcaccctgaactcacgcttctggacaaatgcccacctcttcaccgcatcttgtaagtgacctttgtcatgaaacatctgtccaactttcacctgcttactatcataacaccagtgggcatctaaaccatcgtttaccttcatacgactcattgatatggtcgtccaatcatcgggtatgttagtttcgttgtcccacagtgttgtatcttctcct

SEQ ID NO: 33652 - DNA, 3203 bp, Oryza sativa
aacacgtcgttcaaacccatatgctctggtgcattcagactagtatcatggaaggcatatacagtcaaatccaccccgctatcacatatttgtataggaacatcgccataatacagacgaatgggcatatcacctgacatcctgataaaacatgacaaatagtctcacgtttaatcatttaatcattcgataattaccctattacaacttatactacattgccgtgtactaatttacaactattagtaacaaagaactagtttaataatccaaataaaatataacacctttgtacctattttaacacacaacatatcaataatatgtactaactaagaactaatttaaccgtacaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaacttcactgctggagggtgtcgccaaccctttcctcccggccggcgcctcctcggcctcctctccggcctgctatcccctcccctcgctccctccggcgctcacggcgacgatgtggcgactctcggcggcggctggcgatgtggtcctcaaacaaatcgaactcgcggcctgggtggacggggctttaagccggcctgtcgaacgcccattgttcgatagggtcggtggagggccctgtcgaacgcccccggttcgacaggcctcgcggcgccgggtggtgggccctgtcgaactccctccgttcgacaggtgagcgtgtcgaacgccagccgttcgacagggctttgtcgactgcccgtcgttcgataggtgccctatcgaattgcacccgttcgacagggacctactttcacgattttccccggttggccactacttttgcgattttccataaaaataatattaattctcaaaaaaattccccagaaaccgcccaccaactttcgccacccgccggtcgccggggcggcgtctgagaggacgtcgggcagtgcgcgggtcggaggagggcgatcgagatgagggagctgggccggcagcctctagacatggagcggcctctcgctgcgggtggggcacggcctccgcccttggcttcgccgcataccagtgttgtagaagacggaatacggttgtcggacaaaaagggtatcgttcaccgattaatcgaaattatacggaaatttgacgttcgcgaatatatgtacaaattttattatattatatacttatttgaagaattatatttgtttaactatataaatcaaatatcttcatgttgttttttaattaaacagataagtaaaacattaactcttctaacaccggatttatatatcatatggtggtagaattggttgcattaaataagtaaaacataaaaatatatgtaacaaaacaaaaacaattctaaattaagtaaagaaaacaacactaaatgatcatcaaatacaacatacggacgattattcaggtgatttaacggaaaacgaccaactaatcgctaaaaacgagttttaacgttcgtgaacaataaatgtacaccgtatcacattaacgcggtggtggttttaacgttacgaccgattagtcaatcggtatggccattttccacaacactgccgcatacaccgccttcgatctggtgcgtgccgtcccaccccccttctcccctcccttgcccagacgtcatcccatacgagtagtctgtcgctcgattgctacgagtaaccgtcgctgcgtgtgaggcacgcataccctacactatagaaagacatgcatgtacaatctggagatgggttataatcacttgagtggatgttccattgtgactcgccacgtccatgcgttgcatgagcccacatctcttgaagcgtgtgtgttatggatcgagcacgcttgtaatcgatggtgaacatactggtatgtaatggtgttgcatgcgtatccattaagtaaaataattctattttttttagataataatagaaataattctaaatttaactaaaacagattatatatatacatatatatatataaccgatatacaaaccgagagaaattacacacgaattaattaagaaattttggactaaactaaacacgctctctagctataactagctagttgatggtgcactcgacggggaggcccgtgtccttgaaccgtttggtgtcctcgcagtagtcgtagagcaggtgctcctgcctcgccttgctcagcgccgccgcgtccatctcctgctgatcgaaccacggcgactccggcggctcatcgccgcaccacgccacgccgggggacggcgcgcacggcgtcacccggagcccccggtagtaggcgaagaagggtgcctccgaccagtccgtcttcaccctcccgccctgcgtcgcccagtcgtcggcgttccacaggctgccgtgggcccgcatcttctgccacgtcgggaacgccggcccgccgcgcgccgccgtgttccggtagtccctgatcggcacgccgtccaccagaattctgcatcaatggcggcgtgtcaatgcgaagctctctgtctcgatggcaatggcggcggagagggatcaaacgaactactatctacgttttaggttatacgactttctactattgctcacatttatataaatgttaataaatctagacacatatatgtgagcgtgaggaaagctgaaaagtcttataatatgaaacagaggaagtagtacttacatgatgtgcttggggttccagacgatggagtaggtgtggaagtcggcggtggggtcgaaccagaggcggaactgctgctcgcggccgccgacgccattggcgaagatgttggtgtgcagggtgtagggctcgccggtgacgttcccgaggaactccaggtccacctcgtcgtggtactcccacggcacgtcgtccggcatcaactgcacgtacgcacgcacacgacgacatgtcgatcagcatgcatcgtccatggcggcggcggtggccggcggcgaggaggaggaggaggaggaggaggagggggaacgtacgtagagggtggtgacggtgccggcggagttgttggcgacgagcatcatgtcgacgtcgaaacgggcgtacaggtaggcgtccctggagc

SEQ ID NO: 33653 - DNA, 4940 bp, Oryza sativa
  unsure (1)..(4940): unsure at all n locations
cgccgccgccacaaagacgacgaagaagaacgccaccaccgccgccgccgccgaccaccacacgcggcggcaccgctcaccggaacacggcattgccatggaatattaattcttcaattgattcttcctgatcttcttgttcttgttcttgttcttgctgttgctattcgatttcgagcggaattgtatttataataaccaatcgagaacaggttgatcatcgagaagatgatagaatttgcaggaacatgcgaggcatgttcgtggggaatgtttgagataggggacatggcatgttaggattcatggggatgtcaggctggccaaacactgcaataatctgcatgcatgttgcctcgcctggaatgcatttggatgatgaacacagttgaacacacacgctggtggctcgtgcatgcaggagttcgatcaagagcttaaaagaaaaataaaaaagaacttccatggcgagcgacgaagaacacaccgttgacctagctacctaccaaatgccatgcaacctaacaaccttcatgctgcatgcacgcttaattattggctagttaagcaagtggctaattaatagcctgtgccatgtttcttgtcgaaaaatagcaaagtgtcacatggagaacattgctgattagctagctaggtacagtacacactcgtatggtttcagttcagttgatgggagccaagaaagagagaaacaaaaatgggggttgacttgttattttggagttacctatatctggcagtcagatgtcctaaaacacctgcggtctgcagatgtgcagtagataggaacaattaacttatttttgctagtttggataagcattagaaactctccaacgtgtgacaagtgatgcttagtctatcccaaattaattttcataaatactactcactttgtaaaattatgggtaggattttattattattttttttggaaagttaattcacgtgttccaaaggaggcagcgcaggaggaatcgaagcactccaaatgtcaaactgttgagttagagcctgtttgtatcgttaccctacaaaaaaaaattggtagtgcgccctaaacaagtgataaatttgtacagttaaaagtagaaaattttgacttaattagcacacaactaagaccctctttattcaagtttagacttttaagttagatttttagcttatgtgttttataagcgaatggatatgaaatcttaagtttaatgatggagtcgtacctccaccttgcataaactaaaaaatgcttcttcaatataccttttaacgtaacagtgtaagaatggttcatggctttcaaaaaatcaaactaaaaagttgcttgtttgtttaagtttaatccttttacctcataaactagaaggctgattgtttgtgctgctttgcagtcagctacagctatagttggccataaggcccgaggcccgaaggcccggcccacggcacgcctttttggcccggcccaagcacggcacggcccgacttgggtcaggcccgtgctggcccggcccgaccgtcgggccgtgcctgggcctccccaccggcacgctgggctggcccggcacggtcgggccggcccggcacgatgggccggcaggccaggcccggtacataaagtatagggactaaaaatagacatataaatgtaactgtctaaagaatagggaccttaaatagacttattttagctatttatataccccagcccaaagaagagggaggtaaaatagactttttgtagctgtacatatgtcacagcccaataggagggaggaaatttagacttattctgaggaaaagcacgacggcccatagtgccttcgggccggcccggcacggcccgaggcgtgttgggtcgtgcctgggccgtgagtgcagcacgtgggctggcacggcacggcccggtgcgtcggtcgggccgtgccggcccgacaagccttggcccaggcacaaacagggcctgggccgtgccgtgccgggccggtccacatggccaactatagctacagccggggctatgttgcatgtacagtgcaaacagtaaaagaaattgtgttgggcaggggtggattcaacgtgggggtgggggccttgagttcccccaccctctctggacctatggacaacccccaccctatgccctcttcaaaaatttcgccatggatgatagagtaggaggtgcgctaggtatctggatagctagaggttgaaaaagcgtgaaattgggccgatgaatgcatttgggccaggctcacttagaaaaggaatccccttaaaaaggaataaatccactttgactccctgaaatttaacccaaatttaatgcatgaccctcaaccgcaaaaccagatatcttgacccctaaactattaaaacctgtgcaatttaactcccttggcggttttgctgacgtggtgcctacgtggcaatgttgactggtatgtggcattgacgtggcgcttaggtggtatttgaattaaaaacttatatgtgggacccatttgtcattaaaaaaattttgtggggcccacatatcatcctctctttctttctctttctctccccttcggtcgtccgcacggagcacgggctggagcggcggcgggcgggaccagagtggtggtggtcagcgggagttgaagcgacagcggtgggttggagctgaagcgggtggaggcagaggagaagaaggcggcattggactacaaggtcgcacctcctcgcggtggcagaggaggaggagaaggaggcggtcccacgccatctgctcggatgtccccctggtaccctcgggccacactagtgcccagctcttggcccgccgaagctgtcaaccgccgcccccctcgatctcgttggcatcggcatcggcgctgccatcttgtcccgcctccttgccgtccctcgagcgctagctgccgctccagctccatcccaccaccgttgccgctctagctagctcccgcgtcagagagagagagagaggaaggagggagggtcgagatatccggtattgtggttaagggatacgaattagactcggtcactagttaagggagtcatagtggacttactccccttagaaaatacttctaggctgcaggcccacaggccacatctagcccccagcggcccagcccaagtttccattccccaatccccagccccaaatccctagcactagccaaggcagtgagctccccgtgcggcggcgcaagaggtgagcggcgcgggggaggcggcgaggtaacgacgagctgcgcagcggagcgcgctctggcgaggcagcaggcggaagcgtgcggcgcggcggcgggcggcggcaggtagcaggcgaagcgcgcggcgccgcgagcgcgagcagccgagcaggtgcagcagcaggccagcggcggcggcggaggctgcaggccggtgctggcgacgccacgggagcacgcgagcaagaggcaggaccaggcgagcaacaggcaggcagcagctggccaacggctgcaaaataactaaacaaggtatgtaatgcttagaattttatgcaaatatgcaatgcaactgtgattactgattacttaattggaaatttggaatgattcaatccattaacaatttagcacagtttctttctttctttttttttgtctagactagaatctcagcatgtcgaaaagaacattgttcaactattattcaagtggcagcagcagtactcctactgcatcagaggatgatgagaacacaagacaacaaaaattggcaagggtagagtttacttgcttagatattgttagtgatccaggaacgtgcaaaccaattgatgagtatccatttgagattagagatcaagtgaagagggcatttgttttaaggggtccaactcaaccagttggttatacatttccttgcaaatggcaaagtggtgaatggagatctttccaacaacgttggttggagatctatgattggttagagtatagtgaatcaaaggatgcagcattttgcttgtactgttatgttttctttgagccaggaaaacctgaaaaatttgggagtaatgtctttcaaaggttgagcgcccccccacccccccaccccaatctttcattcctggatccgcccctggtgttgggtttggtgatgctactgctgcagctgcatagccgcagtaatatctcccgatcagcccctagcttataagtctaaacaaaagaggatacaaagtgtcttagaaaatggaacagagggaacacctggtggtatacagtgatgcctagtagttaagtagcaaggatgacagtttcagtttccgaataaagtggagttcaaaattcaattacctaagcccattgggccatcttttccccgactcattcctgcatgtgtttcggcccaagtcccataaccaaaccatcaaatcgtctccgcaggcggcggcgaatcgagcggcgcggcggctgccaggcgaggccggccggtggggcgccatccagcggcagagcagcgtgctccaggctaaacctcatctctctctctctctctccgtccggcgttgtccacggcccaagcctcaaagggccacgcgcgccacgcagcgaggctaggtcaccggcgctcgctgcagcctacggtggatgcccgcgggcggcgtcctgggctggcgcggtggctgggggtcaccgttcccagttcaggtagcaagcaggtgaatcccaattttttccccactcaatttttttttgttcaattcgagatggtgaatcagtgaacgggccatttttatcctagcaagaataagttgggttaggctagaatgctagatcacttccatcctgaagaaatagaaatttgaagcaaacaagaaccnnnnnnnnnnnnnnnnnnnnnnnnnnnnnnnnnnnnnnnnnnnnnnnnnnnnnnnn

SEQ ID NO: 33654 - DNA, 632 bp, Oryza sativa
ttttttcagttaatcagtctactaattggtgggttgatgcaagggccaatgtacatgtttgtgctgacatctcattgttttcttcttatcaggtcgcacggggttccaccgtcctaatggggaataggtcacatgcttctgttcatggtgttggcacggcagatctaaagtttacttcggggaagattgtgcagctgaagaacgtgcagtatgtccctactatcgacaggaatcttgctagtggctcccgtctgactagagacggatttaagttggtttttgagtctaataaagtggtcgtgtctaaacatgaatattttattggtaaaggttatgagtgcggaggcctgttccgcttttccctttctgatttctacaataagtctgtgaaccatatttgtggcagtgtggatgatgaggctaatgtttggcattcacatttatgtcatattaattttagcttgatgtctcggctttatagcatgtgtttaatttctaagttttccattgtcaaaggttctaagtgccatagttgtgtgcaatcaaagtaatctcgcaggcctcacaaggctgctgaggagagaaacttggcacctctagaactcctacattcagatctctgtgaaatgaat

SEQ ID NO: 33655 - DNA, 6476 bp, Oryza sativa
actcctagcttggtctgcgcaccgcgcttcggctcgcactgaatccatcccgcaattagttttgtcccacctcgctgattttgcgacagagcgacctctttataaactctggttgattctgttgtgttgcctccccggagacacccacaccgactagatacagcggtaagatccccaccgtggccacggtttggcggacaccttctgctgtaaaaattaaaaatggagcagtcataaggtcccctcccgttacggggcacggcaggcgcctgccggttaggctgcatccatataaatacgttaagatgtcaaatacggcatacatacagtcgggtctcccgtggaggcagcgctagacattagcgctttgctttttgaaattttgtatgatcaaattattatttttctgttgattaattacaacagcagcaatggaggcctgcatttgaaccccctatgcgtttgaattccaatttcctttgcatttgtatttgaataccatacttaccagcttaaattatatgtggtacagactacggggaaaattagagatgtggcgatagaggagaaagcctatcatcagcaggtatgcaagaatttcctgtgaaacgaagtactgaaatactcttagcagaggtgattttttttttaaagctagagatgtgaaggatttgttcacgctgcaagacaatgacaataatgattgaactgaaacatcaaatattttcagccaattgtctgaagatgtcaataccgggattccaaatgaagcaataagatcagctatgtgcagctttggctgcgccgacaacctctgagactgagctgagctcatcctggtatggacgaagtatccaacattttgaagagtcttttttgtgctcagggattcatgtaagaaaaaaaaattatgatctctaacacaaataatttggatcaatttttgtttctgaaaagaatacccttttttctacttttctcagagtgcaatcaatcatgcggacataatgcatgctaacgattaacagaagctgcgcctagaagaagcagaagcttcacaggcggcataaagagaagctgaagcttttaaggtttatgcctatcatggagtaacaatttttctgttgctacatggattggatcattggacgagctggtgctgtggtgctgttggagcaccattctctgtctgcaaatcactgttccctgctgaactgttttaaggcctcctactaggaagatacttgttcatcctgaagtcctaatctgccaatctacaccttcataaaactgcatggtggttcattccgctcaatgggcatagctgaacatgtcaagaactcttttttttaagaacaagaaccacattctatccatggatatactgctgtttgagaacctgctgaagccaacagcaacgttgcaaggaggtgcaaatgatgcaatatgggtgctgaaacctgactaccacaaattttagctgtagctgatcggagcaaagtattgtctaggtgtaacgcgctgcaaatttgatagaggagacatgcccctaaataatactccctccgtttcgaaatatttgacaccgttgactttttagcacatatttgaccgttcgtcttattcaaaaaacttttataaaatatgtaaaattatatgtctacataaaatatatttaacaatgaatcaaatgataggaaaataattaataattacttaaattttttgaataagacgaatggtcaaacatatgctaaaaagtcaacggcgtcaaatattttgaaacggagggagtatctttttaaagtctttgggtttggcttactgattctttttgtacaaaagaaacaaatttcaaacaagagcatgttggttgactggttgtaaacacaggaaaacaaacatttttcagtggaaggcatttcttatggatttatgtggttgactcgaatttatcactggaatgcttaatgaactggcagaaccacgacaattcgttccttttaccagcttgcagtgctgtatgtgaatgaaggcatgaagcatatgaccttgtaatacccctttttttgacaaattggtccttatagaaaacttatttcgaaactagtccataccaaaaactatatctagaaataggccgtcggctcagcgccaacctctttggcactgaggttgttcgtatcagcgccaatgggactggcgttgacatcgcgccagcgtggcgggcgagacgcgacgtggcagggcctcagcgccaatgtatttggcgctgaccccttgtacaggctaattaaaaggatgcgcggccattaataagcaatgcacttgtggtgcaatggtatgatcatttgcttgtgtaccctagcaccatggttcgactccctatcacggcagccttgttcgttcttttttttttcttcaaatcttcaatctacgtgcgtacattagtacatataaatgattaatgatgctctctgttttttaaatatatataaatataaatatcagaatatatgttctacagcggcgctggcctttatactggctaaataaaagcaaaagcaaaagcaacaattaggtttggcttagctcagtggtaggtatttgaaaggtggcgttacagtgaccagggttcgaaccctctcctttatgtttttactaaacttttttttttacttagttctcaacttgcggttttaactttttcaaagctcaggtatttttaagtccattcttttatttttaaatatgtactaaatgtgttattccttttaaatattttttaaaaaagtgatatttcttttacaagttcaagtgttgttttaattttattaaaacacgtgacattttagaataaaacttacccttagttctcaacttgttgtttattttttttaaaaaaaaactcaagtttttttaaatccattcttctaatttcttttttataaaaaagtgatatttcttttaaaagttgtctctaaacttttttaatccattcttctactttttaaatttgtactaaatgtgatatttctttttaataaaaattaatttaaacaaaaaaaagtacattgaagatttgaagacaaaaacgaaaatggagatcatcactaatatgtacgcacgttgattgatgattaaaaaaaaaaacaaaaatggctgacctgggattcgaaccctagtcctaaggtacagcaagaaagaaaattaccgttgcaccacgagcgacattgttaactcattgcagcacatcggtctatttagggtgtgcaaggtgtcagtgtcaagtgcattggcgctgaggccctgccacgtcgcgcctcgcccgccacgctggcgcgatgtcagcgccagtcccgttggcgctggcgctgagccgacggcctatttctagatatagattttagtagggactagtttcaaaataagttttttgcaaggaccaatttgtcaaaaaaacggttgtaatacttgacgatttgttctgtccttatttgtcagattactagccccagcaaatttagggcaaaattttattatgcttggtttttctttgctttgagacagtgtcacgcaggcgggcgaggccgtagtccccacggccggcgaggcacagagacgacagatagaaagaaagaaatgcacagagggggtgggcacaccggtgggaagaagaaagttttttccttgttgatcagattcatttctccttgttgatcttattgaacgaattacaacttaaataagactcaatctaacaaatttccctaacgaattaatagtagaagaaagtttttttttttttttttgcaaaaaatgtatttttcaatgtgtcggacaaatatccgtttcgataacccaataaataatctcaaaaagaagggaaaaatccctatatgcacatgagtttctttttctcaatttttttatgctcttgaattttgcgtcatccattatatacccgtaagttttattttgttttcttatatacctatttgtccgtgagttgatagttagatttctctaaaatgcccttctctcatccttaaaggcaacttatttgaaaatataaatcttaatatggttttgctttaaaataaaatcaaagggaacgaaattatttgatgccaagtttgaaaattgaaacttttagccaaatttgaagaatttgattaaacacatacaggagtttcaccaagaaattaaaaaccatgatttttttgtttgggtttaaattttggtggtaatattgtccgcattccatcaattttggtctgaaatttatttaaagatttaaatttcagttgtcaaatttgtgatcaaataattctaccatctttatttattttacaaatgagtctttttttcacattgagaattttgttttcccaaataggctagcatacaagtatgagataagggcaatataggctctgtttgaaagctcgtttagcttttgcaactctatcatttgtcgtgatcacgttttccaaattgttaaacggtgcgtgttttgcaaaatcttttttacttgtaagtttatttaaaaaaaatcaaatatactcatttttaaattttataattgtcaatacttaattaatcattcactaacctcctgtcttgttttgcgtggaatatatcagtttaccgcaaacataggttggaagcagccataatcattttgaaggaaaattacaagtgaactcacgactcaaaactatttggatgaggcaaaattcatatgtatagaaaggtttgagggaaaatttatgggctaatgtttgcaaaaaagaactaagccgaagttgcctaacacgtttgaaaacaatgcattcggtgatatccagaccactaaaatatttctaacttcgaatcttgatgatagtttgtctaaatttagagtaagaatctttatattttatatttcaagatgatgtaatcattatcccattattccataacatatcctctctgtccctaaaaaacaaacctattatgaatatgtcacatcctaatagtacgagccacataagtcacaaaacatattagttttttttatatggaacagaaggagtacccccatcttcgtgcactctgaatcacaagtcaaacagaaaaaaaaagacataagaataagaaaaaagcacaccaaagttccctcaacttgtcaatgtagtcggtctaaagggttgtccaggtaggctaagaagtcggaactaccctagaatttggcttagagcaagtttaatagtatagtccactactagctccaaatcatctatagccaatataatagccaattcatacaatagttgcttgctatactattaatacctggtcccacctgtcatacacacattgtgtcttagagctcgtgctgcagctggctacagatctgtagcccgctgcacttctccctctttctttatctctttaaaatatgtttatagctggcttagggcaagttttatagtggaggtggatgtcacatctaatttagaccatatcatcttctcattaattaagaggtaacacatacaacatatcacatctaacatacaaatcctaatattagttcactctcacatcatcttgcatttttcttagagattgtgtagagtttgccccttgcatgaggggtggctcattctctctcttctaagggcaagtactatgggcatccaagcacaatctcctagataccacatgagctaaaatagtgaggtggaggagagaagagatgagagagataagcagccacctctcatgcaagaggcgcaaccactacacaaaattcaagacaaaaggagagagagggaagagtagattggacaaacaaacattggggctagtgtattagaattagtatagatgtgatatattgtacatgttacctctacatttatcagttgatgatgtgatcaagattagatgcaacatccacctcttttttaaaacttgccctaacttctctcttacacctcattatctaatcttatgtggtaaatttaggggcaatatgtaggggcttatagtacttgcccttatagcccactattgtacctgctcttaggatgcgttcggtagtagtagttcccaaccccctcttcctcgttttctgcgcgcacgtttttcgaactgctaaacggtgtgttttttcaaaaattttctatacgagagttgttttaaaaaatcatattaatctattttttaaaaaaattaataaatacttaattaatcatataataagagagactttattttacgtgcggggaggagaggttcctcccgaaccgagcctaacgagaagaccatgtatattcattttccttggcctatcaaaaaaaaaaaaaagcctggcaaaaaaaaaaaaacctatctttctctggcttctccactcactctcccggcctcccactcccgacgggcgacggcgctcccgcgagccgcgagcccgcgactccggcggccgg

SEQ ID NO: 33656 - DNA, 10329 bp, Oryza sativa
gggtttaggacaatgtcttttggtggtgactaggtgggaagtgaacgcttaataatggcatgaaactctggaggagcttgcaactacaaaacaaagtatggaatgaaaccaaatgctccattgaccattaggatgcatagtacattttggttaactgaatcttgcaattgggggcaaggacactcctagcgttgattttggggcgcatacatgttaattgagtatttgtgccaaatgccaaagggattttgggagaaaaagaagataaatgaagagataagggaaaatgtgaaggattataagatttcaatactctcaatgagctgtaatttcgttttctgaaattcttgcttgccttcagaaaattgttcaaattaccctgctaattcatatcatgtgtatagctgcgcttatcaattcttcagctttatcaggggtgtgacttaaatttagcttcacctcgtcatcaggactgcacctgaatagattgttttagtagtatacatgaggcttggattcatgttaaatactgactgaagtatgctcggcctatataatttgataacacatagataaaataagcaggagacaaatatcccttgatcgaactgtaaatggaatctttgttgtccggcgtgagaggttagagctatttgcagtttttcatcttcctggagtttgcttcattgtagtatactccattgcttgagaagctgggatctctttcttagttttagcccagacttttacttgccccaagcaagcctgcttcctaaaatcaatcaaggaataaacccttgctacttgcttgcattattcttgcaaaaagccaagcatgttcatcatataaaaataagtatagcttttcatgtatgccacattcagaggttaaccattcttgttgagcacttcctgtatgctttctcagctatgctatatttatgcagactgcaccatcatttagcatgatgtttaaccattgcgcagtttcatatttgttcaggacactcctgccaattccaacagcctttcgctcgacagttcgtgtgcggttgacctcacctgcattcttgccatcaagacgaaattttgaaggctatattcctcagagctgctcaggttcatcattgcagatctatagccagtcatccctgctatctctctcaccatcttcagctctcgtggtgtcctcccagctgaactcttcggatgttgctcagcgatcagaggaatggtttgctctccgcaaggacaagctcaccacaagcaccttcagcactgccttgggcttctgggctggcaacagacggtcagagctgtggagcgagaaagtatttggatcaacagaaatcaagttggaggatgcggcgaggtctgccatgaactggggcacggtgaatgaaagtgtagccatagagcagtacacaagcatcacccgacggtcagtgggttcccttggcttcgcagtgcacactgaggccaactttggctggctcggagcttcacctgatggtgttctagggggtgacccaaaccgtgggatcctagaagtcaagtgccccgttcaacaagggtaaagcctgagcttcgctctgccatgggcgcgctatgccatactattacatgccacaggtgcagggcctgatggaataatggccagagattgggtcgagctctactgtggactcccaccgaagcagcgttttccgagtacctagagatcgcgaatactgggagctcatccatgaagtcctgcgtgatgtctggtgggggaatgtgatgccggcccgggagctgttgttgcttggtaaggaggccgaagctagatcctttgaaccacagcccaagcacgggttgacaaacttggtgatttttagaagcagtaagcttgcttctgaagccaagttgttgtgcaaggatattggcggtcatgtagaattcttcccatgattagctctgccaatggctgcacactgtattctgattatttattctttcaatcaaaaacatttaattgcgtgactagttctcaaatcgttggtgtttttactgcggttttggagcgtataaaatgttccatgatacgtcttgtcgtagttccacatgttttctcagattttcatccttgaaacaggtggcaatgaatcaagcagacttgcagattagccaaacagaggcacaaatataatttgcttttttcccctatgtgctatagcctaactcaacgtgacgatctcaaactgaactttggtttttcttttcttttcatttgccaaatgtaattgttgagttggccttctctttttcattctctactacgcgaaacagcagaaattcactccgacaggtgttgtttgcttccaggatattcccatcatgttaccaacgaggacggccattcaccatacttgacaaattgacatgaaagcaaaagtttggttagaagtcatttatttctctgcaagtagttgtaaattacatggtagtgtgacaaatgttttcagaattacacaacatcaacattgcggcacgcatgtataaggtaaattacagcaatcctctatttgctctggtgagaccgtgagaggaggagagcagttcatcttcgatcttaacattccaagaatatcagctgctgctgcaatactgacgtaaagttcacgttgtgcttccgctcttgaacagcaatccttggaagcaaccccaaaccaaagataggaaatgatctctcacataagactaaattcaatgggatgtataacatcaaagcaatcaggaaaaactcacctctgaaatgtcaccagttagacgatagtagcgaaacaatcttttttttttcttttttttttgctgaatcaaactaactactctttttttgttctttttcttgcaagaagctaatgcagcatgtcaggatggctgcgccttcaagaataacaaactcatcgttttttttgtctgttttctcagtagaaatgatacgttaagatggcttgcatgacagcattgcacgctgttctctgttagcagaggaagagtgttcgttgggggacaaacccctatttcattgggggagacagatccttcttctcttgacaattagggcaaacccagtccaaagaaaatgactccttgaatgccaacttgtctacacaccttccacactcataacatctcagtatgcaaacagcacaacccttgaaattacctgatcttttgggtgtgtttagttcacgctaaaattagaagtttggttgaaaatggaacgatgtaacggaaaagttggaagtttgtgtgtgtaggaaagttttgatgtgatagaaaagttgaaagtttgaagaaaaaatttggaactaaactcggcctctatcatcacatccttcatctcggcaatcataaacaagtttgtagttctgacaaatagggcacatctcaatatcaggagcatatctatccatcattgcaatctgataaaaactgattagcatgaaggaatctttggcccccgattatgcacctcctgtgtcttgtcggtattcaacaaggataataactcttcgtactgctccttccgtaaactgaagagtgttccaactctgaggtgcttaattccaaacaccgcattcgtattaaatgacttgagattggaaataaggccatccaaagttaaccgtgggcagcccaaaatgctcagctgcgtgaaatattttgtgttagataaaaaaattaatcaagaggaatttctattaagctagaaggcagaatagacaaatatgtatttacaattagaatgtcaaactgacaaacatgtaaatataaatatcaaaggtgttcacaaaactgatggcagaaggtttcttaagtgatgctccaactatgaaaaaactaaaacaacataacaacttaaacaaatcgcagtgcataacttcgctaggtgctcttcagcaactttgcaccatcatgttacatgtcatataaaacaaagttcaatttatttgaaatcatatgcaaattgcggtcagctaatcaaagtactaatgcaaatatctgtaagcactattcagattcgcttttatttattactcaaaaaaacatctaatcaacagctcttgcagacctcgcataattggctcatctaattagtttcactttgagaatattatctagcaggcatacagataagtgaataatatcttaagtcttaatcttaagtaattaaaagattgatatttttccaatcgtcacatcttttcaccagcgttgtttcgtccgtcaccaccgcgttattcgatttatccggcgctatttttcccaccgaatccgatttctaatctgatctgctatccaatccccaaatcaattaatcaacgagacaaccaaaaacagcacgaaaaagaccaaatttaatctagagctcacgaatttgatcccaagaaacctaattaatccccatggattagcagcaatatcacatcacgaggtaatgaatcaaacacattagcgcggatcaggctgaactcaattaccatgccaccgtcgttatcgtcatcctcctggatctgccatcatctccctcgagccccagtccccgccgccaccgtctcccagattcgacaaaaggaacgaagaggccaaggacgaggaggagagggagggggagggacgccatctctgcgccgtacccccactgtcgccgccatctccgcgctgaggcttccgtggctgtgccctcgccatcgctgcatccggtaggagacaggagctcgcagtctcgcaccatcgccaccgcgccacgtgtgccacaccctcccccacccgccatgacgagcgcctccgagctcttcaccacccgccgcacccgtgaggcccgcctctcctcccacagacgcgctccgtgacccgcacggcctcgcagatcgccatcaattggtgatcttttggtggcaatattgtctgcattccatcaattttggtctgaaatttatttaaaaatttaaatttcagttgtcaaatttgtgatcaaataattctatcatgcaaatgagtgtttttttttcgcattgagaattttgttttcccaaataggctagcatataagtatgaaataagggcaatataggctcagttcgaaagttcgtttagcttttgcaattctatcatttatcgtgatcacgttttccaaattattaaatggtgtgtgtttgcaaaacctttttacatataagtttattttaaaaaatgaaatatactcattttcaattttataattgttaatatctaattaattattcactaataacctcctaccttgtttcgtgtggaacatatcagtttattccaaacataggttggaatgcagcccaaagaaaattataagtcaactctttttcacaaacacacaaaagaattacacgtcaatatattagtacaagtcaactcatgatcaaaactatttggatgaggcaaaaatcatatgtatagcaaggtttgagagaaaaattatgggctaatgtttaaaaaagaactaagccgaagttgcctaacacatttgaaaacaatgctagtggtgatatccataccactaaaatatctctaacttcgaatcttgatgagcgcttgtctaaatttagagttaaaatatatttataatttatatttcaagatgaatgtagcattattccattactccatacaacataacctctccatcatgtaaaaaaacctagtacaaatacgacgaattaaatttgaaaatatactgttcatccaagtttttttttagaaatataccgtcgatctcgcacaaccattacgcgaaaatgacatagatgtgacgtcgcggacggtattgcgcggtctcgcggaacggaacagtctcgctgaaccaatcagcgacaccgtctaacggctccatttgattagtgattaactacctaattaactattaactaataataaaagtgattaattatcctaattagcgactaattaataattagttaattgactaatcaggataattaattactaattaaatcggcatgacaccggtatcgctgtttggttcactttcgttccataagaccgcacggtctcacacttttactttgtgaccatccgcgacgtcacgctcacatcattttcgcacaacggttgtacgagatcgacagtatattttcgtaaaaaattgtgcatctcaaatattctaaaaaaatttcaatgaacagttttttaaaatttaattctaaatatgacacatcctccgattacaagtcacaaatagttttttttaatggaaggagcgatgtgcactcttaacagatcacaagtcaaacagaaaaagaaaagcataaatgaataaccatgaaccgttgttttgaaaaaaaaaaagcagcccagatgcgaactggacctcatacttcatcgatcccctcccgacctccgtcgagggcgccgcttcccgacgtccaatggcgagcagccggctctcgatccggcgggcgtagtctcggcgacggcagcgggaaacttcagctccggccagatcgacggcgccctcgccgccggtttccgatggggccaggtatgcccgcctgcctctactcctagctcggtccgtgcgctgcgcttcggcgccgatcgatcccagtaactcgttttatcccacatcgccgattctgatcaagcgcgacctctttataaggtcggttcgactctactccatcgcctccccaagggcacccaccccgaccgaatacagcgaaaagatcccaaatgtgggcatcggctgggcgtgtatccccttccggttataataatggctgtaaaaaaaaaaagaaaaggagcagtgaaaagatcccctccaatacggcaacggtaagttgtcaaatacggcatatacatgcagtcgggcctctggtggaggcagcgctagacactagtgcttagcttttttttaattccttgtcttatgccaagagaagcttaaataaggtgaatttgaatgaaattcttttttctgttgaatcgtttttcaattccttgtcttaagccaagagaagcttaaataaagtcttaaaacattaaagatagggtaggagaggagaggagatacattgctgttttgatatgcccttactgctagcaatttggccttaagacgcaaaacttctaaccgactgcatttccaagtttccactagatacctgtcagagatgacttggcacatgaataattttgtatcgtactctgcagatactatggttagcatagtataagtaatgccttgtcatttaatcaccgaattttggcttatatataattctatttttaatagtatttttttctgtaaaatgtgcgtttgtatctgaattatcatattaccatacttaacagattaaattctctgcgggttaggcttgcgaagtgcacagagaattcagcaagctacacctgaggagatcttttaaagctagagacatgatgaatttttcacgctgcaagtctatgacagtaaagatttggctggaacatccaatattttcagccgattgtctgaagatgtgattaccaaggttgcaaagcagcaagatcaggtatgtgcagagttgcagacaaccgctgagagcctgagactgaactgaatttgtccaggcatggaaacggaaataatagaccatagcagcatagttctgattaggtagatgaagaatccagcattttgaagagtcttttatgttgctcagggattcatgtaagcaataatttctgatccttaagtcaaatgattttcctcgatttttgtttgtaaaaatgactgtccttttttaattttctcagagtacataaatatgctggaggaaatagcactgtcgcaaagaggcttaaaagctgaaacatggatgctgaagaataactgccaataattttagctgaagctgaccatagcaatgtttggttagtatagcatacagcaaacgttaatttcattcagataagacatgcaaatttgatttatgggaaatgtctcccatgtctttttaaaaccttctggtatggctagctggttcttttgtaggaaagaaacaaatctgaaacaagaacatgtagttgacatgttgtacatactggaatacaaacatttggtattgactagaggactgcaacaattcgttctttcccaactttcattgccatatatgtattgaagcatgtcctggtaatacttccttcacaattcgttctttctcatttgtcagattatgagccccaacaaatttggtgcaaagtttgttatgggaacctggtatagagtgtacacgtgaaaaaggtatgacaacagaatgattaactgatcattcttaatttgttatttgctttgagatagcaagaagtaactgaactcaacacttggacttgatattaggcatacattatctgactagtaccagcattgtaatttcatttttctgattgcccatgcaggaacttattattcaattttgacgtttcgtttgtttgtttcaaccattttgtacagttcatccctgcctacataagtcttctccatgtttatctaaaatgggaaaaaaaaattctccatgtttgtattttacagctttcacatgtagcgtcaattctttagcaaacattttgctctgcacctcaatcagttgggcttgaatttctctcataaatcgattatgtaatggttatgaattgcacttccaattacatgcagtacctgtccaggctgttgatataattgcctccataaatcgatccttagtattttttgtttcgggtctttgctcttatgcagaagtagtgaatttttaattcccatatactatgctatccttcttcgaacatcagtgctagggttttttttttttttttttttttttttttttttttttttgcggggaatcagtgctaggtatttgtcaactactgctaaatatgtggtaaatgttgtttgctaattggtatcctgatgtttttatcatggaaatatagctggacttggttgtttactgtatacgaggagaaccatttggattgaggcaaggtgatccattatcaccatatttgttgctctgtgctgaaggctttctgctgtattactgaaggcagagaatgaaggaagaattggcagggttaaaatttgcccaggagcaccaagcatctctcacctgctgttgccgatgattctttaattctgattcgtgcaaatggggaggatgcaatgcaattgcaaggaattctccaattatatgagttgtcttcagggcgaatgatatgagtcagctgtaattttcaacaagaacactagggatcagaagagaagcgaggtgatgcaaacgttgcacataacaaagggaacacaaaatgagaaatatctggggcttccaatgtatattagaaaatctagagctgaagctcttgagtatctaaaagataagagtctggcaaagaattcacaggtgaaaggagattatgatcaaagctgctcaagctatccctatctacaccatggcatattttgatttgacaaaggtgaccagataagcactctcatttctaggtattggtggatccagcaagagaaggagaaaaaaaacgcattggatcagttgggataaactgaaaaaggcaaagaaacaagatggcctgggttttagagacatttatgctaagatccttgcaaaatttctaatcgacttgccgagtttggattggatgctagtgacagatgacctggcatatgaatggtttggatcatacccaaatgtaaagccttgctatttattaatttccggtttacacgtgattttattttcagtagtaaatttctctgcaaattttcatttgtatctaataaccataccagattaaatcatctgttgagtaggctagggaatgtgcatggaaaactgggaaaactagagatgtaccgatagaggacaaagtctatcatcggcagatatgtaaacatttcctgagaaacctagtactgattctattgtcctctaccaaatttttgggcaggctacatgccttcgtgaacaaatcaatatagccttggcttacttattttatcttgtaaccgcgcgctaaaaccaaacaaccgcattaccaatttgagcacaaacaaaaattcctttagaaaaaaaagaaaagaaaacaaaaagaggcgtggactgggcctgcagcagcttgggcttgatgcccaggcgtgaagagagaagcccagcccgtggcttacatcgacacttgtgattcgatgggacgatggacgatgggaaccctcgatctccccctcacctt

SEQ ID NO: 33657 - DNA, 23110 bp, Oryza sativa
  unsure (1)..(23110): unsure at all n locations
aagcttaacaggtggcacaaacggcagttgaagcttgactccaattagaagtcatgatagtttttctgttgctacttggactggaagagctggtgtgccagggcaccatcctctgtgttcttgaagtttaagtcaacacctcaataggcactggtttaatgagctcttctcagccatcacaaacttcgaatagcagggccaaagtctgacaaacttttagttaggatacctggaatgtgaggagctgcttcagatgcacttgaacttccctttgcaattcgctacaaagaaaaagataaagaggatctggaacatcagctcaacctgggactggcttccaatcacacaccaagttcatcatagaaaggccatgcatcaagctcttctactaggaacattattattcagtctcagtcctaattcgccaatgtgcaccttcagtcttgagccagctctgcaagcaataactgaacatttaaagaactgcattttgtgcagcgatatggtgcggtttcagaatctgttgaaggaaatagcagtgttgtaaagatgcacaaatggtgcaacatgggtgctcaaacctgactaccggtaattttagctgtagctgattggagcaatatttttgctaggtctggtgtactgcataatttagtttcattcagataggacatgcaaattgggaaagggaaaatgtctccaacatccttttgaaaccttttggtatggctgactgattcttttcgtaagaaagaaacaaattaaaaaagcagaaatttgtcaccagaagacattttttctcgatttttctagctgactcaaatgatcggtggcaagttttttttttccccaaaacaaattggtggggaggactgacaattttcgtccttccccaacttttcagtgttacatttgttttgaagcatgagctggtaatacttccttcacaattcgttgtttgtttcctcatttgtcagaatcagttccaagaaatttggtgcaaaatttcttatgagaactcagatggtattctgaaagaaagcatgggatgtgctcaaacagcaatatttactgatcatgcttaatttgtctttgctttgagtgaaatcactacttgactaagaccaacattttactttagaggttaaaattttgtcttgattgcccatgcagaaccttattattcagctttgacgtctcatttgctaatttcagccatttctacaattaatccctagttagctagatatgtcctccccatgtcttttaattttacagtttcctaatgctatatagcctctaccatcttgtctagcgccaattctgcagccaaactttgttctgcacttcaattagttgggcttaaattgctctcatattatgtaaatttgcaagcagttcttgttgagattgacgccattgcttccatgaataattcctctgatgtcataacttcacgtagtgctccctgtagtgtttatgggtctcatgtcactgcttttatgtagtggatcttttagttcccatacgctaatatgatgaggtttcctcctttgaacatcatatgctagatacagttaagacccttacagatagtaattttctatgccatctaacatttacctgtgttgctactagtctccctctggttttcttgtacaccaaagaaatgcttgtcatttacactaatgttgttgtcttattgacctcctatgttgcagttaatgtgtttatctgcaccttggacggcagaggggaacctctctatttagacctgaagagtcattgcaaagagtcattactggacagtcttatttggtagaaggagaatggcctcatgcaagaagagtgttctctttgttgtctctgaacctgcctgtctaggatgcccatcttggtacccagttggcaccttgcaaggacgttgcaatattgtttggaaaacaacctcatcattctcaaatattttgcaatgtagtgtatgcatgcagcaaggtatgccattctctacttctgttccatcttgtcttttcccttttccagagtaattaaatggagtagatagaacatcagattagatatttcagaagatttattcatgatgggcatccctaatatatcaaccggaatagatggttttatttatgactgggttattttttccattcatggttttttgaaattttatttgatgtataaacattactcatactatccttttcttttctctgttcagatggacacaacacaaatcgatgaaaccagcctcagtgagagtccgagctggccgagggtcagcctccaaattaaaaaaatatttttttcctggtctttggaatgccaagacgatggagatgcaggcaatcctgaccgttcattttttcacgtgtcagcacaggagccctctagattgggccggtgttttccgttaccagtgcctttcagctcatgggccacggccagcaattgttccaactgccacttttggggcccattccgttgggtgcgtgcccaaggtgatccggacatgtgggcccctctcgtggtagaaacccttgaacaaccgatcaagatcagctcaaaatcgaatcagcatgggaacaaaggaagagagatgcatggatgtagtttaatttgctcctaatcttatcttagccacgtagcatgtgtacggtttgatgtgtgtccacagatgggagaatttactaatcataaaacatgaagtggtaccgattgcctctataaaattatggggaaaattccaaatacctctaaaagtcactcatatttctaatctctccccgacaaattattttggtacaaaacactccacacaagttcattttctctttcaacttttcacctctatccagttttcagcaatttctcatgccttatgggtctcccattaagttgcctcttgacaccaaagctacttttcattttgtttttgcttttgcatgctttaatttcaccaaagatacggcgataaaacatgacaatgacctcaaattattagataaggcgtattaaatcttatgtccaataagagagaacatagggtcttaattcgctcaccatatgctagagaaatcgctaaggagtgcgatgagaatcactaaaaactagatagaggagggaagttacaaaactaatttgtaggggagattgaaaaggtgcgttatttggatttttccctaaagttattatcctaaacctcggcaataccttctgaaacaaaattttgaagtggaacaataaattagtattcctttgaaacacaagaacgtcttttcaaaaaaagaaagttcatggaaaattagttcaattcttgtaggaatcctacaaatatactctgttcaaaaagaggcttactcttataaaagaaactacatacttagcactgcatggaaatgtcacataattttacaattgacatcgaaattttaaaattatgccgcatcctaaaatcaaatcagcatggaaaaagagatcgatgcatgcatggatgtaattttgtgtgtaatcttatcttagagcatctctttaagagtatactaaaatttgacactagaaattcttgatttgggccatccttaaaagaattagaccaacaaatcaccctctccgccaacagtaatcctaaatttggttttaagtgagtcctcctttaaactgtttctgttttttttttccttgcgagggagagatcattgctaccaagcggatcgaacgatagtggctgaatcgacaccaggagtgccgatacgtgcccaatatttggctcggtaaggcatcgatgttaagcgtgagtacaaaattagagagcttatgggtattttattgaaggcctagattgtgacttaattcctaaagttaagctttaggagccatgtatacggccatacggaactcttggagttggagatgctctggtactagcacggtgtccacatgtagggcaagcttcacatttctatgtgaaagaggaggtgtactcaaaagtgataccttgctcgttaatataaaattatttttattcttataaaagagagcagtgatgatggtgagtgatgaatctgccatagcttgcaccaccaactccatactatttgaaaaagaaaaatgacaagtaggaccaaagggtccacgtgtcaaccacctccactatcaattcattacattttattaaaagaaaaaagaatagtctgagggtatgaaggatcacatgttagtaacaaatacatatatagagaaattaagaaatgatgtatgaaggaaatgatggtaataatgggttgataataatcttctttaattaaaatcccgttgcatcgtagggacaatatgaatatgctagtagtagaaaaaactaaaatctttttgcagtaatttgtagagttttcacgcaaatcagttaaactctctcatagaaaccctttccatagtagacttggttttttgacgaaactatacattcagtgatgcatatagaggttaagagtggtcttaaaataactgtgtattatcttgatgtaattatttaatactagtaaaaaatttcctttttctttcaaacaaaaaagttagtgctgcataggagtttaatgaattttcaaaagaaacaatctgagccatacagaaattgtaaaattatgccctacaattccaaaggacttgtgcctttttttcagctagtgtcctagtgtcgtacgtcctgccccacctgagtggaagcaagtgaaagtcgacgtggagaaacctatccaaacaattaggactatccatcattcaggatagccttccgatcgagcagcatcgagatggagatggagaggtgcacggcacaccaaacacatctttgctttgcttgcagctacagtactgctacatactgacagcgatcagcgatggcaattagcaggcactataatcacgaaatagtcgtgctagtttaatttggaggggggcctgtcatactgtacatgtataattaagccgtctccatccaaattgtatttatttattggaatttgttgctctcttaatcgaaagtttcagtttcacatttttgggatcgtcgagtccataagttggtttatcatttcctctaagattttagaaaaaaaattataatttatatttcttactcttttttttttgtcagatttcggtgatttgtttggagggactataagagcaagtttaatagtatagccaactaatagcttcaattcatctatagccaatctaatatcccatccatacaatagttatatactacactattaatatctggtcccacctgtcatacacacactgcgtcttagagtccgtactacagctggctacaaatctgtagtccgctgctctcctctctctttatttatctctttaaaatatgtttgcagctggcttatagcctgctattgtacctgctctaagggcttcatgcagcactgaggagaaaagaaattgttcggtgcttgatttgggtgatttattcggagaaaaagaaattgttcatggggccatgtctacgtgggtacacgcatgactccaggttatctggtcgtcacagttgatcgaatggtcatgatccggtggatccctcaacatgttggtacccatgctcttgtttggttaattgtgcattaagaggtacgatggactccctgcatctatgtgcattattgtcctccttaatgagacactagggccactgcacttttaattaatttttcaaattttatttgagtaagagaaagatcaaggtcaacaggaggaccctcttgcactgatattatgattttttccccctcataaacacgcatgcgttactcagccctacgaacacacatacgtccccttattcttatgagtagtgcattcgaaagattagaccgatataaataaatgagataaatctattttatactactgaatttgtctgaatttaataatttgccactgatattatttctttctataatataccagtgacttttttatcaattattctacgatacggtattgggttaggcctttttttcaaaaatacctaaaaatatccttatgcacacacaagatttacaatttaattatctcattagaagtctaaaaaatatgaaaatttttatatggccttcttatacaacatgtaagttcgtatataagtttttaagtttttgcatttcttttcttttttttactccctccattccaaaatataaggcacaaccaccctaagcccaaagattaagaaataattattatcacctcatagtttagattaatcaaataaatgtaatgcatgcacccaataaaattagagatcttgatagtggataatttaaataataatattttagtggagaatatgtgttaattaatggcatgcatgtatgtatgccttatattatggaacatctctaaaaagtagttgtgccttatattatggaataaagggagtaaaatataacatggaggttgagagttcgaatcattcaaagctcactctttcggatctattttttctctctttttgcagtgcttgtccactcttttacttcttctttttcagttttgtgtggcttttttttctttaattcttgtaataatcctaggtataacatgaattttttttcttaatatatcgtgcaaatattttttttccactagttacatgttgaaaactcaactatttagtaggaattatttggccccctcttgaaattggctcaagctctgcaaccgcgagcatacatgtcaaatctaatctatcacaagaacaaccacgtggaaaaattaggatggaatcacccttgtaaagtgtatagaaaatacaactgagagtgggcatcaattccatctgaattggaagaggcattgatgaacaaactaaagcacatctgcatgattgtgaattcttttctttaagaaacagggtaatatataaagcagatttgtataattgtagaacaaaataaagctaaaactattttatctggactttaaaaccagccagaaataagagatatatatggtttaccccatggataacctcggcaaaataattgctgattccttgtcgtccaaaaaaagaggggtcgttttagatgattatccaaaatttgtaatgcaaaatcttgaggacatatacagactctaattgtaatacacatggaaataatgggaatcatatattagttatacatcgatatggttgggctctgtggttgtgtaggaatgatatgatttttgacaaatcaccatatgctacatatatgcaggtaattttcagggcaacctattggcttccgttttgggcacaactataaaggtgtgatgaagacggtgagcttttaaaagctgcatgtcgtaagcttgagacgacggttatgcagctttttgccaatcatggatgaaaattcacaaatagacttcaataatgtgttctcccgatattgttttggttaaatttacctttgtgtggtcatttcttctatcatttctgaactacactcgttttagagtgctagattgtaataatagactgtagctctctttgagcaaaggccgagatgactatttcattatctaaaaaaagttatacagcgatatacatatattgcaagacaaatccaacattattactccggggtggccagagtatataactttgcatagatgtacttgattcctccctcccctcccacaaacacttgtttccttgcaattatatatccgacaaattagtagtgggaagaaatatgattatggtgtttctcattaatactctttgttgtatttttcgtgttcccatcagatacatgtcttggaccccgtttgatagtgagtttagagtgtcaactttatcctttcttgttagcactttctaaattattaaaacgtatgttttcggtaaaaaatatatatatataaggtttcgtttaaaaaattaaataaacccatttttcatgtttataatacttaataaattatacgctaatggtttgtgttattttacgtacggcgaaaaatccttgcttaacctcggtaccaaacttagcctgctctgttcgctgctggaggttcccaactaggaacagtgcgcacggaaagcagagcggtccattagcgcgtgattaattaagtattagccaatttttttaataaaatggatcaatatgattttttaaacaacttttgtataaaaacttttaaaaaaaacaccgtttagcagtttgggaagcgtatgcgtggaaaacgaggcgaagggagttgggaacgagcacttacgaacagagccttagagtaggtacaatagcaggctataagccagctgcaaatatattttaatgagataaataagaagagagaagagcaacgagctatagatttgtagctagctgtagcacggactccaagacgcagtgtgcgtatgacaggtaggaccaggtattaatagtatagtatgtactattgtataaatgagctattagattggctatagatgaattggagctagtagttggctatactattaaactgctcttagtctgagtggttataacccttagaaatcaagttttggccggataaattttggacactacaaatcaagactttgcgagatatttaaccatttgccacatttagatgtggcaattaactttttgccaatggacccacatgtcatagacacatgtggacccacatgtcattgagatagggatggcaaatagttatttgccaaatctaaaagtggcaaatagttaaaagccccagactttgcagcttccatcaagtattatattagtggtcaaagaatgaaaaggttgacagaacattcatttgtgacggtgcatagagtataaattaaggtcgttggaatgttccatgcatcttcaaaactaacctggacaacagctgcaaagatgacccatgtgctaaccaatttggcagtaatgtgcactatacatatacttctcgtataggtttgaatgcagtacttgtttgcctatccaaaaagcgattagtgcaggagttgtgctgtagattgatctttatggacatatacgcacatacagcatggagctagctttgctaatagcaaggcaatcaggcattatggaagaagcccaatgattaggcacaaaaatctctgattgaatgatcttcctggtggcacgcagtagacagagtacatgtacacacatgcataatgcagggttgttatgttggagcttagctttggtgctgtccatttaattatttgctgttagttggtgatgatctcgcgatcgagagctacatgggaaagtggttgcgatatgatgcatacacatatcgctagcttagctcgtttttccttttatatgaaactgatgaaacatgaagattaagttgatgcacataaaacgagaaaacctttaacacatagttaatgagtttttaattattataaacttgataaatatatatatttaatattttaaaggaacatctatataaaatgtttaaaaaaacgtactaaaagctagctgctcccttttggccgaatttagcctgttaatttgcagtctgcgctggaaattaaaccgcgggcaatgatacatgtgcggtgtgcattgatatgatgatgcagctagctagcccgtctctcgcttttgattttgcagtggaaaatcggttaggtacacgacgcggtgccggtgcgcgcgcgcgcgcgcgttttcaacgggctcaccagcaaccgtagccgcgcgcgcgcgagagagagaccacgggagggagacagtgcggcggcgacgcgcgtacgcgtacagcagcaacagcatggcacacgtacaggctgtttcctcgctgcgctgcatacaccgcgccgcgccgcgccgcgtccaccggcgcgcggagcgtatgcatgttccggggacaacgcgtcccacacagcacatgggctcgatcgctctaagctgcagtacaccgcatatctgtatgcgccgtcaagaacctgaacctgatgcgtatatactgtccttcccttttcaaaattggaagcaaaacatgcacaaattaacaatgtgatgcatggctagctagacaatggctgagtttagatccaaagtttggatccaaacttcagtacttttccatcacatcaacctgtcatacacacccaacttttcagtcacatcatctctaattttaatcaaaatccaaactttggatccaactaaacacagccaatgtgtgcatgacgaacataggctcgatcgggcattgatttctctcaccacagacatatcgggcaatcgaaaagtgatcaatggctatagccttccgcccttcccggacgcacacgtataccgaaccaaactgggggacggttggtaggtcaacaccagcagacggcctgacggacatgcacagaaacccggcctctcagtctcaggatgtgcgtgtcgcaccaaccaaacctcgcgagaatcacatgcattttcgcaattgggcgcggtgaagtgtgcacggccatccggctgatctgccaaaaaattccattggccgaacaaacctgtcacagacagctctagacagtagtaacgtctgaaacaagggacaggtatacccaatgccatatggagaacccgtgaacgtcggctggtctcttcctggagcccgtgcctgtcacggggggcccagctagctagtgctatccattcccatacatgctgccacatgtactgtgttctcttttcatgggcgtcgtgcatgatgaaatcatgcgtatcccactgcaccggtcctgcgccaccaccaagttctgatcaggaattaagccgatcatgcttgatttagtggatgattaaaatgtactactcccaccgtcctaaaatgtagctatttctagcacagtgtcttgtcctaaaataaagttatttcttcacctacctcctcctctcaaccaatcacgaccattcttcttcacctactttctcttttcaaccaatcacacacttcctccaattattctcacctactttcttaatacctatgccaacctcaaaaatagctttattttgggacggaggaagtacaagcttaattttattgaaagaaaagaaaatggtgggtgtacatgtagctgcgcgccaggtgtttctcccccctttcttttttcataaaagttgtttttctttttaggtgctaagcgatttcattcaagaagagaaacgttcaggggttttccggctagcttcacaaggtggtgggctacacgacctggattcgaaacttctaattatttgatactaggtcattccttaatatttgcgtatttttttatttcattcaaggaaagaagagtgattttacagttgtttatgagcttccatattttttagcgtaaaatttagatttttcagtatcttcaatactagaaggtatgaaaatttgcattaaaaattttagtacctccagatattagaaggtacgtaaatttccactaaaaattttagtgtctcttaagtacttaaaaatttctcaaggaacaaagatcatattaacccccatttgaatttttgcttcaaatactttcatattcaacacccgaactcttttgatcggatgaattacaacttgattcgaatttaggacagttttaatccaacgtgatgcatatgtgtaatgggccttccagctaggcatccgcgtgctacttcctcctcctcctcgtctactcgattccctcctttctcctatatatgtttccggtgccaagatactggtctattcaaggctacaacccaatttgcagcatgtgaagtcgcctcgtccactgcagaagaagagggctagggagcagtggtgatggcagccatagagcagcgatggttaaatcgtggaggctgtcccttttctttgacaagtggtgcatggcctgatgcaactatattttgtgagtttttgaatcgaagagagtggtctgaaactctgaatggagcagcccgtggacaaagaggtcttacatagtgaacatttttacgcgtgttcctcggtgaataaattaaacaaagacgaacacttagatggactgactatgtaaattaggttaattaattacaaaaggtgcaccacttaagcacccctcatatgaaaacaaactatttacaatgtacatgtcgaccacttaagtcacttgtttacgaaaatgtgttttctcatatggttcatcttatatgccgttgtttcgctttatgattcgcctatatgggtatcttcaaaatgaatattttaagtagcgatagtcgattgtaattaaaagcgttgcttgttcgagtactagctagtggtaactaaggccaaagaaactcgatcaagctgaagttctttatgttttcaaagagaagatcgataaagaaaaaaaaaacagcaagtaaaggttagctccaaactgtgcactgcattgcccactggcgcatgcatgggaaggcacaccgctactaatatgatgatacctaggctgcatcatgttgaattttttttttgcaagacatctagttgctggattttgaggagtacggttgtgttcgcttttgctgaagataaagacaaacttatgatacgtaaaaatagaaaaacattatgatatgattgattgagttttaattattataattaaacatgagagaaaaatatatattattttaaagaaactttcatatataaagttttcttatgaagtacatcgtagataaaatttgtagcttaatcataaataaagggaccaagcacactacatgatagatttttctggacaccgcccccttttgttttcaagtggtcgtaagtggaaccgtacggaaaaataaggggagcggtgcggggctgtcgcccgcatgggaaaatcgattttcccgtgcgagcctcctaatccgaccgcatgggataatcatcattatcccgtgtggttgatttaagtggatcgcacggaaaaatcgattttcccgtgcggcctttttaagtgaaccgcacaggaaaatacctccctcttttccctcccatccacttcaaatttttcacatcctctctcttactttttttcttttattctccctcaactaccccccctctctctctaccttatctctttcccctcagtcaactccctccacaccttccactcctccccccttccctctgtcaggctggcaaggcggcgagccgggcgcggcgacggccgggtaaggcggcgggccggcgcggtggcgagccgggcccggcggcgagcgggagaggcggcgagcagggcgcggtgatcaccgagctggcgagtcagcgagccaggcgcggtgacggtcgggcgcaccggcggacctcctcatggtgatcgtccacgtcgtgcacgtcgaccgctgcctcccttcctatgcaacgacgagcaggtggggccccgcccagatctggcgggcaacggctattttcatgttttttttggttgttttttttcgtgcgggtggcataagacaaccgtacgggataatcaattatcccgtgcggtcgtcgggtcgcccgtatgtgaaaatgccgattttcctagacgccgggctacagttgggccggacaaccgtataaaacgtccgcataggaaaataggtattgtagtagtgaagtacgcacctctctaatgatctaatcctgtggtagctacacaacagatgttgcggtgtgtcgatcgcggctggcgatcgacttggtaacctcccctgcaggggcatgcagagccgggcacacatgtatacacaaccgcatacatgcacgtacgattgacgctgaggcatattatcggcgacaccctagctaccgccatgcatccatatcacgcatatatattgatcgactacgtatgcatagctaattaatagctagtctcgtcgccggcaaccgaactcatcatcacatcatatcgtcagctcagctgcgtatacatacgtacacgtacatctcatgacctattgatcgatcgagcgtagtagtacgtaggctgctacacactcctgctcctgcttgtacatatgcgtgtgtaccgtgtacgcggttgttgggtcaaaagccaagagcgacggcgcaacggcgaatcggcgatcctgcagccggcccgactggagtgctgatcagcttgtacatgatgtgtgcatgccgcccgccgatcgatcgagggcaacgcgcaaaccaccacaggtcgacgcatccatatatatccatttgcacgcatgcacgcatgcacatgttcccatctgcctatatgtccatgcaaaaacttggacctcatcatatcgaagatcatatacagtcgtaaatctgaaatgctcattttctttttttgaccgtttgggaatagaaaacagggacatatcccgcgaaatccatcaaatgaaaaaaaattaactcgtaaaaaccagatctaaaattcactaaatttatgagaaaattactgcaaacagatttaggcataaactacattctcaccaaatctcagatgcaataacttacttgaaagtaaaatataaaaaaaatgagtgaatagtactatatgttcacgtaaaatttgtctttttaatttctgtaaaatgaagctgattttagatttgagatttggtatggatgaatttcatgcctatatctatctctagtaattttttttataatttttttatgaatttttagaaaactttcagacatggtttttcatggttttttaattatttaatggttttcacttgataattccccccccccccccagaaaacagtgatgtggtggtagaattataggtgcatcactccacccaccagggttcaaatcctgatgcccacgaatagctttcaaacggattttagtggagattaaggatgtgccactgatttccatctcttagatcatgtactagaagacacattcgtagaaatatgagtgtgttgttgcatgtatagtggtgtgtgtatgtgtgggtgtgcgtatgcgtctaccgtgtaattaaaaaaaaagaagaaaacagtcatttattagactctggcattcaatttagactctgcgataaaatatggatggatcagattgtgtgcaactgcgtgcattggatcttgattcgtgaaattgacactgcatgccctcacatttatgttgtcaaaacatatccaccttccgatggaatcgttcctagctatcgcggccgggctgttaatttagactgatcgacatcgatagactccaatctgaagctaaccacacacccaccagctaattaatccagattcgcctcctgattaatcaatcgatcgctcatcgatcctctcatggtcatgggcggcctgaccggtttgatttgatccctgaagcagaaagcctaaccaattactacaccacgtaggagtactcaccaactaacaccaataattagcacccaattagtaatcgtcccttcttttcacaaaactttattattgtagcacttacatttttatcaaaatactccctccgttccaaattaatttacatatagtttttttaagtttttcctaaatgatctacatatttgtgttcattcattagatctatttgttatttgtgcgttggagtaaatggatattgatgtatgcatccatgcacacaagcatttataactcacatacaatatcttgatttgctattggctagaaaatagtggggatggtgcatacattgagtttgttgctagagtaaatatagtatgagggcattcccaacccaatgactaggatggtgtccatagcattaaataagttgccacctaggaaaaaaaatgatgtggcaagtgaataaatgaggaaaaagaagaaaaccatgtcttgcatgagacatggtttctacacaacatccaagacattatgtgagataagtagcgttaaattgaagtatggaatagtggtgtttgcattggaagagtagtgtctagtactagtttcttgatgatgtggagtttatggaaaccatgtctagtgttatgggttgggactgccctgagagagttactccatccgtttcaaaatatagggcgcaactactttttaaaggtgtttcataatataaagcgtgcatgcattcatgacaattaataagcatctcttctctcctaaattattattttttaaatcatacactcataagatgtttaattctattgggtgcatgtattgtattggttggattgattcaaacaaagaagtgataataattgtttcttggtctttgggttaagagtggttgtgccttatattttagaatggatggagtattagcttttcttggtcttggtgtacctatgaaatatgtagatcaatttgatctaattttagagttgacattatacttttacccttcatcaataatgcagccatgcacaattgatattagacgttgagttgttaattaataaggggtgtgtttagtttcacgccaaaattagaagtttgttgaaattggaatgatgtgacggaaaagttggaagtttgtgtgtgtagagaagttttaatgtaatggataagttgaaagtttgaagaaaaattttggaactaaactcggccaatagttgatgatgttttaggaaataattggaatgcagttaaggaggataataacgatataattttgctcatctttttatttggtgtaaaatttcctaaaatgataaatgataatctaaaacggagggagtagtagctagcttaagaccactattttcttcaattagttaagtgaaaaatgcacatatgcacacgcatacacctatgattgtgtcctaatacatcttaaaattttgagaaatttcatggtcgttaagaaagtttgttgaggtagttaaattttacactaagatttttttttacctcaagatactacctaattatagctggaggtactaagttttacacttgaaaaatgtggtacatcttagtaccttttcaaggatataaaactaccctaaaattaaaaaaaaaaggtgtacatgagtaaatatccaaaatcactaattagattcaaatggaaagtgtcacctcatgtttgtaatatttaattatgagcgtcaggacttaaaccgaccattctaaattacagccagtaccatgctctttacttgtagctagtaaaaaataattaatcaggcgtttcccttcttttgcacttgaagtgtcctcatcttggctagcgaatccaaattatcaattcgcactgtacatatatatccccgcgattgctaccttgtaattgcacccctgtcctttgttaactattaacacttcgggctagtacattaatcagttgttagtacatcaattaagctaaaagctagctcttcgtagattataatatatattttgagccataaatgcagattttagctaggctttatttttaaatttgactcccttgcttaaaccacacacaatatctagtgccatctggctacgtagccaacaacgaacttgtttagtaaagcgccgcgtcccaaaatatgccggattattattatatatatatattgcaaaaagtagctaacctgatctgtgtcggcgactgtaacgcgtcaccaatagatttatttaagatcgtaatttggggcccagaaattacagtcaaaagtgtctgaagccactgtcagtagtggacactgatgccaagctagcatgcatgggagccgtagataagtgtacactagatttatttttaatcaaattaacattttaagtttaagcttgtatagttatctctaaccagctggctaattacaaaagtagtgcatttaagacactccagttcagcttttgttgttgtcacttttttttcttaaggagagtgtataagaataatattagggtgcgtgcgtagtgttgtatgttgagtgtatcccttttattcttaagaaatcctttcttgtgaagctaaaaatatcatcatgcaaatttctattcattatcttaaaaaagctacaagtaattattgcttaagtttgttttcagttcttgtttcccctacttgtgtccaaggtgctttatcttattcatagtataaattgtttatctcaatcttcatttaaacttgaattatttttattacgaatatgttgtaattaatccagatgtatagttccaatacttaaactgatggatttggatttaattagcaccaacccattgaactgaactgatgaatttggactaattggcaccaaccaaacgaactgatgaatttggatcaatcggcaccaaccagatgactcaaaaggtccagcatgtatacacctaaccaatgaaacagtttctcaaaaaaaaaagtacacattttggaagttgttaatttacccccagtatgtgtcggcactcggctgcaatcatacaagtcaccaagagattctccgatcctaattttggaaccaaatttgtgttcttcattgaggttctaacctcacctctctcgttttccgtatacacgtctgctaaactattgaacggtgtggttttttaaaaaaagttttttatacaaaagttagtgtaaaagatcatattaatttatttttaaatcttttaagctactgcttaattaatcatgtgttaattcgtcactccattttgcatgtgaacgaaggtgttcccaaccccctccagaagaacacagagcaactcaaactgactgactctgctcttccttcttttctttctttcttttttttccctttctttttgcagagcaccggtactctgccttttgggacacgtagcgaaacttcccaacattagcgctaatcatctttatttatttgctaattatcattgttaacgtagtagattagccacagcccacaagccttcgtccccacccgacagcgacgtcaccaaaccgcgccaccaccaccaccacccgccgccggagcagcgcctcctcctcctcctcgcgccagtataaatccggcctccccctcgccgtgccactcactcatccaccacccaaagacaaagcaagcaagtacagtagccatggcgaagcatctcgcgctgtccgtggccgccgcggtggccgtgtcgtggctggcggcgtcgtcggcggcggcggcggggttctacgagaagttcgacgtggtgggcgccggcgaccacgtgagggtggtgagcgacgacgggaagacgcagcaggtggcgctgacgctggaccggagctccgggtccgggttcacctccaaggacacctacctgttcggcgagttcagcgtccagatgaagctcgtcggcggcaactccgccggcaccgtcacctccttctacctctcctccggcgagggcgacggccacgacgagatcgacatcgagttcatgggcaacctcagcggcaacccctacgtcatgaacaccaacgtctgggctaatggcgacggcaagaaggagcaccagttctacctctggttcgaccccaccgccgacttccacacctacaagatcatctggaatccccaaaacatcatgtacgcatcacaaaaacgaactcaataatcctctcttcgtcaatcaaacaatcatcgtgttaatttgctgaattacgattacttccgctatgatacagattccaggtggacgacgtgccggtgaggacgttcaagaagtacgacgacctggcgtacccgcagagcaagccgatgaggctgcacgcgacgctgtgggacggcagctactgggcgacgaggcacggcgacgtcaagatcgactggagcggcgcgccgttcgtggtgtcgtaccgcgggtacagcaccaacgcgtgcgtcaacaacaatcccgccggcgggtggtcgtcgtcgtggtgccccgagggcacgtcggcgtggatccaccgcgagctcgacggcgccgagctcggcaccgtcgcgtgggccgagcgcaactacatgtcctacaactactgcgccgacggctggcgcttcccccagggcttccccgccgagtgctaccgcaagtgattttgaactcgatcgattcaaatcctcctccattgatgagttcttggcaatgatttgtaattgcttcttgttcttgttttcgtcttcgtcttcgtcttcttcttcttgatccatgtacattttgccatccattcgttctccatttgttacagttacagagacaggttgatggtgaattactattgccgccaatttttttcttcttcttgttactcgatccaattattactactagagttcatcttgcacagttgggcggtgtgaaaaactgaaaaagaaaagggtgtcaaatttgttgctgatgctgagcaagtgagcacatgcttatgctctcaggtatgaacaaaataaacagtaaaattatctgcagctgtttgacccgtttcggattccgcacgctacatgttcgtccgtttgacgcggtttggtaggatgctttgattattaactcgatgattagcacaagatgattaatttagttagtgatgaatctaacgcccaacggcgaggtttggatgtggtgcagactgcagtgcagggaagcagacaagcgggtgacaactgtgtgcttcgctgttcttgggtatcagatttcagtcgtacacgctgaatttattgagcacaacagctcagcctcagctggtaactatccgccatgttcttattggcgtacgcgttggttggttgctgcacgcccaatccaatgatgctgtcaactactggcgtctcactgtaattaagtataggagagtaagttggtaaaagtaaaatcttgcggttaatctacaagtactaccctgataaggaatttgaaatttgaatgaaattgtcccccctggctggacggcgagaacggaatactctgctaagtaaatgcaggatgtttttttttaaaaaatctctgttagaattcgtaccaaaacagtgcccaaattcttgcaagttcagtccagttggcctctcatcactaggagtactaaacagaaacttttttccgataatgaaattttatccgacagtgcaaactcttcatcacttggagtgaacttcttttatatgagcggctcaggttcttcatcaggactgaacttttaccgataatgaaatttaatccgattgttcaggccctttgtcacttgaatagttgaacttagtgaatgtctactactactaaccgataatgtcaaatcatgtcaactatcactccactttttgcccttcttttccacttcaaatggtacaaaaaaaccatccgaagaaatgccactggctgaaagcaacagccactagtttctacagcatcactagccatggcctccagttgacaaaaacccttttattcctgcactgaagcacaatgccaaatcttcaatgatgaaagccagggattacgatcaatcttgtgctgaataaagctgctgagtattttgtgctggtggtggtggacatgaagtagaagaggcaagaacaatgaataatggctgctgctacttcttccactagctgtactgcttttcagctcagcaaattccagaattgcttgtccgggatggccttgtgggacaggaactgggaataaaggttgcctgccacttcgggggtttggcctacacaactcaacatgtttaacacggttgtgatgatgtgattctaatggcctaattggtagtactaatggtgcttggaagttggaatcgaccttttgtggggtcattttgttggataactaataaagtgttcttcttagaggaaaaaaaggggaaaaaaaaagaaaaacaagaggaggataagtgttgctatggaatgaagcaagaggatgaatatagtactccatccgttccaaaatataaggcacaaccaccctcaacccaaaaaccaagaaaccattattatcatctcctagtttggatcaccctaataaatataatgcatgcaaacagtagaattagagatcttgagagtggaggatttaaaaaagtgataatttaatggagaagatgtcctagttaagtgtatgcatgcattcatgccttatattatgtaacatcaaaaaaaagtagttgtgacttatattatgtaacggagagagtactagtacgtccaaataatttggaatctcatgctaagccttttaactcatgcacttcaattcttttccctgcacagaaaagaagccagtgtatgtgttttaagatctctccttcttcttcttcttttttttcatattttcgttttttgaagcaaatattcttatacggtagatgaaagaagaaccacttacccaaaagataatggctcaaaaatatattttgcataaacgtacaaagatgattcacatacacaaatcaacaagtgtatgtgtatgtctatgttctagtacacatacaaaatatattttgcataaacgtacaaaagatgattcgtatacacaaatcaacaagtgtaagtgtatgttcttcttagactctaagacttagagagaaaaatggaaaaaaaagaaaaaagaaaaacaagaggaggataagtgttgctatggaatgaagcaagaggatgaatgatagtactagtaggtcaaaataatttggaatctcatgctaagccttttaactcatgcacttcaattcttattccctgcacagaaaagaagccagtgtatgtgttttaagatctctccttcttctttttttttcatatttttgttttttgaagcaaatattcttatgcggcagatgaaaaaagaaccacttacccaaaagataatggctataaaatatattttgcacaaacgtacaaaaaatgatgcacatacacaaatcaacaacacagaatattctatgtggaatatgagagactatactttgagaacaactaaaacatgcaaaaatcttaaaacatatagacaaatttctgtactgtgcaaggaagctatacaaattttcttcacacttatagaaaagcagtaaaagagaaaattagttgtcgaacccttctgctgtagcagtnnnnnnnnnnnnnnnnnnnnnnnnnnnnnnnnnnnnnnnnnnnnnnnnnnnnnnnnnnnnnnnnnnn

SEQ ID NO: 33658 - DNA, 1728 bp, Oryza sativa
gctctcctagaacttgaagcatgtgaggtggagagaagagggggaacacgcgcgcgctcgctcgcctggcatggcatggcggcgcgcgtgcacgacgtacgcgtcgaatggtccgccaaaattgcccttgcgcaaatgcagcctctttttgcagttttgttttgctgcaggaaattcggatttgtttgttttggaaacactccgaatactccagtgcgtgaaacggcgctccttttgcagttttgttttgctgcgggaaattcggatttgtttgttttggaaacactccgaatactccggtgcgtgaaacggcgtgaagtccggataagttacgcgcgacttatccggttcggttacgcggagcagagatcgtataggtgtcctgatatctcccgctgtctccatgcaacacacgcgaaatcaatatagggtttgcctcttcctctgtattgcaccgtcactcgtagtctactccatcccgctcgtcggcatgcaccggcgatcgggagagtagatctccggaaccttcaccttcgatgtcctgcattgggagaaggcggcaataaggtttttgggaagcgctttgcgcgaccgctctctattcgaccacaacggctcgtcttcctctttgcacgcgtgctacgcgccgtcatcaatgtccgcaaccacgagtacttcctactgagcaaccggtcttctggtacccttggtacgtgttcagtatgttgcgcatatttgatctgttaatgctttactgtctaatatacatgtgtagatctcatgatgcgtttatactagtttacatatgcaattttatgatttatttatgaaataaattaaatcattatgtgcttataaattcaacagtatggttcgacaagtggtattagcaaatgtgtgtgtgatgtgtgtgtagtggacgtgtgtaataaataaacactagtaatatgcccgtgctaacgctacgatgatatttaacaatgtattgtaacgcattttcaagaaaattgttatttgacaaatgaaaaatattgtcatactataattttcaaaataattatatacttagattcttatctccatatactgaatgtcaaccgacaagacattatctgtttaaaatgtaatcccaaacgatcacaattaagaaatcacatctcattttttttcagccagcaaacattgcccctatcaataaattgcatgatccacactttttatcagtaaaatcaaatacagaaatcacaaatgccagcctaggataccctgatacggatacgctccgatacatatcccgtacgtagcctctattttcccgattttcagaaaaaagaaataattagggatacttctctgatacgcacggatacaggatacagtacgatctaatcctagcttctcatgggataccaatcctcgctgcgtccatctttttctacccaacggcgccgtcgttctgaagctaggcaaaggtagagccaccactccgcaacgcggggcctactaccgctgccgcacgccgccgagcgcagcatcgtcgccatgccccgtggagccaccgccgcacgccgcacgccgcacgccccctagcttagcgcgcgcagcaccaccgctgctccgggtcagggattgcttcattcaagtgaggtctcgcgtattgatggttcagtgcatcctggatcttgatgttgtgattttggacaccgcaaagtagactacaaagccata

SEQ ID NO: 33659 - DNA, 810 bp, Oryza sativa
  unsure (1)..(810): unsure at all n locations
nnnnnnnnnnnnnnnnnnnnnnnnnnnnnnnnnnnnnnnnnnnnnnnnncgctaggtgctcttcagcaactttgcaccatcatgttacatgtcatataaaacaaagttcaatttatttgaaatcatatgcaaattgcggtcagctaatcaaagtactaatgcaaatatctgtaagcactattcagattcgcttttatttattactcaaaaaaacatctaatcaacagctcttgcagacctcgcataattggctcatctaattagtttcactttgagaatattatctagcaggcatacagataagtgaataatatcttaagtcttaatcttaagtaattaaaagattgatatttttccaatcgtcacatcttttcaccagcgttgtttcgtccgtcaccaccgcgttattcgatttatccggcgctatttttcccaccgaatccgatttctaatctgatctgctatccaatccccaaatcaattaatcaacgagacaaccaaaaacagcacgaaaaagaccaaatttaatctagagctcacgaatttgatcccaagaaacctaattaatccccatggattagcagcaatatcacatcacgaggtaatgaatcaaacacattagcgcggatcaggctgaactcaattaccatgccaccgtcgttatcgtcatcctcctggatctgccatcatctccctcgagccccagtccccgccgccaccgtctcccagattcgacaaaaggaacgaagaggccaaggacgaggaggagagggagggggagggacgccatctctgtgccgtacccccact

SEQ ID NO: 33660 - DNA, 1159 bp, Oryza sativa
  unsure (1)..(1159): unsure at all n locations
nnnnnnnnnnnnnnnnnnnnnnnnnnnnnnnnnnnnnnnnnnnnnnnnnnnnnnntaggcactgtgattttactatggctggttttgccaatgcactgaggccggataaattcaccggtgtgcattttaagagatggcagatcagggtcactctgtggctgatagctatgaaatgcttctgggtgagtactggcaaggctatgggagttcttaatgttgaccagcagaaagaatttgatgaggccactactctctttgtgggatgcatttttagcgtgcttggtgatcgtctggtcaaggtgtatatgcatatgaccgacgctaaggagttgtgggatgcactgaatactaaattcggtgctactgatgctagcaatgatctgtacatcatgcagcagtttcatgactacaagatggctaacaaccgttttgtagttgagcaggctcatgaaatacagaccatggctaaggaactcgaactccttaagttgtcttacccgacaaatttttggccgggtgcattattgcgaaacttcctccatcttggagaggtttcagtactgcactcaaacacaagagacaggaatacttcgttgaggggttgatagcgtctcttgatgttgaggagaaagctcgggaaaaagactccgcgtctaagggcgatggtgggcagtccagcgccaatgtcgtgcacaaggcccggaacaagagcaaaggttaatacaaagctcagcagaccaccaacttcaagaagaagaacaacaacaacaatcctaattaggatgagaggacttgctttgtgtgtggccaacctagtcatctggctaggaagtgtccacaacgcaaggggatgaaggcacctgcagggcagacttccaagcctgctaatgtgaccattggcaacactagagatggaagcgggtatggtaatttacctactgttttttcagttaatcagtctactaattggtgggttgatgcaagggccaatgtacatgtttgtgctgacatctcattgttttcttcttatcaggtcgcacggggttccaccgtcctaatggggaataggtcacatgcttctgttcatggtgttggcacggcagatctaaagtttacttcggggaagattgtgcagctgaagaacgtgcagtatgtccct

SEQ ID NO: 33661 - DNA, 742 bp, Oryza sativa
ttattaaattcagacaaattcagtagtataaaatagatttatctcatttatttatatcggtctaatctttcgaatgcactactcataagaataaggggacgtatgtgtgttcgtagggctgagtaacgcatgcgtgtttatgagggggaaaaaatcataatatcagtgcaagaggtcctcctgttgaccttgatctttctcttactcaaataaaatttgaaaaattaattaaaagtgcagtggccctagtgtctcattaaggaggacaataatgcacatagatgcagggagtccatcgtacctcttaatgcacaattaaccaaacaagagcatgggtaccaacatgttgagggatccaccggatcatgaccattcgatcaactgtgacgaccagataacctggagtcatgcgtgtacccacgtagacatggccccatgaacaatttctttttctccgaataaatcacccaaatcaagcaccgaacaatttcttttctcctcagtgctgcatgaagcccttagagcaggtacaatagcaggctataagccagctgcaaacatattttaaagagataaataaagagagaggagagcagcggactacagatttgtagccagctgtagtacggactctaagacgcagtgtgtgtatgacaggtgggaccagatattaatagtgtagtatataactattgtatggatgggatattagattggctatagatgaattgaagctattagt

SEQ ID NO: 33662 - DNA, 10336 bp, Oryza sativa
  unsure (1)..(10336): unsure at all n locations
ttcctgcagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgttttttttttaaagtgtgcttgcaatttaaggcagcatttttcaactgttcatctactttcctcctattttacaggtaactggagatggaacaaagccatacactctttctgggaaattcttttttaatgcttcgaattcacccttcccatttggttcagggaaaaaagcttctgaattttctcaatgggtagggcagcaaaagaataccatggatgatggagtttgtttgtatccagatctacaatgtggggaaattgtccagctcttttctcttgttttgtctggagagtcgttcatttcaccctcattgccaagtgaaggagttggtgaggctgatgagcctaatagctctagtttgtttgttgatgataacagtgaattggatgagagtagtcacaaacgcaaggctgatatggttaaacttaaaagcagtaagactaagaaacacaaacctttgcccaagatagaaagcgacttttgctatcgccgagagaaaggtttccctggtcttcaagtggctttgaatcaagagagaattaaaacaagtaatcttacacaagagttacatgataaagaatgccttatttttacttcagcctgggaaatggggagcaaggatgttgattcacaggtagaaagccacaatatgtcatcattgtatctaaacaactccagttcatgtcggcgtttactgtcagaatctcatttggagaactcttacagtgggtggccttgggatgctataaaaacatatgctgaacagtcaccatcattatgttgtaacaaaaatgaaccagacatattgtcttctgacctgttcagaaatgcattttgtgttgttcataaagctggcgaacaaggagttaatttgagagagatgtcacaggcactggatcctctaggtattctttagatttgtgtaacttatgttaaacttagaattgttagactatgcatcaattattttgtaagtatagttcatttttatattcttatcccctgcaggcatccagtttgtcgatctgattgttcatactctcaagagatttcagctggtcattaaggtaaatctgtgagcaagcatgcatatggtagattagtagcctacttatttgttctatttggttactggtttatcgatataattatcttaattcacttttgtttttcatatctgcctaattatgaatacttgcactgttcattcttttgcttgtcaaaatttaccagtggttttttgttgttaacaaacagatcttgttattactgacatatttttctgcacttgtagaattttatataaacatttaaaacatcattgggatagttaaatatttatgtcaaactgattaagagtggaatacttgcatataagatgctacacttactgctgctttcttgtccacatttttttatttccctactcatatataggtgtcactctattttcttgcttcacaggtcaatgcatatgatggtgtgcagattgttgactctatacataagtcaaaatatcatataactacacttgcagattcaagtcattgcagttgtttgcgagcttctgcttttgagatggccgagactggagatacagaaaatctactgagagagaagcatgcaatgtctagtgatgtgcaagggagtgtaaaaatgcttggtgacgggcacactgtgacggttcttaatgtccaaagcaagtcaagctctcctcagatacgctatcaaagtcctgtaggtcagaaaaggtcgtttactccagcacaagacaacaggggcagtgattgttgtcatgcttgcgaaaggcatatatatcacccaatattgccatggataaatggtgatggaagcatgaataacactgtctacgaaggtctaagtcgtcgtattattggatataccatgcaatatccaggagtagtggaggtgcgtgtttgttttattttttgtagctctttgttttgaattaggaaagtttcatgtatgccactgaaattgtgatttgtttatccatctatatctccaaaagttttgcattaatgttatatggcattctttactaattaatccttgttttctttaaatgtctcattttaaaaagaaaattttatgcgagaacttcagtatttgaaactttggaagtcttaacttttcaagcataaatctgaattttaaattccccggatcccttatttttggtttggaaattcaagaattcaaaatcaaggttgagacatgaaattccatattttaaaatattccttttcttttcaaattcgtgttattttggtagtttgacaattgtaattttagttttatttctaaatatctgaatggaatacttaaatcttagttatagctagcactacaatattaaaagattcatcgatacggtacaagtgaacaatggaaaattcaactattgtctaaatttaagtgttgtggaaatttccgtttgtgtatgttatggtttagcatgtcctgttttctttctgaatgtgactcccgtgtttgcttcctctatatcatttatattcttctttttacttactttctcatctcttactgttcaagttatttgaatccctccggttgcgtggtaaagttggtttgtcttaaattgatcaggcagttattttgaatgtacagatctaagatcgtttgattcccctacttagtggtgattccagttacggagttaccattatcagcaacaatattttaaaagttctgatctattgttctgctctaattatgccaggaggatatcatccatcggatggatgtgttgaacccgcaggtgcgtcacccctctactttctccttttgtacctgtatattcgatattaaaatgatagtggtttaaataataaatatttgtgaaaaggcatgtagcctagtggttgcagtgacctgagtagcacctcaaggtcctgagttcaattttccatatgagcgaatttcagattgggttatttgatggctaagtttcctatttgataggttaagtacctaatttaaaaagacagtcttgagttcaaatatccatagtagcaaatttcagattgggttatttgagggccgaaattctcagattgggttatttgagcgaattcaaaaaggctgtatatatccggttggatgtagaggctgggaaaaatacccttcttaaaaaaaataaatattttacattattccactcatggtttgttttctcctttctgcagacctgccggaccttgttggaaaagctgatgtttgataaacacctttatgctcgggtgtttgatgaacgtgccccttcggcacctacccttttgcagagtattttgaagcaagatcgctgtaaagaaccatccaagtgtaacaagcgttactttgctaacccaatgagtacatttctgctatagacagatgcgctaggctctctagtgttagttgatttgtgcatatcgtcactctcaaacgatttatattacagactagttgtacactttgtgattcgttattacaggactgtttatgctgttggtaatcagatttactacaagcccatcaacatagctacggctgtgtttagtttccttcaaacttctaacttttccgtaacataaaatgtttggacacatgcatggagcattaaatgtggaagaaaaaaaaccaattgcacagtttgtatgtaaattgcgagatgaatttttgagcctaattaaacatttgctaataacgaattaattaggcttaatagattcgtctcgcagtttacaggcagaatctgtaatttgttttattattagtctacgtttaatactttaaatacgtgttcgtatacgagagaactaaacaggcatatgataccctacagaggtatctatttttggtcgaatggagggagtagattccagtacagcgagaggtgtggaattgactaaagtcagggttgctccagtctacacgcacgacccggttcacatcgaaattgactcgttgggtgccccggttgtccgggagatgaataatgtcacatacggagaagctgtcagctgtagtcatcgccgaagaacgttctggttaattgcttgcaagtactgtactacctccgtctccatctaatcctaggttatataacatttttggatggaggaagtattatcttagcatgaacacaactgcacaaggcacaaggcacatattatcttagcatgagcacaaagcacatatacctggtcatacatggcatgccgtagtcatgcccttcaagtccaaactgaaagttaatgaaaagcttcggaagattttcagctaaaaatttttctcctgtcattctagctggttgaggtgcacgctttcgatctatgtggacttgcttagctatgtaatctctttctactctcaatttcaaaataaattaacccagtacgagatataatatatcctattgccatgtaaagagatctcgtactaggttaacttatttgggacgaagggattattacagtacatttcagtgtgttacattgatcacacgtggactcggatcaatcaacgccccacatcggtggatgaaatagtaaccatacacaagtatgcttagaaataatttggcagctctaaaagagtgatacatacacgcgaagaaccagactttgaacatgttcccacctaaattggactcatttcatcccaatcacatatatatttctttatctgtggatatactccaccccattacttgtccttgttttgcatattaagaatttcgaatagtttaagtaagaatatagtgggcgaattggcaagttgggtagaagcaacggagtgctaactgcagttttgaacgacttgacatgttacgttctttcaagaattctaacctgtacgatagcagaacaacctcccacaaccacaagtctatgtgcgtgtcttgtagttgtagtacagtcagtttcgcaacgccggccattattttcatcatctaatatgaagcaagatggtagcaatagcatctgtatcacgtttgtgtattatgatcaaaatagcattcgggcagtaccagtctttccagccggtagatagctactgaacgcgtggaaaaaatcggatgaatagggtgagtcgttgggtgagtcgagcagagaccgacagttgggtgagtcgttggccccagcaacgacgtgatatctgatgggagtagtgcccctggacttcgtcgatacagcgtcaacaaatacacagacttggtaaattgcaagaaaattgtttgctgccgatcgagcactaatcaaccgaccgcttgtgggagttgatgtcaatctcgcgtttacttacgaagtccacggacgagcacaaagagatggtgcgtctgaatataaattgaccgtgtagttaacaggcaccggcctgcaccacaaaggcaagtctcggctggcgcaaagatgaggtcgagctttgtggcagcttgtgccatttccttagtgctagtgtgctcggctgctactacgcctcgagcattagctgcagtctatggagatggcggagggctcttgtctatcccttctaatgattccctcgctcactgcccctctagctgcggggatgttgacgacatcgcctatccctttgggattgggccgggctgcttccgggaaggcttcgagcttaagtgcaacaccagcaccaaaactcctaagctctatatgaaagatggcaccacccagatcttatatgtaggtgacgatgatctttgggcacccatgcacttcaacattacaatgaagccaggtactgatacctacaacatatcctgggtgtctcccaggaagggagttactatttctcagcgtaacaccttctacattattggttgtaatattgatgtcaccttgttcgagtatggtacgagagacgctgttggttactgcgtgagtagatgcgatggtgaaaaggtaccaacagaagggccttgtaacgggaaaggatgttgctccatcaagttatcaagggatctgcggggatttcggtcaacactagtccaagttgatgctactgcagcacaatcatatcagctgcagctgcgccatggtgttatggcttttatgtcatacaatgactattatgtagataatgcgactgatcttttcttgagttggacgaacacaagcaatatccaggaagcattagttcagtttgcaatcatggaccaaccaagttgtgaaattgctcgaatgaaaaatacgagttatgcttgtagcaccggcagcaactgcctaaatatgtcatctggaggttacacctgtgagtgcgccaattatgatctttattattattatgcagaacaaagtccttaccttttggaaggatgcatcatccgaggtgattcctctctacctttctccacttaaatactactaaggcacacacatatgagagctttatttgcatatcgaattttcattccttctctctttctaaggcgcaaacaaaagtcttccgtatcggtttttcgttcatttttctctctctgtggagcagattacaaccccaagcggaaagaacactgtcggagatcatgcggaaacatggcaattcccttcccttttggtcttgaagaaggttgtttcgcaagtgaaaggttccaacttaattgtacaacaggtaacatcacacttttcaacccacgggacgcacgttataatgtgactgatgtgtcaattgaagaggggacaatggtggttagcaacttgttgaacgacacagaatatgggggagaggacataatatcccaggtgtatggtggtgcagaaataaagtgggcagtagccaatttaacgtgtgatgccgcagtaaaaaaagatgctacatatgcatgccgcagtatccacagcaattgcctaaacgtcacccatgggaacatattcatgggatatcgttgcaagtgccttcccggttttcgagggaatccatatatccaagatggatgtgaaggtttgttcctcttcattcccaccaatttgcaaatgtgtaataattttatagaaattttatgtggatagtttaaccacggcatttcccctttaagcaggtagtagtgcctgtgcatttatattgtaccaatataaacaaaaaaaaaactgaagcgttaattgcagatattgatgaatgcttactgccaaactattgcaacgggacatgtcaaaatcttcctggaaattttacatgcactagttgcccccgcagaaaggagtttaatccaattacaagacagtgtgttgcatcagctaagcaacacaatcttattataggtaagtcatagctgacagattagtcaatcttattgcattaagataatgcaaagtggcttcacggcacaaaaataatgaatggctgtaggtattacaactggtattagttgtggcattggttccataattattgcattaggtgcgattattctagccaataagtggaagaaaagcatccaaaagagaattagaagagcatacttcaagaaaaatcagggcctactcttggaacaactaatctcagatgaaagcgccactaataaaacaaggatattttccttggaggaactagaagaggcaaccaacaactttgatgctactcgtgttcttggtcgtggaggacatggcacagtttataaagggattctatctgaccagagtgtggtggccattaaaaaatcaaaaattgtggaacaaactgagatagatcagtttatcaatgaggttgctattttatctcaaattatccatcgcaatgtggtgaagctttttggttgctgtctcgaatctgaggtgcccttactggtatatgagttcataccaaatggtacattgcatgatcgtcttcatactgatgttagtgttaaatcctcattatcatgggatgatcgaattaggattgcttcagaagcagcaggggcacttgcttatctgcattcggctgctgcaatacctattttccatcgagatgtgaaatcttccaatatactcttggatggcaactttactacaaaggtctctgactttggtgcttcaagatctgtttcactcgatgagactcatgtggtgactattgtccaaggtacatttggttatttagacccagagtattatcacactggacaactaactgaaaagagtgatgtatatagttttggagtgattctggtggaacttttgacaagaaagaaaccgattttcatcaatgatgtaggcacaaaacaaagtttgtctcattatttcgttgacagactccgtgagggatctcttatcgaaataatagattctcacgttcttgaagaggctcacagggaagacattgatgatattgcctcacttacagaggcatgtttaaaactcagaggaggagatagacctactatgaaagaagtagagatgaggctgcaattcctgagaactaagaggctaagaaaattccaatttctccccgtcccaggaattggtggagagattcagcaccttttaagcccagatactggtaaatcccaagcacagaacaactataccagtgcaggtgatttatcatatgaagggatctccagttgctacagtttggagcaagaattatcatcctcagtcagtttgccacgctagctatatatgtaacatggagtgttgagttatcacatattttctacgaagtgttatgttacgtagttcagtccagagaagagtttttgcatgtttcacttcctgtatacttgcagcatgtatgtgtagcccatgtgagttgatagaatgacagttgtattctactataattatttgtgatcaatatccttgtaaggaatgacatggtattgtaatattgtatttaagctacggtggcaaagtgaacaagttcagtaataattttattactccattgccaatgtcttgctcagtaagggtcaccaataggtatctgactaataactcagtttgtagtatgctggatctttttttccacatagcagtgacatcgttaatacggagtattatagagcttgtcggaagtcagaacttggaactcagagaacgttccgaatgcctttacacaaagtataaatggcacggttgaaattttttatttcatcacttgtccaaaaaccctgcattcataatgggaactgtaaaattgtttggatttggtgggataaggtcataggaattgggatatatatagaggaaatctaatttatggtttgattgaggaataagggaaaaaagtgaagggttagaatcagtccacactccacaccccatcaccatctctatcccaatagcaaaccggaccacaagtagtagtaagtacctatgctgcaaacaaaaatgctattgtctttggctccaaattctctagctttgcaaaagacagtttagtttaccaatggtgataatttgactatggagttaaccataccagtacaattagacttaaaaaaagaattcaaacctagattatgcacacaaccactaacacaccaagcaaaacaatggagattgccgtttgacaagggagcgcaccaatttcggttcgaacagacgagacaaccagagtggcggcctgctggcctccgcgcttgggggaggcaccggccttctgatcgcgccggggaagaggaggagcccgaccgccgaggcggaccaggcctccctttcgccccccgcacctcgacaccgcggccaccagttgacggccgagcaagaggcgcggtggtggaggcgcaagggctctccgctctccgcactccgccgtccgcagcactctacgctatttgggctcatgggctttgtattctttctctctttctttttccattttccctctgttcggctttgcagttgtgccactttgtcgtgattgtgtccgttattttcgtgtcgctatttgctcatgctgcctgcgccaccgccatctcataaattagaggaccaatgttggcttgctcctgcatataagaaacacagtgctaatcaacttgtagggcagaacttctgactgtaagtagagagagcaaagagccgtaattttgacaaattgacccttctata

SEQ ID NO: 33663 - DNA, 4971 bp, Oryza sativa
ttagcgctgacctcttagaaggtttaaaattagtgtgggcaataactgacacaagttaaatctagctcagcggttggtcagtgtggctgcaagccagagttccagggttcgtttcttggtaagaactgagaacctaaatcatacaacataaaattaaaaatacaaaattataataattgagctaagtatttaacattttaattaatgttttcaaatttatttattccagattgaacataaaataaaataaataatccccttaaaaagtaacataaaaataaatctacaaacaaaatatgtgattgtttggaaaaaaaatttcaatagaacaagattcaaagaggaagtaagaaaaaacctgaaaaccggctttcccggttcgaactgtgaacctgtgggctggagtagaggggcctgaccactgagctagcttctgcgttatgacacttccagcacacattcttttaaaccatgtaaatatcagcgccagcacacatgacgctgagctcctcttttgtggctaatccgtgccacgttgaacgtgatattagtgccaattagagcaagtttaatagtatagccaactactagcttcaattcatctatagccaatctaatagctcattcgtataatagttatatattatactattaatacctggtccacctgtcatacacacattgtgtattgaagtccgtgctacagctggctacaaatctgtagcccgctgctcttctctctcatcatttatttccttaaaatatgtttgcagctgacttatagcctattattgtacttgctcttagggtggcgctggtacgttttatctcagcaccattggggttaacgctgaggtcggcctagttttgaaattagtttttgacgcggcttattttggaaataagttttatagacgggtcaatttgtcaaaattacgggagcaaagagtatacaaaagcaagagtatacaaaagcgtatgtggctttatcgtactaaagtaattctagtttggcaaacggcgtcggccttcttttgttcatctgtatgaattagtaggagattgtggtaattgtataacgctagtgtatcgtgattaggatttgtgttacgaactcttcctgggatttctgtcgaacaattggtgagcaagagcgagagagggagacaggaagaatagaagagttcaggacataaagaacaaaggattaggaggaggatgggatttgaattatagagaggtttcagtacaatgtttttcgataccgattcccataaggctaggcctttatatacacatgctagccactctcttacgcaacccagtctggcccaattatacgagtgttgggctgtcgctgtcttgagctcttcggcctggtcttgacagggttggtaacatcctcccctccttcacatccggcttgtccccaagccggagcagcagggtaacgctccttgagccgctccagatcttcccaggttgcctccgatgttggacagcccgaccagcaaaccttgacttgatcaacagccgctgatccccgacgtatcagtctgcgtgctagcactcgcactggaacaggatctgcttcttccaccgctggaggtagggtagctaccgtagaagaagctggttccgatgccttccgaagttgggacacatgcaccaccgggtgaatcatagaagaagcaggcagcgccaaccgataagccaccgcccccacccgagcagtcacctgaaagggaccaaaaaatcgaaaggccaacttctgattaactcgcaccgccaccgaggattgcgcatgaggttgcactttcataaacacccagtctccgacagcaaactgccgctccaaacgcttcttgtctgcttgatgtttcatgcgctggcgagcgcggtggagatgttgatgcaacaacgaagtaataacagtgcattccttcaaccattcttgcaaatccggcactgcacaggctgcgatatcaacaataccaaagtgccgaggaggatggccatacaatacctccaaaggagaagttcccaaagctgagtgcagagaggtgttataccaaaattccgcaagagccaaccattgagaccatttcttagggcaagcatgcacaaagcaccgcaagaatgttttctcacactgattattgaggcagctattccccccagcattatgaggataataggccgtactcatacacagctgagtgtctgccaatttaaacaaagtggtccatagagtgcttgtaaagatccggtcatgatctgagatcaaagactgaggcagtccatggagcttataaatgttagagagataagcttgtgccacatcaaaagctgagaatggatgagctaaaggcacaaaatgggcatatttagagaacttatcaacgaccaccataatgcaatcaaaacccgaggaagtcggcagaccttcaataaaatccaaggataccatttgccatgcatgatccggaacaggaagcgactgcaaaaggccagggtagcgaacccgttctgttttcgcttgttgacaaacagtgcaattggccacatatgtctttactgctttcctgagccctgtccaagcaaacaaacgcttgacacgggagtaggtaacctgtacccctgaatgtccacccactgccccaacatgtaaagattgtaagatttgagactgcacgtgcgggttagcaccaatccaaactcaccccttatagcgcaaaataccagattccaaggaaaaatgaggtaatgcgtcagatttgagtgtcagttgagccaccagctgagaagaatgaggatcttgatcataccccttttgaacttcctcaagccaagctggaatacaaactgaaagagacaatacttctgttgaatcatcggccactcgtcgggacaacgcatcagcggcgctgttctcactacctttcttgtaaaccaaacgatactgcagtcccatcaacttggttaaggctttttgctgccaaggtgtggctaatttttgatctccgagatgaatgagactacgttgatcagttcgaatcacaaactcagcaccctgcagatacgagcgccaatgatcaattgctaggagaatcgccaagcattccttctcataagtcgacaagccacgattgcgaggaccaagcgctttgcttaaaaatgccaaaggatgtccctcctgcataagtacagcaccaacacccacagctgaagcatctgtctcaatttcaaatgtctttgagaaatccggcaatgcgagaactggagctgaagtcaaggcagtctttagggcatcaaaagaagcttgagtttcagcagtccaatggaaaataacattcttcttgagaaaattagtcagggggcgactcagaatcccaaaatggcgaacaaatttgcggtaataccccgctaacccaagaaatcctctgacctccttgacattagaaggcaccggccactgcagtactgcctgaatgttcttagcatcggttgacaccccttcagcactgatgacatgtcccaaataagtgagagatgaccgagcaaacacacacttagatctcttaacttgcaactgattggcagagagaatatcaaatacagcccttaacaagcgcacatgttcctccaaagtccgagtatagatcaaaatgtcatcaatgaagactaacacacctttacgcaagaatggctcaaagattgtattcattataccttgaaacgttgctggtgcgccggtcaatccgtaagacataacccggaactcgtaatggccattatgtgtcttgaaagcggttttatgttcgtcttctggcttcatacgaatctggtgataaccggctcgcaaatccaaactcgtaaaccaacaagctcgtgccaactcatcaagtaactcatctataataggcagagggtaccgattcttaacagtgatagcattaagatgtctataatcaatgcaaaatcgccaagtaccatccttcttctgcacaagcaacacgggagaggagaaaggactggcactgcgttgtatcactccttgtttgagcatgtcagcaacctgtcgttcaatctcatccttttgtgccggactgtaacgatacggtctcaaatttactggttgggctccaggcagcaagggaatagagtggtcaaaagctcttggtggtggcaagccagagggttcatcaaaaaccttggcaaattcctgaagcaatccctccacttctcttggcagaacaagactgattgcaacagcttcactggcacaaagttcaactgtgtgtaggactgcattatgatggaagagacccttaagttgatcagccgaaataaccgggcaacagctaacatccggcaccacaccctgtaacagaacctgcctgctgtccaacacaaattgtatggtcttaagcttccaatcaatttgcattggactgtgtttctctaaccaatccatgcccagaatgacctcataacagcccaacggtaacaccttaagattagtgctgaaggactccccttgtacccaccaatgacaattaggaaactcctgacaacattgcaagataccaccatccgcgattttcaccttcagaggagtcagcgagctgcgcacaccctgcagtttattagctaacttctcactgataaagctgtgagagcttcctgaattaaccaacatcaagacctcatgtcgttggatcaatccttacaaacgcaccatacgagaagactcaataccaagtacagcttctcgagaaatggccaataactcaccatcatctgattcagcagggggctagtagatgactccacttcctcaggaacctcatcagaaaaaagctgtagcacttcttcaatcacatgcagctgcacagtagggccacaacgatgatcacgactccacttttccccgcaagtgtgacaaagccccttcgctcgatggaaagc

SEQ ID NO: 33664 - DNA, 3554 bp, Oryza sativa
gtcgcaccgcccgagccgccgcgtcgtctcgtcggtggacacagcgacgtacccggcccagctggcgcggccgctggtcgacacctccatgcccggcacagcggcgtccggcgacgagtagatgtacctcgtcacctcgtacccggcaccggcgtcctccagcatccggagcttgccgtacttgcagttcatgtacctcggcgacgaagggtcctccaatgccgcgtagcatgcaccgacgagctcgccgtaccgcgccacctctccgcggagcaacgggtgcagcggcgagcatgtcatcccagtcgccggagccctggaccttcctctacacgcgggcgacaaagcccgccgctgccgccgtcatggaccacctcgccacgctcgtcctctttctcccatgaactggatcgatccctttcagctagctagcaaggggcaatttggtaccatcaagccgaaaatacaattgaaaatacacaaaatggtaaaaatggcaaagtggcggtgagtacacgcttcgtattggcattttagcgaaacgcattttcagaatggcattccagcgaaaccgctttttgaaagtggctaaatgtctattttctcgaactgcggcgcgctggcggtgagggggaaggcgacgagcggcgctgccgctacgaggccgagggaatggatgtgctgcccccggacgatgttggacttgaggtcaagagttgagggctcccgttgcgcgtggttgggcttcttgaggcccagaaactctaacaggccggggaaaaaagatcgagaattcacgccaatgcaaaagtattcacaatagtactgtatagagaagtgcagaccgcagaactagattgcaatataaattcagagttgatcaagatttacaccacttccataatttgtgggttgtccttcgttcagatcgctagcttgtcggagaggaaactgtcacgtagtacttgtcaactgtagtcgtcactgccgagtgccgaagaacgtgttggtagaaatgattgcgacttgcgaggtcatcttaccgtgaacaccagggcatatacctggtctaacacggccggccgtagtcattccctcgaagtcctaattcaaaagttaatgcagagcttctaaatgttttaggctaaaaaagtttctcctgtcattccagctggtcgagaggtgcatgctttaatttcgatttatgtggactgactcagctacgcggtggtgttcggatccatgactaaactttattcctatcacatcggatactcatatcacatcggatacgtgtacgctaatttagagtattaaacatagactaattataaaattaatttcataaatgagagctaattcgtgagataaatttttaagcctaattaattcataattagcacatgtttactctagcatcacatagcctaatcatatactccctccggtttcattttaattgacgttttggacaatgacacggtctacaagatatatctttgaccttatttttctattataatatatataataaataaatacatgtttacttttattatagtactttaaaagacaaatctatatatgttgttctagttcctttaaactaaatatttttaaagttattaatggtcaaagttataaaagtttgacctcagccttgtccaaaacgtcaattaatatggaaccggagggagtattaatttagattcgtcgaacgaattagtctaaagttatggaatgggttttgtcattagtatacgtttaatatttctaattagtatttaaacattcgatgtgataggggttttagtccctgatccaaacagggccgcttctaatctctttctactccagtacatttcagttgctttaatttatgatatgtgtagatataataacctaaaataagctagataggaagatttggttaatagtgaccaacatgtgtttaacgttgttttgtttaagccatgctgcgggcggcgtggagccgtgcatctatgtcctgttcttttctcaaaaaaactgtataaacttttagataaaaatggtacgttttttaaattgctaaacggtatgttttgtgtgaaaactttctatatgaaaggtattttaaaatataagattatttttcaagtttataaaaattaaaactcaattaatcacacattattatcacttttttttaaaagacacattattaccacatcattttacgtgaaacacttaatttttatctcatctccatttttgggagatttaaacaccaccatagtcaaaagttaacgcagagctcctgaaggttttcagctaaaaatatgcttatgctttcgatctacgtggacttgcttagctatgaaatctctgtctgcacattccagttggttacgtcgaaatagtagccccatattggtggatgaaatagtaactatatacaagtatgcttaaaaataaatttgacagccctaaaagaacgagacatgcacgtgaagaaccagactctgaacatgttcacacctagattagacccatttcatctcagccacatatatattaattttatctggggcaatcaccttgaatttctacgttgccttattttcattccacaccatacttgtccctgttttgcatattaagaattgcgaaaagtctaattaagtaagaatatagtgggagaattggaaagttgggtagaagcaaaggagcgctaagtaagtgtagaatgattcaacatgttgctttctttcaagaattatgctcccttctttttatattataagactttcaaacattgctcatatttatatagatattattgaatctagacacatatatgtctagattcattaacatatacttcctccgtttcacaatgtaagtcattctagcattttctatatacatattgatgttaatgaatctagatagatatatatgtctagattcattaacatcaatatgaatgtgggaaatgctagaatgacttacattgtgaaacggaggaagtatatgaatgtgggcaatgctagaaattcttataatatgaaatattcattaacatatatatgaatatgggcaatgctagaaagtcttataatataaaacggatgaagtacttggaagatatcagaagagcctgtgcaaaagtctataggcatgtcttgtaggacaatctctagttggaaaaaaagatgaattatccctgaactatcgcggtcgatcgaattacccctctgaacccgccagacattgcttaccctaaacctttaataccggacgaattaacaccctcaacccattccagagcggttttgtcctacgtggtgtacgcatgacaatcccatcaacattttttttaaaaaatggtgggacccacatgtcatacatcattttcccctcttcctctctctctcttcacactctctctcgctctcacgaggcggcgcgcaggggcaggaggtgggctgcggcacgagacgcggaggtggaggcctgagctgggtggctccggctggcggtgagcgctacgggacagtggcagaagcagc

SEQ ID NO: 33665 - DNA, 2672 bp, Oryza sativa
tgtctggttttcgggttggggggggggggggtgggtgggtgggtaatttggtcgagtgcaatagttcagggggtaattcatatttttttcctctctagtttcacaatgccggcaattattttcgtcatctgtaatgaagtaagatggtagcatctgtatgagtactagctaagatataccttatccgattaaaatctcttactccctctatcaaaaaaatgtttgacgccgttgacttttttaaaaatgtttgaccgttcatcttattaaaaaaattaagtaattattaatttttttcctattatttgatttattgttaaatatacttttatgtatacatatagttttacacatttcacaaaagtttttaaagaagacaaacggtcaaacatgtttaaaaaagtcaatggtgtcgaacatttaaggaaggagatagtatattttagtacagatggagtatatatatgattattaattagccttcctgggcagtaccaatctttccaattggaagatagctactggacgcgaggagaaaatcggacgtagaagcgagcagcgaccggcagttggacgagtcgttggctccagcaacgaccgggatatctgatgcgactagtgcccctggacttcgtcgatcaatggcaaattattgcgataaaattgttttctgccgatcgagtataagccaatcaattcctccatatatgttttatacatagcgcttggggagtggctggtattaatctggcatctatacttataaagtccacgaaagcgtgagcacaaagagatggctgcctctgaatataaattgatcggtagttaacaggcaccggcctacgtacaccaggaagggcaagccggctggcgcaaagatgagctcgagctttctggcagtttgtgccacttcttttgtgctggtgtgctcggcagctacgccacgagtattggcttcagtctatggagttggtggagggctcttgattgtcccttctatgactccctcgctcactgcccctctagctgcggggaagtcgatggcatctcctaccccttcgggattgggggaggctgctttcgggacggcttcgagcttacctgcaacaccgccaccaaaactcccaagctccttgttgccaatagtacaacccagataacagcaatggaatatgacatggctttggctcctatgtacttcaattttacgacaaggcaaggtatggacacctacaacatttcatgggtgtcgccagctaagggtattaaaatttcagatgagaacactttctatgttgtctgttgtaattttgatgccaccttgttcgagtttggtacgggagatttcgttggttcttgtatgagtagatgtgacattgagaaggcaccaatagcaataggacagccttgtaatgggaacggatgttgctccatcaagttatcaagggacatgcggggatttcagtcaacacttgttcaagctgaagctgcagcacaaatatcagatccgctgcatcatgggatcatggctttcatgtcatatacggattattacgtacgtaatgcgagtgatcttttcttgagttggacgaatgtgagcaacgttgagggagccgagcttcagtttgccatcacggaccaaccaagctgtggaagtgcactggtaaacaaatcaagttatgcttgtaccaccggcagcaattgccaaaatatatcatcgggaggttacacctgtgagtgcaccaatcgttatctacaaggcaatccttacattttgggaggatgcaacatgcaaggtacttcctaccacctttaatttcctgcaaaataagacacatatatcgatatatatctaactttcatcccttgtcactctctttgtgggacagattacaaccccaagcataaagaacactgtccgacatcatgcggaaccatgatcattcccttcccttttggtctggaagaaggttgttttgcaaacaaaaggtttcggcttaattgtactgtacatcagatcatatcacagttttggaaacaagtgaagcacaatttattgtgactaatgtgtctgttgaagatgggactctgactataagtaatttgttgaataatacggaatatgggagagagatactaataactcaaggtgaccaatatggtgatacagtgatttatggtcctgttgaagatcgatttgacttctctttagaatacaacattgttataaagtgggccgtagccaatttaacttgtgataccgatataaaaaagaatgctacatatgcataacgcagtatccatagcgattgcctaaacgtcacccacgcaaacatattcatgggatatcgttgcaagtgtcttcctggttttcaaggaaatccatatatccgagatggatgtaaaggtttgttcctgttcattcccctcctatttgcaattgtttaagaattttagagaagttttatgtggatagtttaaccatggcatttcccctttagccttgttcggttaatcccatctacaaggggatcaagcgggattggaattaatcccctccaatccctctctaaccgaacaaggctgtactagtgcctagcctatgtctatacgttgtaccaataaaaacaaaaaaaactgaagagttaattgcagatattgatgaatgctca

SEQ ID NO: 33666 - DNA, 3493 bp, Oryza sativa
agactcatgtggtgactattgtccaaggcacatttggttatttagacccagagtattaccatactggacaactaactgaaaagagtgatgtatatagttttggagtgattctggtggaacttttgacaagaaagaaaccaattttcatcaacgatgtaggcacaaaacaaagtttgtctcattatttcgttgacagactccgtgagggatctcttatcgaaataatagattatcaggttcttgaagaggctcacagggaagacattgatgatattgcctcacttacagaggcatgcttgaaactcagaggaggagatagacctactatgaaagaagtagagatgaggctgcaattcctgagaactaagaggctaagaaaattccaatttctcccagtcccaggaagtggtggagagattcagcaccttttaagcccaaatgctggtaaatcccaagcacagaacaactataccagtgcaggtgatttatcatatgaagggatctccagttgctacagtttggagcaagaattatcatcctcagtcagtttgccacgctagctatatatgtaacatggagtgttgagttatcacatattttctacgaagtgttatgttacgtagttcactccagagaatggtttttgcatgcttcacttcctgtatacttgcagcatgtatgcatagcccatgtgagttgatagaatgacagttgtattctactataattatttgtgatcaatatccttgtaaggaatgacatggtattgtaatattgtatttaagctacagtggcaaagtgaacaagttcagtaataattttattactccattgccaatgtcttgctcagtaagggtcaccaataggtatctgactgataactcagtttgtagatgctggatctttttttccacatagcagtgacatcgttaatacggagtattggctgtgtttagttccttccaaagttggaagtttgggttgaaattggtacgatgtgactgaaaagttgtgtgtatgataggttgatgtgatggaaaaagttggaagtctggatctaaacacagccattatagagctagtcggaagtcaaaacttggaactcagagaacgttccgaatgcctttacacaaagtataaatggcacggttcaaattttttatttcatcacttgtccaaaaaccctgcattcataatgggaactgtaaaattgtttggatttggtgggataaggtcacaggaatagggatatatagaggaaatctaatttatggtttgattgaggatcaggggaaaaaagtgaagggttagaatcagtccacactccacaccccatcaccatttctatcccagcaacgaaagggcatgtagcctagtggttacagtgacctgagtagtaccccaaggtcctgagttcaaatctcctatggagcgaatttccccttctctaaaaaaaaaaatctctatcccagcaaaccggaccacaagtagtagtaagtacctatgctgcaaacagaaatgctattgtctatggctccaaattctgtagctttgcaaaagacagtttagtttaccagtggtgataatttgagtatggagttaaccataccagtacaattagactaaaaaaaagaactccaacctagattatgcacacaaccacaaacacaccaagcaaaacagtggagattgccgtttgacaagggagcgcaccagattcggttcgaacagacgagacaaccgggagcggcggcctgccggcctccgcgcttgggggaggcaccagccttctgatcgcgccggggaagaggaggagccctactgccggggcggaccaggcctccccttcgcccccacacctcgacacctctctgacactgggcctctgtcggcaaacaccctgcaactccaccgcggtctctgtttggctttgcacttgtgccgctgtgtcgtgattgtgtccgtcattttcatgtcgctctttgctcatgttgcgccaccgccgtctcataaattagagcaccaatgttggcttgctcctgcatagaagaaacacactgctaattaacttgtagggcagagcttctaactgtacgtagagagcaaagagtatacaaaagtgtatgcggcgttatcgtactacagtaatcctacttaggcaacggtgccggccttcttttgttcatctatatgaattagaagactgtggcaattgtatcacgctagtgtatggtgattaggatttgcactttttttttttgaaaggagggcaaaagctttgcctcatatatttatagagatgaagaaaaaacagatcaaaaatatgtacagggattaggatttgcacattgcaactctttccatctggtactggatttgtggaaagaatgggcgggcgagtttattggtccctgcaatggctttagattttgcaaggataatatatagtagtaccacattcttagaagttgcaatatactccatccgttttatattataagttgtttgattttttttctagtcaaatttatttaagtttgattaagtttatggaaaaatagtgtagtattttcaatacaaaagaaacatattatcaaaatatactcgatgctaaatttaatgaaattaatttgtcattttagatgttgcttttaatgacaatagcccaattttcactcaaaaaatgttgaaatcatgagtccccaatgttttcatagggaactgcagtctgcgggattatatttacgaatctgctcgtaatagcttacaagacgagcatagtgaccctatacggtgacaaatccagcaaatatcctctaattaattaagctaacaaccccaatttaatcactcttagggcatctcctcagcgtgcctccggtcgcaaaatataattttactaatgaccactcctacttcagagtgtgtttcgaaccagagcttgttatatacgcacacaaaagcagccattgcatcgagcaataataatattgcagtttgacgagggagcgtaccgatttcgaacaggaaattaatcggcgctgagctacagcggcgtgtcggcctggccttctgccggtgcctccgccatgaggaggtgctggaagctgaggtggacggcgccgcccccttccccccgactccctcccgaggctgtggcttagttgcttgcgatgaactgtggcccgcgcaccggcggtgaggtctgaggggagggcgacgagcggcgctgccgcgatgaggccgaggggatggatgttgctgccctggacgatgttggacttgaggtccagagttgagggctcccgttgcacgtggttgggcttcttgaggcccaaaaactaacaggccgggaagaagatcgagaattcacgccatacttgcttatgcacgtaggcaaaagtgggggccgctgatccgcgaccagtcgcgcgaggccccgcgcgcgcgatcagctgccccccctctagtgtgatctgttatcctatatata

SEQ ID NO: 33667 - DNA, 6639 bp, Oryza sativa
atgtatatatatagtttatacacatatatattatacatacctgtggatatatacataattttttataagtatacacttttaatatataaaaagatatacacatgtatataaagttttgtatatatacgtataaaaaacctaaaaaataagtgtatacaaacatatatatgtgtatacaaactttatatacatgtatacagagttgatatacgtatgtataaaaaccaaaaaatacacatacaaactttgtatatacgtatataaaagtttgcatacgtatatacaaagtttgtatacatgcatataaagtttgtatttatacgtacacagagtttagcatacatatactattaaaaaacggacaaacacaaaaatatacgggaagaaaaaaaaggaaaaaaataaaaccggaaaagatacggaaaaaaaaacaaaaaaaagggaaaccgtacgcccatacgcgccgaccgccgcctcctctgtcgtgtcgcgcgcgggagggctattagcccatttcaggaaagcccacgacacgaagaagcccaaaaaacagagacccgtgggtttatagaaacagtgttaggctagaagtagtaggggtgaactcgccgcgcgcgctcacacgcgcgactagtcgcttattagcgatttcgggcaaaaatggcttaaaattgggaaccagaaattacgaggccattcagattgtagataaaataaatcgtactacatagataagtgtagatcatatagataagtgtagatcgcagaactgattgcaatataaattcagagttgatccagatttattacaccacttccataatttgtgggttgtccttcgttcagatcggaattgacttgtatgaataatttatattcccagtcatctaccagaaacgtttcgcacgtgcaccggtcgttccaatcatcatctcgctagcttgtcggggaggaaaatgtcacgtacttgtcagctgtacgtagtcaccgccgaagaacatgttggtagaaatgatttcgacttgcgaggtcatcttaccgtgaacacccgggcatgcatatacctggtctaacacggccggccgtagtcattccctcgaagtcttagttcaaaagttaatgcagagcttttaaatgcttagaaataaatttgacagctctaaaagagtttgagacatacacgaataaacaaactcacacctaaattagactcaggttgtgtttagttcagcgcgaagtttggattttggtttaaatgaaaatgatgtgactgaaaagttgtgtgtgtatgacaggttgatgtgatggaaaatgactgaagtttggatccaaactttggatctaaacacagcctcatttcatctctcaaccacatatatatttcttccatctgtggttatcacctttaatttctacacgtacgtatcttcactccacagtccaccccattacttgtcattttttgtttttgcataacaagattatcgaataattatttcaataagaatatggtgggcgaattggccagtttgtagaaacatcagagtactgctaactgcagtgtagatcgaccgacttgacatgttacttcctttcaaggattcattagaaaagaacctacaaaaatctactattgaatcttctacagtctctagtttggcaacgccgcaggccattattttcgtcatctagtagcatgtgtattgctttgttactgtgtgttgtgattaatagcatccggacagtaccattctttccagctggtagatagtcagatagccatggacgtgtggaaataatcagatgtgtataggatcagtgagcagcgaccggcagttgggcgagtcgttggctccagcaacgacagggatatctgatgggactagtgcccctggaattcgttcatatacgaggacaatatacaggcttggcagattgcaacaaaactgtttgctgctgatcgaaatactgatcaatcaatgtctccatatgttatatagcgcttggggaatcgctcttaatcttgcgtttacttaagtctctgcaggcgcacgatcagtataaattaagagacgacagacgttgcctctgaatacaaaatcgatctcacgcgtagttagcatacatatctgcacccacaaagctaggcaagctagccgatcggcgcaaagatgagctcgagcttattagtggcagcttgcgccgtctcttttgtgctgctgtgctcggctgctacgtccccagcatcggctgcagtctacggagttggcggagggctcttgtctatcccttctaatgattccctggctcattgcccctctcgttgcggagatgttggcatcgactaccccttcgggatagcgccgggctgtttccgggaaggcttcgagctcatctgccgcaacaccgccaaaactcctaagctctttctgggtgatggtactactgagatcacagacttgggttataggtatgttttggcccagatatacttcaacattacggtgagaccaggtacggatacctacaacatatcctgggtggccccaacagagggtattactattgatcattacaacacattttacgttatcggttgtaatttcgatgctaccttgttcgagtatggcacggaggacctcataggttcttgcatgagtagatgtgatggtgaaaaggcaccaataggagggccttgtaatgggatgggatgctgtttcatcgagttaccaagggtcttgcggggctttcagtcaaccataattcttcggtcggatggcattcctgtagcacaaacagatccagtgcaccctggaatcatggctttcatgtcatcggactattatatatcaaacacaagtgaccttttcttaggttggacaaacacaagtaatgttgaaggcacagtactttcttttgctaccatagatcaaccaagctgtgaacgcgcgcgcatgaacaacacaagttatgcgtgtagccctggcagcaattgccggaatgtgtcatctggaggttatcattgttactgctctggttatgaacaggggaatccttaccttctagatggatgcacgggtacgtacttcctgcctgccccctttttacccccaaaacgaagcaaaatataatgcactgtcactaacctccttcttattcttattatatattgtaatttctatggtggaacagattacaaccccaaatataaagaacactgttcaacatcctgtggagacatgaagattcctttcccttttggagtcgaagaaggttgttttgctaacgaaaggtttagacttaattgtacagaaggtaacctaactgtttgcgaattaggagaagcacaatatcatgtgactgctgtgtctttggatgatgggactctaactgtcggaaacatgatgaatgacacaaactacgagaaagaggcgataattgttcagaccacagatactggccgtgattattcattctcaggccctgtggaagatagatttgatctctctatggaatacgccattgttataagatgggcagttaccaacttaacttgtgaagtagctgtgcagaagaacactacatacgcatgccgcagtagccacagctactgcctgaacgtcacccacaggaaagagttcatgggatatcgttgcaagtgttctcccggttttgaaggaaacccatacatcgaggatggctgcacaggttatttcctcttcacacctcctccagtgtgcaccagcaatgctcatgcctgcaaatgtttagaaattgaattatatcaatttaacttgggagaatcgacaaactaatcatagttttttgcagacatcaatgaatgcttactgccaaactattgcaatggcacgtgtcaaaatttacttggaaattatacatgcacaagctgcccgcatagaaaagagtttgatccaatcaaaaagaagtgtgttacatcagcaaagcaacgcaatcttcttttaggtaagaccgtaagaagtaatagccaacatgcaaaatgattttattatgacaaaatgaattgatgcaggtattgcaattggaattggttgtggtcttggctccatagttatcgtgttgggggcaatgatacttgccaataagtggaggaaaggcatccaaaagagaatacggagagcatatttcaagaaaaatcaaggcctactcttggagcaactaatctcaaatgaaagcgccacaaacaaaacgaagatattttccttggaagaactagaggaggcaaccaacaactttgatggaactcgtgttcttggacgtggaggacatggcacagtttacaaaggcattctatctgaccagcgtgtggtggccattaaaaaatcaaaaatcgttgagcaaactgagatagatcaatttatcaacgaggttgttatcttatctcaaattatccaccgcaatgtggtaaagatttttggttgttgtcttgaatctgaggtgccactgctggtttatgaattcatatcgaatggcacactgcatgaccaccttcataccgatcttagtgttagatgctcgctgtcatgggatgatcgcattaggattgctgtagaagcagcaggggcactttcctatctgcattcagctgctgcaataccaatttttcatagagacgtgaaatcttccaatattctcttagatggcagctttactacaaaggtctctgattttggtgcttcaagatctgtttcacttgatgaaactcatgtggtgactattgtccaaggcacattcggttatctagacccagagtattatcatactggacaactaactgaaaaaagtgatgtatatagttttggagtgatacttgtggaacttctaataagaaagaaaccaattttcattaatgaggcaggtgcaaaacaaagcttgtctcattacttcgttgaaggacttcaagagggctctctaatggaaataatagatcctcaggttgttgaagaggcaaacaaggaagagatcgatggaattgcctcgcttacaatggcatgcttgaaagttaaaggagtagatagacctactatgaaagaagtagagatgaggctgcagttcctgaaaactaagaggctaagaaaattccaactgctcccaggaaatgatggagaaatcgagcaccttttaagcccaaatactagtaactcttatgcacagaatatttatacaaatgctggtgatttaacatctgaaggaatcccaggttctggttgctacagtctggagcaagaattatcatcttcaattagtttgccacgctaattaggtataccacggtgaagtgatatctgatatgctttgtagttccgttctgaacagggtatgctgtattgttttatttcctgtgtgtaattttaggttacagtacgtatggatagcccacgcctgttgtatattactatcattatttgtgaggaatatatggttgtaagggattaattaaggccaggtggcaaagacaaaaatttgtataatcatgaacagatccattcagtaataatttcataactccatttccagttgcttacgcagtacttcctccgtttcatattataagactttctagcattgttcacatttatttttttttaccggaatcacattcatatactccctcattctctaaatatttaacactattaacttttttaaacatatttgaccgttcgtcttattaaaaacttttgtgaaatgtgtaaaactatatgcataaaagtatatttaacaataaatcaaatgataggaaaagaattaataattacttaaactttttgaataagacgaacggtcaaacatttttaaaaaagtcaacggcgtcaaacattttgggatggaggaagtatatgttaatctttacctattataaaagtttaagatgtttttgccagatgtttcgtacgtcatctgacttcgattcctactcggcttgcgcactctcgcccgctcgtgcgcatcagaatcaggtccgtgttagtgtccgacttctcccctaatacctgcgcgtgttcacatcctccatcacgagtcgttcgcacgcaccagccggaaaaaagatcgaagcatcgatatgtcagcaaatcgatcggactctaatccagaccttgtgcgtatcagaatcgggtccgtgttagtgtccgacttctcccctaatacctgcgcgtgttcacatcctccctcacgagtcgttcgcacgcaccagccggaaaaaagatcgaagcatcgatatgtcagcaaatcgatcggactctaatccagacctcgtgcgcatcagaatcgggtccgtgttagtgtccgacttctcccctaatacctgcgcgtgttcacatcctccctcacgagtcgttcgcacgcaccagccggaaaaaagatcgaagcatcgatatgtcagcaaatcgatcggactctaatccagacctcgtgcgcatcagaatcgggtccgtgttagtgtccgacttctcccctaatacctgcgcgtgttcacatcctccctcacgagtcgttcgcacgcaccagccggaaaaaagatcgaagcatcgatatgtcagcaaatcgatcggactctaatccagactgatacaaatcacataggttgactcacggcca

SEQ ID NO: 33668 - DNA, 4482 bp, Oryza sativa
  unsure (1)..(4482): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggagatatatgtatatctataactaatataaatattcatatttttccggtcgtcacatccttaacccacgtttttcgtccgtcaccgtcgccttcagctttgttcacaaaaactagggttctatttggagagataagctcgaaccgagctcgattccgcgttaatttctccgggataaggtccgattcttggggaaaacggaagaggaggataagggaaatatttcccctcaaccaattttggaaaaaatagaaaggggcgcccggatttggagtggaaagcggcgccgggtcgggttctgtctccggccagaggttgaagacaacactgtagcgacagggatgagatgtggactttggggaaaaaaagcctagcccgagaaaaaaagaaggaaggacgtgaaacaaacttttagcggtgcagctactaggccgaacaggaagaagtaggatgctaaagtggacttcacggattaggcccaagaaagagaggggatttttaattacttctccagataaattaaccaataaaatgatctttaaattgttaaaattatttcaaatgctcaaataatatcaagaaaactcttgaacatacttggataacaacattaaaaccagatcatttaatgattaatttattatttaaataatactgaaacgttctttgtattattaaaattagtagttgagctttgaaaaatccgagaaaaattccagagagcagaattaaccacgcatagaattaaatccatccatgctttatatttaggaaattttattatacatttacaacttattaatttatttatatataacattaattcaccaacaaatacatagcattaagtgtagccaagagcgaaaaaatgaggttggattcatcatgtcatctttccattcactacttaaaaaatatttttctggatgaccacccgaatagattgcagacaggccataagtgtttgtgcctacaaaaatttatcccattttcccatacggcttcttaagaaacttgtatgcaagaatcattttttccaaacggaccatttaaaatatatggacgtgaaaatgtggtgtttaactcaccggcatgcaaaaatacccccccgtagattctcactttttttattctccagtcctctctctttcccatcacccccattcatctcctccctcccagcggtaggcaagggcgacgacgatggcttcctcctcttctcccccactccttctctcccctctcccccctcccgacgcggtggagggctcgggcagtgggagagggcggaggagggatgcgacagcggcgacagatctggcggtggtgaggcgtccggcggcggatccgacggtggggaggtgcggcggccatcacccgcgcggatccgactgcggcggatccggtggtggggatgcgcggcaacagcggatccgatggtgaagaggcacgggggcaacggattcaactctccctcccgcgcgtcgacagtgatgggagcgggcggacccggccacccctagccccctacgccccacgacaaggacgaggatgaggatgaggacagcaacgacgacggttacaacgacgatgatgacgaggaggacggcgggcatccgtgatatggacaatattacatgacctaaaaaaataaataacttattgtagccataaatataggagtcaataaaaaacaattttatttcaaggtggtatcaatatctttcttataatcataaatcgagcggatccggtagtggggatgcgcggcagcaacggatccggtaatgaagaagcatgggggcagcggattcaactccccctccctcgcgtcgatggtgaagggagctggtggacccagccacccctagcccactaccccccacgacaaggacgaggacgaggacagcaacgacgacgatgacgaggaggacggcgggcatacatgatatggacaatattacatgacctaaaaaaataaataatttattgtagccataaatataggagtcagtaaaaaaacaattttattttaaggtggtatcaatatctttcttataatcataaatcgagtagatttaaaacaacaaacaattaggtatgagtgtagtgagtgtcaattcgttgcacaacaatagaaggttcgatttagtggagtcactttcggttgatatgtcatcgctttcgattccttatctactaacgtgcatgtacagagtatatatatgtaaaatcaaaattgacttcacccgtggcaacgcacaggcactgtgctagggaatataaacatatatatatatatgtgcctagatttattaatatttatattaatatgaacaatgctagaaagtcttataacctgaaacggaggtaatactcaataatagtagcagattaaaacatcaacgaggcatggagattgatgtttgagaaggaagcgtaccaatatcggttcgagaagacaaccggaggtccggagccgccgagatcacggcggcgcgtcgtcctggcggtgccgtcgctgggagtaggcaccggcctaacgaggtggaccacgcctcccgcttcccctcacgccgagtcccccgacaccgcgatccaccgtccctcggcggcggccaagcgcggcggtaagcgaggggagtccgctcgctgctcgatcccccctagaatcggaacgaattttgagctccactgcttcaagttggctgttgttgcgagggcttatgcgcggtggccggtggggccaatgggctttggcgctttgctatgctgaaatgtgtagtagagatcccgagccgtgggggtaatgcctctgtttatctgggaacaatggcgatcatgcataagagcagatacaatagcaatctattagccagctgtaaacatattttaacgagataaaatatgagagagaagagcaacggactacagatttgtaaccagctacagcgcggactccaaaacacaatgtgtgtatgatagatggaacaatatattaataatatagtaagcaactattgtatgaattgcctattagattggatataatgaattagagctagcagtaagctatactattaaacttgctctaacgacacgctgtagctccgtggactctgatttgcagccttgcaggcattgcaggcttgcagctcgccgtgtgcccgtgagtgcggcctgcccatccttcatggctcgctctctcatactccagcttgcacgttcgtcgcccaggcgcccacgaccacgagcgtgccaccatcctgtggttagtttttctctctggtgctttgagccgactcgtcctctcctctgtttcagagacaaacaccatctgcgctccaggtcgtagcctcccagatctgggcgtttggcattcccttcgtcgatctctgtttgcgtttctgtacagatacttgcgttcgtccacgctgtacggctatcgttccctcggtttacaaaacagtgcggttacttaacggttatcgcggttacaatacataaagttttttaaaaccacggtatatcttgcggttatcaaggtaaccactttaccgtggggtccgataaccacgccgaaaacggtaaggggaacaagccgtgcgatggcagcgagccgagcaatatcatcatgctgctcgaggaggcggtcgcagcctcgcaggcttaggctggatttttcacattttggttcttttgaaaaacttatttcgcaaatagacccctgaaaaaacttatcctagaaatggtcctttttggggcgccagagtggct

SEQ ID NO: 33669 - DNA, 21730 bp, Oryza sativa
  unsure (1)..(21730): unsure at all n locations
agccacctcagcatcgccccgccacgtcggcagggggacggcgccaaagaggctggcgccagccactctggcgccccaaaaaggaccatttttgggataagtttttctaggggtctacttgcgaaacaagtttttcaaaaagaccaaaatgtgaaaaatccagcaggcctaggcatcagtgccgcagggcgatgctaagttgctaacgatacacacataattgataggttcagatgaaacaaacaactgcaaacaactcatggcagcaattagtaagtggatttcaaaatcgcacgataatggcatgcgggtatattgctcgaacgtgttattacatgtttgatgatggaggaaatgatacaaactttggtatatgaatgattgatgtatgctatatgctatgctacaactgttgtacaaagagtgatctgagaagactggcaagatcacacgagtacacgacagaagcgcaaaggtcagaccgtcagagattttatctcaccgtaataagatacaaatgtattcattctatataaactaaaaaaactggtacaactctatcagatacagacatttgcttactacaaacctgtgttcttgacatttcacctgcacaagcatgtccgttataatgtcagaagttgcaacaaagttaattactacaatcaattactggtacatatcaagatacactaatatgttcatgctaggaaaacgtcagtattgaacccacataagcgggaagacaccatccccaaatgagaccctttttcttaacaagtattcctattacaccactaagtaacaaaattcttcatgactagaaataacataaggcttcaagaaacaggcataaacaagctacttcatgaaatttcaggaaactgcaaagatcgatatctcctaaaaaggtttacttagggtatgcttgatcaaatatttagcatatgagatgtacttttatttctcagacatgaagacaatatcatattttgaaaacaagagaaggtttcaagcgttgaaaaggaaatgaaaaactggcatttgctagtaattgccaagataatattgtgaaaagcaattttactaatcttgatcataccttacaaataaaatgaacaaatcttcatcagttattgctccaagttccattcttctctctaaagcagtcaaccctccaccatctttaatggttgttcttgcacccctatggaacagaaatccatttaacattatccatgtagtcaaacaaaaattaacagtgactaattggttttttttgttgtcctgaggaaaatgggaggacaaacacaggattaaagggattgtaataatagcctgaggaaaggaaaatgcttttttgttgctgtttccctctctgttcctactaaactgttgaaatgcatcattgatgatctcgaaaaggcacaactcacagcacaagtggtatgccaaccaactgaatgccacctgataggcgctataggtatgatgagactgaaaatgagacaaacctccatagaccagtggaccttagacatgggatgagatgactagtatgaatccaagtgtttggcgaacaagtcatccaattgattttatacaattttggttatattgataagattactaaagacattgtcaggaccccagaacatatcatatatgcctcagtgtctcattctgtacttttatgctgaatgaaacaaaaaaaaaatagcctttatgtaaagagttcgatacttcagcttggcaacagtggaaggatagctgtaattatctatattccatactgctagaaattcaatcctacctctttagcagatgcttggtaagtgcatcatttttccttcggacacaatggtgcaacggtgtccgtccatggaagtcttgcttattaatatccgcaccaaaaagaagcagaagctctgccattatagaatggccatattggcaagcaatgtgcaacagggaacagccttgtagacaaccttctggtttcccagaatcatcctttacatcacaagatgctggatcaaataacttcccatctgttactgaaggatcatgatgaacatcattgtttaactcatcatatatcatgttagggctcacatcagccaacacaagaatgcgatatgctgccctcacatcattcgtccttacagcctccaatatatcaatggtaatttgattggtatctttggcaataagaagcttgtcgacatactgcatagatcatttacagtaattaatgatggcacaacaaacagaaggtcatcagaatcaagaaaacagggagctctaaatcttccattcatacatgaagttaatactatcaaaattagcaatagaaactatttgaagcaaaaaagaacttgagggttgttgcagcctgcattactcgacacttcgttgcatatggatcacactacaaaagcttgtggtttccggccagccattgatcaattatgcaagttttagagttgaaataccaagggttaattgttaagtatgcaattcattcatgttctatcaattatcttcagtatttgtaccctgaccgcaacagttccattcttggaagtctctctttacaaatgagattcttctgcatctctgcagaatgaaggatctcctgaagcaatctgttgttaattggttacaaactttatagggtcttttgtttttttctcttgtttcttcctgtaattatttcctataattattctttcaataattgaaaatcacactgctgggcaaagacctggcagtactttcagtcaaaaaaacagtacagtcagaaaataaaatgataaatcaaactacaaatctggttgtgaaccaatccatagactgagttctggctccaattatatctatgctcttataaaagaccatagtggtggtggtgagtttgcctccgccaccaccaactaacatgtgggcccatgagattggtggaccccacacgagcaatttgattgctctcttctgtttaccatccatttgaaatttgagcaagacataagctacactcttttaattttgccttttaagatgaagaacatcgcttcacccaagtagaggcaagatattcttttactaagagaactcataattatgttttatattaaataaactgctgcaacgcatggctattgtgctagtaaagtgtaaaatggttacatcataaagatttcccatgatccatacaactgctgctaactatatataatatatgtgcatgtgaacatccccagcctcccaaaagatttatgtgatatcagtcatgtgagtcgtagctacagaactgaagctggatagcaaaacaacacatttataaaataaaaggcaagggttacattggaattcaatcttcaactagcacatgactaacaaggatatacatcaatatcaagaaagcattgctaggttcagcatataaaaggatggacagaataatttacctttgtctgtatgtacctttcctttattgaaaaagcatcagtaggtttaggcttttcaatgaaaagaatagcatcattaaactcgtttattctgcatacacatcaagaagaaaatagataggagaaaggagcaaacttagtttttccacacacaatgaacatgtctgatgccaatgccattaatgtatgaaatatattcattggcactatcagattaaaagagagatcttccaactcatctgtagaagataataaagctaacctatcttgaacgtgtgaatgaaattattagcattaacatttctaaatgatagaacaccttccttagctacactgattatattcacctaccataatgaaactgatccatttcagtgcaagacagaatatcccattggaaatttcaagtctgagttaagtcaagaatgctatagtccattacaaatgcggtagtgcagtattatgctccttaaattgacaataatccaatgagtaaaataaaagaaaataaaatgactaaacaatacatgcagaagtacaaaactannnnnnnnnnnnnnnnnnnnttggcaaaaagcatattggctgatgtttgtattagtcaatataccactacttacaaatttcagaagagaggtgtaactaggaagaaaattgtctaaagcatgaaggcaaaacatagttaagaaaatatacatttacatacacttcaacatacccttgatcttctttcggaagcatagcttcccaaatggaattagtgtagtcatttccaagttcatggaacaagtccattatcactggctcccataccttgacatctaatcgcaaggatcgaacctacatcaaataagtacatcaaaagcaatccttaaatatggaccacactactgctaaatctgaaaatcaaatgatatttgaaatctacaaatcacaaagtcacaagagagtgtattgcaaaattaatgttcttagctctgaccatcttatatgcattagaaaatacaattgaaaggtacaacaagaaacacaaatgagcaaaaatctaaaataaaatagttaatctttccatcaaattatcattaaggtattatatcaagtacatatagcattatcacaagaaactgtgactgataactacatggagttggtaatagatgcataagtatcaggatatgtgaaaatggttttggtagattgttcatgaaaaaaaaaacactttcatacaattatgtttttaatatttctataaatatatagtcagaaaataatgataaaacatgtgaattagatactgtgaattgcctaggttggtaccacagcctggatctcattttaagagtcgaaggttaacagaggttggagtcgatattcttatgatcttatccaagctttctgcttctaatttgatttattaccaccaatccaccattcctttttactcgatgttttggacattgacaaagtttacaacattacattaagccccaatcatttcagtaatgattaatggcaatagcataagcattaaactttaaatggttccactattatattacagttttatactactaccgtggctaagttataacttttatgagtttaaaattttgaagtgctttcctgtgaaagacagggtcaggtcaccaaaaacgtaactttcaatgaagtagcataaattagactcaaaaagaaagaacaagtgacagagttcacaccttcgaaatatggactccaagattcctgtgagccccagaacactctatacaaataagaattcctaaatttagagatgcccaatcaggatccggtgaacgacattctgcacaactgtcatttccaggaatattcctgagatgattgaatatatcatcatgtccctctggacttttgttctcctcaagagagagagaatcaacagaatttgcagaaccatgatgttccgcctctagatttccatacgacacctgggattaactgaatcagcatacgattatactaaattatcctgaacaatcgatagctcgaatatatgattaaaatgcactaaaatggagctaattttaaggggcagaacaagcactattactatattaaatgattattatgcaatggagatgcaacttgcaagcagtgtagcatatcaaagtttttcttcaaaaagcacgaaagactagaaatgaagtgttgccataggaagtatcgaaacctgtcttgggaatggtaaattaagcagtgatgcaataactccagtaactttctcaatccaatccttttggtcagcaccagattctgcctgcgattgacaaagtctatagtattaatatataaaacaatgcatgtatcatcaaagactagaaatttggtgtcacagaaaatgtgacatccgagtaacagactaaggctgtgttcgctagaacacgttcccaccccggaacagtgatcacggaaaacggaacggtccattagcgcgtgattaattaagtatttgctaattttttttcaaaaacggattaatttgatttttttaagcaactttcatatagaaattttttacaaaaaacacaccgtttagcagtttgaaaagcgtgcgcgcggaatacgatggagaagggttgggaacccttgggtccgaacacaccctaaaagtgttccaattacctgtaaagtgtatgctttcatgggagagattactctgaagcaaaatcttaggtcattttcttctgcatcaatcttaattgttgaagttcttagatcaattttgtggcacgaaagtgcattgtcaccctgagttggagccttttggttcaagaatctgaaacgactaaaaacaccagtcccttcaccagctgtttgctgtgatgccgctccttgcttcccacatgaacaaagagataaatataaaatacagaacaaacaacatgcaattgttcaatatttcaggtatattatgtaacacaattaaggtataaattcccaaataatacattttaaacaatccatgacagcccacaaatcgctaacttttattgcataccgattgtcctttattcccgtagtagaaaagagtcccgtgactgtcgagaacaaagaaccttctcttccattctcgtgaattttcagaacgcttaaagagataaccttgtttgattatttgaacctgccagaaaaataaattagtgaaagaaagcaacaaagcttaactaaaaaaaaggttgcatgttatatataattaaaatgtagtctggtgaattataaatgggaataacagggcattataatactagaatttgaaccaaagggataacaccatcgatctctttgcctagatacctaatttaggaatacatgaagaagcaatcaccatcttagaaataaaaggtgcttcgctcttaaacatcatcaatccctctgaagcagaacattgaacagtgatgcagcaagcttagccgtccaggtatcctagcctattatttatgattgtttactcaacagtggataatggaagtacctcgccattggcagttgactgcattagggcttcaatctttttataggattgaagaccaacaacatggataccatcaccactggtagatgtgtccacattactagccattctcaagttcgcaatttcctcttgagtcctatattcttgaattctctttgcaagtttatcttgttcattgatagccatttcttttgattgctgtgcatatgttagaacctgtatcaaaaccttacagttagcatattaatggttaacttatggtcaatggatccatgctgattgaaataaatgttcatcggtttaagaccaataggtcagataagagattactaaacctggtgaatgaatggttccatttgactcagtagttcatatccctagatcataaagaacaaaatcaagaagaacccaataaaccaaacaataataatcaatcgaattatagagtgaccatgcctgcttgaaatatctcaaatgggcatccatcactgcacttattgattccaagaactcatacttcttctttgcttcaatatttgaaagtgcgtgcacctgaattccttacagccaaggagaattattggcttggcaaaatcaataaaattagcaacactatataaaaaaatgttcatacatactaggttaaagcggcatcgttcgaaagctgacttggcattgtgtagatcctgcaaatttggaattagagatgttgtatagaaattaaataaatgatcacttacggaaaaaaaaacaagttgtccctgttcacctcctcaagtcctgtcactacttctgctctagtccctttccgtactgatacaaatttttcacgtgcctgacaagcaagatagcaacatatattcttatagggcaccacatgccaaaatgaagaaatatgcaaattgaaaactaggtaatcacatagctagagtgcaagatatcacctgatcataccccactgtagccctatccaaacgctgacgacaatcctatatacagtgcaggatgttagcctatagtattaactaattaatgtgttaaaaacttccacatgaacatcaagacagtagggcaggtgtattgtatttaagacagaaggacatccatatattgttcccattacccaaaatggaagtcagtgaaactcgaactacatttctaagatcacttcatgcaattttttcattgtcagaagcaaaaggcttgaaattcggatccaacaaaaagtcaagcacgcaagcaagtatccatgaagaagagcaaaacctgaggtactacctacataaatacagatctcagtagtgtgcttaattttttggggcaggaggttgtcaccctcaccttcacgccatgcaaatccacatcaatgaattgcatcaaacgttcactaagcatatgatcaacctggttgaggacacatactgattagaatgatagagattcaatctgttaagctagtaaaaataaaaagaacaaaaacggttcttctttgcaaataacccttttacagtgtcacagtgttatttgcatcaaaagggaactcctagtcccattcagcaatcttacttttcaatttcattaccgatgagtgacatggacgtatgaaacaacatatggagaaggagaatcctatgtacctataaagttcattcccactaactgcaattaaagctattttcctctactctcatcgtgccatgtcacctcaatttgtatatgccatgcaaaaaacctacatgttccaaaaattcctgattaagtcatcaacctgcaaatgatccggcccaactaccacgcttccttacatgctccattctctcatcctctcactaatcaatcatcatcacatcctcttctgtaaccgctgatgcaatggcaaggaatctgagtggaccgcactggtgcagacaaggtaggatgtgaggaatttaatctgcatcttcagcgtccatcccctactatatgccttcctccgttcctcagcgcacacctgccctcactctggtgctccatgtctggcataatgcgtagcccacaagtcctccacaccttgacacccaacaccatgggtctaccagagaagtaccgcacgtatgcttgagtttatcatcccatcaaatactacaataatcacaggtcataatacccacctcattcctctcccctatgcttcctcccgttgaatgctttggtgagtcagaatcaactgagtcttgtcacaaaactacagatttggaaacaaacaattgaatatatcttacttatttttttcttgtttccaagtgtttgcattaagcaattgaaggaggtacattcacttcgatttgtatttcatggaacatttatgttatgatgaaactggacaatctttatgtagagtcctatttattgcagttcaaatttggacaggaagcattttttatctaaaattaaatgcacattctttcaccaatgcaatcagaatgtatcaaaatgaaaaatgttactatgctatgctctttttttcgttccatcacccagctaatttttcatattaacaattgatcagcgtgttgcagcgcacagggtgccaattactccctccgtcccacaaaaaggatttctggaggagggtcccagaaaaaaaaacgatctgtacacaaaaaagtgaaacattcaatgactgactacttcacatcggtggtcgagaaggaccttatctcttcccaggcacacacccatctcgctcgagtctctctcattcaccatcgtctcgcccgttcatcaatgcggcgctccaacgatctccatctccatctccatccccatgcccactgcgccactgtctcgcgctcccctctcgctcctcccgacgaccttatgcgtccaccctgatgctgcaacctggatgtgacggctgcatcggtggcggatggatgcggtgcagaggagattcgcaagaggcaaatccgatgctggcaacgacgttagatggaatgcagctcgggtgccgccgcggagagggaggcgcccgtggatctcccagcactgaggtggtcaatgagttcgagaagcgtgccattagaatgaaccccatttgtattctttttccatctattcttcttttccaccgaggtttctttctgcccttcgaccttgttaactgtattgaattcttcttgcccttaggcgcaccgtggatgactgccaccttggtgaaggcggacaacctttctcttctctgttcttggttcttgttaatttttgcaggttaaataagagcatttcttgccagcatttatttttttcagatgggagatgttctcttttctttctgcaggtactagaaaatttcaaatttttggcgcttatttttgtgccagatgcctctttttttttcttatagtatgtgctgtgtgaattaatgggtggatgaatgaatgtagtaatgagggcactttggtctttctatgttattactaaatttgcattgggaatccaggattccatattttgtgggacagagggagtagtacataaagaattcaatggcatagaatagattttacctgagaacgaaggagttccttgtatgttccaagctccctaaaagcagtagtgaacttggacattacaggccctgcaacagaattcagaatttggatcttccacattgaaagctgaatgtgttcatgaacttcactttattaacaaatttgcattccataatttcagtgaaatggcattgcattaaaccattacagttaagaaacattgtgttatcatactacaagcctacaacatattaataagtaaaataaaagaagtacatagtatgtgcttgcttatgtctgcatttatatatattctaatgatctgttactgtgatctttccttaagagagggaacagacataaaattaaagatgtggtacataatcgataggagacaaaaggacaccaacgtggcaagatgtttagcaattggcaaggatggactcagttgtttagctatctatggatgggaaaccaggaaaaattaagcaacagatataacagagatttgatgaaattaacctccaatggcaacactaacaggatcatcttgaccagcaccaaatgcttctagagcatcggcaaatgttagatctcccgcgtatccttcatcaagtgatcccctgaaactaaggttatcagcaatactataacaaaacaatatatcgaacatatggttttttattatcgttgtctatcctaggaacaataggaactacaaattattacatgtaacatggtaacaaaaaaatattaatcctgaactagaaaagtaagaaagaagaatgcaaagtcatttattgacacaattttatccaataaacatttttgtcgatataaacttgcagacaattcatattggaccatagaaacagaaacaagttttgaaatcgtgtaattgtgtgcattgcagtaaaaggttgtatgctacagaaacttgatattgacttacatcggcataaacctagagtgatgtctttcttaaaccaaaaataataataataatcatgctacgcattctgcatcgagtgtacgcctgtgctgcaaagttagtagctcgcccaaaaaaaacagtagttgggagcttaatgtacatgaatcttttgcatcctttatgaagatttgaacaccgttgtttcagttcatcgcttagctgttccatagaattgacctgcaaatcaatggaaataagccgcaatcaatagcatatatgcatgtaaaggtctgtttaagatgaaaacaaaaggatttatcaggaaaaagagaagattcaacttgatagcacaagcaggaagcttgcagtccaaattatatattaaaactactaaaaccaatctacacacagccttcgagtctaaggcactgtttgattcagcttagaattattataatctggattattaggaataagctgaaacaaacagatagcttattatgatagattattacaatctataagccagattactataatctagtaatccactctaaaggtgtttttttagattattggatggctaacagctaacgaacagcttataatccagagaaacaaacagctcacagcttattctatgtcggcttattataattcagcttacagtaatctggctcaataatgtagattacaataaacttaagctgaaacaaacagggcctaaataataggtcactattttttctatggcttctaataacccaaaccagccatttgaactggaaaagaaaatcgtctagcttatttcgtccctaagtttttacaggattttatctcgagaaattagacgatgaattaaaaaattgttcaagtgtgtgatgcagcaataaaaataaaatggcaccattacaatcagaaatgcagcactgctcaaagatgaaaacgatcgggaaaggaacagagaacacacaataaatgtaaaataatattccttttgcaacctacaatgcactcatgccggcaaatcaaaaccaacctacggtattcgtcgaaaccaaagcggaatttgatatccattctactcaggaacaatcgcatttccgaaccaatcaacggccaataaagcatgcaatcaggtcgagatctcgccacacagaatgcgcccaacctcccaaatcccagcccaaagctaccacaatcaccccaacctccagctccaccccccctaaatcccccaccacgtacgatccaaataccaacgacgcggagccggaggcgagatctcgcccgaaagcaacgaaccctgagaggaccggatcaaaaggtgacacctcccgcgggcagggagagaagagagggttcggcggggcggcgcacctgcttgcggaacatgggggagtcctcgagcttggtgaaggccgccatgcctggcgtcgcgcgggggatgacgctgcttgctgcggcggcggtcgcggtggcggtcgaagctcgcggagatctggaggcgtgggcgggaggtgggaaggaggaggaagaggaggcgatcggtcgggtagttgctgcctgcctgtctgtcgcggtggcgctgttccgctttcgcgtaggcagcctgcacggttccggggtgcacgggctccgggctcggctgggccggctgcgtttctaacgaaggaataagttcagtttgactcctttaactagtgaccgaatctgatttgtatccctaaatagggatggcaacgggtcgggttggtcacgggtagagcaaaaccatgcctgaccccatgcccgtcgtcgcccgcccaaatcctacccactagggttagtgggtaaaactctatgcccgtacccatgcccgacgggcacgggtatgcccgtcgggtacccaatggatctcacatgaataataactcgaaagatatataatttaacaaagaaaaataaaatcaacaatttaccaaattatcaattatcaataataatttgaattacatcgcaacttattattagttagtatcacaaatgaaccaagagaagggggtataataattaagagataaatcgaaattagctaatacaaatgtatcgggtcaggcatgggttacccacaggtaaaaaatgaagcccggctgttgcccacgatgtctacgggtcttgggcggacaagcccacgggtaaaattttacacccatgcccgtgcccattgggtcgggtatccgcggatacccgaacccatgggcaaaactgccatccctatccctaaaccacaataccggatatctcaacccccgactattaaaaccggtgcaattgattccctcgatggttttgaaggacggtttcgctgacgtgatgcgtacgtggcggtgttgacttgggcttcgttccacgtggcgttgatgtggcacttatgtggcagtagaattaaaaaaaatatgtgggacccatttttcatccaaaaaaaatattgtaggacccacttatatgtgaagcccacatgtcatcctctctccttcccttcttcctcctccctttatctcccttccctccctttctatcctcctttctattcccctacggatgtacgcggggaacgggggccaaatcggtcgtggcggcggcgagcgggggccggaggggtggcggcaggtgctatagcagcgacggcgtgtgtgcgggcgtccggtatggggccatcaagtgagttgtgtgagagctcaaagacgacaaggttgtagctcctgctgaagccgaagcaggactgcaccgtagcaggtgaggagtgggtcggcggcgagctcgcggaggtgtacttgataaccgtgttggcatccgaggagcggtcgtcgagggggacggagtactgcacctggcgtctgagcttgacgcgcatgtcggccgcggcgcgggtcgccgcgagcaccgcggtgaggcctgcctcttgccctgaccctaaactagctccaccaccgcgattagaagggagaagcagggatgagaagaggagaagaggggagagaggagctgggctcctgtcgcccttacttgtcgccgagccaccaccaggattgagggagagagtcgcgccgccgccatcgtcctccttcttcgtcccctcccccctcagggccagggtgagaggaagagggagggagggagggagggagggagtcgcgccgccgctaccgtgccttcagggaggggcgccattgctgtcgacggcctcccttcgggcagatctaagatgaaaagggagagaggccggggaggaggctgcgccgaggagtggcgcgcctgccacaccaggggctcggagaaagcagcggctccggcaactccgccgctccgcctacttcccttcccttccgcccacgacaccgctccccgtttttcatccgctccgccgctccccatttttcatcggcatttcgttttccttccgcccacgatgctggcctccgtactcgaaaaagtgatgggaaggatggaaagagtgacgggaaggacgaaaaatgtgatggagtggcatggatctaatttctcaaaattccagtggcacctagccgttatcgcgaatagtagtgacatttttctaatttatcacatttccagtggcatagatccaattaaccatatatttttgtgtggatgacaaattggtcccacatataattttaattatactgccacatcaatgccacgtggaatgaagaccgagtcaacaccgccacgtaagcgccatgttagcgaaactacccttcaaaaccatcgtgggagtcaaattccaccggttttaatagttagggggttgagatatccggaattgtggtttagggatacgaatcagatttggcccctagttaagggagtcaaagtgtagttattgctctaacaaacccgaaactaattgggccatacttgtaggctgtgtatgaacgtgcaactactcattgtctacccctcattctccgtgcgtaccttgttcgagcggttaaacgatgtgtttttaaaatatatatatataaaagttgctttaaaaattatattttttttaaaaaaagctaaaacctaattaactatgtggtaataagttgctccattttacgtgcacgggaagagagttcccaaacctagctaccgaacatagcctaaagaatccgataacattttgatagttgggaacattgttttctagtttttcttttagaactcatgcactttatttgtttgaaagttttaaaaacacaaggcaagagtgattcttacatctccttttcttgatcggacatacactttgttggcaaatatgagtactattactacagtcaaaggccatctgattttgctctgaagtttgtctagttgctctcgcaggaccatcagcaaccttgttcatttctctaggaatccatttgatttgatttgcatatgttgaccctacagaatgttatttattttgtaaaatgcaggccttagggtccaatgtcctagctcattgatgaagtcatctattcgaattgcttcggccaccgtctgtcatcagatagaaatataggttgatgataatgatgaatatttggagcttcagacagaccttatatttctgtaacaagaggagctcctgctttggagctgtcttcttcgagggatgtgaataaaattccaagcggccttttttccttctcctttcttctgcgacaacctttttcggcttttcctctcagaaacaaagctcacaacttatgcggaaagcctctcaaatcccagtccaagtacttcctaggcctcattcggctcagccagacagccattatgcccctgtagccacgcccacgtggacgatggaggacgcgtgtccgccggcgacaagctctggggtgggacgtggatggtgggcccgctgccaccaaagcttcagcgtgaggcgtgacggntgaagaacctgctcaacatggaggacattgccaccagtgacgacgtctcgatgcccaactccttatacttaggtcctgtttgggggagcttctctcagctgcagcttttctcaaaaattgcttctgctagaaactgatccagacagtccacagcttctgagaatctgtagttacatattctgaaaaataaactacgaagccagaagctatagaagctgggtttcagagcttttccagattctcagaagctggctaccaaacagctgcttctcagaatttaaagctcccccaaacagggccttagtaagaatcacatgatatctggtaggtattgctctggtatcgacgagtattaggtgatatcgacgagtatgaacatatggtaccaactaagtatcatcaatacctataggtatcacctaatacttggtaggaatcgcctgatacctctcaagtatgatttgatacgtgataaaaatcgtttgatacctaataggtatcgtgtaataccggttagatatctggatagggaaggatatgataccttgtcaggacctcacttcgatgatctgttcactgtccaataacaaattgacacaagtagtggtgactttgtgggccataagcaggatcaatagtatagccagttgatagccccaaaaatttccatatcatttagagctatggttagagatacatggtacaatagtaagggtgtatgggtggtggatgagtccctttcacttagatatttatgggtggtctagcatcgcatcggattttttcagacgggcgtcataagcagcccttctgcccttctgtaataattcatatattttcgcaagtggatggcttaaggttccgtatgctaaaatatatcacagacggacaacttaagttgttcacatgcgaagttgcattttcgcagatggatatccattgtatccccgttcataactatacaggcaaacgtaacgtttgtggccgaaaatgtggcctgcctatataatgatatgggcctccttgggaaaaatcttttttctattagtgtatgcagcatcttctcagaggagttgggaacttgtcccattactcttttttttttctttcgttttcatttaaaaaacattggtgaggcggagatgtaaaccattttcattatctaaacaaaaaggtaagcaacaaataggggaactattctaaactcttaaggggttcttcgttgtttgcttgtcacccacatggttatgataaattagaaaaaaaaacaagataaattaataagtgataaattactccacaaacatgcaatgtcaaattttaatttatacaagttgcaataaaaataaatttaattgtgaatatatgttaagtagacattttttttcaacttgtaaaagttgaattttaacttacctgtttgtagagtgatctatcacatattaatctattttgttgattttttaaaaagaaattcataactatttggatataataggtaaacatggagagatgttcccgtacgtgagaatatataatccactctcgcagcagatattggcttatggatttgaaaattctggcacgataaatgtgatttgcaacaaacgaaggaactgtatgccgcggctcgcatgacccatcgacgagtaacgcggtaacgccgctccgtaccccggcgacctgcctcgacagcgccgcagcttcggagcacagcagttcccgttacccatcggcaagcaacaacgcctcatcccgtggaagtcaccgtgagcactacgatcctacgatccattcccatggcttgctcctagagtacagcaagatccgcaagatgtgctctgtggcttaattttctgggagttggatagagagaaaagaaaggcatgaagagggggataagacaggtataataagaagtttaaaccagcgatagcgcaaccaacctgacaaaactgatgagctgaatgaaaaaaaccagaaaagagagtgcaagccgacgataaaattatcgccaactaaacacaagctccaagactagagaaaccatagaaaatcttatccaacacaaacgtgggctccacacacgagatgatgtgcagtaatgagcgagtgatggtctggtggaaagttaaattagtaaaaagaaagagaaaatccatgaaataccattgacaagcactctaatcccagaaatgccattgacaagcgcaatttactcaaaatgccatcgtacaagcgtttttctcccagaaatgccatcacaaccatactgctgttaactcctctccgttaagttgtatgagaagacaatcttacccctgggcaaactttttgctcaaacaacatcattattttgtattgtttgctcacacaatatcattttgaattgatgcatatttaaattcacatatgtgtattattttgctatcaatcaaattatttcaaaattaaattcacaaatttttgcatcaaaattatttcagaaattttgctatcaattatttcagcctggggccgatgcgcgctgcctggagctgccgtgccgccacctgggagcaccacatcgcagttgagggccgctgcaccgccgcctgggagccccgcgccgtcgctgggggccgctgcaccgtcgcttggagccgccgcaccgccgcctgggggccgcgcgccgccgccgggggacccccgcgccgccgcccgggagcgccgcctcgccgcctgcaagcgccgccgtgtcgccgctggggaccctcgcgccgccgcccgagagcacctccacgccgccgccggggacccccgtgctgccgcccgggagcaccgcctcgccgcctgcgaccgtcaccgcgccgtcgcatggggacaccgcatcgccgccgtcgtcgccccccatcggttaggtttagggttgtcttttcttttccccaatttcttttcttttaccctctggatagtaaaatttggagcgagggtaatcttgtcattctggtaaaaaaaattctaacggtgtggactaaacggtaagttgactgtgatggcatttcagggagaaaaacgcttgtacgatggcattttgaggaagttgcgcttgtcaatggcatttctgggattagagttcttgtcaatggcatttcatagattttctcaaaaagaaaagataaattaattcattgaagcttgtatgtatagccatcttctgtacgtacaccatcttttggttatctgatgccgctgacatgttcttttttatcgccggtagctatctacacatgttaaacttgctctaagagtgagttcaatagagcatgttcagccggtgatagacgtacatgttaacatgattgatgagcttgagagaaaaatacatgaaagagagtgttagtcgatgatagattaagcgctcgcttttacacaggctctaacacagagcgctactttctacagttggctgagagagtggcaaaagggaatggtgggccctaataaaataaaatagtgcttctgttatcatcgtactgtagatttctgttctagtgatcgtttattcctccatctcaagatgacatggtaaaaattatagctcgctgttggttatattattgtattggctctaagaagcgatgaaatgagctaggagagagaagtagtgattgggtggtgctaccttaacgggtgtcatgatgtgatttggcatgtattttactatgtgcagtgcggtgcccttgcacctaagccgaacaacggtactaatacgtctatacattatcaccagtccaccacctcaattctcaaatgtcaccatacaagcacaatgataatatattgctctacagatacaacatggaagtagagaaaaccaagatacacatattcagggcctctttgaatcaaaggatttatgtaggaatttcataggatttaaatcctataggaaattttcctatttggccctttgattcaaaggattgaagctttccaaatcctatgaaattcctatggaatgacacattgtatgtagattttggaggaaatttagcaagagctccaacctcttggaaaatttcctttgagtctatctctctcatccgattcctgcgtttttcctgcgctccaatcaaacgaccattcctgtgtttttcctgtgttttgcaatcctctgttttacacttcaattcctgtcagaatcctatgtttttcctattcctccgttttttctaccctgcgattcaaaggggccctcagtatactttttttttacaacaccataaagacagatacataaattaaataaaaatagggtatgaaaatataggaaaaataatttagatgccttctaacaagcttcaaggagtcgaccatgctgttgcgcaaatttttatcgtggcaaaccaactgaggacgagagttcctgctccaacctgtaacttcttgtgctatattctgatgtaaaaccagcagtatggatgaaactgctttgagcatcagagctaatggtctttggacaaataaaaggctcaatctcttcatccattacagaaatgggttggcacttttttagtctggtagttctaagaaactgcaatctcatttctacttctttcatagtaggtctctctcctcctttagctttcaagcatgcttgtgcaattgaagcgatatcatcaatttcttcctgtccagcctcttccaaaacttgggaatccaagatttccatcagaactccctgctgaagtccttctaggaagcattgtgataagttttgttttgtacctacatcatttattaaaattggcttctttcttgtcagaagctcaacaagtatcactccaaaactatacacgtcacttttccccgttagttggctagtgttgtagtactctggatctaagtaaccaaatgtgccttgtaccattgttaccacatgagtttgatcgagtggtatggatctcgaagcaccaaagtcagaaacctttgcagtaaagttgtcatctaggagtatgttggaagatttaacatctctatgaaaaattggtattgcagcagccgagtggagataagcaagagctcctgcagtttcgattgcaatcctaatacgatcatcccatgatagaaggcatttagcacttacatcattgtgaagaagttcacatagtgtcccattagatatgaactcgtaaaccaataaaggtacctctgtttcaagacaacaaccaaaaagcttcaccacattacgatgaatgatttgcgacaagatggcaacctcattaacaaattgatctatctcagcttgctccactattttagacatcttaacagccaccacacgttgatcggataaaattcct

SEQ ID NO: 33670 - DNA, 25796 bp, Oryza sativa
  unsure (1)..(25796): unsure at all n locations
actaattcaagtgccatacctacaacaattatatatcgacaatagtcagaacatcacctataaattgcctcaggtagattttttagagtaattaagtattaaccactgagggcaattcaatagtatatataacttactaatgagcttagctgatgtcacacattcccttcttgttgggtcgaactctttcccgcgagggcaacttgtgcaattatagcctccaataaaattttgacatctcccattgcagtagttcggtagcaagcactcattgacatcttcaaacaaaagaaaaagtcagcatgcacttctcgaaacctttaaagtccttcgaattaattgctatgttactgtggtgacatatcacgtctacatgcaaactactccacgccaataatgcattattttatttttctcaaataaggcttaagagagataaaagtaacataacatggtataaaatggacagctagcccacaaatttggatgatccgtaagaaataatcatcttaaaacgatggtaagagagagagtttccgcacccgtgcaaccatcttcgatgtatggatttcctccgaagccaggagagcacttacaacggtagccaagctgtgtcccatgtgttacattgacatcgatgcattcgctatggacactacggcatgcataggaattgttattgatgtcttgcgtagcttcctggcaagtaaaactcacgacagcccaccacatcttcatatcattttcttgagttaaatcaaaaagatctaactgagggtcatcttccgaggagccatgcatagtacgagcaactaccatgatctctgtgccgttagaagttgaattgttctgctcgttggttacgctcatatatccattgtccactgaaatgttcctcacgagatagtctacatctcctcgatccagaaatagttttcctgctctgcagttaagtcgaaacttttctagcgcgtagcaaccttcttcaagcccaaatgggaagggcacatttgtatttccacaaaatctgttacatattcctttcggaaagggattgtaacctgctcaatgatacaggaaattaaactattatattatgagcaatgttcttttcacaaaaggagcatatatatatatatatatatatatatatatatatatatgggtttggttatctaaatttagtggatgccttaggctccgttcggtagtttgtttagttttcacaactctctcgtttactttgagcatattttttaaaatgctaaaattgtatttttcttaaaactatatataacttaaaaaaaagatttgctccagtccaacaaaaagtacctcgaggtccgtgaggtaccggtacctcgaggtactttttgttggactgagaaaatctcttaaaaataatatcatcttttaagttataataattaatactcaatttattatgtgctaatggttacctctgcgtgctgaaaaaaaaaactactactacttatattcaaacagagccttagactgaagatgcaacatgcatgtgtaaagttttcttcacttaagaattaaaaataaacaaatttggtaaaaccactgatattttgatcttgcaaaactacaacttttatacatcgtattagaaaactacggatttagcactaatttatcatgaaaatatataatttaaaatagggtatcgcaaaagtataaatagatttactaatgaagttatcataaaactacatatgcgcttcagagtttagacccttagcactaatgttctactggagttataaacattatatattttttagttaaatgagcactaactctgaaaacttttattacaaaatatatagttttaacatactacatcttaatatttttttgataaatttgatgttaaatttgtggttttgtaatggatcattttaaatttgtaactttgtgatagtttagtcaaattatctatagttttgtgaaatttatgcttttaaatttgtatggaactgatagaatatcaatactacctaaaatgttactcctccatttcatattataagaccttctagcattgcccatattcatatatatatgttaatgaatctaaacatttatatgtgactagattcattaacatctatatgaatatgggcaatgttagaaagtcttataacctgaaacggagggagcagtagtgatgattgttatgccgcaccacccctatcagcgatatttggacctcacaatggacaatctatactattacaccatcaccaccgacctggcaaataggctccattagttagcccgcaccccgagtcctctgtcgtttcactgttagatctccccaaaatttttaaccaatatttttttttcgaaatcattatgacagacaagagatccaaatagtgcaatttgatgatcatgtaactaatcaattcaatgtatgcacaacaaaaaatcataaaagtactaattatacttaattgacttaataaggtagaagctctacataaaaaaaacttctgcagcctttggtttggttagaagtctcaccagtacagccttcttgagtgtaaggaatcccattgggattaccatcggggcaatagcagtaatagccacccctgtccgcattgaagcattgagagtttctactgcaagcataggttgctttgttcttggatgcgctgtgacagtttggctggtccatgatggcaccgtagatcgtagtatagagaaagttgcttccgttgatccaaggggaggaaagatcttccgtgcgaaactaataagagtcatacgtcaagcaagccttgacactggattgttcttgcggcaccacctggccgatgccatcttgacggacaatccttagcggaaagccctgcacttccctcatcgtctcgatcgtgcagcaacctatgccgtcacaggtcccatttgcttgcatcatgtccaccgggtctttgaagcatagagtcgtgcaagaacccatggtatcgttcgaacagtgtcttcgtaatagatgaagaataaattgataggtagagaagagagatgatgtatttattaatggcccactttaagaaatcatgggttgtagagtgtagtttctattatgatgtcctattgacatggcaccatagacactacttatggacactatgggttgggactacccttaggcaaaagaactactttaaataattgaagtggtcaaggtgatagttttgcacccacccctttcacataattaattaattacccaatttcccatgcaattatttggagtcaaattaaacttaagaaaatcattagaattgtattttgttatgcggctcttgtttctaattttgtaaatacaaagaatcgataaaaaaaaagacatatcagaatcttttttgaagggaaaacaatagagattgtgcttttcattaaatatagcgggagaaaaatacagccccttagggcaagaaaagggaaaaagctatatgcactatacagtgtgaggcaaaagtaagcgctttgctcctgccgttgcccatgtccacgcctcttccttgattttggcaaaaatgaaagacaacgtagcctcattatgctcaaagattcgttggtacctctccttccagatctcccaaacgacaaggaggatgagagtgcacagtcccttttttggaactcgcattgtgtttgctagagcttcccaccagtcttttatggtatgggtcgcctcccattgtccaagggtcaagctattggtaacactactacaaaaaccatctttcgtggcggccattttagattttcgctagcggaatttggagccgccacaaagtaaaggccagtgaagatctaatattttcgctgacggtttcgttccgcttgcgaaaatctattttcaaaagcggacacacgattttcgctagcggttgcggtccgcttgcgaaagtaaattttcgcaagcggacaaacgatttttgctagcggttgagtgtcacttgcgaaaacccattttctctggcggttgtttaaagagaaccgccaatgaaaatcaacccaccccgccaaaaattccctaccccaaattcaaaattccccacccggccaaattcaaaacaatccatatttagaaatgggcataaacatcatttaaacacaatccaaatccagagcatcacaaatacgtacataatattggcatcaatccaaatacaacattgacataatcaacagaacaaacacagattaacctaacaaacatccttacaaaccaaaacacacaaaaaaaacacagagaaccctagtcgccgaagccatcgggatgagccaccgccgctgccatctgccggtcgcggaaccaaaacacacaaaaacacgcttgccggcagcatcgcggtcatcgtcgtcaccacggtcacggtcgtcgtcgtcagctccgctgccggggacgagccgctgttgtcgccgccatccgctgccggggacgagccgccgccgccgacggggacgagccgccgccgccgacggggacgagccgccgcctcccgcgccatgtgctccccgcgccaccgccggggcagatttgcacgtcctccccgtcgccgcctctgttgtgccaccggcggcggcctcctcccctcagacagataggagaggaggggatgggagggcaggggcgacgcagggagccgccgccgctggtcgtcgttgccagagccgtcaccagtcatcgccgccagagccgccgccactgccgtcgctggtcgtcgcctccagagccgccgccgccgcagtcgccggtcgtcgccgccagagccatcgcctccatcgcaggtggagaggctgggagggaggagagggaggagagagaagaggagtggatgtgttgtgttttaatgtggagaagaggatgaggatgggtaggtgggtgttttaatgtgacagatatttttggttggattttcactggcggttctatttattggccgccatgaaaaattgcaccgccagcaaaaattatctattttcgctggcggcgcacctaattgaccgccagcaaaaatagacatactttcgctggcggctgcattagatgggccgccagcgaaaatgcattttcgttggcggccggtgcccctcaccccctcgttacaagtttgctggcggttttcacatttttccgccagcgaaatagaccaacgtcatgaaaaatcgtttttctagtagtgtaagccacccggattgctaccatgctacatattctttttgtgtatctgcaactgacaacaagatgtaaagccgtttcgccttctctatgttagaggggccaaaacccattattttgccattctctaatcgcgagccggtcgaaggtccaaaccctgttttggatgactagccatgcgtggaatttgcatttccccggtatccaaactttccaaatgagagagatgaaaatcttgtttggtgccccaaggtgcctgataagctgacgacgccgagtattggccatggcttgtgaacttataggtaatttgatcaggatcctcgtttaattggatgtcccgcacaacagtccataaggtgactaactgacctataaggtccaccgagattggtgggttggcttcaaggtctaagtcattgatccaagcattatttttcattccctgatgtaaggactttcttcgagattgcgttgaccaatggcatgaggtcttttggcctacgcccttctatccaaacggagtcccaaaaacgcatagtgtttccgtcgccgatggttacttttgttgacgcaaatcaacacatgaacatgataacttcttttagctttaatttgataacaatatgttagacagccgatacaacatccattgttttttcgcttgatgcgttttgaacatcgtcacggtcttcaatttaattcatatgtttttatccttacctcttatgctatgcgtgttttcataaaaaattaaaataaaatacaactatatgaaagactttttcataaaaaaaatcctataatatatttttttgcattttaatccgtaatatgttccatctattaatgatttaagagttattgattaaactctaatcattatgtcgttctattgagaacaaatttaataacatgcgggtcctctctcctctcccagctaatatatcttatttcccatggacgaacttaaagcataatattacgtttgtttgttcttacttataatgtaggatactgccatggtctccattatacttgtttgattgttttgcctatcctataatcatatatcataaaaatattgaaaatataacaacattaaagtattttatcacaaaactatagatacgttaaccaaactatcacaaaactacatatttaaggtgttgtatcagaaaactatagatttaacaccgaatttatcactaaaatatatatttaatgataagtaacacaaaactacatatttaaatactaaagttatcataaaactacatatttcgaagtttaaatccctagtactaccgttatgttagagctataaacattgtagttttgtgattaaattggcactaaacttatagctttgtgataaatttgttatctaatctatagttttatggtgttccatcctaaatatgtagttttgtcataaattagacgctaaatctgtagttttatgaaaatttggttaaagtatctgtagttttgtgaaatttctaatgatgttattttcatgtgccaaatattaacattttttatatattcgtaataaaaaaacttcaagattcgactatgcacatttaaatatatcatttgtttgagaatgaagttggtagagagaaattcggttatgcttaagaacagtgatgacgtaggctagattttaacttggtgatttgaaaagtaactgcaaaaatattgaacttgaacgatctatgaaaactcttaggatgcgtagacctttttcctcctcacatttttctagtgaacatccttatgttaccttgatgtgatttcatatgcaaaacaaatgttttctccggcccgtgagtcaaataacagatcgatgtaaaagccggtatatatgtcgagtgtaagaaatttaccctcactccatgatagaaagcaaaattttgtaaagagaaatatgtaatttcatactgtccaatgagttcaacataaagtttttacagattttgaaagcctagaaacaagttttgaagttctaaaattctggaccagccggcactaaacaatttctagaggaggctatgctcattcattccccttggtaatttttctggaggtcactaactataccaggaagccccacaaaaatacgaaaaatttcatctcctctgtggcccctctaaaatttatgaaatggttgatgtcctattgttctaaaaatcccaaattctagtcttctgaaatataaagtgtgcatcaaattgaacggaaatataagatgttataatttcttcaaatactagtttattttccatgaattaatatgctttagttttttatgttggtttttcaagatgttttttttcattttttgagtttttttagaaggggagcagttttttaagaagagaaaggaggacaactgtgtttctaaagcagttaagaataagaagataccgcgttcacgcttaatgtcgcctagtagctagttctgacgtcgggcctcatgtaattttcaaatacgacacttagtactatcatttgtactaggcgagttggcatattgcaaggaggacgacgttgatttgtgcagtttgtcgtactaaacagggttatgtaaatgaaaaaaaattcaatgacagcattgccaccatacgatgttaactatagccgtttggccaggtcatatcgactcgatcaaaccggcgtggtcagtacgtacggtgcacttctgttaacacagctatctctaggtgaaagcctatataaaccatgttttaggacggatggtttatcatttaaaccagctattcgtattgaagttatagattttaccggatgtgctaggcaacagggaagcataattaatgtagatcagcccttgcctctcccaaataaatcgagtccctacttcccaagaaaaattttacaaggttgggaaaaaggaaattgtcccttgttaatagaataaaagtagtagtattagtgagcgggtagatatggagaattgaagtactaaaacttctcgatttatagactaatgatagttataagttaaaaaaatcaacttatcttggaacatattttaaaccgtagaaattaacttaggctctgtttgattcagcttagaattattataatctggattattatgagtaaactgaaacaacgagatagcttattatgatagattattacagtctataagtcaaattactataatacgataatccactctaaaggtgtttcttttagattattactccctccgtcccataaaaaacgaatctagaaccggatgtaacatattctagtattacgaagctggacatatattcagattcataattctaagattctagtattatgtatgtccagattcataatactaagatgtatcatatcaggtactaggttggttttttatgggacggagggagtaggtggctaacagctaataaagagaaacaaacaactaacagcttattctatgtcggcttattataatccagcttatagtaatctagctcagtaatctagattacaataatcttgggacatatggagtacttcctaaactgacgattcgttcgcatactgattacttcatttctaaatgtaagtattgctaggttttcttacaaagatttagacagaaatattcatcttattggtcaaattacaaaaatttaattgtttaaattccccttctaagcacccaaatgctttgattcacttgcattaaaattggtgtcgaagaaatagttgtattgtgtacaaatttgaattataggaatgtttttaatggactgatataaggtgtggaaatttcattgaatataggagtgcaaagggagctttacaagtatggtgtggaactgtacaaaaggggaaagggagaaactagggaataatatctgtcgttttactgctattagagccgattaatttttacggccaaagatggcaccaatagctcttgtgatgaaccactctatgtttcctcttcttccatattttccatacaattagtaggacgagtgtacgaacatgcctttggcggggcttgtcattgtcggttgctagtgttacccaccatttgtgcgctatgttggttttgctccaccatctccatgtttttgggtttaattgtgcaagaggccggtagtgtgctgtgtgcggaggatcatcttccacttccttggtgttctcctcctcttcgctacttgggcctttctctttttttttcgaggaagagtagaaatatattactcaaccaaagtgccagtacaaactaactgagagataaaattacaggtttctcctaaccaaaaatcagaaacaaactctgaacaagccttattggctagcgcatggcttgcatatatggttctgggagcggtgtatcttctgaatgatgatttccctttccccagcgcggaggcgtttaacttcttgaatggtgtgagctagtgctgatagatacttctctttagactgaatgagctaagaggccaccaaacaatcagtctctactacaatagacagcaaagtccattggatcgccaaagcaatttcctccgcgcaggataggagttctacttgggcctttcttgaccccgtagtcatcaagagtgatcttgcccctaccgaaaagggaagagctctcctctgccaacgtcaagtcaaccccccccccccccccccaacacacacacacaccgtagagttcagccaactcaacgtgacaaacaaaatggtagatcctggcaccactagaaaaacagttttctacagcagaacacataatttttgtatgtgaacttatttttgactatgattgtccgcctccctagttgtatggagagatgtctaatagccacccgcctaggaaataaatctattttcgcaggcggatggcttaagaggtgcgtatgcaaaaatacctttattttttcaggcggacctcttaagtcgtccgcttgtgaaaattggttgtggcatttaaatagatgctagaggaaactgaaacatcagatatttctaagtcccaaccccctctcttctccttagttcggcgatgagggtggcgagggcggcggtggtggggaagggagcagcggtggctctccaaggccgtggcgcgcgggataatagacggcaacgcacctgggaggcggggatccagcgacgatggcatgcgtgggcagcaaatatggtaaaggcgacgcgcggcgaggaggattcggcgacggcgacacacgtgagttgtggatccagcgacagcgacacgcatgggtggcgggggcgcaccctcctcgcattgctcatggttgtcttcctcgtcatcatggtggaggaagccggcttccggatcggctcctcggcagcgacggtggcatccttcctacgacgatgaccaccaccacaacgtccaacttgatgttttttttcttttttgttgagaacttccaacttgctatgaaaaatacgggtgtggatttgaatgtgattttgaacgtgaacttccacatattttttgagaacttccaccacggatgtgtctttcaatgtgaatttgcatgccatgaataatatattgctttttatttttctttttgcacacaattcttttggcaagagttcctcttaatgggtccttctgcaaaaattgacttttgcaggcagacccatgaccgtctgcaaaaatcgacgattttcacatcttgctataggcagagtatttggccacatgcgaaaatgtgttttggccgcctgcaaaaatagcttttctagtagtgcggacaaaccttggatagggcaatggctcatccatggtaacggcaaagcttccttccacgtagccaggccgaatataatatcgaggcatgaaaatgggaagcgactcatttgtgcttcatgcgacccactaacagactgggggtctgtttggggagcatctagcagttatagcttctcacagaatctttaggaccccaaacagtccagattttacccagattctaggaatctgtagttgtagaatccggaaaatgaactagaacccagaagctagaaaacccggcttctctagattctcagaagttggctaccaaccagcggattctcaaagtcttaagctccctcaaacatggcctagaaacgttgtggcaagtatcccgattcgcgccatttcgcactaaatcgacgaatttgatacatgttgtgtgattatattattggattttgatgcacgtaatataatcggacatgcaacatcacattgggggacaatgtctattcgcacaaggaatccccctacgcatatagacttggactcgaaaaaagtcctccgccccctcaccgaagggggaagggaggttcggagtactgtttacaattccgataccacttttcatgccggacgctagtggcacatcgattttcgtgaagtccgatcgaaaaccgatagattctgaacaatatttgtaggcaaaaaaatgaattcgaatgccctattttggtcggtctgaaaatcaatgggctttaccgaaatttcgaagaggaaacaaggcgttgttcagctccctttgttgcagatttgtgggctatagcatcaatccaacacatcagtttttttttttggtgcctatcgctagcgagatgcaattgatagtgtagtggtaaaaggtgtgcggtttcaatcttaaggtcccgtattcaatccccatcctatcagataggatgactcctgaactattaaaaccaatgcaatttgactctcttagctgttgacctggtcttcatcccacgtggtgcttgtgtggtattagaattaaaaaaatatatatgtgggacttatttatcattcacacaaaaatatataaggaaattttgctacaaggcactgctattgtgtggttttagccctaggacaccgcaaaaactaacttttggaggaaaacaatccataattgtggtattttgccagtggacaccgtgcctggttttagccctaggacaccgcaaaaactaacttttggaggaaaacaatccataattgtggtattttgccagtggacaccgtgccgactaaaataataacttccaattgaagaggagagagaaatcgtgtgaaatgtcaaaaatgccaaataatatattatgggacccactgtcatcctctctctatctccaacccttcttccttcctctctctcttccttatctctctctctcttcttttggcaaaatttgctacaggacactcaaagattatggtctttgctgtgagacactcgaagatcgtgtatttgctcgtggacactgtaaaaatatggtaattagctgctggacacccctcccattattttattattttttggctgaactggagagagaaaggacgttgaaagtaccaaaatgcccccgtgccgttttgcttgtaaacgctggttgaaccagacccaatcccctctcattggaaacggaggcaatgagccggctgtcaggggagaagacgaggtcgaagacaccctcgccgtcatcgtcgtcgcacggtaagccgcgaccactgcatcccggtcgccgtgccgcatctggccaccgcgccatgccgcaccacactgcccgctggatggccggaatcgtgcatgccccgccaccacccagccgccgcacggccggtccgcgctgctccaccgcccctcggccggccactacaccgctgggctgcgtcattaccatcctcgtcgggtcgcttccatatccgcgttaccgtgccagcctgcacctgcgccacgcctggccacgaccgccgtatcccggtcgtcacgccgtgccacgcctgcaaagccgcaccgccaccgcacgacgctcacctagccgcgccacctagccgccgcgcacgcggtcctggcgatagcatcctatggcgtgtcggcggtgaaggcaacgtacaagcagctccagcagacgcaacatccctatgacgccgaggcgattcagtccgcggatgccgcgttgtcctccattgccattgccgcgacaatcggagacgaagacgggaggggcacgagcggcggcacacatagcagcacaaggaagaagaggaagagagagaggatacgtgagaatgacaagtgggcccatgggcaaacttgtctttaaccaaagtttatctctccgttttcatcaaaaataataaaataatggaaggagtgtccagcagccaattaccacttttttacagtgtccacgagcaaatacacgatcttcgggtatctcacagcaaagaccacaatctttgagtgttctgtagcaaattttgccttttcttttctcggctgtggcggcagcgggtgggacgacaggtgctggagcagcggcggcgaggaacagggcatcgcagatgggcgcgacggaggaggggcaatgaaacgaatttgggacgccgagatgaccaggccccaatcgaggggagaagaggcgaggcaaggcgaggctggcgtggtggtcgacggggaggagacgatatcgattcagcgtactggtgggaccacgtggtgctgctggtgaggagggcgtggctcggcgtcgctgcctgattcgaggttcgccaaacatgtaaggcgacgagagggggttctggtggggtggaggcggcgtacgtgggtataactctgacgatgtttttggtttttatggtcttaagtctctggaggttgcggcagaggtgagcacgtgatgtgggagatgctgagccgcaccagcacggctagggcagcgaggcgggccgcgggcgctaccactggccaggaagcacagccggttccggcagccgcgactgtggaccgagagtatctggctctgcgggggcttatagaaggtctctgccacggcctagtcgtcttggccctggggatgtggaaacagagctggcgagggcgcccttcctcgcgtgtacaaactcgtctcgccgcccctcctacatcacgctcatcggcgacggcccgctccaacatcccgttccgcttgctgccaccacggcccaaggggaaaagaaaagagagagatatataagggagagagggatgaggaagaagggttggagagagtggatgataatgggtcccacaatatatttttgtatgtgaataacaaatgggtcccacatatatactccctccgtttcaggttataagatgttttgactttggtcaaaatcaaactgttttaaatttgactaagtttatagacaaatatagcaatatttgtaaaaccaaattagtttcattaaatcaataatttaatatattttcataataaatttgtctttggttgaaaatattattttttttctacaaacttagttaaactttaagcagattgactttaaccaaagttaaaatatcttataacctgaaacggaggaaatatttttttttaattctaataccacataagccccatgtgggacaaagaggtcaacactaccgcgtgagtgccacgttagcaaaactgctctccaaaacctcttggagtcgttgtatccggttttctgatttgagaaggggtgaactagatttcggcctattaaagggagtcaaagtgcactttttccatctacaaaaatacgccagtgggctttcatcctaggagtggtccgtgaaaactggatccaacagcccaactgtgcttacgtttcggcctttccccgccatttgcgctactggccgtgctccccgcccccacgccggcgagcgcgttgcagccttgcaggcgaggcaagaaccaacctatcgccatctatcttcaagaaaaaagaagcatatcgccatcgccaccgtcgccgccggggccgagcgcgcgcagctccttcacggtggagccgacggtagctagcttacgctcgccgccgctcatgagcaaaagaagcaatgtgcgtgcgtcgtcggtgcgcggacctgcatcctggcgtccaaggtgtcgccgcgaacagctgcagctgcaaatctgcaggtgccgcatcacgtgtacggtgtacccggtactgggctatactactggctaacaggccggtgagctgaaacaactacttcctctatcaaaaaaaaaaaaaaaggataaaccttgagtttccgtgtctaattttgactgtccgtcttatataatttttttttataattcgtattttcattattgttagatgataaaacatgattaatattttatgcgtgacttgtttttttaattttttttataatttttttaaataagacggatgatccaatgttacaaacggaaatcagggtttgtcttttttttagagacggagagagtataaaatccaaactggccagtgcatcaagaatcaaacgtactacggggcaccggatgcctgagacacggcaatgccggagtagatataccgtcggcgtcgaccattgtctcagggagtcacagatgtgtagatttgttgcgtgttgtcaggcggtcaagatcctcgcttatccctgcctctgctgctgctacagtgctctgcacccatccaatgtctgcatccataagatttgctccccaggccggcaccaatctctgacgatctacgagcttcaacagcaagcagggctagcattcatcaattcaacccctcactcatagagtcctaggactactacactaccactgttcctgtcctgaaccgtaaggattttcttttgtttgcaagtcgattctactacggtcgcctattgaatttcggaagatcgaaattacatttcgtcaaggcagacacgttgctcactgtacatagatttgactctttaattcgcccccagcgaaggcttcctgtgcgttccattatgcgtgtacttgttcggtggatcctgcatttctgctatgctgttggacatgagagaaaaatggcgcgagccgaaaatttttagctgcggctccaccaccatgtggaggttaatcctggacgctagtagcaatccagttcttccccatggcgcgccaaaaatgcacaaccaagagtagtagtagtagtattctgcgccattacgccgatacggttggtagcttttctgtcaatgcatgcacgagattgcacttggcaacacagcaaaaggcagctatttctctctctccctctctctcacactaggaatcgagcaaaacgtttatggcacatgtaaacatgaatcatatactcctagctgatgaatcactggtggggttcacgcatttaggctttgttcgctagctgtgggaattaatcccagggaaaagcctcccacgtggggtttgggttgtcccctcaccccacacccaatccctccccgcgaatccccccctctcatccctctgtttggacagaggtgggattagaagggatcactaccattcactacacttcaaattcagaatgagtacaacatttttgaaaattcggataaaataaaaaaaactggaagaaaggtcacgaacgtcaaaataatctagaaatgataagaaaaaaattgatcatgaaaacaaaacaaaaattaaacgtggaaaataattctaaaaatccccaaaaaaataaaattgtagaattacaacatatgcactctaaacatagtccagaatttttaaacaatcataattttggatagattaaattctacaagcagtaaaacatccaaaataatcacaagttttccaatagatatgctaggaaccaacttaacattgatactacaaaaatctctcttcgttttcaaagaatctaactttcaaaatcagtctaaaactgaccactcttaacatcgtactcgcatacaatttctattgaaggggcactgcactattgcaacaatcaaaattcagtgaaaacagctttgttcaaatcagatctctctcattgagctaactggaagaataaaagttccaattgccattgtgcaaagcaagacaaaaattggttcttggaacttaataaatctctgtccaatcaaactcaataatatatctctgtctgatcaaacaagtgataattctgtagaaaaaattggttcctgcaaccataatagctacatgaattaagcagttaaggaaaaattatctttcatccatcgcatttcacaattcaaggagtctctaagaatcttgcaaaacaatccttccaatgggcacagctagcaaatgggccatggaaccctgtaactacacatccaaaaagaaacaagtgttagacactagacaatggtgattgctaatatgtaaactaattaagcaacaggtaaaataaacttgagcacaggcaataatacaattacacatcaaacacactgacacacacggagagaattactatactttaaactatgtgtgagaacataataatatgcatatgttttacaagattattaaacatgaaattagaggcattcaaggtggctacatgcataaatacttttaatctttcagcaaataaacagtctgcaatgggaggagggggatcaataatatgttcagattttgactagttccagaagtactttgtgtacttagttttgtttaaacctcaggtttgaagacataatttcctactcgatcattccacagaaaaataatatttttatcttttgaaggcatgcttttttgatgtaaagcttgtatctctattgctagaagctggacatgttatgtcagatcaaactgtatagcatgtttacttaaaaaggttgcatcctgaaagggtgatagttgtcacgcccagaaattcccgaatagaattccaagcagaatgtgcattaaaatccccgtccaggaccagccggggtacacaaacgacaatgttgacatacagatccacgtcttacaaacattgtaaaatcttacagaaatgcagcggaaaacaaaagataactggagctaagccttgacttgaacggcagcgggaacaccactccacaggcatcctcgacggcacggacgaagcctactcctcggagaacccgccatcggacacatactcgagctctgaggttggggggaaaagtagagcaagactgagtactacccactgtactcagcaagtcataccggaataggggtatgatgcatggatttaacaagggatagctaagcaggttcatttgcataaatactggcatttataaacaggaatttaatgcgaaaacagttgtaaaaattaaacagtattaaacatccgctgtccaacgctaacccacgttgcgacaggcccaaccatccacctaaactatccaaattcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcatagaccgtcgcagggcccatccaaactccatcacgcccacccttgcctggatgcgtcggctagaggaaagctacactacaagcccagccgttgcccacgctggcttgtggtaagtacgataaattcttccagggcatcccgcgaaccggtccttaactgccatgggtgcgactagcaaaaccatgcacccacagcccaccatgtggttcattttatttaaccaacaccagagcggtggtattaaaccaacattatcatataaacctatagtctaggttttaaatgagatccccaatgtgtgctagttgaactaagcatggctaagcaagtcctagtccaaagtctaatcatgttataacccaagctaacaaaggagcatgatatccaaaagcatggctgtaacaataggtatccatcccatagtgatattataaaacagtgcaatatttgaaagaaaacaatggagcatttgcaatataggatcaacatgttcaagtgacaagcatgacttgccttgctctgctgctggaggtacctcggcgactatttcgaagtacaccggagcgtcgaaagaaccggaatctagcgacatacaaagcaaacattgcaaacaggctataagactactgaaacagagaacaaaaccatttttaatggattctacacatttttcttgatttactgagacttgaatgggcttaaacggagctcggatgatttagttatgaattttagaagattcactgtgtttattactataaaagaaatccttaaataatttattgcgcaatattaaccagggctgacgtcagcgagggggcgcggcgccgacaggcggggcccaccggtcagcgaccgggagagagagaaagagggtggcggcttgcgggcccaccggtcagcggcacgggaaaaggatggggcggcggcgccacgtggcgaccggaccgacggccccgatctacccaagggtagatcggacggcggcgcgggacctcgcggccggggcgcgcgggcgcggcgcgagacggcggcgaccatggcgccggcggcgcggcgctcacacggcggcggcgcacatgcggcagcggcgcaaagcgacgaccgacggcggcggagagcgcggctacaggagaggaaggggaaaagaagggaggggatgcctcaccgagggtggccggcgcggaggaaggcgatggcggacggcgacggcaagccacgggaggacggcgtcggctagcggacgagcttcggcgtgccctaaggaaggagaagatagggattagagagagagagatggaccatggcgatcgggatccatggccgaaggcggcggtagaggtggcgctcacccgtgcgcgtggagatgagggttccggcgacgaacctcgacggaggaggggtggacgaggtggacctcggccgcgcgaagctaacggcggcgacggcgtgagacggcggcgagcctagcggcggctagcggcggccggagtagcaaaagcggcggcggcgggtggttgcacggcgcgggagcgatggggagctcgggagaggtcggcgaaatggggaaaaagcgagagggggtgccgcgatgcttaaatagggggagagggaaccggacgtgccgggagcggcgggaatcgccggccgacgcgggggagtggggaggagagagaggcgggattcggttttcgaatcccggccatctcgggcgcgggcgcgagcgggacaggtaggggaacgggcgcggggaatgcggcgcacgcgcgggcgtggtcgacgtggcccgggagagacggaggcgtgggcgcggcgtcggttgcggcggtggcggcgcgagcgggatcggcgggaggagggagacgggtccgacaggtgggccccacctgtcggcgaccccgagaggagggaggcgggcggccggctgtcgggctgggcctcggcctgcggccggcccagtaagggaggggaaggaagggagaagtgggccgacggcccacttgacaaaaaggagggaaaagagaggaaaaagaaaaagaaaaggaaaaaggattttccctggaattaacaattgcactttagtgatttttaattggttaaaattatttctagagctctgaaaattccactaaaaatcctgttaatgaatttcgacatgtagaattcaagaaaaattccacatgtcagatccgattattatttgcattactttcttagggttttctcctgatttcaccagcattttcttagggtcaattataaattacaattttgacttgggaggaaaacttcggggtgtgacaaacctaccccccttaaacggaatctcggccccgagattcggtggagctggtgaagaggtacggatgggcggccttcaactcatcttccctttcccaggttgcttcctcttctgaatgatgactccactgaacacggcaaaacctggtgaccttgtttctggttctcctttcgctagtgtcaagtatgcgaaccggcttctccacatatgttaggtcctcttggatatcaatgtgttccgaattagcctgttcttcaggtacccttaaacacttctttaattgggacacatggaacacgtcatggatgccgatcatagtggatggaagttctagctgataggcaacttctccccttcgttccaaaattttgtacggtcccacgaagcgtggtgccaacttgccttttgtctgaaagcggtgtactccccggagcggggtgacacgaagatacacgtaatctccggcctcaaaagttagctcccttcgacggttatccgcgtagctcttctgtcgagactgagcaatcctcaatctctccctgatgattctgactttctcttctgcttccgctaatacttctgttccgaacagctgacgttcgcctgtctgatcccagaagagaggtgtgcggcacttccggccgtatagagcttcaaacggtgccatctgtagactggcctggtagctgttgttatacgagaattccgcatatggtaagcttttgtcccaagctccaccaaaatcaagagcgcaagctctcaacatatcttccaagatttgattgactcgctctgtctgaccatcagtttgcgggtgataggccgtgctgaaatttaaacgggtcccatttcttcctgcagcttctgccagaactttgaggtgaactgactacctcggtcggagactatcttcttgggtaccccatgcaaacacatgatccttgcgaggtacaattctgccaatctctttcccgtataggtggtatgtactggtataaagtgagccaccttggtgagtcgatccacgactacccagattgaatcatgtcccgatgatgtccggggcagtcctgtgataaagtccattccaatctcctcccatttccattccgggatttggagaggttggagtaaacctgctggtctttggtgctctgctttcactcgttggcaaacatcgcagagtgcgacgaattcagctatttctctcctcatgctgacccaccaaaacttttctttgaggtcttgatacattttagtgctgcctggatgaatggagtactgggtctgatgagcttcggtgagtatcagatccttcaattccttgtcgtccggtacgcacaatctttctcccatccagattgtgccatgctcatcctcaaggaaatcccgagcctttccgactctcatgttctttttcaattctgctatttccggatcatttacttgagcggctctgacttgatccacgagcgtaggccgtgcctccaaagcggctacaaacccgtgttcaacaattcccatgttgagatgttcaaattcctgccgcagttcctcacacatgccctcgatgcatagggcagtgcagtaacttttccggcttaaagcgtctgccaccacattggctttacccgggtggtagtgaatactcatgtcatagtctttgattagttccaaccatcttcgttgtcgaaggtttagatccggttgggtgaagatgtatttcagactcttatggtccgtatatacttcgcagcggtttccaatcagataatgcctccagatcttcaaagcatgaaccactgctgccaattccaagtcatgagttggataatttccttcgtgtggacgcaactgccgcgaggcatacgcaaccactctgccctcttgcattaggacacatccaagtccgtgacgggatgcattacaatagacttggaagtctttcgtcgggtcgggcagaatcaatactggtgcggatactaatttctttttgagctcctcaaagctcttatcgcactcagctgtccatttaaacttctcatccttcttaagcaactgagtcatgggtcgggcgattctggagaagttttcgatgaatcggcggtaataacctgccagtcctagaaaactccgaatctgcgacacggtctttggtggggtccattttgtaactgactccacgttcgatggatcaactgctacaccctgggctgtaatgacatggcccagaaatttgacttccgtcaaccagaagtcacacttgctgaacttggcgtatagctggtgctccttcaacttctcgagtaccagacggagatgttggtcatgttcttcctcggactttgaatagataagaatgtcgtcgatgaataccacaacaaacttgtccagaaatttcatgaacactttgttcatcagattcatgaagaatgcgggtgcgttggtaagtccgaaagacataaccgtgcactcatatagcccgtaccgagtggtgaaggccgtcttccgaatatcctcttcccggattctcagctggtggtagcctgatcgcaggtctatcttagagaacactttagctcctttcagttgatcaaataaatcgtcgattcgcggtaagggatatttattcttgattgtgacctcgttaagtgcgcgataatcgacgcacatcctcttcgtcttatcctttttctccacaaaaatgaccggagcgccccaaggtgaagtgcttggtcgtatgtaccctttctgcagctgctcatcaacttgcttcttgacctctgctaattcgttggccgccatcctgtatggtctcttgtaaattggagcggttcccggtgccaagtcaatccggaattcaatctccctcttgggtggcatggtagtgaggttttcggggaacacttccggatactcgcagactatgggtatatcttccaattttctcaagttcttccccacggtgtcactgggatttccgtttcaatctgattcaacgaggctcctttctttggcgagactagggatttgtacaccacggtttctcctttctcattggtcagggtgactgtgcgattcgcacaatcgatgactcccttaaacttggtcagccaatccatcccaagaatgacatctaggtctttggattcgagaaggatgaggttggctagaaatggtgatctttggatttctattagcactgaagggctaaaactgactgaggttgaactatttcccggggtacgaaccctcattggtgtgctaagctcttctttccttagcccatacattcccacgaatttctttgaaatgaaagaatgcgttgcaccagaatcaaaaagtactgttgcagggattgagttaacagggaacgtacccagtacgacctctggtgctgcttgtgcctcctccgcagacgcgtggttgacacgagcctggataaaccttggcccggcacgcctgggcttcgggcatttgtcagcgaagtggccaagctcgccacagttgaagcaggaccctggttttgctcccgtctccttcttggcttgcgcgggctgggctgactgtgccggtgccattggtgggcgtggagctgcaccgcggttgggctggcctccctggtggttctgactgccactagtgccctgtggaagttgctggagttgaacgggcggtgctggcggacgatcatggtggtaggtccaccctgctgtccgggagtgaagcgcggtcggtgctgactgccttggttggaccggaactgcgccgcctttcttttcctgtccattttgttgcgctgatcctcctggcggattgccttgtcaaccagcctctcaaagtcggcgtagtccccagatatcagttggttggtcagctcatcatccagacccgccatgaacttctctgcttctcggcgtcggtgcggacatcctctggtgcatatcgcgcgaggcgattgaactcatggaggtactctgtcacagtcctgttgccctgatggagcgcacggaattccctcttcttttgtgccacgaccccatctggcacctgtgccttcctgaagctacggcagaactctgcccatgtgacttcagtacccggtgggcgggtggccatgtggttgtcccaccaagctgacgcaggaccctgaagctggtgtgtggcgaaagcgaccttctcctggtcattgcactgcaggagattcagcttcttctctatcgcatggagccagtcatttgcctccatagggttggtggtgctggagaaggtgggtggcctgacacgtagaaactcaggcaacttggactgggggggagggggaccaactgctggtgctgctgttcggcgtgctgcatcatcctctgatgcatctgctgcatcatggctgccatcatctgagtctgatgtgccataacttgggcaagcgtcggattctcgggaagtggtggcggaccattgccagaatcaccgttggggtgcacaccatcagcgcgttcttcgccgttgctgccctcgcctgttgcgcggctaccagtcctggtgtagaccatctggagggaagagcagacggggaaaagaagaaaaacagatgctcaagaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33671 - DNA, 11583 bp, Oryza sativa
tccaaattccatagtccacatcgccaatttcgtccatgtttgtgaagccttcttgggaattaagccccacttcgctctgtttcgccggatcttctttctcaagccccaaccgaacaagagtaagccatgtgtagtcgggggggctggatttcagctgagggggactctgagccagaagtacttctctatgcctttcaaaacctcaaacaaagggtggcatgcaaactggttttatattcagaatcctgagcctgctcttcccgagtactcttgtcttcctccggtgtacctagatacctggaactctcttccgattggggatgaagcagcccaagccttggagttgatggatcgcatgctaaaactcaaagaacaaggcttacaaggagagcagattactcggcacttcatcaaatgccgattggcaccaattaaagaaagatctcgtacggcattcgagtttgacggcaagcatgatcctaaccgcgaagaaccagattctttggattttaaaatcatgaaggagagaatgtataaaatcttctcaaacgctattgtcgtcagctactcacatcagctgccagttgtgccatataacgcattcaatccgcctccgcaggtatgtatctgaaatcttcaacctatgaccaaaacattatcttgtcttcatgttgagttaactaaccgtggaggcatctcattcaggaatatgtattgatgaaatctgatcctccaatcactcagcgccggtctcctcgccagcacaccgttcagggaggtggagggccaacaatcagatcagatccgcaacctcaaacctccaatccaactggacagacaggttctcgcaagagaaaactggtacttgacaacgatgaaggcgacgacgacaacaaatctggggacaagggctcgcctaataaactcccaaagcgtaccatgcccaggaaaaaactggctaaccgcccaacgccaaagattagaacatcttctaggtataaaacctcttggtaccatttcacttcggcacgcttctctcatgaaaataatactgaatattgaaagaacactttgcaggaaaccatctgacatagacccaactggaaaagatcctgatccggctgtgacagagccaaatttatccaaggatcctgagccgactggcgcccatgcttcgggtgataaggccgatccgagtgaccagccgccgactggaaaccagtcggcagcagctgaaactgcaacaacccaagagcccccgactggaaaccagtcggatgtaggtctcgatcaagaaatccccgaagttgaagcgcagacgacaacttctcaaggaccagaggctggtaacgactcgatgattgggtctccaaataaagaacaaggatcacctcacgctcagctaggaacatcctcaggtaacccgtcttctcaagtgatgctgatttaaataacctcggtttattcgtctaacgtattggaaatacatcaggaccaccaggcgatgatgaagaagagattcctcgcataaaagcggctgatgactctcgtcctccgatcttgctcaaatggtgggatgaaaactcacaagctgccggcatcgtcataaatcgtcaaaaagaggatgaggaagtgtgccagctgaagaaggcacttggagaagccactcgcatcgtgaatgtaaatattccgggtgactgccttttgacgactttgttttctcttcagcaaaactaaaccatgaaccatcatgcagagaatccatcttcgtaatgaggccaagaccgcaactttagaaaagctggttcctcatttgggaactcttgaagcagttagggaccagctacacgaggccaaggagctcgccaaaaagacagagaaggaattaagggaccgaattgcccagctccaggattcaaactacgagctgagtggttcatcaaaaggtaatctctagatctgtcccattaatttatgctgtcataactgtatcctcaactattcggatttcaaacagcgcatgccgccaggatggctcaaatggagaaacaaattgaagccctggaaagagacaaggtagaactggctgcgcaaagggactcggccttgaaggaggttgaaggtactgccagctgacaatctgaacttccctctttttaatgcagcagattcttattataaatatgttttgcagaccgcaaaatcaaatctcaagctcaattcgacgtcctggttggtaagatcaagaggcttgaaggagcaagagatgaagtcgctaatgtcgctgccccactcgtccaagctatgttcctcaataacagtggtccgagtgcactcgacgcaaccgaaattttcgacaagctgagagttgctccggatgtatatttcaagaacatcaagaaagctggaagtatgggagctagcatggcattggcgatgaccaaatccttgtacccgaggattgaaattgacgccattgatggctttgcagacgggacaagcgaagaggctgctcttgatcttatcagcaatgctcaaaacgcggctgacaagattgcaagtgacgttgtagatcaattccgcaatactgaccttcagccgagtagtaacaactctgatgatgaaaagactgattctgagtgagtatgaatgtagcaaatggaggctcaacttgtacaatactggtgtatttatgctgtgcttgataattctagccaagtctttgatttcttaaaagcttttatcaagctttgttgagcctaaaacccaaagaagctattaaaaactttcagtcctcgcaaactaagtagaaaaatcgaacaaggcaatgataaaccaagtaagcaaattgaattgataaaaaatcacactacgttattatgatgatagcccccgactgacaacttcaaggagaaaacttgatgttgacagtcaagatagggaagtacaatgataagcctaagcgtagaaacgacgaagatgttcaatgttccaagagttgtcgacgagagtaccgtcttcgcgcttgagtcgataggaacctggccgggtgacttcagagatgataaatggcccctcccatagaggagataacttgtgccgatcccgtgtagtttgaattttcctcaaaaccaggtcgccgactaaaacggcacgggatcgaacattgcgattatgataacgccgcaacccttgtaagtatcgagccgaccgaatcaaagctgcttcgcggacttcttccagtcggtgcaagtcatccactcggtcctcttcatagcgttcttcgcggaaattacgaaagcgcaaagactcgaattcgacttcactcggcaacattgcttctgccccatagacaaggaaaaaaggcgactggcctgtggcccgactgggtgtagtacgcaaagaccaaagcactgatggtagctgtttcacccatttgccggcatagggttttagccggtcaaaaactcgcgctttaatcccttgaagtatcatgccgttggctcgctccacctgtccattgctcatgggatgtgctactgaggcataacaaatcttaattccaaagtcttcacaaaagtctttaaaaactccgccagtgaattgtctgccattatcagtgatgatccgattgggcactccaaatctatgcacaatattgatgaagaagtctcgagcgttatctgctgtaattgtgacaaccggtttagcttcaatccacttggagaatttgtcaatggccacaaagaggtgcgtgtaaccgccgactgcctttttaaacgggccgaccatgtcgagcccccaaaccgcaaacggccaagacagcgggatagtctgcaactcttgagctggtagatgaatttgtctggcgaaaaattggcaaccttcacatgtgcgcacaattttgtcggcgtcggacactgcagtaggccagaaaaaaccctgccggtaagctttgccgacaatggtgcgtgcagcagcatggattccgcatatcccagaatgtatgtctttcagcaattgtctcccttcctctaaagatacgcagcgttgcagaactcctgaagggcttttcttgtataactcagcttcatgcataacataaagtttgctccgccttgaaatccgctcggcttcatctttgtcttggggaagttcttgagaagtcaaaaatcgtatgaggggctctcgccagtcggcttcaaccatagctacgtcatgagtgcccgcaacttgagtagtatctttgtgaggtactgtcggcgtataaaggtgttcgacgaaaacatcagagggtgccgcctcgcgcttggatccaaagttggcaagtctgtcggcggcttcattattgtgtcgaagaacgtgactgagctcgagtccatcgaacttgtcttccaatttgcgtacctcttgtcgatacgccatcatgttgtcgtcaaggcaggaccactctttcataacttggttgacgaccagctgtgaatcgcctcgaactattagacgctttatccctagggaaattgcaatccgcagtccatgaaggagcgcctcatattcggcgacgttgtgggacgccgaaaaatgtatccaaagcacatagcttaatctttctccagttggggaaattagaactactcctgctccagtgcccgaaagtctttttgacccgtcaaagtgcatggtccagtgctccatcttctccgcgggggtatcctcctggcactcggtccattcggcgacaaaatcagctaacgcttgggacttgattgaaattcggggcttgaatgatatgtccaaagacatcaactccaaggcccacttagcaatccgtccgtttgcttcgcggttgtgcagtatatcaccgagtggaaatgatgtgaccaccgtcaccgagtgaccttgaaagtagtgagatagcttcctggtagtaattagaataccatataacagcttctgaacctgggggtacctcgttttggagtcggctaggacctcgctgacaaagtaaatcggtcgctggactttctggacatggccttcttcctcgcgctcaacgaccaagactgtgctcacaacctgggaggtggctgatacatacagcaacaacggctcctgcggatgtggtgaagctaagactggtggctcggtgaggagtttcttgaaatcttcgaaggccttctgtgcttcgggtccccactggaaatcatctgttttcttcagtagcttaaagaagggcatcccccgctcgccaagtcttgaaacgaatcggctgagcgccgccatgcatccagtcagcttctgaacatctttctggttacttggcggtttcatgttgaggatagcagtaactttctccgggttggcttggatgcccctatgagacaccataaaaccaagcagcttccctgacggtactccgaaggtgcacttttcagggtttaatttcatcctgaaagcgcggatgctcgcaaaggtttcttctagatccgagaccaaatcatccttttgcttggtcttgacgactacatcatccacataggcttcaacgttacggccgatctgcgttgagaagcatctctggatcatacgttgataagttgctcctgcgttttttagtccgaacggcatggtgacgtagcaatatgctccaaagggcgtgatgaatgaagtcttcaagcagtcagattccttcagtcggatctgatgataccccgagtagcaatccaaaaaactgagaagctcacagccggcggtcgagtcgactacctggtcaatgcgaggtaacccaaaaggatctttagggcaacatttgttgaggtcagtataatcaacacacatgcgccattgccccgttttcttccgaactagaactgggtttgccagccagtcgggatgaaggacttctttaatgaagcctgccgctaacagcttagttaattcctccttgatcgcgtctttcctgtcttgtgcgaatcggcggagtcgttgtttgataggcttggcatcttctttgacatgtaaggagtgctcaatcacctctctaggaataccgggcatatcagatggtttccatgcaaagatatctttattgttctgaagaaaggtgatgagcgcgctttcctatttacaatctaactcggcgcctattacagcagttttagtagaatcagaaggatctaggggaatctttttagtcttggcttcgctttctccactttttgagatcttggtagcgggcacttctccttcgctcgccgtggctgcagccagtcggatatcctctcgagcagacgccatctcgcgggtttgggccatgtcgcaactctccttgtcgcatgtgacggcttgcttgatgtcgctccgtagggataggactcctcggggaccaggcatcttcatcatcatgtaagtgtagtgcgggacggccataaacttggctaacaccgggcgtccgagtatggcatggtatgctgtctcgaaatcggcgacttcaaagctgatattctctgtgcggaagttttcccgagtgccaaaagtgaccgggagggtgatctggccgagtggagttgcggataatcctggaattactccgtgaaaaggcacattgcttggttttagctcggagcgaggaatctgcatatcatccaaggtcttggcgaagaggatattgagtgcactgccgccgtcgatgagggttctgcgaagtttgacattacggaccactgggtctagtaccaggggataccgccccgggtggaccactcggtcaggatgatccgagcggtcaaacttgattgcaatctctgaccatcgaaggtattggggcgtgtcgggctgaacagcattgatctcccgttcggtcaacttttgcttccttttagactcgtaagccaaggggccgccgaagatatggttgagctccttgcggtggtcttgaaatcctgccggggggtcgccgtcgtccttcttccttgacgtgctttgttcttcgtcagagctcttccgtgtaatcttggtgtattgctccgcgaattgcttgtagacgaaacaatctttggccacgtggttggagttaggatggtgcgggcattgggagttcatgatcttgtcgaacgtgttgacgcgcgaacgttgtcgagaagagtgactggcggttgcaacaagttccgcaggcttacgcttgcggtcctaatgattgttacttccacctcctcccgaagccggcgtatccttttttggcttccaactgggacccgactgctttgatgcggtgacggcgtcttcagctttggcgtactcgttggctttttcaaacataagcttgactgtcctgggaggcttacgcccgaacttgccgaccaattcttcgtggcgaatccctttggtgaatgcagcgatgatgacgtcgtcggtgatgtcagaaatcttgttacgttgttcagaaaatcgccggatataatctcgaagggattctccggacttctggacaacgttgtagaggtcgtattgcgtgccgggacgctcgaaggtgccttggaagttggcgatgaagtggtcgcgtaattcagcccaagatccaattgtaccacggggcaatccatggagccaagatcgggcggaatccactaaagccactggtaaatagttcgccatggccttgctgtctcctcctgctgcgcggattgcgagaccgtagacggtaagccacgattctgggttagtggtaccgtcgtacttctctattccagtcggcttgaagccggctggccaatccactcgacgcaggttgtcggtgaaggctgctactccgtcaaggtcgtcgtcgtggcggtccggcgaatgatgatgacctcgagctgctcggcgctgtatgattgtgtcgcgaagatcgacggggcggcgacgaggtggtgagcgaggccgttccactcggcgctccctatgatagtcgggaggtgagtgaacggaccgctcgtcgtgacccctgctcctgcgattagatcctgcgccggtgatgctgaggctcggatgacggtagtcatgagatcggaagtgagggactcggctgccagtcggcgtgtggacgctttcggagttaactgggaccgaagccgcaatcatggtcttcgtctggttcaagatattgatgacgtgatcagattgattaagctcgttttccttgaggagggtgtcgaggagggtgatcgcggcaaccgcattctgttgaggggtgcgaaaaaccgcgtgtcccttcaacatcttgttggccgatgagatcacgcgctcggcgccctgcttccaaagctcgctgccgtcgatcctcagcctccttcgcggtccgctcacgctcctgttgctcacgccgtaaccgttcttgctcttgtgcttgacgctcctcctccagtcggcgacgctcagtctcgcgacgtgcttcggtctcccgggcttggcgttgctcctccgtctcgttatcggccatgaagacgccgaagtagagaggggtgtagttgtcatctaggctttcgtcgaagtcgtcgagatccgggtcgttgtagcgagagcaaaactcgtcgtactccacgatgtcggtggggcgcgagtcgacggtgggagagctgtagtagccatccagctgatccgtcgaaaccgtgccgagtggttggaggatgacgccgacttccctgaagctaggcgaaatcggtgttgaagctgacttccgcctaggcctacgggatggagacgctgtcgtgatggagatggccgccaaatcgtcggggagcttcatcatgatcggtgggtaagccccatcatcttgatctggtgacgttggagaagatgcgatctcacccgagtggtttgatgccaactcgattgagatggtcttgaagtaactttcagccgtgtttgggagtccaaacgggactgaaatccggttctctcccgactggtctgacaccgagtcaaggagagagatcttgccgaagttgttggtgacgaagtcgaggctgccgaaccgaaacgtctgcccgggtgggaagacgaggtcgtcgatgccggagatggaacccattgcactgatcggcgaaaagcttgacgctacccctacctggcgcgccaactgtcgaaactagatttcggcaataataaaagggggtggctatcaagctggaaaagtgtatgggtttggagacaaaggatttatacaggttcaggccttcttattgaagaagtaataccctactcctgtccggggatgaatccgccgagtgtcttattgattgtatgatttggagaaaatcaacatatgcccctagaggtacctggaccccccttatatatgggaaggagtccgtgttacaaaagataatctatatccctaacggaatacgcagatacagataaaatacagtcgtaaccgactaagtgtcaaggtatttccttgatgtacaagttgagaaacaaacccaggatacaaataagatattctatctatattcggtatcctatattcagtccaaatatcatcgccgtgtagatatgggatatccataatctccacagagctcattctcacaagtttttcctcttcgtaaaaaatcatcttcgctatgtcatatgcagctgaacattaatcttgaaagtgcatatgtcttgttgaaaatttgagcattgtggttgtataaaaagtttcaagtaatagttctttgttgtttctaaaacttattgtattcttgaactcttttggatgtgttccttgcttgaactcttatggtttatgaaatgccaatgatatatgattccaccgaaactcaaaagtcatttttgcacttctcaaaaccaagcctccatgggtagactccaaattccaatctttgccaccaaatacaagttgatccttgctaccaaagccaactaccatttcttgattccaaatttacacttgcatacacaagtagtgtccatataaaatggtagtatcctttgatcatcttgcactcggtatttgccaatcttagtcattccattgccgagagtactcacttgaccaaaaatctctcaagtatctttgaccaaactcctctcatagagaaaataattgatgagtatatttcgagagaaagttcaagtgctcataatcactccctcctagaaataaaatccattctaattcttcttgtctaagtaacaagactccgagtgtaagggggagcatttcttaaatggaccgtttctcaaatttttgctttgagctttcatcttttttttttggtcttgtgaatgtttgttcttgttttgcttgagcaaaattgtttctcttcggttccatgcaaatctttttgtgattaatgccaaaaggggggaatatttgaggatcctacatttgatatgatcgttgatatacaaagggaaaatattctaggatcccacattcatttggtgcatgtcgtgaaaagaagcataccatcatctatcatagcatccaatatgcaccatatgcacaagcatcacatgcatggatataaatcaattgtcaatttctcatatcatgttgatttatatcattgatttcacccttcatatccaaatgtgatcatttttaatggatttgtcatcaatcatcaaaaagggggagattgaaagttcaagtgccattaatttggttttggtgattaatgacaaatccaattatatcagactaatgtttttataagcatttctttgcctagtctcatgtggatatgaaagtggagtgtgtgagaggtgattcccggacttcatatgagttgagatagaaacattcattgatggtggaactaaatcacaaagatgaaatgcatggagatcaagctatatgtatcactctttctctccatgtacatattgatatgttcatatataataattccacgtcattgacatatgcatgtgagactaatattttgtttgaaccatatcttatttagtctctttacattgagaacatggagatggtgaaggtatgtttttattttaatacctatatttgataaatgccttctattcttgtataggataagctctcaatgtttcatatcttactatgcatactcttgtcacacaaacagtttgtatgcatatatttaaggggaggaaatcatatactttagttatgcatgtaattgatccaagttattcattttcatttaattgagatctttacatttgagcatatgtttgagtatatgacacttgtggtgttgattaatactcatcatttattcatatccttttatacatgcgatcggttggtcaacgtgtggaggttgacaaccggatcattgggactaataattttattgagttgaataaaagaaataggtcccaaggattacaaaggtgttgatgttcaagtgatatcattacacgtaacgataccaagaatgacaaagtaaagatattgaagaggtgggatacgaagtggctactatggcaagacagtgaagggcaagcgatgctcggtcgcgatggactatgcggtggtgaagggcaagcaaggggcttggcgccaaagaaccaaatccggtggtgaagggcgagtgacgg

SEQ ID NO: 33672 - DNA, 37485 bp, Oryza sativa
tgagagctagtgagcctcactccatactttgagtactcgagttcatagcaagcaaatcttcgattgggtttgttactcttggagactaaggtctcctagacggctaggcgtcgccggtgagcacccaaggttgtggtgtgccacggaaagtttgtgaaggcttcgatttcgcctccgcaagggaagaaatcaagagtgaaaccgaggagtgcatttgtgcaacctcgtgaagaaagggttgaaatagacccggccttgtggcctctcaactgagacgtaggatccatggatccgaacttcggaaaacaaatcaacgtgtctcttctcttggtttgctcattcttgccatctctcatattgtgcttgagtttgttttggcccgatctacttgcatgcttaattaatatagttggtgaccttatatcttgcttagataccttatttgtcaccttttgattcgtatacattttgtttattcgtgcaacaagttcatagctagtgttttattccgttacccgccgaacttttcggttgagaccggaagttcttatcccataccggaagttccgatttgaaccaaaagttctctaatctctaatatgctatgaagttgtgataattttttaggaacacctattcaccccccctctaggcgacatcaagttcctttcaggaagaaagttgatataggtccaggtgataggccaagaccgacatttattagtaaaaatttatctccggaattcagaaccaagttgatagagctcttaaaagaatacagagattgctttgcttgggaatattacaagatgccaggactcagccaattgattgttgaacatcggctccctatcaagccgggggttagaccatatcagcaaccaccaaggagatgcaaagccgatatgcttgaagctgtcaaggctgaggttaaacgtttatatgatgttggttttattcgtccatgccgatatgcagagtgggtttccaatatagttccagttattaagaaaaatggcaaagtcagggtgtgtattgatttccgagacttaaacaaggctactcccaaggatgagtaccaatgccggttgccgatcaattagtcgatgctgcttcaggtcataagatattgaattttatggatggtaatgctggttacaatcagatttttatggcggaggaggacattcataagacaacttttagatatcctagtgcaatcggcttgtttgagtgggttgtgatgacttttggcttgaaaagtgctggagctacatatcaacgggctatgaactacatataccataatctaatcggctggttggttgaagtttatattgatgatgtggttgttaagtcaaaggaaatagaggaccacatagccgatttgaggaaggtttttgagagaactaggaagtatggcctgaagatgaatccgacaaagtgtggttttggtgtatcggctggttagtttttaggatttcttgttcatgaaaggggaattgagataactcagaggagtgttaatgcgataaaaaagattcaacctccagagaacaatacaaagttgcagtagatgattggcaagataaattttgttagaaggtttatctctaatttgtctggtagattagaaccttttacaccattgttgagactgaaagccgatcaaaaatttacttggggggcagagtagcaggaggctttggataatattaaagaatatcttagttctcctccagttttaatccctccccaaaggggaataccttttagattatatttatcggccggtgagaagtcaattggctcggtcttgattcaggagcttgaggggaaagaaagagttgtgttctatttgagtcgtcggcttttggatgcagagatgaggtattctcctgtggaaaagttgtgcatatgcttatatttttcttgtacaaagttacggcattatctattgtccaatgaatgcactgtgatatgtaaagccgatgtggttaagtatatgctatcagctccgattttgaaaggaagggttggaaagtggatatttgctttgacggaatttgatcttcggtatgagtcaccaaaggcgattaaggggcaagctatagccgattttattgttgatcatcgtgatgactcaatcggctcggtcgaaattgtgccttggactttgttttttgatggatcggtgtgcactcatgggtgtggtatcggcttggttataatttctcctcgaggggcaagtattgagtttgcctatactatcaagccctatgaaactaataattaggctgaatatgaagcggttctcaaggggttgcaattgctcaaggaggttgaagccgatgctgttaaaatcatgggtgattccttgctagtgatcagttaattggcaggagaatatgagtgcaaaaattatacattagtggtttacaatgagaagtgccgagagttgatgaaagaatttcggctggtgactttgaagcatgtatctcgagaacataatgttcaagctaatgatttggcccaaggggtatcgggatataagccgatgatgaaggatgtcaaagtagaagtcgccacaataacagccgatgattggaggtatgatgtgcatcattatttgcaaaatccatctcaacggcttctcggaaattgcactataaggctttgaagtattccttgttggatgatgagctatattatcagacaattgatggggtattgcctaaatgtttgagtgccgatcaagctaaggttgcgataggcgaggtacacgaaggaatttgtggaactcatcaatcgtctcataagatgaagtggttgcttcggcgggcatgatatttttggccgacaatgttggaagattgttttaaatattacaaaggatgtcaagattgtcaaaagtttggagcaattcaaagagcacccgcatcagctatgaatcctatcatcaagccatggtcgttcagaggttggggaattgatatgatcggtatgattaatccaccatcaagcaaaggacacaagtttatattggtggcaaccgattactttaccaagtgggtagaggcgattcctttgaagaaagttgattcgggagatgctatacaatttgtccaggagcatattatttatcgatttggtattcctcaaaccatttcaactgatcaaggctcgatctttgtgtccgatgaatttgttcagtttgccgatagcatgtgtatcaaattgttgaattcttcgccgtattatgcacaagccaatgggcaggccgaggcatctaataagagtttgatcaaattgattaagagaaaaatttccgattatcctcggcagtggcatactagattggccgaagcattgtggtcttatcggatggcttgtcatgattcgatccaagttcctccttataagcttgtttatgggcatgaggctgttttaccatgggaagttagaatcagctcaagaaggacggagttgcaaaatgagttgacagccgatgagtattataatctcatggccgatgaaaggacttggttcaatcaagattgagagcccttgcaaaagttactatggataaggagagaattgctcgacattacaacaaaaaagtggtgcccaaaacttttgctgagggtgaacttgtttggaaattgattttgccgatcggaactcaagataacaagttcggcaagtggtcaccgaattgggaagggccgcttcaaattcataaggttgtatccaaaggggcgtatatgttgcaaggacttgatggagaagtctatggatgagcgctcaatggcaaatacttgaagaagtattacccaagtgtttgggttaatgcatgatcggctggtgttgccgatacatgacagccggtgtgttcacatcgccttgagatggccgatatggttatatcgcccttagttgtttttatgttgtaatcggttgtgttttgctgatgtacaatggtcgatatggttatatcgcccttagttgttttcttattgtaatcggttgtgttttgccgatgtacaatggccgatatggttatatcgcccttagtccagattataattttattaatgtcttcgtcattgcaaaattaggggggcacatatatacacaagttgcaaatttgcaaaaatttttagcaaattgagaagttatattaatcggcacatcagttcaatgacaaaaggagaatcaaggtttcatagccgattacaaaaagaagctataaagtctaagtcctattacatagaaggtcactgagatagatattgctggatagctgatacagcccggtgtctgatttgttctacttcttcgattgcctgggtatcttgtgcatcagttccagggatgacttttaaggacttagtcatatcggcaacatttctaatggccaatttcagcctagacttatgttcttcaacaacacttggaagatcggctagcttttgcttttcaagatccaactcggcattgcattcttcgagttaagctataagatcaatcttgcgggcttcaagccgatctatgttcgactgaatcggcccaacagagagttgatcgagcttggctttctcttcatgcacgagttgccgattggcttggatggtagcttcaatgtctttccactcccgccaatcggctatccgttacttagccttctccagcttgaattgatgttgctcgaggtatacagctggagtaatgatgttcgccagatcatctaggatgaaggcttggatttcagcaaatcgtgcccggattgaaccacaatcagccaccaagctgtctaatgatgaccctagccaaagggatatatcctcaagtgttctcttgatggtttcatccaaaggggctagagccttgcttgtggattcttcttctgcttcttcatcaaaataatccttgatatcaaaagaaaacagatcggctaaggcctgcaacagagaaattcgaagatagtcaaatatcaaacagtttcagccgatctaggttcttatgtcaatgaaggacttattgggatggcaggagtggctggttgttcctcttcttcaacatagtggcttcctgtagccgatggggtacggtcacttgacatctattgcacaggtggtgaaggaggacgaggaggctgcaaaaaaacaaagtgttatgtaaatatcagctgtgattagataagtgagaggatttatatacgacaatcttactggtgtagctggtttaagtgttgttgctgccgatttcttcctcacagcagtcttctttttctgcaaaaacgagatttataagtaatcggctatgaataaaatgattgcaaggggaaattaatataagtgatttacccttgaaaaatgagctggagcagaaggagttggaggagttcacttaggtgaagccgatggagttttttttgtatcacttacttcggctgcagcttgatcaacatcctcttcaatctcttcctcatccaaggcttgcccgatggatggatctaaggcaggcaagtcatcggctggcttaggcttattcttcttgatcttctttttgggagccagagccgatggatctataaccgatgccttggtctttctcttcctgccgacatcggctggttctctcatctgcccttgaagcagacttgaagtcttgggggcatgatagccaatgactggaggggtcaatccaccaccgtttggcaaatggcctggagcatactctatatccctgccactgttgctcttgcggggaggagaagattctgttgtctgcaaggtaaagagaaaagttaatcaagattcaagtcggctaatagttgtttaaataagattgataagagcagaggtatacctgaggaatgacatctgggaacaagtctatcatgcacatggaggctgactgatggaatatgtgttgcttccattctccccaccatctgtcaaagtttttgctccaaaacctggccaactctatgttatcaatgctggccaaaggaggtcctgggatgttgagtagccgatccatcatcagggttgatgaaatgtctcctcggcattggattttatcggcaaagaacaagccgattggtagctgtcccattccaaattgcctagctgagctcatcggatgataaaactcataggagacttgaatatttcttccttgatgtatgctgacagggaggatgcatgggctaatagcagcagcaaagacttctctggacttttgatatctctcatggttgatatcttcaaatctgaagtctgctgggagatccaaattgactgaatcttcatatgggaaccaaacccgagcatctttctggaagccttcataaaagctacagaaccaatccttgagtaattcagccgataactttgctccagcatcggctggtgtggatgcatattccccataggacatacacctgcggtgggtgcgctcttctccatcatcatctgtgatcggctctaatcttggaaattcagcttctgttacggctggccgattgacagctttcatggctaccaagtttagccaagtttgcagcaaccaccatggcccgcctgcgttaacgactgagccgacagcaatcttagccgatgcgttgttcaacatttgatacaaatagccaagaaggattttgcccaaagggaattgcttctttgtatcaagggcttcggctaagaactaccagttggtggtagggccacaacttgatccataaaaaaggaatttctcaagccatatcagcaggagggccacatgttatcgggaagttacaggtcctttgcccatatatgctgctacataaccagaccagcctcttgctcttagttctgaagtcaaactggttcttggtgttcaaactcatggggttagccgatgaggtcacatccaaatcggtgatcatagtaatgtcaagcaaagtgggggtcatcggcccttggttgaataagaaagcgttgatggtgttggaccaaaagtaggtcgcggcagccatcaggggttcatccttagctgaatttgctatagtgagggcgagtgcctggccgattccgatttcatcctagtgaacctgcttgctagccgatatacgcttataccacacagcccagcttttctcaggggcagttttctcaagagaaggccaagacttgaaggtgtttttccagtgacctagattctgattggctaatctaaaagggatcctattggtttcggcggagatgaactcagtgggatcaagattgccgatcggaccaagaaaatagtgacgctcatgtgacaaactcggagtcgcaaccagatcggacaagtgctacagatgtgaataagaatagagaagaagaaaacaagatgaggcaaggaaaaaccaatctattgcgaaaagatgggatctagccgatgagcacttacttctgcgtactcagccgatggcgtggtagacgggctggcggaagtcgacatcgccgcgggcggaaacttggccggggaggagatcgccttgaaatcgccttgcgcaccgagggaatcgccggagagagggaagatgagtttggcttaagcggtgaaaacggaagtaacagtgtgaagtttctcggggacaacggttagtatttaaagcagagtgataacggtcggaaaaacggcaagtgcgatattttctcggagatgaaatatcgcaaatccgaaacaatatcatatattccggacttggggggaatgtgttaacaaccaaatttggtaatccaagtgtcagagatgaagataagatcgaagcagaatccaagatcaagatcgtttcagaaacatagtaagaatcggctaagtccgaatcttctatgatcttaatcagtagagtttgagtcagacaaggttagccgattgagccgattccgacaatacgactcggtatacgttgtcgggttgtgttaatgtgcttcatatggattgccacacacggattgggtcctggaaaggcaattgtatctattaattaggatattttatgtaattcccttatagatatgtttgggcaaaagtctaccgcaaagacttatggtatcttagagtttgttagagataagagtcgtgtccaacacggacatactttgtaatctcgggtataaatagaccccgagccccatgtaatacaacaacacacgttcaatacaatctcggcgcatcgccacccttttactttcgttttgtttcgacgagttcttgctttcgggttgagctgcatcggtttcgatcttcaactagaggtaaaagatgttatggcggcttgcgttctcgggattagtgcttccatctttatgatactctaatcttgtttatgtaattcgtcgagttatcatatattttatataatcttaggcaatattgttatttaaccatcaatcggctaacatctatcgctagaaggcagttgatcaggttaaataccaacgttgacttagattatataggatatccaccactctatgaaagatccagcggcttgattgtctagatattgtccttcttttcatacttatagctgcatcaattgggtttgaccttataagtcatgattagaatcttatctctagcctgctttatggttgccgattagtgtagcatcggggttttagccgatcttacctgatttaatatatatttcgatctaagtgatttatactgtctcggcatggcgaccgttctatcccaatcacttgatttaagtatatatcgacataaggattatatattattaatatctacagccgatcgagtagattcagttctttcttacttgttcatgactgccgatcgatatacatatgacatcggctcaaagataaatgatatgttatcggcaactagccgatcggctatcgtttatggatttaaccgcggtttctttgtctttatttcttgttgattgcaggatcaaatcagctgcacactcacgaacctaaaggcaagcttttggacctgcactggagttaagcagatctcccaagcctcgtgttttcgcatcaacaatcgtatagttccattagctagctagtgttttgcctgcaagtacagtgtgatgaccgtgacgccgctcttctcaacatcactctcaatataacttgtgaaattacgtgcaaacaccgtgaagagctcctcaagtatgccctccccaaaatggctcgcaatcagggactccattgccgcccttaggcttgcagacatgctctctcccgcagtgtgagtggctgaaatgccctctgcttgctctgagtcatccatggcgttcccatctatctctaagagttggatgtcacttatgtcaagtagctcgcactgctgcaccagctgcttcagctcgtcagctgaagggcagtagaatggtatgttgaaagagtccagcttctccttggcaacacgaccctatttatgcaaatgcagattaattaaacacgaattaagataatagttttccacgtatgagtgtttgactatataacattgttggtttttattgcccttcaaactaaaagcaatgtacaggtatttaatttaagcccaatatatactgtttggacaaacataaacatttaattaggtagcttctgaatatatatttgttttctatagcacacatatatatgttcatatttttgcacgtttcctttgcactgtcaaacgttccaaagccgtaacaagcaaaaattcctatttgtatagtaaaaccaactggtataactatccaatgaattgagagccttccaaaatccaaaccgaaggatcagattgattcttgtactatttgtactagcagtagtagaagacacaactatcaacagtaacaaatgttaaatggtcaacattactcgaaacaacaaatatttttatttctcatatatatgtttatacttttaagcatttctcgtgtgtcatgcacaagaatattttaacatgaatcaaactttagaataagtactaaaataagtaagatgctagctattttcactaaatctttgataagtaccacaatacaattcaaactttagaataagtatctataatgtttttttcctaatatgggagtaggtcaaccaggagaataattactttttctatcaaagaatatcattatggtttaaaccataatgtggtatactcttgtcatgtgcattatacctcagcaacaagagtgcgtagcccctgtgacagcaactcgaataaggtggttgtccctcctgcatggaacacatctttgttcttcctcccagcaaccgtcaggaccatccggcctccgggcacaatctccatgcatctcatttggaggaactgtgagaagtccttctcaaactgattttggtagagctttgccaccgatggtggtgtagtcgctcctatgtgaatgttcccctcgttcatgctgccatcaagatgctcaggaacctatccaaacaaccaacgttgccagtgagctcaaagttccaaaggtcaataacttagtgtcctaattttaagcttatgcaatgagacatatataaacaagcctcacctgagagagccacatgatgctcattgaggaatggaagagatggacgctattggaagggaagagtctactgtagaaggaacccggcagacctgcgacaaagtgcgcgggaggttgtaaccctttgcaagcgcaatcatgtattgtcgactgctcgaactgctctagtgattggaagatgtggttgaagtcattgccaggtagatcattgaggaagaactggatctccatggggctctccttgatagtgttgttatggtcctcacatattgtggtgatcgcctcagagacgaagagaagtgtgtttgctccgaaggagcaaccaaggtcagcaatgaccattaattgaggatgaagatctatgcacacttcccgtacagctttctcaactattggtttggcagcaagaacagctcttttctagacagacatggtaagtataaaaattatggtcaaacaaatactccacttgtcatgtgccaacttcggtaggcccctggatttgatacatgactttaattaatttaaagtcctgttagtatttgcacatgaacaagtaatgttagtggttaatttctctatgctctatatatactaccgagtagatgcatgaaatctacagtactgcatgagatagaatttacaattaacaattttctcagggcagcatgtttaatttgtaatgaagcaataatttcaagaatttgaatggaagaaaagtagagagttggtacaaacttgcatccttgaattctcagcataactgaactcatcgtcccctttcatcatgtggaaatcgcgctcgatcttcatggctgcaagatactttggctagaagcttaattccctgtatgtgttcctatctgctgcctagacaacaacagtgttatgtgtggagtatgagagctcacgagagattatttcttccttttatagagaaaccaaatgcatgtccgatttcgaacaagaaaataaaattgtatcgatgatagttattcattccaaatcagggtgcttgattctggggtcataatatacattgtcctcggcgattgcctcttgttatgtacataatagattttgcaacttgtaaagccaatcagttgatagtttggggttatactatggggatgcatttaaggtgggtcttggaaaatctcacgtccagtttggtgttcatgcaaatggatttgttgaaacaagagttagggatcatgtatgtgaaggaaaaaaaaagttcatttgtctccaactgaactatttcaatgcatcacttaacctccaaagttttttttcactcattttacacgaagaactattaaaaacgattcactttgctctctatcgatatttctctttttgttcttctaggacaatgaaatttagtacgattgatagatgcgctataacttacctctctttttttttacaattttttttatcaccgtttatatagatcatgaaaaaaattgataatattttgaaattttgataatgatgttatctacggctctacaaagttttagcttaaaataagactcgtaaaagtgtaacaaatcatagaaatgctattaaggattaaagtgaataattttttatttgtataggggtaaaatgagccaaaagactgtttagggtctaatgaaatagtttgggggagtaaaatagacttttttctacgtgaaatggaagaaacggtgatgggttcctttgacatacattcattcaagaatgtagaggaatttttcctgtggtattccttttttctatgtgcatgctagatttagattctaatctgaatcagtgtgcttaattccggagcattgcccacggttgcaattgctttcaaaccctatacgtgctcaaatcttacacctcaaaccaattaacgcacgttttaaacgttttaggggtccacacaagagtgttctaacgatttccagctacaacacggtacaacaccaactttctttttttttttacatgggcacatcgtgtgtaacaataaaaattaagttcataaggtacgatgaatgtgtccatctagccttttatacttgacaccattgaccagtgtaattttatttttactaaaaaaatattttaaattgcactgttgtaagggatgccagttatatttatcatgcatagcactccgcattattttgataatccgacattgttctaaatatttgtaaatcttttaaaaaataagagcggtcaaagtttgtagatcaacatatctggtgacaaagagcaccaagggagtaattaattactccctccatattttaatgtatgacgccattgacttttcgaccaacgtttgaccattcgtttcattcaaaaattttgtgtaaatataaaaatatttatgtcatgctcaaagaacatttgatgacgaatcaagtcataataaaataaatgataattatataaattttttgaataaaacgaatggtcaaacgttggataaaaagtcaacggtgtcatacattaaaatatggaggtagtattacgtatcatcactgaagaaaccaccactctaaagtctctattgcctaatagactttccacttgtacagagtacagatagagacaccatctatatctttgatcaacgcaacgacttacctgccatgcgtcaaacctagcctccgttttttttttctgtaaggtatgataacgtctccaggagaaaattttgacgcgtcagattattttatttaagtaaagaatgctgtaatttctaagcttgaccttatgctacaccgtttgttggcaaaatcgtcacaagaaggacctcctgtcttttatttgttcttgttgctccatatgttactgctgattttgttctcctgaaattaaaattcatacgcagattgtacctgaacaggttcacataactgacaaagccagttcaaacccaaattggccaagttagtttaaaaagttcaacataaattcaaaattttgagaaatcttgttcgatttttactgattttagctagctagcttgatggtaccgggttgtatacatctctagttgcagatattggatgtttttatttgcttaaagaatcttagaggaaatgtgtctgggcctcagggaaagttagatgatgggctggcatgctgacatggccagtttgcacgcatggcatctcctagctactaacacaaagggctcataaacctgccaagttgttaaaccgctggtcaaactgcataaatttctcaaagacattgcacctttgtgtttcaaattggcaaagagaaagcaaagaagtgttcaacaagagttactaaataataactggattatatccttcaggcaaataacaacagttgaagagctccacgaattagtgaagttggggagtttacttcagggagttgaactaacgccgaaccctgatgatatctcatggaagtggaatgaatcaggaacctactcaagcaaaagtgcatacctgtttcaatttgagggatcattcgcttccatagatttcacctcactttggaaagctccggctgaaccaaaaacaagattcttaatttggttggctcattcttcatcagaaaactcttacggtgcaaaatttacttcgaatacactggccatgcaattggatttgctgtttgtgcacaagcacctttgaagacactaatcacttattcagcgaatgcccttttgtaagacaagtctggagcatggtctgtgcttgggagaatttggtgctaagcaacggccttaccctagacggagtttcaaaatggtggtctgcaattgagtgtgctggctcgaaagatcaaaagaaggcggtaaggggggcaatgtttcctacttggtggaacgtttggcttgagagaaataagagaattttcaacaatatcacaagatcggagagagaagttgcttatattacaaagcaagatttagaccttcttagatcggcttttaggcctccttgagtttcgattttgttttgtttttatcggtgtaagtttctcatagtttctctggactgtaagcacttaattcccccccccccctctaatgaaattccgccaggtctcctgccgtcgttctcctcaaaaagactgcataaatttcaagagttaatttggtccatgctattacaaatatggtatattagaaagatggtattacaatccacgttatcggctgggtgccattgaaaatttcaaaaattggaaccatgccactcctgtcactatttacgtcctcctctctcatgtcgccgttgtcaccgtcatagtccacccctaacgccaccgccgccgacgacgaccaccgccggctgtgaacctgcagcacctcgtgcgccgcctctgtcacggtcgccgccgacgtgccccaccacctccatggcaccgtcggtgtggaagctggtgcttgcctcggccgttgtgtcgttcgtgctcgcactctatgatggcgcagaggacgacgaggtcagggcaaccgccgttgtggaacccttcgtcatctagctcatcctgatagtgaacgtcgtcactaaagtctggcaggagagcaatgccgagaaggcgctcgaggcactgtaggagatccagtccgaggacgcaatcatcaagctcgacgctcggtggtcccatgggcttccggcgcgcgatctcatcggcggcgaccgtggcaaaggtagcacacggtgcggacgcacggcctcttcctctggtatcccgtccgcggctggcggtggtcgtcagcggcggcggtggagtttgggagggctgtgctgcggcagcaagggccgcgtcctcatgctcctgtcccagcagcggcagcagcagcacgcactcccttgacgccagcggcaggcaacaacagcagcagcgccgcacttgattctctccagcaacaacaaaacatctgcaggccgaagcaacagcagcagccactaggcgacgacatcggcgccgtgcttcgcctggtcggcgcgtcgtcgcccctgccgtcgtcgtcgatgtaggaggcacgcgaggtcagctgcggcggtggtggtaggacgaggcggcgcatgggtgccgacagtgacacgatgtgacggtgaggatggcgacgtgagagagcaggacggaaagagtgacgggagtggcatgattccaatttttgaaatttttagtggcacctagccgataacggaaattgtaatagaatttttctaatatgtcatatttgtaatggcatcaatcaaattaacccaagcatgaattctttatgcatgaatgacccaatcatatttctaatatcttcccttcaagcggagttttatgcatgaatgatcctccggcagtgacgtctagatagaatgcagattctttatctagacccgaatgaaaatgttgcaacagcacatgatcgggtatagataaaggttggccagattgcactagattagtgaacctggaccaaactacactgattgattctttgtttatctgctgtaagctcagaatttctacccacagagtagtgatacgggttaccggaaagaatctatctcgcggtttttcccagtcaccgttcacacatctgacggtagatgtgcaccattgtttcactctctcgtgaagagagaacggaaacaatttccaccgaacagtctcttgcttcatgcctccaatcttaaggcacgagcaaagtgctcaaattcccacagatgatagtaagggttttcctggtctaaaccagagaaagatttctccctaaccatactgatgaactcgggacaaatttcatagccaggtgttaaaataggctctaatgaaggaggtggctcgtaaaattcgccccgaggagcagataattggaaaatagattgtggctccattggttgagaaggttttacaggaaggggtgaaggtacaggaaagaaaaataaaaagggtacgaggatgaatgaggttccgagatagacaacaaaggttcctcggcaacggcgctagaaatgcttgttggtatttcttacgatcatagataaatccgcaagcgcacggaatatactgatgtagcacttcacccgggagtattctcaggtatcgatttccacaaggaacgtgtgtgctaactctggttcaggctcatctaaggacacgaagctatggataggcaaaggatagagaggtttcacgggtaagaaacaatgtctacagaaagcttaactttaatcctaatgtggtactttgggcactggctagctcgctactcccagatatcgctctactgcgcacctggatagggaggacttcagtgatattgacggttgtcaccacctctacaccgacctcacacctattgtgggatgcggagcaaacaccagaaatcaactatctagacaccgcgtctaagcagttaataactactctagtgtttataagtcactaaagcaatcactatattttagttgactatagtgaacgatgatcccgtactctgtttaggaactaaccaagaaataaatctcactgagcaaaactaaattactcaaaagatatttcaattataatcagagtaataaacagagcagaatgaaataggaagaggattaccaacaactccggaactcctccgacttcttctactctactctctcgctaatctagtatacaataaagtacaattagagcctcttataatttagcttatgcttcaagtgtttgtgaatgagggagaaaagaggggtatttatagtgtagaggtgacttgagagagtggagatgctatggaatattctccatagtatccaaagagcatatttcttctcctcttgccatgtgacctgttgatgatgggttccaccggtattaatgctcataaccgtcataggatgaggagcacaaccgtcatatcgaagttgggctggattgggccacctgctggtttggctgaaccaggggttcggccgaaccctggctggcccatccagcccagccctttctctggtgttctgacatgtgggtgccactatatgttccactgaagattggccaagataaatgtatcttattgggtttctgggctcaaaactccataggcttggatatggaagttatattgcatttcatctcaactttggtgggttgtattctacatacaaatatacattaacactcgtgaaaatggttagaaataaatcctaccactatgttggatgttttacttttatggtcttatacaggtattgacggtgagaattttgtacttaacagccgtcaacaaacgtgtacgaagaatagaagaaaatggagagaaaaaaagataaagaaagtaattcaacatccatgtggcatgctacatgagcaccacgtaggatcccgcagaggttttcgcaattttggactagaatgacaaacactgacaagttcggaaacctaaaaaatacatttttgagagtttggggacctggatgacatggacgaacaaatctaaggaccggcaatgcaatttactccttcaaaaacaattttttttttgcttttctccatactggatcattactcccagatttattttcattgaggcgtgttctagatacctaaacaagtttttgtaaaaatctgtgatatacttcaacaagttctactgccctttaattatcccttcttcctgttctccatatgttattatgtctttccttttcccaccattagctttgccatgataatacatggtgttattatcccccccccaccctctcaagccaacacccagtaaattgtgcggctgtggtggtggagggcctcttcccaagccctatgcacctcctccacctcgatacacatccccttggaagggggagtggtgtggatgtcacatgcttgaacggaatatgtccgccattggagctttccccaccaccttcaccaccgttgcaaaaccttgtgaatctcccatcccatcccctttccatctccaatgtctccactgtaacaccttctctcgggcaatattcctctacccaaactcgcattgctctagccttcgaagatgctagaaagtgttttgagaagtggcgctagtgattctagggcaagccatgacttgagaagatcaggaaagaaactgggaaaggtagcagtgcaccaagcatgatagctctcaccttaccgggtcggatccccattacaccctagacccaatcgccatggccaggtcccttgtgctttactgtcgcctctagagtttttcctaaccaattgagttatgctcactttgcgtgtattattaaatcataaaaaaattatactcactctgtcccactaaataaggcatgattgaacttatcacggactcgaaaactaatcttttacattaaatttctcttatacaactgtttgtagcaacaaaatcataatcataggaaagtaaattcaaatgtcaatctaatgcaggggcgcatctacagtaataccactggtgtcaggcgacaccgacgacttttggcaagctatgcttaaaccgcctatccatatattataacactatattctaaatatagttagcatgctatgacaccgatagacacgttatgacaccaacgaactaaatttctggatccgccactgatccagtgatattattttcatcaaataaatttgaagttataataaaatagttattggtcaaatatttaaagagttgaatcttaaaatacatttgtgccttattcagtggttcggagggagtaattaatagtcaaaaccaaaaaagcaggagcttcattaattcttgttttaataaatccatatattttgtgctagaagatcaacagattggataaatggacattgttgatttaatgtttttgactaatgtgagaatttattgcatttttaggattaattttggggcttatagattctgcttataggagagactttaattagaaattaatacaaagatggggatccatcttaccaagtgagcaaccaaaaggccaaaagcctcataagcttgctcttattaattgggaagtgcatctctagttgttttttttttatcgaagtgtatctctatttgttattggagatactgatgttatcatttgcttaacataatcttgtaggagaagttgtgagcttcgggagaattagatgcacatattctcctaacaccaaagaacccaccatcttgcatcatatcacaccacattattttcaatttcttgcattaactttcaccgaacttgccaagctggcataccatgagcgcactttactctataaaatcaccttatatttaaactttatatgtttctctgccaggatatattgttgacactctaccgtatagtaccattatctagctagtgttttgcctgcaagtacagtgtgatgatggtgatgccacttttctcaacctcactctcaatataactagtgaaattacgtgcaaacaccgtgaagatctcctcgagtatgtcctccccaaaatggcttgctaccagggactctgtcgccacccttagagttgcagacatgctctgtcccgctgtgtgagcggcggtggtgccctctgcttgctccgagtcatgcatgcggttctcatccatctcgaagagttgaatgtcacttatgtcaagcagctcgcactgctgcaccagctgcgtcagctcatcagctgaagggcagtacactggaatgttgaaagagtccagcttctccttggcaacacgaccctgtgtatgcaaatgcaaattaattaaacaataattaagagaatatattttccatgtatgagtgtttgactatatcaacattgttggattttattgtccttcaaactaaaaaaatgtacatgtaattagtttaagcccagtatatactatttggacaaacaaaaacatttaactaggtagcttcatttgacaaaaaatatatttgttttccacggcacacatgtatatgttcataattttgcacgtttcctttacattgtcaaacgttccaaagccgtgacaagcaaaatgtccaatttttagagtaaaaccaacagggtatataattgtccaatgaattgaaacccttccaaacaggatcagattgttactgctactatttgtattagcagtagtacaatgcacaagtataaagagtaacaaatattaaatggtcaactttacttgaaacaaaaagtatttttctttcccatatatatgttcatacttttaagcatttctcgtgtgtgtgcacaagaatattttaacatgattcacatgctaggtattttaactaaaattttgttaagtaccaaagtacaattcaaactttagaataagtatctatagcactttttttataatatgggagtaggtaaacaaggaaattaattactttttctatcgaggatatcattatggtttaaactataatgtggtatactcatgtcatgtacattatacctcagcaacaagaatacgtagcccttgtgaaagcaaatcaaatatcgtggtcgtccctcctgcattgaacacatctttgctcttcctcccagcaaccgtcagcaccatccggcctccgggcacaatctccatgcatctcatctggaggaaccgtgagaagtctttctcaaactgattttggtagagctttgccacggatggtggtgtagtcgctcctatgtgaatgttcccctcattcatgctgccatcaagctgctcaggaacctttccaaacaaccaacgttttaggtgagcgcaaagccccaaagttcaataacttaggatcctaattaagctagctagtttatgcaatgagacataaataaataagcatcacctgagagagtcacatgacgctcatggaggaatggaagagatggacgctattacaagggaagagtctagtgtagaaggaacctggcaggcctgcgacaaagtgcgggggaggttgtaaccctttgcaagcgcaatattgcgttatcaactgctcgaactgctctagtgattggaagatgtggttaaagtcattgcttggtaggtcattgaggaagaactggacctccatggggctctccttgatggtgttgttatagtcctcatatattgtggtgatcacctcagagatgaagaggagtgtgtttgcaccgaaggagcagccaaggtcagcaatgaccattgattgaggatgaagatctatgcacacttcccgtacagctttctcaactattggtttggcagcaagaacaactcttttctagacatacatgaaaaatataaaaattatggtcaaacaaatactccacttgtcatgtacaacttcgataggcctgtggatttggtacatgactagtaattcaaagtcccgtttagtatttacacatgaacaaataatgttaggggttatttcctctatgctctatattactgagaacatgcaatctacagtagtgctcaagatagaatttacaattaacaattttcacagggcagcatatttataatttatattgaagcaacaattaatttcaagaacttgaatggaagaaaggtaagagagttggtacatacttggatccttgaattcttggcataactgaactcactgtcccctttcatcatgtggaaatctcgctcgatcttcatggctgcaagatgctttggctagaagcttaattccctgtatgtgttgctatctgcctagctagacaacagcagtgttatatgtgtggcgtatgagagctcacaagagattatttattccttttatagggaaaccggatatgcacgtccgatatttcaaacaagaaaataaaaatatatggctgatatttattcattctaaatcaaggtgcttaatattgtatttgatacaatccaattagtacgggattatatcaaatacaaaattctcaggccatgagatattggcactatgtaagcaatactcacaaacttacaggcggtttttctaagtatccaccagtgaaaaccatgaattttaaaggctgtttcttaagaaacagtctgtaaaaaatgtggtgacttttataggtggttctcttaaataaaatacatgtaaaaatgtttttttacactgtccttcaaaattgaagcaatatgttctggatttaaagaaaagtcaaatgattataaattttatattaaaattgtagctcttgatgagatctataaaagttttttttatttgagatcacttttcaggccgaaatagtcattacaggctctcaggacatagggtaattttgcacattgtcagggttatggataccacatacccaatagtaatcgattaatctcggcagggcccagcacataccaagtcttatacggaatcataactcgtatataaaaggagttccggataaggaaggacaaatagagttctatatggaaatgacaaagactacacggattgtatctatattggtctctctagttctacttggacaatgcgacatctataggtataaatacaagcctccctagaaggagaggggacaagccacaaggcacaacatacacacaaggcaatacgccactaaatatcgacatcagagattagcctagacataccctatccggcgcctatggaggccggcaagagggatctagctctatctctgatctcgacgagatcatattcgaggaggaagactaccctgccgtcgactacgagttggttatccatgccgccaagtcgacgaccttatctcaaatattgtactggtgtgattatgatgaataagagcaacaccagtttcggccaacaggagttgggctatcacctgtcagataagaggtccgaacctgtataaaaatacttgtctccatctctattaactcaatctcgcatataccctggtaccaacgatccccataccatccaaataccgtagtcgcggtaccacccgttgacacacgtgatattttaggaatttcaaactctgatattcatagaaaattcattttaagtatgatttagatgaactaaagttctctaaaacctttgaaatattccctttaatatggcatggactatattcccttaatatggcatggtcaacaccaactttctttttttttcttttcttttttttgcatgggcacgtcatatataacaataaaaagttcataagatacgaatgaacatgtccatctagtcttttatacttaacaccaatgaccaatgtaattttacttttgactaacaaatcttttaaattatttgtaatgttgtaaaggatgcaagttatattatcatgcatattactccgtagtatatattttgataatacgacatcgttctaaatatttgtaaagattttttttaaaaaaaagatgagctgtcaaagtttatacatcaacatatctggtgtcaagtaagatacaacggaacggagagaatgattaaatactacttcctccgtttcacaatgtaagattttctagcattgtctatatttatatttatagatgctaataaatctatatatataataatgtctagattcattagcatctatataaatgtgggtaatgctagaaaatcttacattgtgaaacgaagggagtaccaccgaagaaaacaccactctaaactctaaagtcactattgcccaatagactgtccacttgtacatagtacagatagagacgccatctatatcttctattgtaaagtctctattacccaacaaactgtccacttctacagagtacaaataaaaccgccatctatattttgatcaacgcaacaacttacctgccatgcatcgaacccagcctctgattggattgtccacttgtacggagtacagatagagacgccatctatatctcctactctaatgtctctattgcccaatagactgtgcacttgtacagagtattccgtttaaattttgataacgtcccgaggagaggattttgacatgtcagattattccatttaaggccgtgtttagattgaaactttttaattcaaacttccaacttttccgtcacatcaaatatttagacatatgcatggaacattgaatgtggaaaaaaaaccaattgtacagtttgcatgtaaatcgcgagacgaatcttttgagcctaattacgccatgatttaacaatgtggtgctacagtaaacatttgctaatgacggattaattaggcttaatagattcgtctcacagtttgtaggcggaatctataatttcttttgttattagtctacgtttaatacttcaaatgtgtgtccgtatacttaaaataattttggcacatgaactaaacacagcctaagtaaagaatggtgcaatttctaagcttgactttatgctacaccatacagtcaccatgcgtgcttcactatcgatgggtatgttgcttgttactgaaaaaactaattagccgtaaatgcgagcacccttgtcaagtttaggacttgaacctgctgagtggattggttccacacaagcaaacctaaccagttgagctacactcacttcgctatgttaggcattatattgttctcctgaaattaaaattcatatccagatttgtacttgaacaagttcacataactgacgaaaccagttcaaacccaaattggccaagtttgttcaaaaagttcaacataaattcaaaattttgagaaatttcgtttgatttttactgattttagccagcttgatggtatcgggatgtacatctctagttgcagatattgcatgtttttattagaagtactattcagcagccagcgctcggattagaaaaagacgcgcctcacacatcaatcccacattcccacgcaccaccacccctcctccttagtctgattagggtaataattttacccaagccattccatgtttttatacaacaggaatgctaaatagctgtcgcatgatttttgatagctaaatcattcatgtttcaatatattagaaccgttgtttcatacgttgtagcaaaatgtttcacgaggtgatttaattgtgatctacttggtgaaacatttacggtgtttcaactttctaaaagattgaaacattttttatctacttggtgaaacatttacggtgtttcagctttctaaaagattgaaatattttcaatctacttggtgaaacatttttgatctatttggtgaaacattcagaaccgttgttttcatatgttgtagcaaaatgtttcatggggtgatctgattgtgttccagcttttttaaaagattgaaacattttcgatctacttggtgaaacattttttatctacttggtgaaacactgcttgatgaaagactaagaaatcatgcgaatcccatatagacagtccctttatactataccgtaacaatccaacaacccatccattccttccaccacgatactatttttccggattgaccaaacaacgaacaaccaccgtatctcgagcaacgtaacatgcatcggcagcggatgaggggcggatctatagtagaagggtcggtgtcaaacgacaccaacgacttttggcaaaaaaactatagtgaaacttcttatccatatgttataacatcattatttaagcataattagcatactataacactgatagacacgttatgacaccaatgaatcgattttatggatctgccactgagcggatcaacggagtgtgggaggaggcgcaggaggaggtcactactataaaaatgatttttccgtgcggaggtttttgcccgtctgcacccacgggtctggaaaaatcaacatttttttccgtacgggcgccccaaccgcacaggataataatcttcccgtgcggtcgggttaagtggaccacactggataatcgattatcccgtgcagttaaattataccgcccgcacgcaacaaaaaaaaaccaaaaaaaaatcaaaaaaataaaaaaagcctaaccctaaccgtagaaatgcctgccggtgccctccgccgcccgagctcaccactcccggatccgcacgtcatcatcgtcccgcccgccaccgtccgcgcccgctgcgcgtgcacgtcgagccggcggtgccgcctcgtcgtcgttgttgtcgcgcctgccgccgccgcccgagctcgccgctcccagatacgcacgtcatcatcgtcgtgcccaccaccgagccgcgcggggccccgccgctgtctgcgcctgctgcgcatgcacgcggagcgagcggcaccgcctcgtcatcgtcgtcatcgcgcccgccgcagctcgttcgctcgcggagccgccgcggcgcctccgccagcagccgtcggtggcggcggcgcttgatcgatggggaggggaggagaggagaggaaagaggcagagagagaggagagagaggagtgggtaggagggaaaagaggcatagagaagggaggcgagtaaacagggagagagaataaaatggaaaaaggaagagagagagtgtgcgtcaaaattttaaaatgggtaggaggaaaaagagggggagtatttttctgtgcggtcttgcacgcgaaaatcgattttcccatgcggtcctcttaagtcgcctgcatgggatagtgaggattatccactgcggtcgaattaagacgtccgggaaaatgcattttcccgtacgggtgacagcctgatgccgatccccttatttttccatgcggttccagttatggcccgccagaaaacaaaagcgctcggcgtccaggaaaatcttttctctagtgggtggtggtgttgtgctgctggtgggagcaacgtggtcgagggtggatccaggtgacagctgatatgggtcggaggtggaggcctggcggtgaccgtgcaggcagggataagccactgatgctcgctacagggagcgcggcggtgaggtttgtacgtagccactcgatctggtgtaggggatgcttgagccttgaggtcaccagagtctgtgacatggagatggaggtctgtgtggaacccatcagaccgtcggcgcgccgccaccatttgctctgccttccattggccactcacgtctctctctccatggctgagctccggccgtctgctagcctcacaccaggcgccctgcccgggatgagtttaggggaggaggacgcccatccttggcaaggaggatgacgcttggggggagcgagagacaggaacggttcccaagatgccggggagtggcggggacaccagatctggtggtggtgggatcataaccgccaggatgcccagattcgatgccagcgtgggtgaggaggatggatccgtcaggaagccttccaccagtgccacctcctccgcggcatgtcgcttccgccgctgggaaccacgccaatactagaggcggtgaggtgatggggcagggggacggttcctggcggcggcgacctcgatatcggccaccgtccggatcaaccccatccaccgttcatctccggtcacagtcccacctgtcacttgtcctgcgtagcaccgggccgatctagcgcaccaaaaaatgtaggaggcgcacgactggcccgtccttgaaactgcattggcctttgagctgtcagcaaaccggcttctccgtttccaccggcaacgacagcataggctggaaacgaatatggtatgagaatatttcgtccgtatccactacgatttcatctctgcagttaggtaggtagaatcatttggtgtgggacacgtgggttggggttgactgaggcgctcgaaataaccaggagtgcgttgcgcaagtctatataatatataatagaaaaatatatttttttaatcaaataggttagtgccacttgtttaaacaaaatattggatcattttataatattagataatatcatgggtcgatttataaaattaaaaaacagtgatggttgaaagtgagtctaccaccgcaagccttctaaagaagtatatattacattaacttgtactcactcacctagctaatacacaatgagcaatgtttgcttaaaaaaagttactcacgaggatgtatatagttgaaacaactgtagggagagcacaaatgttcacagtcgactaccattaggctgagttcggctcttcatcttctcaacccaccactttcattttccgcgcacacgctttccaaactactaaacagtatgcttttttaaaaaaaaactctatatgaaagttgtttttaaaaaatcatattgatcctttttttaaaaaaaaaagctaattcttaattaatcacgtattaaaagaccactttggttttgcgtgtaggagggatgggttcccatcatgcagtgcagaacacagccttagcttatataacaatttagtgttttggctgcaaggacaatgtgatgactggcacagggctcttctcaacctcactctcaatacagttggtaaaatagcgagcaaacaccgcgaagagcttgtcaagtatggactctccgaaatgactcgcgatcaggggctccttcaccgccctcaggctcgtagagatggtcttgccggcggcctcagcggcagcggcaccatggatgatgacaggtgcagcagcagcatcctctgctgactgatctgagccgccattggggttcccgttaatctcgaagagccggatgtcggtgatgtcaagcagctcattctgccacactagctcctttagctcatcaaccgaagggcagtacaatggcaagttgaaggagtccagcttctccttctcaacacagtcctgacgcggaaaattaaatcaattaaaaggcattctaccagtaaagcctaatatatatttggataaagcaaaattagttataaccagttagctttatttgaaaacaaaaacatgtatttgttttctgtagtacacacatgtttttacacgtacaccgtcttcttttaattttcactgtctgcgaagttgtgccaagcaaaagcaccgatttctagttttctattaacaccttaaatattggtagtcaaactgagacgtgcccccatttaaatacttttttttgcccgaaaaccccatttaaatattggtagataattgcccaataagtcaaaaacatatatataaagattgttcatgctactatttctaatagtagtagaaaagacgacgattattttttatcaacgaaagagatgaaattaattgatggatagttgtgatagcttgagatgagtgactaggtagaatagtagctatatcttgggataaaatttgaacgctagaagtaactatattttgcgatggagaaaataagaaaaaaaaatctttgttttgtcttaaaatagcacctatctttgaaaaattaactggtggactatgggaccacgcttcaagtattaaattgggtgtatgatgtttattaactaaaatttaaacattctttttaagattttgattctagaactgtacagttctagttagataggtacatgtaccatccaaacatataattagttagataggtatgttgtaatgggacagtaaaataatgttgaatttgagttcttctattgctaggtatggctatgagttaaattattacccacaagttgaaaatttttttaaaaagggagccaattcatgtattttaaatcttgaagccccgtatggccatccatttgtctttcccaatgttcatacttttaataatttcttgcctgtagagatgcatattttaacatgctttacatgctaggtaatttcacgaaataatttgataagtgccaaaacgcagctcaatcgatctttagagcatgtatttatagtgcttttttgtttttgaagtgggagctggtaaacctagtgattaatttttctatcaaagaatatctcatgatgtaaacaataatatggtactcatgtcatctaaattatacctctgcaactagagtttgcagcccttgtgaaagcaactcgaatgccatggtcgtccctcctgcactgaatacatctgtgctattcctccctagcatcgtcagcaccatccgacctccaggcacaatctctttgcaccgcatttgtaggaaccgtgagaagtccttcttgaattgattttggtagagctttatcaccaatggcggtgtagtcaaccctatgtgaatgttcgcttcattcatgatgccatcaaggttctcggggacctgtccaaacgaccaatgtggttggtgatctcaaagccccaaagaggaacttaggaatctaaattaagtttatgcaatgagtcatatattaagataatttacctgagagagccacatgaggctcatggaggaatggaagagatggacgctgttacaaggaaagagtctggtgtagaaggagcctggcagacctacgacatagtgtggaggagattgcaaccctctagaagtgcaattttttgttgtcgactgctcaaactgctccagtgattgaaagatattattgaaatcattgccaggtaggtcattgagaaagaattggatctccttcggtctctccccgatagtattgttagggttttcgcctattgtggtgattgcatcggagacaaaaaggagtgtgtttgcaccgaaggagcaacctaggtcagcaatgaccatcgattgaggatgaagatctgtgcacactttgcttatggcttccttgactgttggcttggcagctagaatagcttttctctgcatagatatgaggggaaaaagggaaaaaattgtggtgaaacaattactccatttgccatgtgcccactctggtgtaactaggcccatgacaatccaaagtgtggtgggactgtatatttggctcatgactctatagttaatccaaactagtgtcaataataacatagtacccactaacaattattatattctaaagcacaacatacaaatatgccatatcattaccactagtaattattattgtagagcatcttaaacctgatgcaacatgacaccatcatctacaatttattatattccagaggtcaacatgcatctgcatgaaaaatcataattcacatattatttttataatattttaacatatctctattcattatttctataatatttagcatacaatgattcatgcatgcatttcgcaacagaatgcatggcatcatctagttatatagcaaacagcaatagtgtggaaaatttttatatgctctatattactgattacatgcatgcaatctacgttgtggaagatgataattgcatttgacaatttacgcagaaaatcatgtttagtttgtaatgaaacggcaattaattcctttcaaaaactgaaacggcaattaataagcacacaattataacataatggagaaacaaaaggtagagtcagttggtacaaacctgcatcatagagttcttggcatagctgaactcatcatccccatcattcgtcatgtggaaatcacgctcgatcttcatgtctgcgagatgctagaagctcaatccctatatttgttgccacctgggcccaaacaacaaaacagtgtttgaatggaacttgagagttcacaggagatattgcaatcttttatagacaaaccgaatgctcaattcctgatcgactcctaaaaactggatgaatgatgcttgttcattctaaaccagggtgctcaattctgaggtttgagatacatgaattgtccttgggaattgtctgtttttattttctacataatatactttgtaaagccagtcagttttgatcagttgattgtctggaacatatactatgggatgcatatatggtgtatttcctggaaatctctctctggtcgctgctttgtggtgcagtgcacacacaacttgattgttagaataatgggttaattaagggcttctttggaatgcatgattatagacttatagtaatgttggaatagaaaaacacattattaagatgtatgattttgctagtaccatggttaggcaaaggttgtgttttggagagctcccatacagtttaattcagaacatgatcagaagctagaatctaaaaaatctaagattctaaattgacctttggctagggggaagttaaaaaaaacttcctttagctatgtagaaaaattgttactccctctggactaggattatataagggattattcccttttagcactaattaaggaagagaaaaaagtgtgaactccatcggttgccctaaaaaggcaaagccaaagctaaaatttgaattttcaaacttaattttgaagttgattttatgataggatcggggattagtactaatagtacacgtgattttctctgtgtgtcttttcagatgggaaggggtgggagtgggattgctgatggttgttgtactgatcctctcgggataaccaaaatcctccataattttggacaaacccaaggaccataatttcctataattatggatagagggagtataagatggatctagtttttttcttttaaaatacatattatttaatgttgaatgactgttgtttttattttggctcggctcattaaaaaatatggtcttaaatgtagagaaaaatatggtaaattaaaaaataatttcaaagaaacctcgataaaaaggtggccaagctttacctagccatattattgcggttcaaaggaagccctacattgctctataatgttgtgtgtggagcttggagcttatgataagaattgcttcctccgtttcatattataagacttttaaagttaatatttatgtgtctatattcattaacatatatatgaatgtgggtaatactaaaaagttttataatataaaacaaacggagtagtttcatttccactagtctataaagacaatagagatctctactttatattcatagtgtgcatgctagatcagattctagtataaatcagtgtgctcgattcctggacattccccacagatggctgccataattactttcagccgtacttctggaagaaaattttgttcatttgggaacattgtagaacacattttgttgaatctcttgaatatgaagatgaagataaaaattaaatgtttcacataaaacgatgtagtaacaatgtctgattattacaaacttaaaaaatggattaatccgatattttagagcaactttcatatagaaagtttccacacgaaacacaccgttaagcagtttgaaaaacatgccacgagtatccaaaatttcatccaactctaataagagaaacgaacgcaccaaagtaagtccaaattaaatttgatgtcaatttttgaaccgtcactcatataggactccatctatatcttgtgttccatgctaggtggttcaagtctgagacaatgttctgatcaggagtataatttgacacgtcagtttatttaatttaattaagtaagtaaagaatgtttccaactttccaagtctgacgaaactgtcaccaatgtccctatgaggcggacctcctggtctatttcttctacatagttcatccattccataaaaaattaatatgaaatgtaatatgacacatctagtaatataaatatgaaaaaatatatccaatttcatagtattaagatgtgtcacatcatatactagatttatctttttatggaatgaaagaagtacgtgtgttgtcgttgattatttctttcttctaacattcaaatccaaatggcacccgatcaggtacatagaaccgatcaaaaccgcttggtatttgtgattttctattgactctttatggctcacaccaagaaaccgcccggtaaatatgaggaaattggacgtgtccattgaggtggagcatgaaaaaaaattgggtacgtgttttaccagacccctttttgacggaaccaacctagttttattttcaaaagaaaaattaaaattcaattttgtagtaaaacttcttgtcgttttaaggttttacctattttcagcagcttttaagaactaatcgagaaaaagaaaggacgaacgggttgggaacggtattctgttgtcaaacaattctgaaaaccacgagagataaaaacggcctctcgtatcgcccctcccccacgggcgtcgcctccccggggctcgtctccccttcctcctctacatcgccgctgcccgagcgcggccacaagaatggtggtggcggggcttcgtcctcgcgctggggaatggaaggggggcctgctcgggcggcggaaccgcctagatccatgtcgcccgggcggatctggtgatggggcagctggcggcggggctgagcggtgcggcagcggtgtctagtggcagtggcaacggcattcgaggcgttggcggcggcggaggaaaccgccagatccacgtctggatttggcaggatagcggccggcagcggcgtttagtggcggggatggcgacggcggtgaggacggcgaggggatgtagccagcggcggtgtctggcggcgggggtggcgagggatggcatcgatgaggcgaacctggccgcgccggcggtggatccagtgcctcgaggagttttggacccccggcggtcgcggcagtggtggcgaggagttcacgcgacggcggcgcgggctaccacggtaggccgtctgtgtcgtcggagctcgtcgaggataagcaggtgtgggagggtggcgagatggcaatggggattgaagggcagcggcggctgcggtggtggcaaccgtcaccgtggtccggggaggcatggcggtcttggacggctagccgggggcgtggcagacgaccgcacctagccggcatagcagcgtttggaggaggggtcggaggccggcttggcgcagagaggcgcagtcgatggcagtggatgccggcaggcgcgagaggcacggccggtagcgaggaggccagcttggcgcgagaggcgcagccaatggcgggaggccagactggcgtgagaagcgtgtccggtggtggaggaggccggcgcggcgcgatgaggcgcggtcggcagtaaaggaggtgaccacggtgtgaggaggagctgccggtgggtgtggcgcggtcttcggcgcacgaaggctagctagcggggggtgccagtgtagtggtcccacatgtcggcagaggttgagcggtggtggagcatcggtgcatcagccgtggactcgcaggtgatgagcggcgggtgaaaacccagcccgtccttggccaaaccgacaacgatggttcattccccctcctgagagcgttgtcgtgacgtctcatccctcaagggtggttgcagggggaaagcccagtcttggctcttttgagtccctgacggacggcggcggcggttttccgtcgcttctctccttagagacgtcgtttaggtatactcttgccaaaactacccaaacgattagtgcaagcacgctctaggatagagttgggctttgtgttggttgtaagggcgtttattgggcgttcttgtttgtgttcctttgttgacctacggcggtcggccacgcttagcggtggccggttcgatgctagccttctcctggatctgtgtgtcggtgttgtcggtgtgtgggtggtggtatattttttccattttcccagttacgatcttctaaagttgtaatctttttttttctactctatcaatagaacttcgcatcgtctcgtgtgagtccttaaaaaaaaaacaattctggaaacctgcgcccgagcagaaattcgtgatttttttaacccaacacaaagagcaatgctaccacaaagcagtgctcggattgatgtgatatagagcatgtccgcttctggatttttatcctattgagctggtatcgaaccaaatactactaatttctaaagactgagatgagaagtaggtactccggccgtttcatattatgtgttgtttgattttttagtgaaactttgttaaggttgattaagtttatagaaaaaaataacaaaatctgaaatatcaaattagtttcattaaatttaatactgaatatattttgataatatgcttattttgtattaaaaatactactatatttttctataaacctagtcaaactttaaaaaaacatatttccagttccatgaaattcagttacggagccaaatcaaaatgtaaactcttcataagctcttcataatttccaatatcatttgactttaagctcttcataagggacagatagtttcggctcagatttttttttttttgagatgacgaagggcgtgatgggctcttaccatctgacgacagcccatgggcctcagcacagcctcaaaatgaataagtccattttgcctccctcatctcttgcccttgtgtgaataacatccccaaaccgtaaaaccgggtataacgcctccttcatctcttaaaactagagcaaatgacctccctaagcggtttagcaggcggtttcgtccgacttggcgccattgacccggttgacaagctgactcagtgtgagcgacccacatgttagtgtattgtatgtacgaactaggccgagctgagtcagctggacggtaaaattattggcgcgcggctcgcatctctctctctatccccatttcacccctttgaccaaaaccctagaccggcaggcgacggccaaggcgacgcgaggtgcggcggcggcggcggcggctggtgtggagcacggcgacggctggtgcggagcacggcggagcatggttgcggctgcggagcgcggcgcggcacggctggccggtcgagaagcgcggcaagagggttcacctgggttgaatgtgtggccgtggttcgtcctctttcccttgtctgaatgcttccatttgatttgttttgattttataatgccggtagatttgtttgtggtctcggggtgggtgtgtttgaataattttttaggttggctagcaggagctgtagctcaagtggattttttttttgtgcttgaatcatgtaaagtgtgttggaatctggattggc

SEQ ID NO: 33673 - DNA, 35419 bp, Oryza sativa
atagtgattatctgcctggtgatgattgctctttagatgatgatgatgaggaaggtgcagctatagaaagacattacaaagatctcaagaagaagctgaggacaagcaaagtggctagcttggatgatgtgacttttggggggcacaagacaaatgcaaatatggctactggtactaatgaaggagatggcaatgacactgagtatattgacagtgatgatgaagagtcagtggaagagggttctgatggggagttaagagtgagaggaagtaataatgcaaggttcaagaagaagcctggatatccaacatttgagttgggaatgaaatttagttgcaagagtcagtttaagaaagcaattacagcatatgctttggctgagagaaaggtgataaactttgtgaaggatgatcctaagagggtgagggcaaaatgtgactggcatagctgtccttgggtatgtctgttgtccaataacagtagaagtgatggttggcagattgtcacctttgagaatttccatgcatgccctcctagaagagataacaagttggtgactgccactaggattgctgacaagtatggcaaatttataattgcaaacccctcatggccattagctcacatgaaggctacaatacaggaagagatgtttgctaatgtttctgtaagcaagttgaagagagccaagtcaattgtgatgaagaaagctatggatgcaactaagggacagtaccagaagttgtacaactatcagaaggagttgctgaggtcaaatcctggaagcacagtggtagttaacagagaggttgatatggatccaccagtgttcaaaaggatctacatctgcctagatgcatgtaagagaggattcatatctggttgcaggaaagtgataggactggatggttgcttcttcaagggagcaacaaatggaaagctcctttgtgcaattggaagggatgctaataatcaaatgtatctagtggcatgggcagtgattcacaaggagaacaatgaagagtgggattggtttctagacttgctgtgtggtgacttgaaagtgggtgatggcagtggctgggttttcatatcagaccaacaaaaggtattcccaagaagcattttttcaatcttgtaggactgaaagtgcatgatttgcaatagggctaatgttctcactgttttcttatagggtattattaatgcagttgagaaatgggctccagaagctgaacataggaattgtgcaaggcacatctatgctgattggaaaaggcatttcaatgagaagatattgcagaagaaattctggagatgtgccaaggctccatgcatcttgctgttcaacctggcaagggcaaagctagcacaactgacaccacctggagctcaagcaatcatgaacactcacccccagcactggagcagggcatggttcaggttaggctccaattgtgactccgtagacaataacttgtgtgagtcattcaacaagtggatcttggaagctaggttttttcctatcattactatgcttgaaacaattagaaggaaagttatggttaggatccatgatcagattactacctcagctagatggaacactgctatctgccctggtattcttaaaaaattgaatgcatatatcactaagtcagccttttcccatgccatatgcaatggtgcatctagctatgaagttaagcaccatgataataggttcacagtgcaactagacaaaatggcatgttcctatagatattggcagttgtcaggactcccatgccctcatgcaatctcatgtatcttcttcaagacaaactcactagatggatacattagtgactgctactcagtgactgaattcaagaaaacttatagccattgcctggaaccatttgagggcatgaacaactggccatatgatgacagacaacctctcaatgcacctggatatatcaaaatgccaggcaggccaaggactgagaggagaagggaacccactgaagctccaaaggcaaccagaatgtcaaagatgggcacaaaaatcagatgtaggcaatgcaaatagtttggccataacaagtctacttgttacaaacatagttcagggggccctagcacagctgcttctcaccctacaggcagcccagcagggaccaatgcagtcagcccagcagggggtttagtactgtcaaactatacacagggtaggaaaagaaagtcaatctcgagtaccagcactagttctgcaatacactcagtgagaccagctccttctaagagaaaggtatgcacatatttcataatccattcattgctgctccaattaatagaaacaaacttggtgctaactctttcttgtacatgcaggcacaaatgcaggaggcacaacagatggtgaaagtgacagccacagcataagttcccacaaatgaaggtggtacaacaactgtagacctgcatgcaattgtaccatactcataggcttcatccagtgcttcagtgaggttgaatagtggcaaagcagttgtcaacgtttcagctcaagaaccagtcaagatgaagccaaagaaagccacacctgggccactactccttcttccaccatgggagtctgcaaagctttgaagttctgccatctccatttaactaatattagaactatgttaatgtgttgtaatgactcctgtgtctgagagctatgatgtttgatgtttttgtaatggaccaattcctggccatttgctgccatctgtgaaccatttcaaatgtgtgtgatgtctgatatggaccatttgttgtgtgtaggcctatattgccacacactaatgcagtctgaacttatgtcacaaattgagctatctgaatgcaatatcatgtgaactatcttcatttgtgctggtcatatgtgttgtgtgtgctgttacaaataatgtgttataaattgagtgctcaaatgacccaattatatttcatgggttctatcttgtctgctcaaattacacaattctaattcatttaatttcagatgtatcaagcacaaccatacaaacattttaacaggaatttttccttcattaacacagagtgcattacaacacaccacaacttgcagatatttctttcaacctgacaaagttcattacaaaacaccacaacacccatcttgctgcaaatacttcaccctacatttctccttaccaacaccagtgcaaacatgacaaatacacaacccataacaacaactaacagataacatctctccttctctagcctactatttctatccttcagcacagcaattctttcagcatagtcacatgacagctttcttgctgcctccaactctctttgagcagcatcaacctctattatcttctcctcaaccttcatcctctcttcttggatagccaaacaagtctttccttctccctcctcgctgaccaaactgcatctcgcaaatcattcaacacttctctaataaaggtggtcgtcggcccatcataccaagcataaaaaccacatccaccttcctgcaatccctagcaataaatttcaatccccaataaaaaatccaccgtccaaccaaagaacaaaacatacctgggcattgcgacatttgaagtaccggcggctggggttgtccggactccacgagatccaccatgcagccttcacgcgacagtcgcacatcacggccgactggtaatcaaaaggaccaaccctatatgggatgggactcctcgatgaatgctgagaataggacgatgacccgtcgctctgggaactagccatcaccgcaccacctctattcgcgaatccactcctaccttcaccgtctcggcggattgcgcccttgccgtcgccacggattgtgccctagtcgtctccgccctcgctatcgccagccgcgctccgcaccagccgtcgctgtgctccgccgcgctccacaccagccgctgccgccgccgccgcacctcacgtcgccttggccatcgcctgtcggtcaagggttttggtcaaaggggggaaatggggatagagagagagatgcgagccgcacgccaataattttaccttccaggctgactcagctcggcctagtccgtacatacaacacactgacatgtgggtcccacatgctgagtcagctcgtcaaccgggtcaatgacgccacgtcggacgaaaccgcctgccaaaccgctcaaggaggtcatttgctctggttttaagagatgaaggaggcgttatacccggttttacggttgggggatgttattcacacaagggcaagagatgagggaggcaaaatggacttattccgcctccaaaaccctagcccgttcccacggcccttaaacccttctcccatcttctccacctctcttgctctctcgccctcttcaccaagaaagaaaacaggcgcacgcctcgcctcgcctcgccgccggcggccaccgtctccgccgcctcctgcccccaacccaggaacccccggcgagagagctcgatggaccaggcggggtcgatggaggagcgggtcatcaccgagcggatccggcggaagctggaggaggtgaacgccgccgcgcagaagcacctcgccggcgtccaggaccacgtcaacttcaccatgcaggtcagggctcctctgaatctctctagtgttagtacatttttttttcgcctcgcggtagtatatttattgtgttttggggatacacgggaccggaaatccggaaatttggtggtattgattggttgcaaatcttgactgacttggtgcggcgtttcttggattagtctcgtgggagctgggaagtaagggcttggatgttcttgttccgatgtttgatttggcgacgatgaagcaaagtgttacggtagtgcgtgctatttatatgggatttgtagatagttcagggatagggcagtctctgctattttgataccaaatgtttgtagactctcaagttgatataaggatatcagatttggtgagccttgcataaataatttgttccaatgtagtttcagtgattcggttgggcatcaatcaatcaggtggatgcaacttagtatattttggaagtttggaaagcccaatatcggagaatgattaccaactactgaaacctgctggttatatatttttgtgtgacttttgcccggatctagcttctggagtatcttaaaaattctcctgtcactccattgtatgctatcaggtgtgggtagacagtcttggagtttgtttatgaaagttcttgaatcttctgttctgtactgtcatttgctttttgtatgttatcaggcatgagtagacagtattggagttgtttatgaaatttctttagtgttctgttctggagtctgtaaatgtaaggatatgctgtacgcttgttcaatttgtttcactgcctctcattgtggaagaccaagaataaagtatgtcattatgagagaagaatttatctaaattgagagccctgtgctaattatttattttatatctggttttcttattgatcttcagataaagaataaatgctgtaataaaatatgctacatatctttgtaagaggagaatttatctccataaaaatgagaggggtaatctgcacagagagccaatgttaatttttttttttggtttctggttttcttattgatcatcagcaagcgtacttcaagtgtgcgtatgaatgctttgatcgccgaagaagtcaagaagggatcaacaattgtgttgagaactgcagcgtgcctgtccttactgccaacaatgttgttgagactgagatggctaaattccaggtacttccagtttcattcacctattgcttttcatttttcttatgattattgccttccattacttgccatcatagagcaacatagaacccaactttgtgtctgttcatttatgtagagtttcaatatattttttgctgtacagtctatatcactctacatgtgaaagaagctatggttcacttgctgcaagttttacctagaaatatgcgtggacaaaatttttttcctctttggtttctttgtgaacttagactgatcattgatgctgaactatgcctaccacatgtgtgtttgttattgatgatatcatactgagcaacttgtacataatggtaccactgtacaaagcgcaccgtgttacagtagattatcaaaattttgttgtccagtacaaacaagcatttgtgcatatctatttgcatatgatgtatgttcctgatttatcttctgattatgtattttgttcagcaagcaactagcgtggctgtgtgctgatcttagggaaaatgatagaaggaatgacttaacaagtagtgacatatcatctaaccaaaaaatgggaatatctctcccacgcgataggtataggcatcagttgctatggacatttgttataaggtagccaaggtgtcacttatggaaacatatttttccctccatctggcagtgtaagtgtgtaacattgataaaactaaataatgcttaaatggtaaaattttgcaggactctgatcttggtgtgtaactgtttaaggatatgcatatctaactgcttgagctattttatcggaatacatatgcgaaaaatattatgttagaacagaaggaaaagtcaatggcatttcgaataaaaacatctgtttgtacaaatagtgatcagtattcagtattcacctttagctgtatgttttatcatgcaaaagcatgtctaacccctattacctttatctgtatgtgatctaagttgtgatcttttcccctgtcctcaggagcggctgaatcgatctttgatggtgtgccaagataaatttgaagcagcaaagctccagaagatgaaaacacatgcgactgaggagctagaagcatgcgtaaacagatctattgatgacagtatcagggtcctgccccatctggttgatcagatcaagtccaccctctccatgaattagagagatcagaagaagttcagaactaaacagtagaatcttcctcgtaaactatttcagcttttacaaaaagcattttcactaattttggcaccaagatcgttggccaaattactgccctttgttaacatgagtatgacatatgagcggcatatcgtattttgtgtgccttgagcattttgttcggaaccacactttgttgcagagctgatttatcgaaagatggtgcaataatagaagatgatatcctcatgttgctcatccttattcatttgcatcttgcagtttgtttcagttcatgttaccagcatttgatcttcattcatgaaccctatgatgatggcagaagatgatattcccatgaaattactggcgtttccacttgttctccctcccttgtcaagtatataccacattttttattgcttgttctcaagaatatacaattaggcctactttcgaatggaggaatcaatttgttctctatattatcaggcctcttttggaacggtggaattttaaaggatttttcgaggaactgaactagaatcctgtaaaatttatacatttcaaagagccagtctctctctcaaaaaaaaaaaaagacaaatgtaatgtgctatgtgcttgatttggtgaaaggaaatcccgaaaaccgggggatgaatttaaaaaaaagggtgaatagctaatttagtccctcaagtttcaccgaaggctcactttggttcttcaggtttcattttgttaacataaaaatcctctaagaccctgtttatatgggactaaaacttttaagtccctatcacattggatgtttgggtactaattataaatattaaacgtagactattaataaaaccaatccataatcttggactaatttgcgagacgaatatattgaacctaattaatcatgattagcctatgtgatgctacagtaaacattctctaattatggattaattaggctttaaaaatttgtctcgtatattagctttcatttatataattagttttgtaagtagtctatatctaatattctaaattagtgtctaaatacatagactaaagttaagtccttagatccaaacaccaactaagtatttgttttggcctaaaattatcattgggcccacttaatatgccatatggctatttttagtcatcaattctattagaaaatgtcccttttgcccttaacttgtatacaactatacactagaaaaaagaaaccaaaataaataaacaacattgtatatttacttcccattatttcaacatgtgcacatgaaaattgagcctaatggctatcgtatacacttgtaagcacataatttttttttgttttatctataaaaagaattcattacatgcattttttctctatatatgtgaatgagggggcataagtgtcatttatcaaaagagttgttagttatgtgggttaaaggataagtttgaattaaaatggtgaatagctaatatgacctgaagtttcgcttcgggctcaatttagtccttaaggtttcaaatcgtccatacaagtcctctaaattaattatttgggttaatgtagtccttagacccacacaaagtaccatgtgagcatgccaagtcatcctcgcatgcagcggtatgaatgaaatgaccattgtacccttatataccatatagaaaagaaagaaaaaaaagaagattaatgtttcacacgtgcatgatcattttagaattgtcagttacgattgctgcaataagcaaaaaaagattactaggaggacgtgctgcacacttaaaattcaaaatattttccttgcacaagaaaaatcttactcatctaaaagttttgatgaagttgctgtttcaaaacataaaagacccctcaaattcgtaccatcacaaatcccgcagaactgacgagcgctaatggcccctcctcccctggcggcagcgccaccgccaccgcccgccgccgccctcgtccaccactacacccgcctcctcttcgccgccgcctccgcctccgccgccgcctccctccgcgccctcctccccatccacgcccgcgccgtcgtgctcggcatctccgccaacccggccttcgccaccagcctcatcaccgccgtggcccccgcctgcctcgcctacgcacgcagggtgttcgacgccgcgcccagccgggatgcctacatgtggaacaccctcctccgcgcccatgcccactcccgcgcccacgccagggacgccctcgcgctctacgcgcggatgcgcgccgcgggcgtggcgcccgaccactacacgtacccaatcgtgctcccggcgtgcgcggcggcgcgggcgccgcggctcgggcgggcggcgcacggggacgccgtgcggttcgcgctggcgcgggatgggttcgtgagcagcgccctgatctcgatgtactcccaggagggggaggtgcgcgacgcggagcgcgtgttcgcggagagggatgatgcccggacggtcgtctcgtggacggccatggttgctgggtacgcgcagaactgcttcttcggcgaggcagtcacgttgttcagtgacatggttgctgcgggcgtgcttccaaatgagatcaccctgatcagtttcctgccctgcttacgggggcaagaatggctgcctgttggggagatggttcatggattcgtcgtcaaactgggattcgatgcaaacgttcccatggtgaatgcgctaattacgatgtatggaaggtgcggaagtgctcccgtggcaagagttctgttcaatgggatgagtagccgcactctggtttcttggaatactatggttgcgatgtatgagcaacacggtgatggggttcaggcaatcaagtttttccgcaggatgcttaccgagaaggtggggtttgactgtgtgactttggtgagcgtgttgtctgcttgtgcgcgctcgggagcccttggtaccgggaagtgggtgcatgagctagccaggagtcatgggcttgacactgatgcaaggattggcaatgttcttgtagacatgtatgcaaagtgtggtgagattgcttatgcaaaggaggtttttcattcacatggtttgcgtggtcacagtgttgtgtcctggagtgccatgatcaatgcatatgccaaccatggggaggcagaagaggctctcaagctcttctccctgatgaggaatgaaggggtgaggcctaattcattcacatttacagcggttttaatggcgtgttgccactcaggccttgtcgatgaaggactgaagcatttcaacagcatagccacagactaccaaatgtcaccaacacttgagcactatgcttgcatggttgacatgctaggacgtgctggtagacttgttgaagcatatggaatcattaggggaatgccgattcggcctgacaagtgtgtgtggggtgccttccttggtggttgtaggcttcatggaatggtggagctagctgaatatgttgcaaaggagcttttcgactcaggatctaatgatgtaacattttatgttctgatggcaaacatgtactttgaagctggaatgctggaagatgctgagaggataagaggagtcatgaaagagatggagctaaagaagacagctgggcatagcttagtttgtactgatagagaaagaatagctgtcgtaaggtagcagactagtaaaattgtactactgatgctaattagcttatctgttgctagcttcgtatgtagattaattctttgatagttgagatattcaagagtaccagcactttcttttggtgagtggcttgtactacggtctttattgtgaaggcaacataacttctactgtcttcagaccaatagcaacttttcatggcaatgttgtccaatcctgggtgtctatttggtgcaatatccatgatttgttttggtgcctcagcttgaaggtaccacaccaaatgcctagatttattaaaggcacgtatttccctaatatcaaggaatggaacctctttttgcacaattattttgaccacaagcttcatactctattttgcaggtatgttctcttctgtaagcacactaattgaggacaatgttcaacccaaagtgcctaccaagtcattcatcaagaaacaactgaccaaatagtaagcctttattttctcaatgatattcatgagaacactatcaacccaggaaggaaaactaagaacattatctccagaattcatttcttgtggagaactaggttcaaatgaactcatattctttacttgtgcctactctagttctaaaaagggagctattttccgagactagtcttgtgctgaaatcccacgcttaactatttccaagatgggaggtctatagctcattcattttgctcttctgtttgcaaccactaagaaaggtactcttatttcccgtgaatgatgaatattatttgataatacatgctctgatagcctacatgtatatgctcataatcctacaatattgttttaaaaatataaactgggaaataaaaatgaaggaaattcgtttcagttggatagcatttagaatgggagccttatcattgtaggtaacaactaatgaggtagagtcacctggggttttgtaagccaagcgtggaagtgaagctgcgatgtgggctgcaagagagctcagccattcactggatggagacaagagcgtggcatgatggcaggtctatccgctcagcatgtcaatgataacttgaactgaatatgaatatgtttggtgagatagcagtttgcttatgcagttgatacatcagaaaaaccagaatactaaacttccttttgtatttttgttatatgcaattagcaattcaatttagtgtactctgagcggcaaattatcctgaacagaaatagcactgcatgtcataatcaatagttttattggtctaccttgtttcgtttgccaaatggtatgttcaaaatatcatgaatttctattcctctaagattacaattttgttatctattatctattgaatttgtttatcttgcttcagtatcatttgtcattttcttcttttggatgttcacaaactgatgatctgtgaaaagagtggaaaacgagaactttgtgttagatacaattgttgaatggctggtcaagacaaattatgagtgccctctatttggccccttgaagacattgatatgatgagactgaagatatgtgttggactatttgttgctcgatgagcaggacacagttccattggaaattaggatgtgttctcccagaaacctctaccagaaaggcatgcactattctgtttcatgtgcttgttgttcatcttgtgtgccttaccttaccatggttaacaatttgttatccatcaagtgtagttctggaataataaagaaacttcaatttgccatgaaaatcttggcctgatttattgttcgacaatattagtggaggctgggacaagcaaatcagctgtgtgtattattactgagactacgagttctgcatgctggtatattcacttccatatccatttcttgttttctttggctggttgcagcaaaattggttgatagttaaggtcttatggatatcataagagaacaaactttgatgcctatgtttgaatgttgtatagatattggctagtgggtaattatttgccagattcacccttcattcgttgtcagtaacagtgcctggaccttgattgtccatagttgacaatttgttccagcatagttgacaatttgtgcctggaccttcattcgggatgtacgggcctgtttattcagctatcatagtgttgacaagctttgctgctctactgcccctacctattcgcagggttcaatctttcgtttgtgttagatatggcaatatttctgaaattttgaacaaaatttagtcaaatttgaaaaaatattgccgaatttcatgaaagtttttaaaaaattcggccaaaataatatcgtataaggggcgggggttccataggattgaaattccgaaattttgaaccctacctaatcttagtgttatattatattcctcatggtttgttggcttataagccagacccaaaattttaattttcaggcttaattttagattattttagacttatttatttatttttttaccttaacttttaaactgctaaagggaaagatacacgaggccaagccggctatcaacatccttaggtcatatccggtttcacctaaactggaacctattaagctttcaaaagtatagtttctttaaaacatttttttatcatccttacgacttagtatttatttgtcctcgtttcattcagttatgtctatttcatcaaatcaaacataccaaaatcgaaaatggccaacaactgcatgcgggacgaccgaacgtttcccttttttaatatctaagattggctcattcaaatattcagagtttataggatcctgatatagccaggaatacaatgaaataactaaagaaacaagtagatcaaagcaagaaatggcagcatggcacgcggcattcaacgcaccagccaaccggaaacaaccgttacagtgaccggcatcccaaaccccaaatgtatgaactaattacgtaatcaaccggcctaattaagcaggcaaccggcgcaccggcaacgcataagcacgcaaatcaggctgaggagcagagaacagtaaacgaagacgtgtaaaacagtcagatagccaaaaaaaaatccaaaatcatgagaaaaacgcgaggttagaggagttattgattgatgatatcgataaacaacgagctcactcgatctagtcaatgtactttccatgtttaaccatttatctcatttaaatattatgtgtaaatgcataaaatataaatcatgcttaaagatatttttagttataaaaataacataaattttttaataaagaaatggttaaacgtgtattaaaaaacaacagcgctattgtcggtgatatgggaccgggagtatcgtgaccagaggcttgaggcagacacaatcgcccacgtggcctggcaccttcggggacgtcgggcccgagggtgaggtgtccgccctcctcctgatttccccgagggggggtcgggtgactcctgccccggccccgagggccgaggcgccccgaccccttgtggagttagcgccacatgaatgggttgggtgaacacggtgagcctcacctaaccgcattaattgcggtctggtcgaacgtgtcacgctgcatgaagcacagtgcagcgcgttcctttatccggtctgtgaccggtcacagaccggtcagatcacgggttaggtgcgactggtggtctgacgcacgccttgccccatcccgtcaagatgaaagcctctaggcactcgtctcaagccggagctagcgtgtaatctcttagagatggcacgttagccctggttagatttataccaggcttcatctcaaccattacagcctatatgttgtatgaagaagggtgaacatgcagattgttgaactgacgcgtggaggacaagaatgaccagtctgacactggtcatgtcgtcggcagacagccacgttcccacgacgcgcctgtcttcggcagaagtggaggtaggtgtgtgccgtcccgtcagaaggatgttcggaggacaaccgtgcaaatctccgtccatttatgaagagaagaaaagtccagtttggaaagagaggggtgcatgtggtatccccttgaagtataaaaggaggaccttgcccatagggaaagggggatgatcttttccagattcggaacttagaacaagtaagaggttggctcacactttgtagctccctcatacacagatccaccaaaacacaggagtagggtattacgcttcttagcggcccgaacctgtatacatcgcccgtgtctcgcgtttcttcctagctggcgatcttttcacataccgagagagcttgagacttcaccctaagcccccggccgaaccggcaaaggggggcctacgcggtctcccggtgaggagccacgagctccgtcatctggcgcgccaggtagggggctcagcgtgtgttttctgagctctcgtactcctccgtgtgcgccaagtttttcttgttcagcctaatggccgagcaagcaaaggtgcacgacctctctccgagtgtgagcggcgacgacggggagccaaacccacgtcgtcgagctcgtactcccccacctcctccacaccaaaatcctaagcagggggaggcgctcgagagggtcgaaaaatccgcagcatcgccagtcgcgggtgatgcaggagaacggcgagatggggagcgtcgcctcctcgtctacggcgacggcagcacgcctcagggcgcgcttcaggctgttggcgcgctcctacgtcacccgcccgtcgtccctgacccggagtctccagcccagcgatggctggacgacgtggccaacttggtcatgacggcacagcagcgcctgggtgctggtggacggtccgccaccaccaagacctccggcgccgccactaccggctccgtgtcatcaaggcggagggcgcggcgagcggcggctgttgcacgccattcggctgccactccctcgtcggcacctccgactcgggaggatcagcatggagagccggatgcccgcctcgacatcgagcgccggcgtaatagccggcgtactccccgcgcaacggagggcgcctcttcgtccagagtgtcacctcgacatggacgtaaggaccagccctccgtgcccccggctggtggtgtcggctgtagagcctttgtggcgagtcttcggaatgtccgttggcccccaaggttccggcccaccatcaccgagaagtatgatgggagtgtcaaccccaccgagtttctccaggtctatacgaccgggattgaggccgctgggggtgacgacagggtcatggcgaatttctttcccatggccctgaaaggacaggcgcggggttggctaatgaacctgccacctgcgtcggtccactcttgggaggatttatgccaacagttcactatgaactttcaaggcacttatccgcgcccaggcgaagaagcggacttgcacgcggtacagcgaggggatgatgagtcacttcgctcgtacattcagcggttttgccaagtccgcaataccataccatgcatccctgcacacgcggtgatctacgcgttcagggggggtgtgcggcacaaccgcatgctcgaaaagatcgcttccaaagagccccagactaccgcggagctttttcagctcgcagaccgagtggctcgtaaggaggaagcatggacctggaacccctccggttccggagtggcagcttcggccgcccccggatccgccgctcagacagggcggcgtgacaggaggaggaagaagaggtcggtccattccggcgacgagggtcatgtcctcgccgtcgagggcgctccgcgggccacccgaaaggggaggcctgcgagcgacaaaaagaaagaggctggtactcccgccagggagcgcccagctagcaagtggtgctccgtccacaacacctccctccacgatctcgcggactgtcgcgcagtcaaaaacttggctgagcgaacaaggaagtgggaggaggacaggaggaaggaacgccgtgagggcaagtcgccggcaactccctccggtaaacggcgaagtgaggccaaacagaaggcccccgctgtcgacatcgatgtcggtgatgatgacctaggtttccaagaacctggagccaccattgccactgtcgatgggggagcgtgtgctcacgtctctcgccggagcctcaaggccatgaagcgagagcttctggccgcggcccctactcatgaggcgacgtgccgggcgcggtggtcggaggttgccctcactttcgaccagaccgaccacccaccgtgcgtcgcccggggagggcagattgcgatggtggtttcccccaccatctgcaacgtgaagttggggcgtgtcctcatagatgggggagcggccctcaacatcatttcccccgcggcttttgatgccatcaaggccccggggatggtgctccagccgtcccaaccgattatcggtgtgacgccggggcacacatggccgttgggtcacatcgacctaccggtcacctttggtggatcagccaacttccgcacggagcgggtgaacttcgatgtggcggacctcagtctgccctacaacgcggtcctggggaggcccgcgttggtgaagttcatggcggcggtccactacgcctacctccagatgaagatgccgggccccggtggccccatctctgtccatggcgacctgaaagtcgcgctcgcttgcatggagcagcgcgcgggccacctcgctgctgcgtccaagcccgagggtggtgacgagaggcttggcacctccgcccccaccgccccgaggcagcggatggtcacatgcgccgaggtcccggtcaagggggttgccctgggcgacggcccatccaagaccacacggatcggtggtcttctggatggcaaataggaagacgcgctcgtctccttcctgcgggcaaacgctgacgtcttcgcatggagaccggcggatatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttccaaaggcgaacggcaagcttcggatgtgcatcgactacaccgaccttaacaaggcatgtcctaaggacccttaccccctgcctcgcatagatcagattgtcgactccaccgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcaacgtactactcgaatttctttgggtagccaaatagggcgtaatgttgaggcttatgtcgatgacttggttgtaaagacgcgcaaccaagacactttactctcagatctagcggaaacttttgaaaatctccgctccgcccgcataaaactgaaccccgataagtgcgtgtttggtgtacctgcgggcaagcttctcgggttcttggtctctgcccgaggcatcgaggccaaccccgagaagatacgagctatagagcggatgcgcccccccagcaaacttagggatgtgcaatgcgtcaccggttgcattgccgccctaagtcgtttcatatcgaggctgggagagaaggcgctacccttatttaagctcctcaagcgctcggggccgtttacttggacggaggaagctgaacgtgccctcactcagttgaaggcatatctcagctctcccccagttctagtcgccccggggccaaatgagcccctactactctacttagcggcgaccccccaagtagttagtgcagcgttggttgtggagcgcgatgaagacaatcttcatttcgcgcacccccgccctgtgttgacttggcccgggagcgagcagggaggagaagcccccgagtcgaacggtggcctaaggcccctgacgaccggagtcggccctctgcctgcttgtcagacggtgctgggtgcccccgaccctcaggaaggccccgaggccactgcgggaatgccgcacctatcgccctttggcctcgaggctaaccctgtgctgactcgacccgggagaaagcagggagaagaggcccccgagccgaacggaggcctgaggcccctgacgaccggagtaggccctttgcccgcttgtccgacgacgccaggagcccccgacccccaggacggccccgaggccactgtgggaaggccgctcctgtcatcctccgaccccgaggtcatcggcacagaagacgagtgcgccccgagaggccacttggacgaagaacgccccggggatgcggcccctagcgaagaggatcggccccgccgaaaggtgcagcggtctatctactttgttagtgaggccctccgggacgccaagacccgataccctcaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatctccgaggccagcacggacccctctcggctgcctcacaccgcccactgggtgatgcagttcgacggttctctgtctctccagggcgccggtgcgggggtcacgttgacctctccgaacggagacgtcctcagatacttggtccgtctcgattttcgagcgactaataatatggcagagtacgagggactccttgccggactcagagtggcagctggactggggatccgccgcctcttggtgttaggcgactcccagctggtcgttaaccaggtctgtaaggagtaccggtgctctgacccacagatggacgcttacgtacgccaagtgcggcgtatggagcgccattttgacgggatagagcttcggcatgtacccagacgggataacatggttgctgacgaactctcacggctcgcgtcctcgcgagcccagaccccaccgggcgcctttgaagaaaggcttacccagccgtcggcgcgacccgaccccttaggggagacggatgcgcctgaccggcccccgaggtccgtcggagtccaggcctcgggacccgaagggagcgctccaagctcccttagattgattgcttggatctctgagatccaagcatacctcacagataagactctacctgaggaccgtgaagggagtgaatgcgtccaacgcatttccaaacgctacgtgctggtagaaggtaccctctatcggcgcgcggctaacggaatcctcctgaagtgcattcctcaggaacaaggcgttgagcttcttgctgatatccatgaaggcgagtgcggagcccattccgcctcgcgcaccttggttggcaaggcctttcgtcaagggttctattggccgacagctctcaatgatgcagttgatctggtccggcgatgcagagcgtgtcagtttcacgccaagcaaatccatcagccggcccaggccctgcagatcataccactttcgtggccttttgctgtctgggggctcgatatcctgggaccgtttaagcgggccccgggcgggtttgagtatctgtatgtcgcgatcgacaagttcactaagtggcccgaggcttatccggtcgtcaagatcgataagcactctgcacttaaattcattaagggcatcacggcccgttttggagtgcctaaccgtatcattacggataatggcacccaattcactagtgaactcttcggcgactactgcgaagacatgggcatcaagctctgcttcacctcacctgcccaccccagaagcaatggccaagtggagcgcgccaatgcagaaatcctcaaaggccttaaaaccaagaccttcaatattctcaagaagcatggcgattcgtggatcgaggagttgccagcggtgctctgggcaaaccgaaccacaccaagccgagcaaccggggaaacgcctttcttcctcgtctacggcgcagaagcggttctcccatccgagctcaccctgaggtctcctcgggccaccatgtactgcgaagctgatcaagatcagcttcgcagagatgacctcgactacttggaagagcgaaggaggcgcgcggccctccgagccgcgcgctaccagcagagcctgcggcgctaccatcagcgccacgtccgggcccgatcactctgcgtcgacgacctcgtcttacgccgcgtccaaacgcgtgctggattgagcaagctctcaccaatgtgggagggtccgtatcgagtgatcggtgtcccccggccgggctccatacggctggccacgggcgacggcacggagctgcctaacccgtggaatatcgaacatcttcatcgcttctacccctgaggggggggtcgagtgtcaggttttggctcgggccaaccccgcacccccctcgggtgtgcagggttggccgggggctaccacacatgcactttcttatttctcttatttcagcatttcaataaaagcagtttcaatttcctaaaggttgtgtctgtgccgttttttccttttgaagaatcttgacttgaaataaggtcactcgtgctcaaccttgccctcgggggctcggttcggtcagctaaaatcgccaaacggggcccagaaccgagccgtgccccggggcgtggtgaactccgggggggaatcggcaaaaacccacaatcgggtcacccataaccctcggtcaccacgttctcggcctggccagcctcgacatgtggatctccctaggcactagccccgacccgagccattagaggactgggacttgggcacgaggccttaaatcaagctaagacacaaaagaggaccacggcacagataatcctcatctcatacgcatagcaaaataaaattgacacgaattttttcatcatttttgattccagattaagttgatctatacaaaaaagaggcatgaagaccttagaagaaagaaaaagaaaaaattggaaattggcgggggcctgggggctcagtccgatgcgcccgggtcgccggcctcgtcgtcacggtcgtctgcaccgctggcatcgccctcctcgtcggagttgggggcgaacgcgagccgaggggccgacccctcgaaactgtggacgatgtggtcggcggcatcccggacccgcgcgcgcgcgtcgtcctcggtcccgggagggaactcttccagcgccatccatggagagaagttggggtccctggcctggtaactcgccagtacgagttcaaccgctccttgggcgaggtccctcgaggatgacttgatggtcttctcgagctcctcggggagttgttggagagcccaggccatcttcgtgaggtgcggagcgaggccttccaggttggtggagtgcgtccttgtctggcctttccagaggcccgcttgccgaccggcgcgatccaggcgggagaccgcatcccaaagcatgccgggccctatttcgcccgccaagcggagggcctcggcttccccggcggatgagtctagcgcgcactgcatgtcggcgatggtgagttcggcagctgcgaggcgggcggctaagtcgctttcgcccgcagccgccccgctgatatgcgccctcgcgtccagctccttttcccgcgcctcgaggttggcagcccgctgctccagtgcggctctctcggcgcggatggattccaaattgcggcgtgcctgctctgccagcgctgcctcacgaagggaaaggctatccgccaaccgttgcgccgcagcctcggcctcttcgagagctcgctcccgctcagcgagtgcgtcctcgcggaggcggagcgcggactcctcttcggcgcaggcggcctcgtgcaccgccagcgttgcctctcggatagcggcggcggcctcgcggtccgccaagcccctctccacggcgccggcgtgttcctccaatgccatagcacgggcctcaagggcctcctcgcgacgccgggacgccgcttcgatctccgttgcccgccgctctcgggcagcggcggtgtcaaggaccccttgggcggcgtcgagctttttctttagctccgcctcccagctcccgtgttgaaggcggagggtgtcctgcgcctcgatcatcgcggtggtggcaatgagggcgacctcccgctcctcgtccacctctcgggcgatctctgccagcgccgctttgcgggcttcaagctccgagacgtgacggcggtgagccttacggcccacctccaccatgacatccaccgagcgccgcccctcctcgacacgcgcccatgcggcctcgagctccgctcgttccgctcgcagggcctccacttgggcgctgaacccatctagcaccgcggtgtttgcggcggccaaggcctgcagaaggggctcggcgctcagcggggcgacagaagacgaggagaagagccgccttggagagaatgcgacgcggctcggcccgccggaggacgcactgggctcgggaatgtcccccggacccgtttggtcctaggcgtcgcctggggaagtgcgcccaggcgatccgcccgcggcctcgtcgcgagccgccccggaggctgtcgtctgagcgtcgcccgagggagtgggcccaagcgacgcgccagcagctttgtcgtgagctgcctcggaagacgccatcgcctcagcctgacgagcccgggcggcctcctccttagcagcttcttcggcttggcgagcccgggcggcctcctcccgagcggcctcccgggcggcctcttcagcttcccgaaggcgatctgcggcctctcgccggtcagattctcgcctccgttcctctacggcccccggatcttcggcctcggactggccggacttgggatggcgggaggaacgtgacgggacatcgctgaagcaaaagaaaaaaccagaagacaagcaagataggtaagagaaaacttgcttttgggataaaagaaaggcggtcgcaatgagagtgggacgaacctgcgagggggtcggttaaatgaccaccttggaggggaaatcaggtttccccgggatggttccgtctcccccatcttgcggagccgtttcttcttgcgctccccctcgggctgcgatgtcggcgcggccccctccgggtgccgactgctggcacgcaccgccccgccccctcggggaggagatgggggaggtgttcctcccagcttcctcttcccctgggcgtcggcagggcggctgctccccgagcccccgacgcggggcccagaagcacgaccccctcctggggtagattgttccccccggcggctctcgcccgcgccgtcgtggcccttaggagtttcttcctctgaggccccgacccccatcataatggtcagaatggaggcgcggtcgggatcgctgcagagggggaggataccttgaggaatgagagacgtctccacggagctgagattcagcaccctttggaccacgatcttgaagtcctcgggagcccaatcccatctgactccctggtgggtccgcatgtagtcttcggacccggtgtactcccaggcgccccgggcgcgccgttggagcggcgcaatccggcgacggaggtagtcgccgtacaccatggcccctgtgagcccttgggatcgcaggcccgccaggcggtcgaggacggcgtcatagtcatcccccagatctaccggcgcccgccagctggagacctgcgccgggggctgacttggaagtcggaggcgcgcttcgttggcgaggggggtgtagaaccagtcgctcttccagtcgtcccacttcttgcggagggcgcaggggatgtagcggttcaacaccggcccccgcggctggaagtagcagccaccaaccaccgacggcggcgacaccgactgcacggtgaagaaccaccggaacagccgaagagatgggcgcaccccaatgaacatctcgcacaggtgcgtgaagatggccaatgtcatcactgcattaggggtgaggtgcgccatctggagatcgtagaaatccagaacatccataaagaaagaagaaaatggcggaaccagccctgccattgcgaaggggaggaaaaagacggaccgccccgggtagtctggtgccgggcgtccctcgcccagcatcactatctcccggccggtggcagattccggcataaagcggcgcggcagcccggcatgcctctcgctcacgatgcgagaaggcggaagtacgcttccgtcgagcagagcggaaccccgagccatggcgccggaggaagggatgattgagagcgagcgcgtgtggcgaaggtagggcgcagcagagaaagagttagggctcaagcggcgaaggcaagaggaataatggcgaaaggaagggagcaaaacttttcctcggtatttttatacccttgccatagctgggcccggctcctcgtttctcgcgcccactatctcgctccctcgtttctcactatctcgctccctcgtttctcgtgcccacgcttccactaatcccattcgcccgcttgcggcgcatgaggtggatatgcgattgtggcagtcgagataggtcgtatcgtgcgcgcattaattacgctcgccggccgaagcgacgttaccatatctccaggcgaagcaaatcagctcacccagattcgtgcgctgcttaggtgatgtggcagtcttaaagagaccgcccattatgaacagccaagttaccattaccgatgtgcatggtttgagaccgttgggtttctgcgcaaccatgaaaaccggtcccacctgtcaccaggctttaggagtggcgttacgcccgatcgcttcccttgagaagggcgatcgccctggcataacgccggggactactgtcggtgatatgggaccgggagtatcgtgaccagaggcttgaggcagacacaatcgcccacgtggcctggcaccttcggggacgtcgggcccgagggtgaggtgtccgcccttctcctgatttccccgaggggggtcgggtgactcctgccccggccccgagggccgaggcgccccgaccccttgtggagttagcgccacatgaatgggttgggtgaacacggtgagcctcacctaaccgcatttattgcggtctggtcgaacgtgtcacgctgcatgaagcacagtgcagcgcgttcctttatccggtctgtgaccggtcacagaccggtcagatcacgggttaggtggcgactggtggtctgacgcacgccttgccccatcccgtcaagacgaaagcctctaggcactcgtctcaagccggagctagcgtgtaatctcttagagatggcacgttagccctggttagatttataccaggcttcatctcaaccattacagcctatatgttgtatgaagaagggtgaacatgcagattgttgaactgacgcgtggaggacaagaatgaccagtctgacactggtcatgtcgtcggcagacagtcacgttcccacgacgcgcctgtcttcggcagaagtggatgtaggtgtgtgccgtcccgtcagaaggatgttcggaggacaaccgtgcaaatctccgtccatttatgaagagaagaaaagtccagtttggaaagagaggggtgcatgtggtatccccttgaagtataaaaggaggaccttgcccatagggaaagggggatgatcttttccagattcggaacttagaacaagtaagaggttggctcacactttgtagctccctcatacacagatccaccaaaacacaggagtagggtattacgcttcttagcggcccgaacctgtatacatcgcccgtgtctcgcgtttcttcctagctggcgatcttttcacatactgagagagcttgagacttcaccctaagcccccggccgaaccggcaaaggggggcctgcgcggtctcccggtgaggagccacgagctccgtcagctatctattaaaagtaaataaaagaacagtacgaccgtatggtttgtctagttaaccctgcggcttacaacaggtataacagcagactataaaccagctataagcgcatatcgagaagataaaagaagagaaataagaacagtgggttataaatctatagccaaccgtaccacagactctaagacacaatttgtgtatgataggtgggaccatgtattaatagtgtagtatatatttatagataactattatatgaattgtgattatagttgatttgaagctagtagtcggctacttgctcttagagcaagtacaatagcaaggtataagctagctataatacatatcgagaagaaaagggaagagagaaagcgggctacagatttatagccagctataacacggattataagacgttgtgtgtgtatgagaagtgagaccaggtattaatagtgtactatatttttataggtaactattatataaatgggctgttagattatctatagatgatttggagttaacatttagttatactactacctccgtcctaaaatatagctatttctagcatagtgtcttgtcccaaaatgaagctagtttttcacctatctcaatctctcaaccaatcacaactattgttcttcacttaccttttcttttcgaccaatcacatacgttttccaatcattcttatctacttttttaatacccatatcaaacttaaaaatggctatatattttaggacgcaggaagtattaaacttgctcttacatggaattattagcgtggtcgtttcgcgtgaactccacccgcagacgcagacaatctccgccagcgccaaagccggacatgccgacgtggcgagcaatgtggggcccaccatctgactcatcccccctaaacccccccacggcccaccgcctctcctcctcctccttcctcgatctctccctccctccctccgctcccaatcatggctaccgccaccgccgcctcccgcctcgcggtggccggcgctgaacccgctcgcgcccggcgccaccgcccgacgacggtggcagtctgcgggggcgcgaggccgaggtcgcgccccgcggccgtcgttgccgccgccggcgccgccgctccctctccggccaccggcggcgtcgcgccggttccgccaagccccaggggctcgtaagatccgtacctgctcgaaaattatttttgttggtccggtttgatttgggtttctgggcgttaaggactacggaaatgggagctcccctccattttgatggaactctcgtcgtatccgggttgacctgatagtgtatagatagaactgatcctatcttttatttctccccgtctcgtgtcgccgtatcggatcgattatggtgttaggggtgtggaattcggggatttagcattccgttgtgaaatctgaaatggttcgttctgagcagtcatttctgtagcgcctgagcataattgaccagaattacaatcatttttcaaatcaagcattcattattgggtgtttgtgacatgcttgtttgcatttgttgcccacaaagcctgtaaagtgacttacgtcggagtccagaatattagctgctgaatggcaattctcgtaagatgatttagttgcacagaacatttgttatttgtttggtccatgtcaatgaaaattgtataacagtatctttcagttatgcaaccccttttttcttctgaagactagttgtgttaacaaagggaccaactttcaagatgtgtataatatgctttttctgttaaggttgatttagacaactaagaagctttccatatttatgtatgtatatgatgaattgatgaccatgtaggcctttgaaccagagtctagcacaactcctctttaacatttctatgatgatttcttcaacatcaaacggcaacaatagtttctcaagcaaccttttaatatacctctttgcatatgtatacctaaagagatcaccaattgttatacatttctattgaagattgcaatcaacacagttttgtcgtcctttcatgttttttaggacttccttttaagttataaataatagcatctgccatatagaaatgttaaagatgcctgtattagttccattttgatctatatttttttctatgtttatcttgtaggattataaagcgtcatacactatcagtttttgttggagatgaaagtgggatgattaatcgaattgctggagtttttgctagaagaggatacaacattgagtcattggcagttgggctgaacaaggacaaggcattatttacaatagtagtatctggaactgagaaaatactgaaacaggttgtagagcaactaaacaaacttgttaatgttatacaggtcagtattttcctccttatcatatgaattctaagatgtttgctgattaatagtagcaagagtgactgtactaactcgttcattctttccaatatatctgatattcatagcctaatgtgaatgcaactaggttgacgatctgtcgaaggaaccacaagttgaaagagagctaatgcttataaaactaaatgttgagccagataagcgaccggaggtatgactgcacaaccttatgagaaaaccatctggggatttatatttgtgctgtgtttttgattttacaactttcataatgtctggatttttttactctatctgcattttctggatttaccttaaaaaggagcactgaatactgattactgagttggtgcaaaatttaaagaattaagtggataatggacgaaacatttgcacatttacaaattacaaatgtcaactggatttgcaaagctgcaaatctacatgctaaaccttgtttatttatttatttgtttatctgcttttacatgtaggtgatgggtttggttgacatcttcagagcaaaggtggttgacctttctgaccacacactaactattgaggtaatcctatgtttatcttaccttgcagatcacatcgaccataattcttgtggtttttatgaaagaaaaaaaatcttctttttttttttcatgttgaaggtaactggagatcctggaaaaattgttgctgtacagaggaacctaagcaaatttggaatcaaagaaattgccagaactggcaaggttaaacttctccagaaagaggctagaaaaatatgctcttttcatctctctatttttatgtaataaaacttattaatgcaacagatagctttgcggcgtgagaaaatgggagaaagtgctcctttttggcggttctctgcagcttcctatcctgatcttgaagtggcaatgccatcaaaatctcatgtcaacactgcgatgaaaacagctaaccagaattctgaagaatcttcacaagtatgacacatcaattatcctcgttcatgtgaactcagccatgatctctctttaatttcttcagaattgtaataatatattttatacatatattactctatggtgttgttctaactttcccatgcatgctaaactgtcgaacactcataatatcttcaatatttttctttccaatcaagttgtagtttttattttttcaaattgatcttattaatgctctcctgctgctcattccatgaagtttgatactataaaccattttattctttgcaatatattactatcattatgtgttaaggctgagtttagttcggcccaaagtttggaatttggttgaaattggagacgatgtgactgaaaagttgtgtgtgtatgaaaggtttgatgtgatggaaagttggaagtttggaaaaaaactttggaactaaacagggccttattcccgtgcattcattctttttttattttgggaatcatttatgcatccaggactggatgcattatttaatttgttgttcctgactaatgtcagcattgtattgaacaatattaccttaattagaaatatttaaaagtgttatctatcttagcataactacacggtaggctgatatttcagaattgtaaaactgagtatcgctgtttagaaaatgatcatgggtactgtgttgcatgcactaatatgggttgttatcattaccaggatgttcatttggattttgactattttatatgtgattatcttcttactcctagggtgatgtctatccagtggagtcatatgaaaacttcacaacaaatcaaattcttgatgctcattggggtgtcatggctgacggtgatgtaagttcttgtgttctgaattgtttggttgcagctaccctcacctccatctagttctgcacttctacactgaattatgtatttattttgactgacttgtaatactgaatttagtgtataccctcgaactaagctagcataattttgctgcttcagccaacagggctttgttcacattctttgtccattttggtgaatgatttccctggagttctcaatgttgtaacaggtgttttctcccgaagaggctacaatattcaggttcatttccccttgtatattttatgttgtctcacttagacaactgcaggtttctaggttccactgaatgctaaataatttcatcacttgacagagtctggctgttggcccagctgaaaaagaaggcacttctcggatcactactgttgtccctggaactgatgagtctattgccaagctagtacaccaactgtataagctcattgatgtttatgaggtaaatcctattcactttgtggtttgcatggttattgatgctgatgtaaacttagctcaaattttgtttgaattttcaggtccaggatcttactcatttaccatttgctgctagagagttaatgatcataaagattgctgtaaacaccacagcccgcagggctatcctagatattgctgatattttccgggccaaaactgtggatgtatcagatcacaccgtaactcttcaggtaatagtcatgggctatttttacatacacccacctcattggcccttatatcttactgatctttgaaactattataattatcagcttgatgtaagatattgagatagactagagaaaatctctctagtgtagctttcaattagctgatgctaatttcaatatagatccttgaacataagctatcattttttcttgaaatatatatggcgggagcctctcccgcagttttgattcagtaaagaaaatcaatataggtcaaatagagacaatgctattaggaaatgatgtaatttgttgatttggattgatttgaacattatgaatttatgcttttttacaccaatgaacaatatacctgatgactgaatcatctcctttagtatttgcatgaagtagttttgagggcaatgtatccattctggcaccaattgcttttctgtcaaatatttttccttaatagtttgcttgcatgcaacaattgttttaccattcagaaaacttttaagtttacggatgatctcaatttctgaatgtcatgaattttatattttttgcacattagtgaacaacataatctcctttttagtagtttttatgaactagtttcaagagccaactaatcatattggcaccaatttgttgtgttatatatttttccttaataatttgcttggcgaacaacattgttttggcatgcagcttactggagaccttgataaaatggtcgcattacaaaggatgctcgagccctatggcatttgtgaggtttgtattgagcttatcactttgcatcttgcaccatgtttttcaaccaacagtagtgaatccaacgtaaatcatagttcagatggttgcaatatattgctcttgatcctcctctttgcaggttgcacgaactggcagggttgcgttgcgccgtgagtcaggagtcgattccaaatacctccgtgggttttcccttcctctgtagtttgtttgtcagttggcaaagaggtcatccccatcttgtcatttcgattcaattttgttctcttctgttagaatcacaatcttgaagtgatagaatcattcgaaagcaatacaataagaaaatagtggtcacagtttgtgtcagttgtattagaaaagattcaataaaagtatttgagttggctcaaaattgttgtatctgaccattaaagctgtttatttttctagttcttatattgcatagtttctggctttctgcgtatttgggtgaatccgtgtatggaattgttcattagggtgttttcaagggtgaatttcatcgtttcgtataagttttttttttaaaaaaatacatgtattttggttgaatgaataggatgagatgatttggatacaattttttttaatactcctgagatctcgcatcgttccatacactaaaaaaaatgtgcatcacagtgtcccggatggctcgcaacagagcttatgtaatagctcagcatctgctttggtctatcagcaactttacgagatttttgcagtattatttagagtatttactccacgtctctagaactacgttttcttaaaagaaacattgttttgttgtattgtttagaacttattttaatctatctgttaaatttatttattaaaatatttaattcatcgttataatcaaggaggcaatgcgtggcaaataatatgatcgaattattagtggtgttgtgatcgagtcctttcagaatttaaatcacggcgcaaaaaaattacgcacaagcaagtgagcttctagcagaaatttagtaagatcaggagtgtgtatcattggttttcgtctctttaagcgtgtgttcaaaagagtatttacagatacgtgagtatggtgttacgtgtatagtggtgtatatctatcatgtactttatgaaaaatataccatgaataacctgttttgcatggaaaagggaggtgtatatggatgtttgaaacagaaaagagaaggacgatttttttgcctcccacccaaacacccccatagtgtacagagagcagatggacttcaataccagagcaagcaattggccaccatggttcatgggtttcacctaacagaaagtagcaacaagggacaacccacccataccgacataggaggatttactactggcaaaagaccgtctcgtgaaaacgccacaggtgcgcaacgaggagcatagggaggaaagcgaactggaggaagagacgggggaagccacgtcatttgatggaaatggaaggtccaagcagcccattcattcttggaataaggggagggagcctatcttctacaaatactccctccgtttcgaaatatttgacaccgttgactttttagcacatgtttgactgttcgtcttattcaaaaactcttgtgaaatatgtaaaattatatgcctacataaaaatatatttaataatgaatcaaatgataggaaaagaattaataattacttaatttttttaaataagacgaacgatcaaacatgtgctaaaaaatcaacggcgtcaaacatttcgaaacggagggagtaacaaattttatagctgaaacttttagacatcaagtggccagcatggcatcgttgaaacttttcggatagtgaaaaccaagtcctctttttccattaaagaaacaaataaacaactttaaacggttgtgtgttgattttcttttgaacacatacttgaatggctccttgctacctcataagagttcaaaaaaaatgacaagcagtcctctgaggttttctcaggttttgcctatataatctggttcaagtttttctggtctatctacccttaagtggtattaccaaccattccggaggagcagttgatttagcaaattttagtattcatctattagatgtttcatcaaattggttctatcaattttatacaactatcttcaacatgtgtggacctagaatgactatgcatagtgacatcatgcctgtatctaccaatttcgctatggtggttaagttgaaataacatgtttattaaaaaataaagttattttctcgtgatttgtttagattggaagagacattagaaaattcattacaatagttggctttgatcgattgcttggtgttacgctatttactactttgattagctaaattcatttatgacaccaattaatttacagctgatccattcataatatcgtttagaagcaaaggcttactattgtactatccatacaagtaacttggtcaagtcaaaagaagtttgttgactactactaaatgagtgcacgaagaaaggaaggtaaagcagggacaatagtatatggtaagtagctttgcattgttctatatgtagaatacctattagtttttcacaaaatagtactatatgtggatggtacataggtatgatgaaagagggctagctctgtttgaataatagttaccagttaagataagactactaaataatctgctacttcgtttccaacggttacaaacatacaaagaagagataactctttcacaagcgattgtgggcattcctagaatatgagactagtgccttacttggggttcttcttgaaataaaacaaatgcccattcaatcggaattagaagtaatactcatctttcctgagattccaaatcccaacatatgaacggggggtgcaggaa

SEQ ID NO: 33674 - DNA, 19097 bp, Oryza sativa
tatactctaaatgtttattatatttatactatgtattaaggtgcttaattaaatagagatatttttattgccgtacttcagattttatttgcctaattacctttttaaaattttattagatcatgccatactacttattattatatagttagttatagatgaacatagttcctttcttacaagaaaatataaaaagtgaagtgcacaactagttgtagtatactatattaaatgataaaaatagaatttttgatttattgttttagaaaaatattagctacatctcttcgttggtttgagaagttcaatttaaaagtttttatgttccaataaatatacattaccttattcgctccgttttcgcatttaataataatcgattccatagtcatatctggggtttctgaaaacgaaaacgatgaacatggtttccgttcgtttccgaagctaggtttctcgttcagcgaatttggctgcgcatgttgtagcgaaggagtgttactccaggaaatgcattacgaccattatgacctggttgttagtgcgtcggtgcgtccgattttacttaggtctttttttttattttttttattctttcagagaagggtattttttattctgcctctatattcaattagatatatgtagcatttttaaattaggaacttagcctatcaaataggggacttatagcacttaaataacccaatctgaaataattcgctcctatggagatttgaactcaggaccatagggaatttatagcacttaaataacccaatctgaaataattcgttcctatggagatttaaactcaggaccttggttgctactcaggtcactgcaaccagtagaatacgtgccctttcacatattactacgaggattttatccagcagaatcggattgtgtaatgtggctttaggcctgctctcaaaaaaataaaaaaaaactgggacttgctagttcgcgcatacgcgctgctacagtaactcgcgcgcactaccctatcacgccgcgctcccatcactaaacatgatgattagtgttaattacggtaattagagttaattacgccctacagtaattcgagaaagttgatcggtgcgcgcaacgacggagtggttagggattgttttgttgcggttttcttttttcttttcgggagttttttcgtgagacgcgtaactaatccgtttagttttagataatgatgataattaacgtaagatttgtagctttgtcttatttaaaagattttttaaagtaacagattgaaaataaatcgtgaaatcaaattttgaaaactttcaacccaaatttgaaaactttcaactcgaaatttcaatttgtttaaagtcaaaatttgaaaacttccaacttttcatctcaaatttgaaaaactttcaactcaaatttaaaactttcaatccagatgtgaaaactttcaaccgagatttgaaaactttcaacgcgaaatttaaatttgtttaaagtcaaaatttgaaaactttcaacttttcatctcaaatttaaaaaactttcaactcaaatttaaaactttcaacccaaatttgaaaactttcaactcgaaatttaaatttgtttaaagtcaaaatttgaaaactttcaacttttcatctcaaatttaaaaactttcaactcaaatttaaaactttcaatctagatttgaaaacttttaagtaaagatttgatatctttcatgtcaaaattaaaaactttcaattctacatttgtaaaaaggtgtgtgaaagattgaaaaaaaatatgaaagaaacggcgaaagaaaagaaaaacgcgcgcggcaaaatcagaaaaaaaaatgcaaacagaaaaaagggaaataacctttacgtagaaaaaaaaatataatggtcaccgtaattcagatcgtgatcatgattacgctaattaatttgatcctatctgctgcccatacgaacgtatacgtgtccccaccttccacactgtgaagctgcgttatcatgtggtgggctggtcccaaaccgcgcgccagcgaacatcatgtggtgggctgggcccaaaccgcgcgcgacttcgttcgctggcgcagacgcgcgcaataggaaattcgaaaaaactaacttttttaagtcaacattactgtaatgtacataagacgaaaagacccttgaataaaatacaggaaagtgtaataagtatgatcctcgaataaaatacacgatgtagtaagtacagaaaaatatactagctagactgatgtcacgagcaaataaactgtgtatattgacaagttggtgcatacacgaccagtttaattgtttcaaattctagtcgtaccgacgttgcaccaaaatcccaatgcatattgacgaacccgtaaaccctaaactatagataaataagaaatcatagctagatatatctactttgttccaaaacaacccaaaaagtacttgcgaaacgcctccttgtggctctgccgggtgccaccgctcttgcatggctcatcgtcattgtcgacgctgcatttgcagatcatcatcaggccatccaggtcatccggcccgagctccatcgacatcgtcgccgccgccgcggcctcctcgacgacggcgacgtcgcagtggatggcgaactcgtcgtcggtgctgaaccactgccccgctaggacgtcgtggcggatgaacgtgaagcagcggtactccgccttcccggtgccgtggaacgacgtcgcgtagctcctcacctcgttcgtcggaggcacgcacggctgcagattgaccatacggaaccggacgttggttcggatgccgccagcggcggcggcggtgccggagtcggcggtgtggagcttgaggcacacggtggagtagccgttgcccgaatatttgctcgcgttgaggtggaagaagaagctccaggtgtgaccggcgacctggaacttggacgactcgatgtcgtatttgctgccttggtgagatttcttgatcgcgttgcggaccttgatcttgagaaggttgcaaccggtggcggccaccgacgtagaggtggccgtcgacgcggtgacgacgtccttcgtcggcgacgatgacatggcaagctaactagcagctacctggtggtggtggtggtggtggtcgacggcgagatcaatcggggacgaagaactcgatgcagggttaacattggttaaatagattaggagaggtaattaaccacacgtttgacggacggacgcgcggctataatccgtatatagttttgttccgatcatgcatatagcatagaagaaaagccagggtaaatatgtctcgttctcaaaaagaaattataagtttgtccttattaacttcgaattcgataaagcagctgttactgggatacatacggatcagttaatattatgcaacacaagttaccacagctattaggttagttaattattaaaaaatataggtcagttaattttagtttggttcagatcggatacaaacagttacgtcaacagacaggaaagtatcaggttgttacggtagataggaatagttttcatctacatttaatttcaaaaattactttatcatttactcttatatatattctaactcaattcaattaaatctattatttacagtagtccctatttaattcaacatcgtaagagagtactaaacactgatatataaaaaaaacattttcacagacaaatcaaaatctagtattcacagcaatatctcttctacctaattcaacacggtacaatagtaatactcactattagaaaacatatgttgcaaacgggcaaaatagattttttcaggttgtcatccaccctgcctgtacataaaggcttgtgaaaatgcacggattttacaggcagccattggctccacctgcgaaattgattttcgcagccagcctttccatctttgcaagcggtacagtcgaaaccgctaaaaaaagatcagttgcatgcctcccctcccacacggcgcggccacgtggcacgcgcagagggggggggggacggtggaatggcgtgggagcgtcacgtgcggcgcattttcttggttctttttcggttttttcttttcgtttttttgtttttcccttgattttttttggtttttaacttatacgtatataaattttgtattcatacgtatacaaagtttgtatacgtacgaatacaaagtttgtatacatggtgttttctgtgtttttctttacttttcggtttattaaatatgtttgtatttacgtatataatgtttatatacgacatatacaatatgtcgtatataaatttagtatatgtcatatataaattttgcatatgcacatatgtttttatacatataaaatatatacttttttatagtagtagtatattagtagcagtagtgtagtagtaagtactactagtagtagcctagtaggtgaccgagtaggcggctgggccacgcattatcagtcccccggttcaatcacccgcctgcgaaaatatactccatgaacaaataaaagaaaaatcccccgccacccctcccacccccacctactgttgaccctccttttatgcccgcgccactgccgtcgccgtagcctgctgcccggcaccactctgccatcacctattgtggaaggagagggaagggaggggaaccagatcttggaggtaggagggtcgcaccggtcgccgccaccatcgctcctcttctctgaccggatctaggagcaggaagggagggaggggaggggagcgccgcctacgcgccaccactgtcactccctccaagacgcctccatcgccgcttgcggtggccgtcgctccccctcctccggccggatctaggagctgggagggatctaggagctgggaggaagggaggggagcatcgtctctgtcgcctccacgctgctaccactgctggcatcctctgctgccctggtttgaagtgggagggagggaggggagccgcctgctgagaagggtggtgggtgaggtgagggagagggaaggagagctgggaggggagagaacttgcggaaattactggggcttggtaggtggtgatgtttacgaggtataagcttttcgtaggtggaacatattaaggtcttgcctatgaaaattgattttcacaggcatggccttaagaggtctacctgtgaaaattaaggatatttttgtaggtggagctcttttgaccatgcgatttaaacaggcaggactagatttggtatctttaactatttttacaaatggtgattttatagtttgtctggaaaaataaatcgtaaccttgggaaaaaatgtttttctactggtgagtgatacagaaaacattcgcatagacagtcagtaactctgacgaacgttttgtaaaccgcctgcagctcaaggcaggtaaaagtcggttatttatacagatggattctgtaattggccacgaaaatgcaaaaattagctatttttatactaatggataatatatatttttacttcaatgtgcgacaaaaaatatttcacagcttgtattggaacacaattgtccaaagttgtccccgggcaaatctcgtctgataactcatcctccgtgattcgacaatgttggctcggtgttacctttctcaacgattgtcacgatcttgtaagtcttccactgctgcagaaaccatctttggtcgattggccaaattctacaatagtcccggttctattaaaaaccgggactaaaaacgatttttagtcccgggttataagagcaacgggactatttgatctttagtcccggttagtaacagtcccagttcacattgtgtcagggattgtcaggctccccggatctttattccagttggtgttactaatcgggactaaagatctcgtggatcttttcgcccggtttgtaacaccaaccgggactaaagttagcttcctttatatatgtctttttcctcctccagcccgagccaagcttcaaaattttttcttgaggagggaaggtgctgccaaaatttattgtgaatttattttgatgattatatacaaattggatatgtctaaaaggttagcaacttcatcctccaaagttttttttatcatattacatttagatatttgttttgtatatattactgcctgtaaaactttgatggaagttgatgagggagaaaatttgtgtagggagggaagaatatagaaattttgtttatttacaattttataaaaagtttttataaaagagttgagaaggaaaaaatattaaaaattatttaaagaatagaaaactaactaaattgaaaattaaaataagtacaacacattaaaataagaacaaacaacctcccgttaccttgcccccatcaggccggacatcacgttccccattaattgcgatcgaggaggaagcaagacggtgatggcagcggctccgatcgaggggaggattgtttcacgacgtttatctctccactctttttttttgacaattatacccttgtacttttttttactattatatccttgcacttttttttaagaattacgcagtacaacgcagatatttacaacgcacgcgcactcacccctataaacacacacacacaaatcctttccctatcagcatctttgaaaactgagccggcaaatccttgagatgcactcacccctataaacgcacgtatccaaatcctccaattatgacgactgttcacaggatgacaactgtttataccaaaccttgtatctgtcataatcatcgtcacactatactctgcatgggctctatgacgatagcacgatgacaatagtggatcgtcataaaatatagaactattatatttttagaaacaaaaaaaatattgttatactacattgctaccagaccacaaattgtttgttctaggtggactcttcttgtctacagcatttcttgtctcttattttaggatttaggattgaagtcatctctactctcattttatgaatgaaaaaaaatcaaaattatggcgtttcattttatgatggctaaaatggctataaattggtctaaattattctttgaaattttccatgaatcttcggagcacaataactaattttaataccataaagtttatttaacttattaaaataaatagaaaacaaattaaaattcctctctatgtctttgggccttttatggcccaagtattactctctccctcccacagtctgcagcctctctctcccttctcctccctttctgggccgccggcccagcccttttcctcctactttgccgacaagtccattttacctcactcctctcaattcaaataacttttcacgtagtaaatgatttcaaatgaaaaacttgtcaacaacaaagttgtataacttatcaagatctacaacttttgtttcagtcatttttctatatgactttgtttcaataatttgaatttgaattccaaattatgacaacttcaaacactattttcaaatagtaaatgatttcaaatgaaaaagtcattcacaacaaagttgtataagtcatcaatatctataacttttactttggtcatttttctatgtgactttgtttcaataatttgaatttgaatttcaaattataacaacttcaaacaacgttttcaaatattgaatgatttcaattgaaaatgtcatcaacaacaaagttgtataactcatcaatatctataacttttattttggtcatttttttatctgccaaagtgatagtaacatttttcacgaaatttagatatctctcttacagtttataaaaccatataagagatatgtaaattttgtgaataatgttactatcactctgtcggatgaagaaatgacaaaagtaaaagttatagatattgatgagttatacaactttgttgttgatgactttttcagttgaagtcgttcaataacaaaaagttctatttgaagttatcaaactttgaatttcaaatttcaaattgttcaaatagagtcagatggagaaatgaccaaaataaaaatttgcatctcaatgatctgtacaactttggttttggtgacttttccattcgaaatcatttattaaccccaatttttgttcgaagttgtcaaattttgaaaattcaaaatttgaattgttcaaatgaacttatatgtaaaaaggaccaatacaacagttgtagatctcgatgagttctacaattttgctgtttatgttttttgcatttgaaacataaaaatcagtctaaaattaaatttaaagttctcataagtttaaggtgaaatgtccattttgtccataaaatttcgtaactaccctcacaccagggacagtttggtaaattcgcataggattgcttcttatccatatactctgttctctaaaccctagccaaactccatccatccactcagccgccgccaccatctactcactctcctcctccatccactgcgccacctgcatctccttccctagccacctcttcgcccttccccgcctcactcccccacccagggaaggacggtggcgtgcaaatctgccacctcccatcctcaggagcgacggcggcgcatgaatccagcggcctccgtcctcgggagcggcctggcgtgagcgggagcgccggtagcacgcagatccgcccgcctccgccctccggagcagtggcggagggcttaggaaggcgggagcgagcggctacggtggcggcggctgcggcaacgacggcgatggtggctgcaacgacgacgacgacggcgacagctgcgacggtagctgcgatgacgacgatgatgatgaccagcggcggccggcgacttgcaatcgcgaggcgggcaggtggcgtggggccgcgggggcgcgccggcgcggggcaggggtgcatggcaacgggccagcgacacgtcggcgcctcggcacaggagctgtacgccgtcgcggcggccagcgagtcggcgaccagcactggaccagcaatggttgcgccggaatgccaaccaaaggtccagctccaagcgtcgttcactcatctgtccatgtgcacggctgacggctggtatattcagtgagtatttctaggatctctctctggtttggtttttctctttgcagagtgagattatttgaaaagttgaaacctagaatgagtaaactcagttcagttcaaggcatatttttgtgatttgtatgcagagaattgagatcctgtgtctttacttcatggttcaattagcaatgtgtaaaaatgaagcgctataattaggaatgattaattatattgttgtgaacaagttttttatttgattcaactatactatgacatgtgggcacacccatgacaaaaatctgacccttgttttctgctaaattcgaatgcgctgttaagtttaagtacactgggtttgtttgcttagcttgttcttctgatcgtatagtcactagaacaggtgctttactggtacaggtggacctaattacttttatgataattcatgagtgaattggaggcatcgcacaactcaaattgacttgaggatcataactcaaattgacttgagattcatagcttggacaagtgagcaatccatccaaggaaattaactaactgaaccaaagggtgaaatttgatggcaccgcttcttttgggctttctgttttgcaatgggcttcctgataagttctttcaagaaaaatgcatggttaactaattatagttatgaagatgtttatgcctgcccaaccgatcagagctgttgtttactgctttgatctctactatgtaccaaacttatcacatgcattcttcttgaaaacaaacaccttttttttgttaatgttaggtgtggtagtattaatctgaactcagtttaatccaagtatatagatcatgatatctctaaggaagaaattttttctagcttttttttgttaatattaggtgtggtagcattaatctgaactcagtttaattaatccaagtatatagatcatgatatctccaaggaagaaattttttctagcttggatcctttagtgcagtcagtagaagaagtaggaagggaagctactgctgcatctccacctcagtctgtagttcataaagctgaaaatgtcactggtaaaagggaagcatcacctcctgagaagaaaggtcatggctagcatctctctgactccttctgtaatccaatataatgtctgtcacagaaatatccctttaagaatgtaaataagatgtgagatttttactaaattgcctattaacttgctcaaagagtacatgttccttaaaatcatgttccttaaaaccctactcaactaacatatttgcctagcaaaaccggttactagtcagaagcttctgcaactctaatgcaatgttgtgatcctttcttctgatcctttcttcatctgtgttgcagaatgtgactacaggaatgagggcctcgggactgcaagatcaggtggcgctagtgagcatcggcgggtggagccctaaccagggcgtgccgcagccggccatcatcctcaacccttccttctcgcgccacagacggggcctttgccctgggcggccatattgggcggcggcaatgggattgagcaaccgcactttaagtacagaactggagccaatggaattgagcactactgaacaaggcaagtaacttggattcttgttcttttgtccttatatgtgctatgcttcattcatatcaagtgcaggatctttttattgacacctgtaaatgttttatgttaggcaccctcactggcagtagacaagtggagccaagggggaagaccatgggcactgcaattgacagtgagcccactgcaattgatctctttaaggagttgcattgcagcaaaactaaatgttttagtgaacctgtgaagaaagctatagtaagtactaaactattacttcttctttccttcttttattaagtaccttatgcaatgaacctttatttatataataatgcaaaactgaaaccttgctttgattgataggaggatatgcatgcccgggaagtcctcacttcaccatcagtagaagatgggcagccagctaagacttctattgaagctgtttccaaagtgctgcggaagtcgaacacatttttgcgcaacgtcggaatttagcagctcgctgccaagacaaccaatgtgatgaaagagatacaagttgaactagatgcaaagaagctagagtctgcagtacttcaggaggagcttgaaagattgaaggcacaggtacttgtgtagttggatggtggatggatcattttgtattcatgttttgtgcttttgtatggaacatgttggaaactctattctggaacttgcttttgtatgggctggaaaattaattatgactggaatgtgattataatataattatgcaactggctgtgatttatattctgtgattgctttttaattgggctggcccataatatgggctagaattgtactgttgagctataatgaaaaaaaaaacgtaaaagcaaatttgtagctgggtcaaaaaaaaatatttgggccaattgtaattgaaaataaaaaagcccatgctatatgggccgaatgtgaattgccacgtcatttgccatatcacccgccttgtcatctgcaacatcacatgtcatcgtacacgtggcgttattcagttcaatttgttatgacgaatttgtctcgtcattcatcaatgacaggagaactatcgtcactgcatcaatgacgatgtcctctggtggtcacagaagctggttagtgacccaccttctgtgatgataaccatttcgtcactgtgggcagtcagtgacaggaaacaagctgttatcgtcataatgtaatcgtcacagaagcccaaaattcctgtagtggccgttgcccgaataattgctcgcgttgaggtggaagaagaagctccaggtgtgacctgcggcctggaacttggacgactcgatgtcgtatttgctgccgtggtgagatttcttgatcgcgttgcgtactttgatcttgagaaggttgcaaccggtggcggccgccgacgtagtggtggccgtcgacgcggtgacgacgtccttcgtcggcgatgacgacatggcaagctagctagcagctacctggtggtggcgctggtggtcgacggcgagatcgatcggggacgaagaactcggtgcagggttaacgttggttaaatagattaggagaggtaattaaccacacgtttgacgtacgcgcggctatatgtctctatccgtatagtagtttgattcggatagcatagaagaaaagccgggtaaatataattatctctcgttctaaaaaaaacaattataagtgtgtcattatcaacttcgaattcgataaagcagctattactgggatatatacgtacggatcagttcatatgcaacacaagttactacagctattaggtcagttaattttagtttggtcccgatcggatgcaaaccgttacaaacagttacgtttagagacgggacaatatcaggttgttacggtagataggaatagttttaatctctatctctatctcgtccataatccatgtttgagtcggttataaaaattaaatatgtttccgcggttcgttatccgtgtttgagtcggttttaattttatattttggttttaatctatatatcctctctatctctatctcttatcataaaaattaaaaatgtttttgctggtattttagtacgtcatccgtgtataagtcggtttttaagtttgtttgcttttggaaatacaaattgaagatgtttccgtgatttgtcatccgtatttgagtcgattttaattttatattttggttttaatctatatctcttctctatcgctatctctatcttttctccactattataaaaattgaagatgtttttgtcggtattttggtacgtcatccgtgtatgagtcggtttttaagttcgtttgcttttggaaatacatatccgtatttgagtcggtttttaatattgtgcacttttgataataaagaaggaatcatataaaaaatatgtttaaaaaactcgcatgctaacttcagacgatcgaactctgaactgcaactcatgattttctaaaaaaaatatatatatccaagcgaagtcccacagtaaatttcatcttaactaaaccatataataataataagattaaaatagacttcacccgttacaacgcatgggcatttttactagtatatatttaatttctaaaattaatttatcatttacccttatatagtatatatatatatcctaacccaattcaattaaatctaatatttacagtaatccctatataattcaacatcgcataagagcactaacagtgataccgaaagcatttccacagacaaatcaataaaattgaatcttaatattcactttaatatcccttcttcctatataattcaacatgctacaagagtagtattactcattactagaaaatagattgttgcaaacaggcaaaaaagatttatccagatgatcatccaccctgcctgcacgtgaaggcctacaaaaatacatgatttttacaggcggacatcagctctgcctgcgaaaatcattttcgcagacggtctctccatctttgctggtggtacccaactgtgaaaatatactccatgaaaaaaaaaggcccctgccaccccaccaacccccacccaccgtcaactgcgctcccctccgctccctttctacccggcgctactctaccattacctgctgtggagggagagggaagggaagggaatcgaatctgggaggtacgagggccgctctgctgccgcttgctgtggcgaccgcggctaccctccccccttgggtcggatctgggagggagggagagggaggggagcaccgccaccatcgctccctccgcgctgcctccaccgctgcatgcggtggctgctgccgccgccaccctctcacggccgctccggccgaatctgggagggaaggagggtactatgggaggggagcatcgccatcgtcgctccccttctctaaccaaatctcgcctcaactactaacaccacttgaattaaaagatcagagggttgcaaataggacatagaagctagaacctagatcataaacaatcacaagctaccgcatgcatagattggccaaataaaattaattactcaaataaatatgttaaaaagggtgaggaggcaaacgataaaattaattactcaaataaatatgttaaaaagggtgaggaggcaaacgattttagcgcggattttatatccagtaatcctacttctctgtttgagtagccccaaaaggataggtctgttccatccattttcctcgctatagcaacgccttattgctctgtgggttcaatcttaattccttcccctacggaggtgaaatcgaagcactcacaaacttatggtgagagctgtctgtcttgaattatctaggaggttctattcgacctgggagttatagcattagccccctatatccaggacgacaccatctctatccatagtatcaatttttggtgactctacaaaagtgtcccaatgtaacattaactactttttcgaaaataatgatgcaaacctttacaccatggtactaatattttgaaggaaaataagtgttacctataaagaaatcgataggagcaattccattaataaatgaaagaaatgtaactaaagacatgaaggatggttgagattaaactcaaaagagatccaatgactaatgttttctaggtgatgtctcaaactctcagtagaaattaatctttatacatacttccattttacaccatggtgtatcaaactaagttttacatgacattgccgcatcaagatgcatcatcaaactagtagaaatttccataaattccacaaaacctgaatgaaggtacttcaagaaaaatggtctaaattcttcccaagattttccttccaatcgtgcaacatgaaactagttgttttcatatacccaatgtaaattgaaatctattaacttattaaaggaatagaaaaaggagcctccacgttcgctctcatggccaaaaaattcccacattaatcggagaaaaagaaaagcagagtccatatagaaatacaatttagaaatagttgaaattcagaattaaaaataaggaatattggaagaggagactagtatccatatagaaatacaatttataaataactgacattcggaattaaaaaataaagaatattagaagaagagtatagagtccatatagaaatacaattaagaaataatagaaattcagaattaaaaataaggaatattagaactagagtatagagtccatattaaaaatacaattaagaaataatagaaattcagaattaaaaataaggaatattagagatagagtatagagttcgtataaaaatacaattaagaaataatagaaattcagaattaaaaataaggaatattagaagtagagtatagagtccatataggaatttaaaactaactaaaatttagaaaaaagcataataaaattaaaagtagagtttagagtccgtataaaaatataatttacaaatatttaaaattaggaatttaaacaaaacatgggaagaagagtataaagtcaatattggaatacaatttagaagtaactgaaattcgaaattaaaaattaaagaatattgaaagatgagtttagagtccacatagaaatacaattagaaattgttagaggtataccacgaagtgccttccgccgggcctgccgaaaccgaaaacttgggcgacaggctcggaccagaggcaagcgacgaaggtcaaagaggaatgacccaagggcgaaagactacagctcaggagtacacgtgcttcgccggacaaggaccccgtcaggaggccacacaggcggagtcggtgagacgaaagcctcagcccgaaggcataggtttcgccaaggcaccaaaccccaccgtgaggaagcccagcgggccgttgcgcccccgcagggggattctccagattaatgggccaagccatctagcccaattggggcccatacatgtaaaggacgttgtgtacccctaataatgtccctatcataagggtaaccatataaattcccctgtaaagcctaaaccctaggggagagaacctgtaataggattataaatagcccctctaggccatgtaatgggtggatctgaaaaaatttctaccaagtaatacaattgtcctttttcccaaccactgttgagagaaccacgcctctcggggcgtggcgcagttgtctattcaacaacagaaataatgaaaatttcagaattaaaaataaataatattagaagaagagactagagtacatatagaaatacaatttacagataacgaaaatttggaattaaaaaatattgaaagacgagtctagagtccatataggaatataatttacaaataactaaaagctgatattaaaaataattaataactaacacatatataaaatacaatacgaatattacacatttgtagtttcgtaaagttagtacaaaatttaaaattatgttgtcattttaatatatttgaataatacattaagaaaacatatatgctattatatgagagaaaatataatgattttgtactaaactaagtgcaaggtcacatgacgtaaagtctaatttacttttttccatatcccacgaagctttgtagccaaatgacttgatcgatttgtattgtagccaaatgaaccaattcctattagtatcattcggtttataaatataaaaataaattcttctttcctacacgttatagagagaacataggaaatgtttcattgactcaaaactcgtagaaaattcctaaagattgaagtgttcatacatttttattcctccattttttttctattcctattgtttaaaatttcttcaaaccgaaaaatcccttagtcttagtttgaaccagctgtttggcctggatttttgatggtacgcgaaataacttgttaatgtttgactaacgagggtaaaatgtatattgctaaagttttacaccgttgtgtgtgttgactcacactaacttgctaattaattagcattaattatacacaaccttcattcttccgaaacagctttattgcgcccatggttccaccatgttgcatgtgctagagtatatatgctagttgtaggaatattattacgataggattgatttgattagagtccttccttatctccatctctagtaccttccttatctctctacccatgtaatctctatatatactggcctacgaggttcaatacaaagtatccacgttacacattattcctctctttctatagtattcaacatggtatcagagcgggcgagttagcgctgcagctcaccgcttctgctacccttgcccccgagaccagcaatatcgctcccgggtgtggccacccgttccctttttcttttctttcgtcgttgtgcttgccacgagagagatcgatctcggtctcctccgacatgccacttcttgacgtcattatgagattatcgatctcgatcttcttggacgacatgtcttcgtcgttgcattgtcatcgtcgttcttcatcgagtcttcgtcaagcagcaagcagcacaccatcttccacctttggcaccactaacgaaccacgacctcagattggatataagggacgtgttgctagctgcccccttcatctcccgcctcgtcgtcacgggactgcgccgccactgtcaacgtcaccctcagccgaccaccaccaccttgactcctctgccggccatgctgacccctgcctctcctcagacaccatcgcaccgccggtcaccctttccccggagacctcatcaccgccggttgcctgactgccaccaccgcccaactgcttccgcttcaatgacgacgacgtcacctctacggccggggaccgccgtcgcccgagcgatccgtctacgcagctgctggggggacgaccgcgtcgagggccaaggccggtgtcgttggattccctctgccgcgttgctcccgacgacgcccccaattccaccagtctaggccgccggcaaccgggtcccctaggatggcgcccccgactccaccacgccatttcgatgtgggcctgctccatggcctccatggctggtcgccaccttcctcgccgatctccagacccttcgttggccgcctgacggcctggcgctccccactggcaccactgtcacaccctgaagttctcctcccaagcctaaattgaatttataattcacccaaagaaaatatcggtgtaaaagcaagagtaaaccctaataaatcaatgcaaataataatcggatttggcatatggaatttttcttgagttctacatgtcgaaatatgctaacaagacttttagtggaattttcagagctctagaaataattttaaccaattaaaaatgagcacaagcattatttattccctggaaattcctttttccttttctttttcctttttctccccctttttcccaaatgggccgccggcctatttcctccccctccctgcgctcttgctgggccgaccgaaggccacggcccagccgctcgcccgagctccccctctccccctcggacgctgacaggcggggcccgcctgtcaggcccatccccaacctccagtcgccgccaccgcgccttgcaaccgccgccgcgcccacgctcccgcctcctccgggccgcgtcggccacgtcggccacgcccgcgcgtgcgcccgaatctcccgcgcccactccctctctctctcgcccgcgccggcgctcgagacggccgggattcgattttcgaatcccgcctctctctcctctcccactcccccacgtcggccggcgattcccagcctctctcggccacgtccggacccctcttcccctatttaagcaccaccaccatcccctctctctttttcctcatctcgccgagtcctcccgtgctctctatcgccctagtgccgttgccctcctctccgccgccgccgccgcc

SEQ ID NO: 33675 - DNA, 15152 bp, Oryza sativa
ctcgtctcgccgtcgtcatcgccctccgtcgctcgccgtcgtcgatcgtcctcggtgattctccctctctcccgcgctgcttagccgccgcactgccgcctagtcgcttagccaccgctatcgccgctcgcgtcgccgcgacgccgccgccctccgccgccggccggtcgccgccggtcgccgcctcgcgtcgccgctgcgtgcgcgcccctccgccatgcgccatggccgccgggccagtttgagccgtgcccgcgcgcgccggccgcgagccgcatccaacatccgatctaccgggcggtagatcggagccgtcggtttggctgcccgcgtggctgccgcgtggccgccgcgtgtgcgccgcgttggcgccacgtgtgcaccacgtggtgcgctgctcctccccggtccgtggactcggtccaccgtggaccgccctccccgagtcactgacatgtggggcccacatgtcggcgcctccctctctctccccatgatcttaattattgcacaataattcaattaaggatttttctgtttatagtaaaaacacagtgaatcttctaaaattcatatctaattcatccgagctccgtttaagcccattcaagtctcagtaaatcaagaaaaatgtgtagaatccattaaaatggttttgttctctgtttcagtagtcttatagcctgtttatattgtttgctttgtatgtcgcttagattccggctctcccgacgctccggtgtatttcaaaatagtcgccgaggttcctccagcagcagagcaaggcaagtcatgcttgtcacttgaacatgttgatcctatattgcaaatgttctattgtttttcttcaaatattgcattgttttacaataataccatgggttgtttacctactattatagccatactatttttgtaccttgcttctttgttagcttgggatataacatgactaggtattggactagggattgcttagccatgcttagttcaactagcacacaatgggggaaatcatattaatgtatagactgtaggttctaatattaatgttggattagtgccaccgtcctggtgttgcttaattaaaataaatcttatggtaggctgtgggtgcatggttttgttggtcgcgcccatggcagttaaggaccggttcgcgggatgccctggaagaacttatcgtacttaccacaagccagcgtgggcaacggctgggcttgtagtgtagctttcctctagctgacgcatccaggcaagggtgggcgtgatggagtttggatgggccctacgacggcctatgcggcttccagattcacctaggcacgagaggggactgcccgctgccttgcgaggagtgggggtaaaacctgaggtgtggtgtgcttggttagagggggttatgcgaagggtcctgtcacggccttgatatgtcatggtggcatgttggcacacggaaacgtgtcgtggggctgtgtcttgtgggtacagttgtacacctctgattagagtaaaactattcgaatagccgtgtccacagttatgggcagtcgaccagattcaccgtgattagtctcacccctagttagcttctggaactggttagttcaggtggtggtttgggcctgctgcaacgtggtgtaacgttggacagtgattggttaatatggattaattactacaactgttttactgctttcaactactgcttttaaatgctagctttatgcaaatgaacctctagcctcctttggttataccctgcatcataccttcttttccggtatgacttgcttagtacagtgggtagtactcagtcttgctctcttttcccccacaccagagttgaagtccttctcagttgaagatgtctcgaagaggttggtttcgtcgcggccgtcaaggatgcctgtggaatagagtcgcccgctgcaggagtcaagtcttcaggcttagctcgcttttatcttttccgctgtatttgtaatcttttatattttttgtaagacgtggatatgtatgtcaacaattatcgtttgtgtatcctggctagttctggacagaggtttaatacatattcagcttagaaattctagttcgtgaatttttggtcgtgacaaccacctagctcaccacctctctcctggtgcccctgactcctccgccccaacctccatcactaccggcctcccgctgttgccgatgtgctacgccaagccgtgtgccctactcatcggccgggttaccggctcccttgcttccgccagcctcaaaactccccccccccccctcctctctctgtttagtgttcagacatggagtaggtagcgggaggataaggctgatgtggggtcggctgacattgggttttgacaggtcgtggacttggtctatggaccattgagcactgtggattactgggctggttactgtgctgctgctagcttgctgtaccttttgttttttctctcgttcatagagtgggtttgcctctctcagcgcctcatcgatatctgcacgtctccgacatctacatagactttgcttcgacttcatccttctgactcgcatatcttcgacttgatcacccattcaagtgcttggctacaatgacttccgcaaatgatcatcatcaagtgtctacgccatgaggctccgggttgccgctgcgtcaccctctcgggcttcagtgccaccgctcgtggtccacctctattagttgttgcagtgctgagaggtgccctcctcagcatgacttcatcaccgatggacttctcgccgctgcattgacatggagctacaactgtgtcatccctttggaccacagcgtcaccgctctcgtcgtctccatcgccgcccgcacatcgacatcctcgtcgtctgcactggtgatcttcagctgctaggttcttctttgtctacttcgagcatcatcgccgcgtctccacgctgccatcatcactgctctagggcggtggtccagctacctctacatggctaccgacatcgccgtccaagccgttggtcccactacttcatcttcatctccgtccagaatgcctcattggcagcgtcgtcgtatcttcctcgactacaatttgctcttctccgacaagtgcgtgttgctcaatcaattctctctcttcactgctctcgcgccacgatcatctcggaggccttctctgctagtctcctctgatattgccaaagattcatggtggtctcctacctcgcccgtgcggtattgacaacatcattgcgcgtgtttgtcctcccgggtctggcaaacccggcggaacgtctcgtcctccacggttcggcaacatcgactcttcggtgtcatcttccttaacgaccaccgcattctcgtcaccgtcatcatctttagttcgtcctcgctcacgactactctatggtgccccatgcacgccgtgcggctcggctacctcgacatcagctttccgatttcggctacatcgatcatggctactctacgcacggcttcatcgaccacggctccctcacaaccttcgttttggctacgtcgactatggcacaaagggctatgatatgtattgagtactctcgtcggttttttctctagtctaagcgttcacactgctcacgctcggaccgtggggagatattagagtatatatggtagttctagaaataataggatataattgatttgattagagtctttccttatctctagtacctttctaatctttacccgtgtaatctctatataccagcctacgaggctcaatacaaatattcatgttacgcagtattcctctctttctatactattcaacagcatgatccatctctttcatcctgtacatcagcttcactagattaattggcacatcatctgacttcttgaattgattgcgcaattgagttatgtaaccaaagtgtatactttgaaaattttgacacggttaaggtacgtagccggtgacgttaggttggatagatttttctagagctacctctgaccggtctctgcagatgtagggcccacacacaaataaataaactttgaattgaaagaaatgtgtcaataacggacaaaacttctacgagataaataggtaaaggacgatgcaatatatatgtaaaaacatatcgtaagtatgaggctttttctactatggccctttttttttgtgtgtgcggtgctttatatacagttcaaattgttgaagcaacatttactgtcatggattatgtcaacagagatgtcagtacataatataagctttaatgaaatactctctccggtcacaaataataagtgtcactttagaatcagtgtagtcaacaagagttaactttgactatctttgttttgaatacatcacttgtgtattggcatagccaaacttttaaaaacaataactttcataatataatattagtttacacacaattcgttttggatttatacaaatgaattaagtgatcaaattaagttatctcctgatgactttgcaaagtttaaaacaacacttatttatgattgattggagggatcaattaattactcattctccattcttaccgatcgagcgtcatgagtgacagaggtttggtcattcaaactgtaaacctcatctatttaaacccaatcgcgagtgctaagcttgcactcccccagcttgaacttagaggtgggttgcttagcctggttttacaagaatctaaaccagcaatggatggaggaggcgtcgatggctatgagatggagatggtgaggaacaggaaggtggtgctaaggaggtacgtgacggctgggtaccctacagtagatgatatggaggtggtatcctccaccatgatgccacgcgtgcctcttggaacaatggcaccagcggtgatggtgaagaacatctacctttcatgcgacccgtggatgcgcggtcgtatgactaagcacgacgatgctaccgcggagatagccgaagacttcgtgttaggagaggtacatagataagtaattgttcttgtcaaaaattaataaattctcctatatatataacacctttataaaacttttgaaatctttttttggtacataaaagataaaaaattgtaagcatagatttgtatcgtaaaatatttttataatcctataagcttatctgaataaaacttatgatccaaaccacacatgaaaaatacaaagaagtcaaaaagttatatacaatgatagtagtgaacctagggttcacggttttggaaaccaccaaaatttcataattttcgtgaatttcagacttttgttacatgaaattatttgaaattttaacaaactcctacttaattcaaatatattttcagaaaatatcacataaatttggaaaaccctaaaatttcggtcgagatggttattgcttgctaggaggtcagaaattactgaaatttcaatccctgggtgaaactcgcctttttaaaaaagaggggggggggtacagtggcttctacatgaagactttgcactgactttgttatattattttgagagaaaaattgggctgacttgtgctggtgatggtgggattgacaggccatggttaatttcggtgtgagcaaggtggtcgactcaacgcacccggtgttcgctgctggcgacctcgtgtggggactgtgtggttgggaggagtacagcctcatcacccaaccggagacactgcacaagatcaaccatcctgatctaccactctcctactacaccggtgttctcggtgagtcaattcttgtgcatggacggacacatcagttctcggtagacaagaagatcggtttggttacatcttttctcttttctttgtactaatttcagatgatatgtggtgttaattgaccatgtaggtgtgactggtctaacagcatatgccgcattctttgaggtcggcaagcccaagaaaggagagaccgtctttgtgtcggcggcatctggtgctgtcggccagattgttgggcagcttgcaaagattgccggctgctatgtggttggaagcgctggctccgacgagaaggtcacccttctcaagaccaagtttggctttcacgatgcattcaactacaagaaagagagcaatgatcttaccggtgctctccggcggtgcttcccagatggaatagacatctactttgacaatgtcggcggtgcgacgctggatgcggcgctggtcaacatgcggcgtggtggtcgagtggtggtgtgtgggatgatttcacagtacaacctgcaggagcccgagggggtgcacaacgtgatacagatcctatccaagaccatccgggtggagggatttgccgtattcaaccacttcggcttatacccgatgtttgaggatgagatggctaggtacctaaaggaaggtaaggtgaccgtcctgcaggatgttgtcaagggcatcgagaaggcatcggaggctctcattggtatgttttctgggaggaatgtgggcaagttgttggttgctgttgcagatgaatgactctagttaattaataataggcagttatagtactgttatagaataagatgcaggacaatatttccaattcagttcatatatagcaaatgttgtaaacccactttatactcataatcttatatatatcacagtgcaaatttcaggttctagtttaaattccattataacactcatatttgaatatcaaggaccagcgacgttacgtgcggctccttctggccccctcctccacctctggtgtcctcgacgaacatgaggcagaagggagggaggggtgtctcttgtccgtttgcaatatatttttagcattttaataaagtgtttagaaatcaatataataagtcaggttaggttttctttccatggtgtttatgaattcaggtttgtttagagccttttgcattttctatctctttgttggtggctacttcattcgcgaggtctccaacaaaggcctataaagtcttgtctaccaagttgtcgatcaaatcagcatcgctggatttggtgtccaggtgaccaactctgttggtggcatcggttgcctactctgttagagggacggagatggtgatctatacttgttcatatgcttttatgtgtgccggagttcatcagcattgtggctgtgctcgtctgtttgcatttcctacgacattccaagatgtggagtcttttttttttaccgaattttatgctgggtaaaccaaactgatctattctcaatcttttatttaatataatcacccctagtggcgtatctaggatttatggtctgggtgatctgacttagagaaaaaaattctatacactgcaaatgtgatgacgctaatatatacaatacaagtatagaggataaaataaacccaaaaatgcacaattcacaagagttcaaactgaaaaattgaaaaaggagcacaaggagaagacctaaatacctaccactgctggccacagccctgctcgtcgccgttgccagccgacgcaccgcatcatcagcgctgccacgcaggtcgctgcatgccccacgccggccgcgggctgccggtgttgttgcggtgctgagcacctgaggccggagatagagaaagagaggcggagttgcggactcgcagtcgctgcacacaccaatcgtgcaaggtaggtagccgggagagtagagtggagagccggagaacgggagaagccagaagccatcaagcgaagttgacaatgagtattcacaccgttcttgtggcggaaaagaattgatgctagacattgtgccgcgttaagtttgattctttcggctgtgtatttcttacgccctctgtcccaaaacaagttaacctagctgttggtatctttttttggtaagaagacaatcacgatcgaggcacctaaacgccttgcggtgatatggagtcgccaaccaccccaacctagcaaaaagctagaccaagatgggttttgataaattaaaccggctaacgaagccaatttagatagaatgatggataactacccgtctcgtgtgcaaatgaaaggtttacgggacaaacccacaaaggatttcgcactgtcgcagcgaaggtggacaatttacggtgcaaatcgacaaagatggacgaactaaactagaaacatgtgaaaagtagatgcaatatttaaaaaagcgattcaatagcttgtatgtagattgtgggttgtatattacaattgaaccggccttgtcccttatatagaggttggtctttcctcctacaggtcctcctccatgtccaactcggagtagaaaccaaaggaaacccgaaacatacattttcgagcaaggaaatccaagacccgacgaaaacagactcaggctcggactctgccagtctgaccagccacatgtcgccggtcagaccggccacatgccgccggtccgaccggcccttaagctgcggtctaaccggcccatactcagcggtcagaccggccctgtgggggaaatcgatgactttcccaaatcttgacaaatttccttattttgaacctaggtgccaaatttgggtgtaaacactagctagtacgggatgtggcatatcttagcactataagtatcaacaatacctgtcaagattcatagtactgggatatgttaaatctcgtaccaacttaacttatattttgtaatggaggaagtactttccttttctctttatttttttttttacaaaatctataccttgatgggccttgggcgggaattttttggttgtccggggacctacaatccgcctatgatcacctctagtttcgccaaaaaaaaagaagaatattcacgtgggtggacttattccccccccccccccccccgcccaacaaaaaaaaaagaagaaaagggccaagcccaggaattgcgccacaattataattcaattacaccgtaactacactatgactatattataacttttatataacatattcaatcaagatgccatccacctgttctccaaatgtaaacatgtgaagctagcatggcaaactctgaaccttcaatcacttggaggaaatcttgcgctacagtcaaaaggaaaaaggagtcatggagaccatttgtgtgaaatacgagaaacagagaagacgaaggtgatgctgcttttgtggcacgatggaatgaaagaaatcgagtcagggatggtgaaggaggtcccccagccgagttagcatacatagttgcggcacaagcggatgaatgggtggcgttgtcgacaaaagacaataatgaatagggttacaggggcaacaaattaacgacaacgacgtggaagaagcccggggcagatgtcctgaaggttaattaactctgatggagcttttgatgaggttgggggtttgtcatcagaaatcaccagggagaggtggtgacggcaggggcaggtaaactttagcatatgatggatgctttccaaactgaagtattggcaagaatgaaggagactaaatctgcaagtgaaatgggaaacaaaagtgatagttgagacacgctcaattcttttgaagataattaacggtggaaggctcatccttcaatctcttgccaatgggtgtcatatatgaactccaaagggagattagaagcgggtttttttttctgatttttcaattgtatattgtcccggggacaatgtccccgttcttgaaattgtgtggcgcatgctcgggcggcattaggatgtaagtgctctcagctctcctgggatggcatgtcggaaggcatagagcctggtgacaagcgatttagctgactctataagttaatggaaagtttttttttccaaaaagtatattaaaaaattgcatgttagtaattatgatatagttacagtataatcatactatagttaccatgcaattacattataattactttaaaactataattatattaaattcaaaagttcttttacctaaaaaacttagttactacagttttttaggaattcccaattttaaattaaattctttcgatacgatagatatatatatatagtaatataacaaatgacaccgttttttctattttggtttactatctgatatatatatatatagtatgtttgataaagaaaataaataatttactagctttcctattgcctacaggggagcgtatcctatgcacacaggctctcgcgtctacacaccgtgtgcaccaactaaaaattatcacaaaaaattctaggaaaattcatacatgtactttcaatagtattacatctacgtgcaaagtcacatcttcaaattcattctacatagagaataacaaaaaagataaaattctgacaaaattgcaaccttaaaactgtcagattttttgttttttttattacggctaaaatataatgaatttgacgttaagattttaaccctaggtgtaatacaattgaaagtatgtgtattattttttctagattttttggtgacattttttagttggtgtgcacgtatgtacacgtgagggcctgtgtgcataggatatgttgccttcctacagtgcccaaagttgataagtatatgtgggttgtccattcttctggattcaacaaaggatttgtcatattccatacttataaataaagagcatatggacagcttttcaagtttggtgaaatgctaggcagctgaaatttgagaagtgctcttgtataatgggattcaagtcctcttaagaaatgactacagggatgcgcgcgattgttcgttagtcttaaccttaaccgtaactagagaccctctatacgaattttctatatatatgtcaacaaattttactcacaaatttgtcaaatgtaaatatattatagtgcaactagtacgattaataacattgtaactagacgattcaatcatgtgacctctcttccctagagcagcacgcgctaccacagggtttataacaattacatacagttgagttatattacaattacgagttaaaatgtaattatattacaattatttgtacttagcaaattattagaagaaaaactatcgatagatgtaatatagtcccctgcttatatgtacaacaattgaagtttcgaaaattcagatatgctgttgcgccggccgcaggtactaaaaggccctttacaaaaaacggctagcgggagcaccacactcataaaggcattgccgtacatgtttatcccatctttccaaactgaaaaaatgtgagtaaaacagacacgacaaatcaattatttaccagcaagtgaccatatatatgtcacattctgaaaccgatcaactagatcatcaattaatttagaccctcgtgaaaagttctggcatttcacatcggatatgcggacacacatttaaagtagagttaattacactttggtccaccttttattaccaaaattttactttgggctatcctctagctcatattttcactttggaccaggtaagattacctttggtgcactttggaccaccttctttagctgtatttactctataatgttgtaaaaaattacctacgtaagttggaaaagattaccgggttacgggttgttgatatgtttaaagttggaaaagtcttttatgtattcctaaaaagtttatgggatggtccaaagtgaaagaaaggtaaagtaacctagcccaaagtgaataaatatgttaaagggaggtccaaagtgaaactttggtaataaaaaatggtcctaaacgcaatttactctttaaagtattaaacgtggactaattaacaataaaacaaattatagattatgcctgtaaacggtaagacgattttattaagtctaattaatctatcgttagcaaatgtttactgtagcacaatattgtcaaatcatgtagcaattaggcttaaaagatccgtctcataatttacacgcaatctgcgtaattagtttttttttctatatttaatactccatgcatatgtccaaatatttgaggttacaggatgaaaagtttttgcgttggaacgaaacatggccttaaccgcaacaagtactccgatctaatcaatccgccatgcatgatctgatcaatcccccagcaagaaaaccaaccaatcatgtaacatgcacaaggtagcctccgctttaattccttccctttttttcttctccccaaaacttatccggccatgcatatgatcatgatcgccaaccgccaaaaagtttgtttctaacttcccgccatctcccacctctcccgccatctatctctgacctctcctctccacatgctcatcgatcagcttccctttcactgctcaaatggcgttttgccgccccacgctacaactcttatcatatcttcgcctatatatatcgctcaagttccagtttcgtttcagctcattgaactgaataaagtcggtgtgctatagctaccattcccccggacctgtgtgttggcgctgtcggtatctgggtggtgatatattttttctttttttttttacgatctttctagagttgtaatcttgtaattttttttctgctctatcaatagaacttcgcatttccaaaaaagttcatttcagctcactcaactgaataaagtcagctagcttgtattttaggtgaaaaccgtgcgaaatgctgaggtgcttcctggtcgcggcggcggcggtggcgttggctgcggcggcggcagcgccggcgagggctatcccgttcacggagagcgacctctcgtcggaggagagcctgcgggcgctgtacgagcggtggcggagccggtacaccgtgtcgcggccggcagcatcaggaggcgttggcaacgacgacggcgaggctcgccggcggttcaacgtgttcgtggagaacgcgaggtacatccacgaggcgaacaggaggggcggccggccgttcaggctggcgctgaacaagttcgccgacatgacgacggacgagttccgccgcacctacgcgggctccagggcgcgccaccaccgcagcctgagcggcggccgcggcggcgaggggggctccttccggtacggcggagacgacgaggacaacctgccgcccgcggtcgactggcgcgagcgcggcgccgtcaccggcatcaaggatcaaggccaatgcggtaaaaaagcgtgaacatttttttctcgttctaaaaagcatataacatttctatggaaaaagccaaatgcagtcaaaaaaacatatggatagatatagtacaaattatgcaaaatcattagattattacggcacattattttctaacaggatttaaaatttcggtttccgaaattttggaatccctgttaacacgaaatttttggatttttttctaattattcttaaatttagtcaaaaactcaaaatatatttaaattcagttagatttttaaataatttcttgcataagtgaaaatacgatttttttttcaaaatggttttttactgttggctacacttttttctcagaatattttatctatccatataattaagcatatagtttatggcaaaagatcttatatttacttcgaaaataattaactatttgccactcttacgagtggcgataaaggatttgccactgaacccacatgtcatagacacatgagagccacatgtcatatataacaagtgacaaatccttaatggccacatctcaaaagtggcacaaagttaaatgtcccatttacttcgtgcacgtgtgtgctagtcactcggctcttattggtgtgattttaagggagctgctgggcgttctcgacggtggcggcggtggagggagtgaacaagatcaagacggggaggttggtgacgctgtcggagcaggagctggtggactgcgacaccggtgataaccagggctgcgacggcgggctcatggattacgcgttccagttcatcaagaggaacggagggatcaccaccgagtccaactacccatatagagcggagcaggggaggtgtaacaaggcaaaggtaattgcacggtgaaatctcatgaaaaattatatttatgttaactatactaaaaaaaatcaatgttgaatttgaagaaaaaaaataacttaatttttgcgcaaagcgttcggaggaaacataaatgtttatcatgaaaaaagatctgctccgagtaaagaaagatgcatggttaataaacacttgttttaggactaaaatgaagttagtctgaatacaaactgaaaatttgccatctggtgtttatgttgcaggcaagctctcacgatgtaacgattgatggctacgaggacgttcctgccaatgacgagtcggctctacagaaagcagtcgcaaaccagcctgtggctgttgcagtagaggctagcggccaagatttccagttctattcggaggtaattaacaacatgaccaacaacctagctacacgatatgtctgaaattaatcaacagttcaacacatgatctacacatattcagtgtgcgtgtgtctaattatactcaaagatactaataccatcatatatatatcacttgggaataatcaaactagggtgtcttcaccggagaatgcggcacggatctcgaccatggtgttgccgctgtcggttacggtataactcgagacggcaccaagtactggatcgtcaagaactcgtggggcgaggattggggcgagagagggtacatcagaatgcagcgtggtgtgtcgtcagactcgaatgggctgtgtggcatcgcgatggaggcttcttaccctgtcaaatcaggagcacgcaatgctgctgcaagtaacagagtggttaaagacgagatgtgagcctgtgatcgatggagggatatgatatggatatgatcgatgctttatgtgtgcttcgctgaaagtagtgctagctaagctttcgttgtcaactggatttaatcttctactgttcacggttgtactgtacgccaggtgtcaaatcagaagttaggtaaaataaattcaaagaggagcatgactaacataatgtgctcaactggattgctgaaaaatttgctcaaatcgacattactgggaaaatattttttgcagacaaggtgcacctatcttttcaacgggtactccctccgtttcaaaatgcttgacaccattgactttttagtacatgtttgaccgttcgtcttattc

SEQ ID NO: 33676 - DNA, 797 bp, Oryza sativa
catccctactcatacctgtcttgaatcaacctgagtttgctactcttgaattactcctcgatatattgagcgactgaactcttgttcagacagcattttcaccatgatagtgtttggaactaatatgtgagctaaggcctatatgtagattaattctttacaaaatcaaaaaagcctacctcatgaaaaaacatgcatgtcaacctttagtaccaccttgtctattctagaacaagacctttttgagagggagatttcccttctagccatttgagatatgtatggtggagagaactagaggaacacatgcgttcgctcgcattgtctcgcctgacataggacagctagttttgttcacttgagatatgtatggtgggttgtgaaagggcctatgggtgctggcccattaccactcctaagtgtgcatttgttagatgagtaaagatggacaggatataatgacagaatgatacaatatgatggattgctttgatatattaaataatattgtttgattggttaggttcttataaagtattggatagtaggagataatgtttggctacaagctagtgaggtggtacggtatactcttctatgcacttttgaacttttttagcttattttctaattgtttttccctcttctttttttttaaccatgtacacatgttcccatacatatatcagctaatggtatgatcctaccttttgaatttagatctaatatctcgtgcctataagcagggcatggccaagacgctgctagctgccagcccccttcaacccgacctaata

SEQ ID NO: 33677 - DNA, 760 bp, Oryza sativa
tcatacacaaattgtgtcttagagtctgtggtacggttggctatagatttataacccactgttcttatttctcttcttttatcttctcgatatgcgcttatagctggtttatagtctgctgttatacctgttgtaagccgcagggttaactagacaaaccatacggtcgtactgttcttttatttacttttaatagatagctgacggagctcgtggctcctcaccgggagaccgcgcaggcccccctttgccggttcggccgggggcttagggtgaagtctcaagctctctcagtatgtgaaaagatcgccagctaggaagaaacgcgagacacgggcgatgtatacaggttcgggccgctaagaagcgtaataccctactcctgtgttttggtggatctgtgtatgagggagctacaaagtgtgagccaacctcttacttgttctaagttccgaatctggaaaagatcatccccctttccctatgggcaaggtcctccttttatacttcaaggggataccacatgcacccctctctttccaaactggacttttcttctcttcataaatggacggagatttgcacggttgtcctccgaacatccttctgacgggacggcacacacctacatccacttctgccgaagacaggcgcgtcgtgggaacgtgactgtctgccgacgacatgaccagtgtcagactggtcattcttgtcctccacgcgtcagttcaacaatctgcatgttcacccttcttcatac

SEQ ID NO: 33678 - DNA, 13546 bp, Oryza sativa
  unsure (1)..(13546): unsure at all n locations
agctgcggtgtggataaaatcttttgagccctgggctctacgaaagctaacttatctcatgctcttgaaggctaactaaacagagcttttcaggttcaaatcagacaagtcttcaataccagaggtaattccactcaaaaaacaggctcaacaatgtaaggcgggcaagagtaagaaaccattgctaagaaaacaaatgcccttgaatggctgggttggatcgcatcaggagttagacaatcacacgatctgagttcaacaatgccctacttggtttaaactcacttccgagctcttcctcgcttccccctcttcccgcctcgccccaagctcccagttttctgagcaggagactcggttttcttcgggcggcctctgccccttgcagatggctttggctcaggagttgcctttttagctcccctgcctctccctctgtttgaaggtttgcggccacgtctacccttaccaccttttatttcaccattttcatcgtcgtcgctatcatcttcctcatcatcatcctcttctgattcggaaacatccttggttttcttgcgcttgttagatcgtgcattggtgctagcagatgccttcttggcaacctggacctccactctgtcttctactgcagtgaagagttccaatcatgcatgagtcgatgcaaaataataaaatggtaaatgatatgagaagcatttcagcagcctgcatgattacaataccagtccattcaaatttcagacaatacgctcacagcaaaatgtaaagtaacagcaggatatagaaatggcatgtaaagccaaaagttgctcacatacttgactacttgagttacaccaacaatcacactggcactattaagcgattttccctccacaagcggagcagcctccccgcacaagggcataaccacattagctcatagaactaagcacataaaaactattgactgtaaacaaaaggaaccatggtggtaggggactatccaattatatacaattggagacaataatttattctgcacatatcaaaccaaactaaggatgatattcatacaacgttaaatttcttgaagcttgcatacataatttaacaatgtgattgtaaaacaaaataaagaggacatgcaaaatacaaaccttcagtggaggtatcaccgtcataaatatccagctgagaaaaaaaaacatttattataagataaccaataataatccaaaaacctagggtaacgagagaatgcaagaaattagcatacatctgtacagtttgtactgcgactactaaaagagatgctagatgataaaacaaaattattagtctaagcaatataagagacgaaataagataagtgaataaggtagctcattaaagaacaccttggtaacagataaactatcttgatcaaagctgtgcttttaaaagactgtaaggacaaatgtagccatttttaacattagtgtagctccatttcaagggtagatagcctaatgcaagtctttaaacctaaaagttatagcataacatccgttggtaaatctaatgtgccttattcgagatagagactatgataccgcataacacctaacatagctgctaactcgagcaactcattttctttgttgaacatctcaagtaaatgttgcaacatattgtaatctcttggtagcatcaagcagatggcctgtgaattggagcacattcagttacctgattaagccggtcactagcaattgatctgtctacaacaatcgcagacaacccatatccacaaccaacactgcagaatgtgtcagcaatttagttgattatacaggagctgcaactatataaacattttgatttagtgtagttaccttataacatgcattccttcaaggatgtcaacctttttaggattagcagatgacctgcattacaagttcaatgactgtaagaggaattctatggttttaacaattgctagcctagtattaaaatgatattaacagtattcaataggcgtacttttgcccattagggccatagccaagctctccattttgggctgttccccagcttatgcaagaatcatctgcaccaacaacgtggtgcatgttaccagaagccatgcaacgaatgttccaaccactgaacaataaaatcaccagttaaacagataactttggataacatcatttgaacaggcagctaatcacgatttatcaacagaaagaatagccaaggacggaactattcatcactatatggtatctacagttaagtttgtccgcaagtaaccttaaatccaataatggctttggatacatccagtcgtcgcctgtattctttaactttccccacatgtacaactgtcctccacctaataaacaaagcaaatacccaaaaattaataataatgtggtgttcattcttatctttttatgcaacactatcaacatcattttggttagcagaatccaagtctccaaggttcaagtatgatattcttaacaggacataaataatactacacaacatgaatctccatctaactagcaggaaacacatagagtgggaaaaaaataaacctgatgcatgctcatatcggcctatcagaaggccagaaaaaaatgagcaggcttacgctataagatgcttagtgtacatgctaaagcatttaaaaacactcaactggctcctcgactacataggatcccctttgcctatagcacctcgctactcaatcatcaaagcaaagaggttgtaacagcaaattagagcaaagccaatagtatcaacatttcagcagacacaaaaccctgatgacaattgttcacataataacacatgggaggatcaataaaacggcaataagttgataataacttgacagatttgttggcagagataatgcacaggaattccataagacaataaaataatgtcttcccgattttgaaaaagttagcatgcgacatgctgaatttcatgtctcatttattagtccatgccatttaactgaatacatgaataacagtacaatcatcgaatttcagaaatacaaccaaaatgctctataatattataattacaaacaaaacaaaatataaacttacatcacaaatagcttattttccatgtatgatactcagctaattgcctaatttacaggcccaaagtggtttttattaagtatttctttatgattgagccaaataataacagaactactctatcgatgtccaaatatcagaaaaggaaacataccggcagtgcatgcagaacttgccgcaccagctgatataatagcattgggtggcagaacattatgcttctggaagacttcaacaaggcgaggctgccactcatccttttgttctctatggcccaacctatgcaaataacaagtggatggggatcagaccaacgatgctatcctgattatagtgggatattgggttatatgacatcagtgtctcaccttccatatccaccaaagccccatctgccagggccaaaagaaaagagaaacgatattagaaaccataaacagggaactgaagaaaacatgtattattagatattgcagataggaaacggcttgatagctgatacaggacagatggatactatcatactagcaagtcaaaataatttaaagttggtaattgcataaaaaattgatgaataaataacatacgtgtaaacatagccacttgaatcaactgcaactgcagcacacaagtaaatgaacagtgtgagattggtgttaatcctgaaaggttagaataaccaaaatatatatctgtaaatataacagaaacctgtatgatttgttccacatgcagctttgacgatagttttcccagataatgaagctattgccctgggacggggctggggatcatatgccagctttacagatgagtctttaatattgtactgcaacagcacaaatcaattatcagtgcattgatatgaaataaatgaacaggttatctgtgttaatagagtagcaaacaacctcattgtcggttccatgaccaagctgaccgtactggggaagacctgctgtactgaatagcacagaagaataaaatactgcctcaaaaaagttcacgaacaacactcactaacaagagcacaagcagatataattaaaagggttgaaaatatattagtgtcgtattataagcaagacatacagtatagtagagccctccactgatgacagccagacagtaaaatcagcaccacaaacagcattagttgcttcagtaacaagacagggcattggtgatgtctcaatttctgcagcaatttttgaaccaaaggaacaagaatcaaataatgtaataaataaaggggaaataagctgcccaaaacaagtaaaataagtttatcagttatcacacattgtgtcgcagagctaggaagaatttacgaaatgtccaacatttgttagcatatattataagaatatgaaaaactccccgtgaaacactgcattgcagcatcaatgtctaaacagacagatcacacatggaagcattaccaaaaaagaatcaaccatccgcgaagcagatatatccagacttttccaaagacagaatgatttgtctgcaggacatgtatttggtgtactactgatgtcagtgagttaaaaatgaaccaaaggtacataccattccttagggagcctgtacccaactgtccgtgtttattgtgaccaaatgagaatgacttcccgtcatcggttacaaccactgtgtgatttcttccaacacttgctttaatgactttgtacctgaaaacatttagcacccataaataattcatctcaaccagtgcacctggtcaattcatgaatttagcataccaagagctattgttaacaattgaagtacaaacaaatagttagttcctactttgatagttcagaaacaacagtcggcaggttacgctgaagagtatccccatgccccaactgccccttctgctagaaagtaacagtgttaaaaaatatagtgaagaaaggtggcgtcaagtaaatttcgtacctcatttcgaccccatgtatagcaacgtccttcagcatccaaggcaacacaatggcaagccgctggataaatgatgttatagagttattacaggagtactgaggatcaccagaagatcgaatttgcttgtggattacaggaaataaattaggaaacttaatcaaccaagcctaaatgcttatgacagaatgccctaaagttgaactcttaccactcctagagttaaactccgtccgatcacccaaaaccaaaattaggaaaacgacaacctcgtattaagtccgtcttaaaagcacacatactcgctggatggttgcatcagcagtctatctagaccattaagtccactgcattgtatgtttctcacacgtgtctgaatcgctaaaatccaatcaaccagcacccccgcgttagaactttccatatgtactatctgtctcgatgctatcaatctaataggtcatgacagcattttgcaacattaagcagtaagcacacgtgtctaaatcgctaaaatccaatcaaccagcgccttcgcgttagaattttccatatgtgttatctgtcgcaatacggtcaatttaataggtcaggaaaacattttccagcattaacttgatagtactaaacagagtggcgccgtttcggcattagctcatccagccactggaagagcccgcgaactttaaacctgaccaattccacctgacctggtttcacgcatccaacgaataaatataaactaaaccagcggcagttctcatccctccgtgacttgactctaggagaccatctgaaactgacagaaggacgaggggactcactgcacccggaggcaacgaatcgtatgtcgacgcccatgagcgaccgcatccgcgtcggcgacactaggttaccctgcgccccgcccaccaccttccgccccatggtctcgaagttggtcgcgccgcagtacagcagctctcccccggagcccgcggcatccttcgcgccgtccgccttctcctctccctcggcggcggcggggaccttctcgggctcgccgctggccgacattatcgccggtagtaacgccggcggcggtggaggattccgatccgaaaccctagatttgttcgggggtagcggagaggagaagcaacgaatgggggagatttgaaattagagattgcagatagaaactctttttatgtgcgggttagttatttatgagccagtgcggattcatagtacgcagtgggttcggctagtgggtcgactaatcaaagcggaccaggagatatttcctatcacgtcaaatgtggcactgaccagtgggaccgggaaaagtggggcccatttgtcagtgatgatcagttcgtggtccaagtggcactgggtttagttaaggccgtggttttaacttcagccttttcccgggcttcgttcctatggacaggccaagaggcccaagacgacgtcgatgggtcgtactttgcgaggtgatgagttactgacttgtggtccatcgtcatcgtagggtccacttgtcggtagatttgagcatggagtaataaaactgtaagtacgagcaaatgttgtggtcataactaatttttgctggctggccaggcgagggcaaggatgtcagaagtcatggattgagggcaactccagtgtatgttcgattactatatgtgttagttcgtgaatggcgaatgcaactttggtttggtggctgcagtgtgcacatctatttatgtgacccgtttacaataagaaaagttgagagaaattgtaaattatttgatttggcttggatgtgttcaaccccgtcagcaacaattaaggccctatttagatcccctagtaaaattatacaccctatcacatcgaatgttttgacatatgcatagaatattaaatatatatgaaaaaataactaattacacagattgtgtgtaaattacgagacgagtcttttaaacctaatagcgctatgatttaataatgtggtgctacggtaaacatttgctagtgatggattaattaggcttaataaattcgtctcgcgatttacaaaagcggattctgtaatttgttttgttattagactacgttaaatactttaaacgtgtgtccgtatatctgatgggacacgtcaaaactatacacccttggatctaaacacggcctaatactttaattgtctaacatcgactcaagtttggaggtcgattctgctatctcacacaacgatcgactctctcagcgtgatgtgttcgatacttttggctcacgattcgatttctccacacactggagctgctctaagaggatagatttccttgtgaggctaggtcatgaagtaatatggcgagtggtttcgggccttcaccttgctaagcctcaaccttagctaagagagtggcttcattgagcatagatgtctagcggaggatataggagtatggaaagggaaggtggatgtggagcgggatatgaaattataggaggaaagtgataaagaggatgtcatttgaagaacaaatattgagctgagcaccacgacgagccatgtgtgcgaagaagaaagctagccacatgatgatggccttgacaactctagcaataaggagaccaaatgagtatagctatatcgcagtggctcatgaaggaatcaaaggtcagtagacacgggctgcacatcatctgccctcgtcggtcggtcgtgtcatatactttacgaacaacctaacaatcgactcattgggtggataacaaaaactagcgctgtcagctagaggggtgcgaggaatgatgatgactggagaggagagggggcaaggacaactgaacagcagatgaatggtagtaactagagtgagggatttggaggcttcgacgtcaagatgataaaaaaggcggagaagagattggagataggatgacatctggggctatatgaaataccatctctcttaaaaccgcaccacgagaacgcctgcattgtaaatttatgaagcgtataaatttattgtatgtgactattatatgtatgagtttattttgtgagatattatttaacaaaagtaatattttagtttcgcctcgcgaagggaaaacaaaaataatttttatctatgacaaccctttggtatcaataaaaatataaatttatgaagtatattgatggagtgtataaatttattgtatacgactatcatatttatgagtttattttgtgagatattatttaacaaaaataatttttatctcgcatagcaagatttatcttataaaaatttccgtacaactataacaaaatatgcagtttttaatggtaaaaaaaaactacgttttgttttatctaaaataaattttgccatagataaaaattattttgttttcccttcgcaaggcgtaaaatattacttttgttaaaaatatctcacaaaataaactcataaatatgacagtcacacacaataaatttatacactccatcaatatacttcataaatttatattttcttgataccaaagggtaaaatggactttatgatatgaatttaacggtcaactgacaaaaggggtatataagagatccaaattgaaatttaggggtatggaagtgaatgcgcaaatctcagggatataaaaaggattggatgaactttcaggggtacacagggaattttctctaaatgtttctagtgatagcgttttcaaagtaaatttggccatatattgctttaggaaacaagtgtgacaaggaagcataaatatgtgctaataggttccttgtggtggaatatgttcactcgagtttaacctaacatggatgctcccatatgatgttatttcagtggtaggcgatatatatgtcaataacggaacgttgtggtgacttcattaattttatgatacaccggtccaatttttttagatacacatgaggatcgagtgtgtgtatgtatttatagaggtgagctcatgttgttagaatccgcatttatacgtactccatccgtccaaaaaaaaagacaaaccctaggttttcgtgtccagcgttcgattgtccgtcttatataaattttttttataattagtattttcattgttgttagatgataaaacatgattaatactttatgcgtgacttgtctttttaattttttaataattttttttaaataagacggacggtcaaacgttggacacggaaactcagggtttatctttttttaaggacggaggaagtatctcttaaagagattcaattccaaaaaaattatccggtataaaagcagagataaacggaagaatatacccacctatcatttttattatcttttctactaggagaatcatttttattctctcgttgaaatgcggggatggatatagcttgcagccacgggcaaccacaaaaaatgtcaaatttcaacgaaagcccgaccctcccactgaccctgttaccgcacgtttgagtaacccgaccgcaacgaaacacacgccccaattttcttggttcgtgatgactctcccataggttgatccgatccgtaggttctcgatccaacggtcaccgtgacgcgcagctccctgcagccgacctggccacccacaccttcgtggtcgtggcttaccagcaccacccacctaccgctcgtaaagcaaccgccccccacctcaccaaacaccgcatccggtgcacgagacggcgaccggtcgaccacccccgcctcaccgcgagtcgtgagactggagccgcactttttttctttccggcttgtgggccccacaaatcctcaaacccccatcgtaacgcgtgccactggagagcggggcccaccgccccactttatataagccttttggaattcggcccggtccaaaaattccgggacgcgctgaggcctgtgaaaggaaaggaaaggaaaggagaggagtggaggcgaggcggcggcggcggcgagatccacacatgacacatctcgaggcgcgcggtgggcatcaattctcctccactccaccgggtttttttattatttatctatttttgcgcggccgcaagctcgcgcaccttgtgctatctctcgccaccgcctaataatagctcgagtgaccaggcaccaccaccgccatgggagcgctcgaggaggcccacctcgccgccgccatctccgcgtgcgagtgcgagtgctacgaggaggaggaggaggatgacctcgtcgagggggacggcaaggcggcggccgccgacgccatggagccggcggtgcgcgcgctgctgctggggctcggcgaggacgcgcgccgggaggggctgcggaggacgcccaagcgcgtcgccaaggccttccgcgacggcacccgaggtacggcccagactccctcctccggcctccggagttcgtggatccgtttttgtgtgtgtgtgtgtgctgtttgtggagtccatggcataattttttgatccgtgatttgcgagctgcgggccgcagctgtctctcttgcttgtctagcaccgaacctggtgaagcagaacaaagccgtggggcatttgaactcgtgtggtgttgtttggatctcaggacgatgggtcgggttgtctgggaattattcctgaatgattgaattctatctcggtagcccatcatagaagtgataacttgatgtaaatggttttgcccatcggtcataatcattgctgttatggtggtgttaggctattacagcgctattatgcttgtagtttcagcaattaactcccctctctttaaaaatttagcaactggccaccaaacagactttgatgcaagcatgaatgaccaaagtatgcagcaggattgtgcaaagagaagttggattcggatggttacaacgaggatccgttgtatgtagttactaggagtcttatgattggattgcatacttgcaataagccattccacagtttcttatggttatgaaaattgtttatttcagtctgcaatactgggaattcctgtagtaatcacaatggctgtcctttatttattagtctacttttgccttatgggctgcagcagcaggataatgctgtgccatgtgcttgggtttgtctttttggattatttaaattatgttaatctattattaccttccaaagttcctgctccgtacagactaattgcaacttcaaccggcagctcttctacttagtacttaaaatgtaatctattttcttttagttctcatcctagccacactttttacacaaactcgcctgctccttgattaaattagaaatatgttctttgtttcattatgaaatgtaacgttggatcgtagttatgtactgttccgctgttttgacttttgatacattactactacgatttcaaagagaaaatttggaaataaaagttactttaattatttcatagctgatgccatgccaacttgccaagcattagtatccttttttgtgaccagctggcagttaccatattcttggagagctttctgtatcaatctgtcttacgcaaccattttttaatttaattgtgtctacttgtccataaaacagtgcttctcatttagtttgagtaccaattcatgggatttggggggcattggaattgattacattgttcttatatttgttttatcaaatggttgtactctggaaactagccacaaaaaatgactgttttttcatcattgcttgtttgataaattactgctgtcaatgagagaccgtagtctacataaagcttaggggcaactgagaagtgagaactaaccaccaaattttatttgtttctcggagcattcttttggccacaatcaacacttaacaatgatactcttacaatatttccaagaagggaaccctttattgctggttggtttacagcataaattataccatgaaaagcctgttcttgtacatttattccatactcgtattactttagaacacaatgccatttttacctgtgatggtaaagaggactgctgatgttctgtggtattactggattactggaccattgtcagcgttggagcgttgtttgagtatgctgtttctcttataatctcttttgaaagaaaactgttattttatatttattttagtggcttaactcacaagaacagaacccttacaacagtagcatggtaatagcaactttgaatactcaaactggtagggctagggagcttgtggttcttgtcttctcccaagttgtgcatgcatagatgacaaaataacaagtcaacttttttggctactttgttgcagctgataatggtcttgtagaacttaatcaagtgctggagttatacagtatagccaatcagcgaacatttgctaactcttaccattgctttggagtcgaataaatataatatttttccgtatcatctataggaccattttacactagactgctagtttacctgaacaggacagttttgagcttgatgtgtgcaacttgcagcatcccaatccaagctacatcatgctgggtctaatcttgaaaggtttgtgtgaagtcatggatagtcagcacatgcgttcatgtgcacaatctgtggtcatgttattcttatgcaaggcaaagaatcctttcagccccatcagcaggcagtggtgccaatatatttactttgttgtatcaacgtctcttctttgttgttacaatgtttgggctgctaacaattatttgtttgtaaaaaaaaaactgtaatgcagttgctttatgagctttatttgacatatagttaaaactaatattacaggttacaagcaaaaagtaaaggacattgtgcagggggctctctttcctgaggttggtgttgacaacaggactggttctgctggaggaactggagggcaagttgttgttcgtgatattgatcttttctcatactgtgagtcatgcttacttccattcagcatacaattccatgttggctatgtgccctctggtggaagggttgttgggttaagcaagctttcgagagtagctgatgtcttcgccaagaggttgcagaatcctcaaagactggctagtgaagtttgtggtgcattgcatgctagcatacaacctgctggtgtggctgttgctctgcaatgttggcacatacctttgccagaaaacttgaaatgcaagactttgcaaggttggattagcacttcacattcatctcgctctggagtttttgagggtgagagcagctctttttggaatgacttctcagcccttcttaagcttaggggcatagacatggagagggacagccattctgcctccatagcttggtgccctttaaggtctcatgatgtcccagtctgcaatgggcactgcaagaaggctacaaccaacggtgcaatttcacccaaatcagtaccagctccctctaatatggtttctgctgttagctcaatgctcttatcccttggagaggatcccttcaggaaagaacttgtagnnnnnnnnnnnnnnnnnnnnnnnnnnnnnnnnnnn

SEQ ID NO: 33679 - DNA, 2912 bp, Oryza sativa
  unsure (1)..(2912): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgttgtaccatttttcatttgcacggcacttgaaatctatactgcactaattgcagatgtgccgagaaagatatatacacagaagcaatgtttgtcacatcatttttcactgtagcaaattttgatgagatcaatggctccagctcctgtgaaatgaatgtgattgttctcttgagtgttgacccgccaatgcactcgctgtcttcttctctctttttttcctgagggcatcatatgcatatttttggctcgtggggtttgcaccaactggcattttgcccttttggtgcttgtagattgcagatacgcggggctagcgatttactggtattttgacgggctgttgcgacaggttggtggagcacgcgacgtctccctccccgccgggagaacgcgcgccacggctacccgcccgctcaccaccaatcgttcaaagcggccgcgcgaactaagcagcgggaccggatcttacatcactgttcactcatcgcgtgccatgcagacaaacgagacgtggtactatactacctcattcctaaccgatcccagtcgaacagttgttagttcatggtagcatgatgtgatcatcccagaagagtgtgtttttcctcgcgtagttgcggataatgcttctcctcgaacgtctgaagtaaggagaaaagtcggacaggcagcctctgacacacgtacacctattcaagactatatctctatctccaaccatataacatacacttttaacgatatttaaaacgaatttttttcttaaattacttagctgatctacaattcgatcacaccgttatattcgttataattaaatctttacaacaagatatcgcttgattatattccgatacaaaataatcatatgttttaatccattaacattttttttcttacgtgatagggacatgtttcaatatgtgtcttcagcgtgtttcacaaaattcactcacaaaactaactgttactactctctcctctctctctccacctcatgcatgcatgcatgcattttaactagtttcaaaacgatttttctcttaaactaattattcaacctacgatctgatcacaccgttgtattctttgtaattaaatctttaaaacaagatatcgcatgattatattttgatgaaagaaaaacatatgtttcgatccattaacattggttgttttatatgtgatagtgatatgtttcaacgtgtatcttcatcatgtttcataaactttttaaatgtttcagttgctgatatttttgtttcaccatatataacttgatgtttcacttgttagttaactggaacatttgactgaccgatttttttttgcatgctgcatacacaggtggtgtgatgacgtgtaaacagtcgggcgtccgatatttggtggaatatcggacgtccgatgcggagtcatctcccgtagttgcccgttgccaatttttttctacagtaactacaacttctctgatatggacaaaaatccaaactatttaggtgagtttctgtttatggaagaagctgcagctgttaaaaactctcccaaacatatccaaagatatttcctacgctcatctctaggatatttgtaggtattgtagggctagtttagctcccatagtcccattgaagcgtacgtgcacacaaccaaaaatgtttgctggagcagtggagagcacggaatgttagatagcacctacccttcaccgtcaaatcggaactacctaagcttatcgatcgggtgatcagttatgctaaaggcctgcagctagctagagaacacaaacgcatcgatgagtagtagttggaacgtgccactgcccactgcacgactttagttcttcgaccctgtgtgagtagtagcgaacccagcctctctatgtagcgtgctccacccgtacagtacgcccctccctatatacggatgatcacgcagtacacgctctccctatcgtaaaacccgcgaaaaccacaaccgaaacgcaagggtcgatccatccacgcctatcgcgcgcgcgtgcatcgggtcgatcgatcgagatggcgccggtggccacgacgttcctcccgacggcgtcgaacgaggcgacgctgcggccgtcgttcgtgcgcgacgaggacgagcgccccagggtggcgtacaaccagttcagcgacgcggtcccggtgatctcgctccaggggatcgacgaagcggcgcgggcggagatccgtgcccgcgtggccggcgcgtgcgaggagtggggcatcttccaggtggtggaccacggcgtggacgcggggctcgtcgccgacatggcgcgcctcgcccgcgacttcttcgcgctgccgccggaggacaagctccggttcgacatgtccggcggcaagaagggcggattcatcgtctccagccacctccaggtacgtcacgtcacgtcacttcacgtcgttacgttcctagagcactcgaagtcgacgcacgcgcgggaacggcgacatgtcgatcaccatgtctgctctgttgcttcgtcagagcagtgatcaccgaagatattcctatgccaatgttgactaggttgcaattccaatggtttgtcgtattggcctcggctgctatattttcaaaagaaaagaaaacgaatggaatccttacacaatcctgaattctccaaaaggatctggtaaannnnnnnnnnnnnnnnnnnnnnnnnnnnnnnnnnnnnnnnn

SEQ ID NO: 33680 - DNA, 9312 bp, Oryza sativa
atatatatatatatatatatatatatatataaagtaacttaaaacaaaacgaaagtaacttgtcacgacattagaagtaaatccgttgtggggggtaaaaacatgagtctatctaaaaattaaatgtaattagcatacattatggaattgattaaaaatggtaataaaacaaacaactcacaaaagtatttttttatatatgataaaagtaacttacatattaataaaagtaattcatagatattttttaataaaaaaaatataattatgtaaggttttgttgtaaatatttaattgcaacgaatacaatagtttaatcggattatagatcggataagtaatttaagagaaaattttataagaataaaaaaaggcatacattgttaggtatagacgtaaaggtctctcattaaaacaatacagtgtacagtctctgtgtagtcacgtccaatatatttgtcagtttcaatttacagttttacacgtttagagtttactgtaacgtgcagggtgaagcggtgaaagactggcgggagatcgtgacctacttctcgtacccggtgaagtcccgcgactactcgcggtggcccgacaagccggcggggtggcgcgcagtggtggagcagtacagcgagcggctcatgggcctcgcctgcaagctgctgggcgtgctctccgaggccatgggcctcgacaccaacgcgctggccgatgcctgcgtcgacatggaccagaaggttgtcgtcaacttctaccccaagtgcccccagcccgacctcacccttggcctcaagcgccacaccgaccccggtaccatcacgctcctcctccaggacctcgtcggcggcctccaggccacccgcgacgccggcaagacgtggatcaccgtccagcccatccccggctccttcgtcgtcaacctcggtgaccatgctcacgtgagtactacggccacactgtatccttggtgattttgttttagatcatgcatctcttaggcaatgtgaacttgcagtatctgagcaatgggaggttcaagaacgcggatcaccaggcggtggtgaactccgactgctgccggctgtcgatcgcgacgttccagaacccggcgccggacgcgatggtgtacccgctggcggtgcgcgacggggaggagcccatactggaggagccgatcacgttcgcggagatgtaccggcgcaagatggcacgcgacctcgagctcgccaagctcaagaagaaggccaaggagcagcggcagctgcagcaggcggcgctgccgccgccgccgccgacgcaggtcgccgcggagttggcagcacagaagcccaagtctctcgacgagattcttgcctagatcgccatggacgcagcgcgatcgatgtgtggagtactgtggactagatataagtataactatgctgtctatgcatttgcagcacgaatgcttgaagactgaaataatgtgtatcttccgtcgaaaatcgaagcagtcgtaatactactaatatagtagtaaacgaagtaaggactctttacatgagaccttctttacattttcagagttgtcttttctctatatcggctaagtaatagctagggacagacctcccgcctccctttgtcaaagagagcaaaagggggagaactttatatgaaacatgaccaaattcacttatgaactgaaaaatatctcacgctcatgacctttaaattttgataaggaacagggcaaacatatgcagacgtgataattaactggccaattgcctaccactcggcaagaaatgcaggctaaatggtcctcatcatgcggcccaatcacttggtgcatgcaagtggaacaagttggcccacgagcacaagcatagatcgctgccattggtagagatccaacctgggccgtccatcccaacgcccgatccgttcgttcgccgctcacgaacccaaccccatattccgtgatcttttcgatctgggtgacctgagcactatcggacggctgtcatgaaccaaccccatgtcagcttgtcaggggccacaaaataaaaattacactgtcccgttcttgaggacgcgatcattgcgacaactcaaatcacttcatcctcccatgctttgcagtttaagtacacacgacaaaagaagagataaaaaaccaagctgattactgaagcctctatcagtctgtcaccccaccgtgcaccagccagcagtaataaatcaaaaaccggcagacgagcccccggtttcgaggtgcacgagccagccaggatccccggaaatgtggggcggctcaggtgaggcacgcgacgacgacgcgatcgatcgatcacacgtacgcgcggtgggcgccgtccccgttgcgcttgtgcagtgccctcccgcgcaggcaaaccatcgcatcgcacagggcagcgtacgcgcgcaacgcccgcaatctcgcacccgtacgtcgcggtcgcttgctcgccatgcacggcgcgcgtcgatctcctccggaaaggcggccgccccgcgcccgctcacgcgcgcgagcccgtgacaagatcgagcaggagtagtacgctcccatgccgcagcgctgttccatccgcgcgcccgcagcaaaaaggcaaaggcgccccgcgcccgtcccgactctgtgtgcgcgagccgaaaccgggcaaaactttccaatatcccttaattatacattttatacggtgtgctatgtgtgtgtgtgtgtgtatgtcgtgtgtatccgtcgtcgatgaactccgttgatcttaatttaaatattgtggttttgcatgcacgcatggatgtgcaggcggcaagttgcaaggcgtgacgaaataattcggcagctgatatgctgtaacgtggttcctgtagaatatgtcatcgatttcagtttggaggctccaaattaatgggtgatcgtactgccacacctgcaaaaccgtgagcatagcatagcagcagacgcccggtattttgcaatctgttggctgaacagtattgtcgcgcttgtcatcacggagaagccagaattattccggcccagtagagattatggacgtacaggtttcagtttcactgctgaagtgctcatgtgtgccggtgatggcgagggcccaacggtatgagatggtgaatcctcgtatcgtatcgtcacatgcagctagccagctacgccgaaaaaaaaaagaagcctctctttatcggaaaagaatcaacatagtactactccacttcctagtgtcaaatcatcgtgcatggtgacagattacctgtggtgagaactcaatgacctgttaaactcgacacgatgcaaataaggccgatgtttagttacccaaattaccaacttttcatcacatcacattacattaaaaacttttctacccacataaattactaactttttcctctaaactatcaacttttttctaacttctaacttttccaccatctaaacacagcctaaaccgagttacggcgtactctggatttagaacccgttcacaagtgggcgacctcaccatcaaaggcttatcctgaataatccatacaccagcctgttctggggccacgtacgtgcccagttgagatcagtagatcacctcgcaagggtgcatgctctgcatgacagatcagggtgcacatccaccgggcagacacgccgccggcagcacgtacgagctgcgaggaaagcaaaataaatgtggtgtacccctcgcccgacgacataagaaacgcatgtttcaacactgcaggtctcacgcgaacgcatccatgtatgcgtggtgcaggctgcagccgtgcagctggtggggaatcgaagccaacgggaggactacgtcgcagccgccttctttataaaaaagaaaaagaaaacaagatttgaaaggagatatatccctaaattacgagagtgttaagatagtattgaaactaaatattacttatcactgcactatcaagtacatctcgatgtagtcgtcatctcgctggtagcgaggaagattttgcagggcacgccggtgtgaatattttacattttaatcatttttaaaaactttgtaaatatataaaaaaaaacttattttaaaatggttctttttctcagcattagtgaccttcatgttcaacgtcttggtaccaacaacactaatgttaataccctcattttcttaaaatacttatgtcatcgatgtaaaggggatcgatgctaatgataatggcaggatctatttgtcagtcctggaatctagcacaccgatgatgactgtgtcttaattctgagttcggcgcacgagctgatatgcacgccagcttcgcgaaggttcggcagagtcctcctgccgtcctgcgtggtgaacgtgcgcgtttgagcggttgagccggatttaacggtgaacaggcagtcggtgctatacctgtatagctatgtactcctagctgaatagctgcgtccagtttcggggaaagattgttgatcagtttgggaactctccgcatgtacctgcccattgaaccaggggtaagctatttttacgtttgattccaacctccagaactgagaatactggaacaaaaatgatctatagtaaaagatccagactagtaagagaagactgtaagaaggctaaatgctgatatggatgagagaggagaggaaagagaggagaaacgggtaataagcttacagccggcttagatacataaaaataaagggcttgtttggtttggtgccaaattatgccctaccaattcattggtaattttgaatagtgcttctatatgtttggattggtgccaaattttaccaacaccatttattaggtagtacaaaatctgtccacccaaatttggtagtgccaaaagttgcctaaactttggtactaccaagattttggtagggcaccaaaccaaactggctcaaaaatttgtgagagagataggtggacatatattaatagttaagagctaatcactatgtgagttggttaagaggtaaactgtaaagatctactagtatacagtaaacaactatttactggctatattattagccatgttctaactcgatacgttgattatgctccaggaactgagacaaacaatatcttttgcttttgtttcagactttcaggtgtgctaatgaccaggttagcatccctgtaacatgtgaaagtgaaacatgggattgtaagcattcccaatctcgtgttttcactttacactcagcagtcaggactagagcagtactcgtacggtggtagcacagcaatcagcagcacccagacttcgagaaacgacacaaaccgcttaccgatgccaaagtatcgcctcacctgcgaaacatacacgcacagtcacacactgacacacacaaaagaaagaaaaacaaaaggtgacacatgtcgatgccattcctgcaattttcgcccaactccagtggccaacacctaaccaaactgctatatattccaagtccgtcttgccctcctccaaccaacagctcgcgcgccaagcaaagagccaaagagagatcgaaaagccaccgccgagcaacaaacacagctcgctcgttccgccattggccgccgctcaatcgatcgttcgatcagcctcattctcgccgtcaaccatgtgcaaggtcatcacgatccagtcgctcgtctggctgcgccgcacggtgcggcggtggcgctcccgcgccgcggcgcgcccggccggcagcaagatggagcgggacggcgacgcggttccggcgggtcacgtggccgtgcgggtgggaggcggcggggaggacgcgaggcggttcgtggtgcgggtggcgcacttgaaccacccggcgttccgggagctgctccgccaggcggaggaggagtacggcttcccgtccggcgcctccggccccgtcgcgctcccctgcgacgaggaccacttccgcgacgtcctccgccgcgtgtcctccgacgagcgccacgacctggccttctgccggcccgccgccacctgcggcgtcacgaagcgccgcgccgagtcgtcttcgtcgtcgtcgtcgcgggcgccgctgcttcaagggatggacagcctcgtctggtgatccgcgccaatccgaaagcctcgtacctaagccaccgataagcaaaagcagctgcaaaccgtgcacgcgcgtccatgtcgtcgatcggcggcattgcagctggtcgttcgggcgcgcgtggcgaccgcgggacaagaaggccgtgcacgacacgtacgcacgcgggcacatgcaagaacgcgcgctggggcatgcatgcgacgtctaaagggcgccctcccgtgctcggcgtaatggcggcgcgcgcaactggggcaggcggccggcacacagtactgtagctagctaagctagctagcatagcaagtaggctatagctatctgccatgggctgacagctactacaagatatactaatctgattgagagggtggtgatgattttaggtattcttctccctgtaattctactcggaaattaataaagaatcgatatatggcttattgtgtagtgcatgtatgcgttttgtcgtcgtttgtcatgtgctcgtgatgttgatgtggcaaacttgtctcaacccaaaatggtttggatctttggatatgccatgtattagcctttaaactagtggcatgcctttgtcctagcttctagcagccggaagtccggcaccagtcgataatacaggaaaaaataacagcaaaacaagagctgcagtgaacacgatggacgacggatgaacagttaatgcggatagtttagctagatcaaagtcaaggcatatggacacatatggttcaatatcaatgctagtggatactcacgcgttgcaacaggccattagaacttcttttctttaccgagaattgatttgatgattgatgttttacatacactttgataaaatggttagtatagtttgatggctaaaaatgtgaaagctgctttataacaatcaataatgcagttagtatgttgtaacgatgtaggaaaaaaaatatcttcattccaaaatataacaacatatgatcagatttaaagtttagaaaagaggaagtaaaaaatacaagcggcggagctaggggccggtaaccatgggcaattgcccgggctccaccgccgcacacatcattaaagcaagtttaatagtatagccaactattggcttcaaattatctatagtcaatttaatagccagttcatacgatagttacctataaatatatattacacaattaatatctagtcccacatgtcatacacacatatatgttggagtccgtgctgcagctggctacaaatctgtagctcgttgttcttctctctcctcttttatcttcttaaaatgtgtttatagctggcttatagtctgctattgtacctgctcttagagtagtcttaaatcatggtgcttaaccacaacatacagcagtataagcacactacttggttgggacactttaataatttgtataagtattagagagcatgcttagccacaacatgcagcagtataagtacgttttaataatctgttaatagatgttagacacacaatcatctagagtaacctgaagcaccatgaatgtttactagatcgttgtacctattacttgagtgcaagttattagatgtctacaacctgaaagcaaagtaaattttctagcgtccattatattttttttcattttcaagataataaattactaagtcccatagtctgcaaaaacacaaccatcgttttcctctaaattagaatacggtaaaaaaaattgttgtatggtgcatagtctatggagttatatgagatttgttatatatttgttggcgttgttaataaggcttgcccaggctaacaaaagtttctagatccgccactgcaaaatacatatgtgcatatgcatacctacactccattcttagtctctccgctctcatcttttgctattgctgtctaagggcagccacaatgtgaacataagggtgggttttaagactctaaagtgaaccttatatattgtgagagtagtctttataggtggcatttatttgagctagccatatgtataaagaccacccacaaggagtaaaaaaaatatattattctttcctctctcataatagtgatactctctctccctctctcaatggctaatcttgggtttgtggggtccaccttaatatccactctttccatatacattgtggacatgataatatattttagtgtgatccaccataatagcaatgtagttcatatacattgagcatgccctaagacgtgtaagctagcatagtaaataagtaatccctcctattctaaatattaaatatttataaaaaattgattaaatttaaaattctgtccatcagttatatagtacaaaatctaataagtttatgaattatgataatatttgtgagataaatctacatgtatcatttcttttattttgagactaagtatttaagaaattatcgatcgatagtaagttggtcttggaggagacgaaataccgtttatttgagttgcttcgtatgtgagactagggttcaatttgttggtccaccacaaagtgtgtttccaccctcttgccaacttgtatataagatctgaggttgataacgctggagtcacataatagcagagttggtatgacaattcaatttgtagggaccagattaaactttaaagcatgcaattcgaaccacgtatacgcttggattcggacgtggcaggttcctgtctttccgatccggatacggattaatggtctctccatccaggcatccatttcggcaaatatcaagctcgtccgcagcaaataagcggatgtgctgcagctgtccaactcccaaacgaactgcacgcctgagaaatagcagggctactgcctcatgaaattaatcagctaatttcaacagttggtttaactggtttgatgtaattttggagttcttaggcctgtagtctcacaaccttgtttgttgtacgtaatctatattcaaactcttctttgtcttaatgaagttggccgtcgtttcgtcgctggcctagcggaaaataaaaacaaaaatcaagctaatgccatcatctaggacatgcatcctgccaccgtgtcactgtcaattccacactggattgatcagagtactctgggaacagtgtcgcatacgccccctcgttgcacatttcagctgcacaaagttgagtacatgcatcttattatgctcctaattactaacacctgtcgatagggacttctagtaca

SEQ ID NO: 33681 - DNA, 18594 bp, Oryza sativa
atttcagccagttacactgcactttcaggttcgttatctctgaagattatatccttcgctgccgccaagcatctgcgctcgtgcacgacgcctaaggctcagcgcacgatcacgaaggccgtgtacgtgtcagctcgccaaggcggtgaacatgcacaacccccagaatctttgtgaaatgatgaagaacccccgtggattgagcgactgttccaaccgaaattggtttttgtccttttggttgcgagatcacatcatctagctacacgcaatattatcatctaataaaatgcaaatgcattatgcatgagctagataggagctagctgagtgctgagaggctgagacaagagagagaaaaaaggttcttatttttagagtgttccggaataaattaactcgtcactcatagatgtatgcatacacatgaatgaccagatgcatgaaccgggcattctggtgcttagttgtactaatcgtgactaacaattaccagtgcattcctgcattgagtattgttcttcagattaattaggaaagaccctgagtttctgcgtgttcgctagtgattctttcatattggaagtctatgtgctatccagctgagctgaaaaagaaatgagtttttttctaggcatgttttatatatgtagtatatatagattactttgaaattagctacgagtcacaagaatctagtagttaaattgctatgcagagtcagccacatgctcccatgacacacatggcaccaccacatgtatcaccatggtcatggagaatcatcatttgcaaggcatccagtatgctacttaacaaattgcaaggacgtcaagtgcgtacttagcgttggtggttgacacgtagagcatctgtgaagcacaggacaaaggttgatttggtgacatatgattagcgaattaggaaaaggacgaatagactcatttggcttataagcctacatataaatctcctcctcgcaatgttcccttcacacccttttctattggcgagatcataaaagagaatctctgttcggtgaagcgatttagaaaggggaaaacggatgaaaaatatgattatattttggtacgcttaatcatttggctaatcatttatcgtcaaacaaggttgatagttaaagacgtctaataccattttcaaatgtgtacctgcagctaatcatgctactccacacacaataagattcagtcagaactgggtagttttaactaaaagtgcaaaacatgtcaaccgatcatgcaaccaactatcctacagtagtttatactctgctaaatattcaggcttctttatactctctaaatatttgtattcgatccttgcacgcaataatttttttcagtaaaaatatattttttgttattacatagaagctatgcatgtgtacatcgttgtttataaccacgcacacccaactcacacaagcaaaaacatttctcgagaaacaatatggtgatactgtaatcgcaccagcagtcgacagtagaccaaaattaaaaatttgttcacagaaaagtaatagttcacgtcaaatcgtttggatattgtggaggctaagccttttatgcggtacagcgagaatgctgaatgcatctagacaaatgacactctgtctaaagttagaaatttgaaccgttctttccaatgcatgggcactacttaggctctgttcgttacagagtgacaggggagatatgtctcattttccacgcgcacgttttttaaactactaaacgatgtgttttttataaaaaaaaattctatagtaaagttgctttaaaaatcatattaatctatttttgaaatttaaaatagttaatacttaattaatcatgagctaatggctcacctcgttttacgtatcttctcaatctcctcaatccccttctccttaaacacacccttagagtacaatataacgcaatgtacgacgttgcacttaaattgatgtgaaacatatacaatgtttctgttctatctctcttttttcgcagcttcgctggcgcaaatagcaaaagatgaaaaggctatgtctgctcctttttttttttggttgcacgccctgctgattctttcttctttggcgctttatgacgagacagtcctatgataatattatcaggaaaggttggaggatgcactactagtgcgtaaaaaatgtatgatagtttatgcctgcaaatatatattcttttgtttgatacttagtgctcgcaatcttcctgaatcactggctcgatcgagagaagcaaaatgcagtagcagataatgatcctgcaggccagaaatgaaaaaaatcgaactgacaagttactagtacaccggtgtttggtcaggtattgtctgctacgttgcatatacgtcaaatttcgattcgttttgctttggctgtttacgataagtgccatgttaataagcgaaaattaaacatactagtcatgaacagagaaaaacaaaaacagtggttagccttagtttgtttcatcagcatgattaccggctagagctaaataactactccctccgtactaaaatataacaacttttgtttggatgggatatattctagtattataaatctagataggaggcactatgatgcattccattcaaccaaaaattgctatattctggaacggagggagtagctagcttacttcaccagttgattttctaaaccttacataatctttttttagataatcttaatttagcaatttagaagtatgtaccaatacattacattccttggtgttgacacttgacatttcagactgaaagcaaacgatatatcctacttattgcggccactctgcatgctaattaagctcatatactttgagcagttcttatttttatggtacactttgtagcacgtcatcgtggtcctttgatcgtttcccgtgcatctatggcgatcatcacttggttgacaacagttaacacgaattttaaaaataaatggaagttaagggtgtcatatagttagtcataggatgcaaaagagaggatggcatggaaagtaaaccgtcatcctcatcattctgggctgcaacaaccgttgtagacagcagccaagtatgaaattcctaaacaaattactagtagaagagaatccttactttagtggttcagacttcagaccatttctccttttgttgttgttttatagctttagaaaactagagatccagcctgaaaaggcagaggtgtgagtactttttttggacctcttttgttaaactttcaccggccggaatggatcaggatttattctttaaagcaagttatccttactgctactaaatttgtaataactccaaattaattatgcaagcctcaaaaccaccggaccaaagtacactgtatgtccttccaagtacacccacttggttgccacttgccccggtggttatgccaaaacaatacgacttcagaccattagacgctaaccaagtttggcgttcacattcttatgccctctgtgacctgtggaatggaacatcacctcagctttcctctagggtctaggctcaactggctgaaagagcaccaatgcagccagtcaacgtgatgacgtaggcaggaaacttgaacatatgcggatgggtttttaattggatttagtgagattaaagaaatagcactgatataatcgtgtgttaattgatgtattcgtaggtgtgtcagtggtgctgtgtacaaggtggtgcatgtacttatgcagtcctgtgatcgaaaaaaatagtgaatttaataaaactaaaagtactttgatcaaattattataaaactatagatttgacactaaatttaccataaaactaaaatatcacaaaactacatatttagtaacaaattttgttatcacaaaactataagttttggtgacaatttaatcacaaaacatgaacaattataagtccaacataacattagtgctaaagatttaagccccataattttgtgataattttattattaaacatgtagtttatgatgcttagccttaaacctatagttttatgataaatttatcgttaaatctatagttctgttatatattaacttaaatatatagttttatgatgatttgaccaaagtacctgtactttcgtaaaatttactaaggccctatttagatccctcttcaaaaattttcaccttgtcacatcgaacgttttaacacttgcatgaaatattaaatataggctaaaaaataactagttgcacagattgcgactaatttgcgagacgaatcttttaagcctaattgcttcatgatttgacaacgtggtgctagagtaaacatttgctaatgatgggttaattaggcttaataaattcatttcgcggtttactgatagatcctataattagttttttttattattgtccgaacactctacgtgacatctatataataactgatgtgacacgtcaaaactttacccctagacctacacaccccctatgtgttgacgtagcaggcatgtgactgacaagacggacgagcagctatctcgctcaaactctgaggagatggaggcggttagtttgcgacgaaaagaccaactggtggcgcatgggcgagccaccgtttttccaatgctcgtcgcgcaatcggcgtgcccactgcccagctagcggccaagcacgcggctgcctcccgccgcaccgaagcgcaaaggaaattcgcggcccggctgcgccgcgcgcgccgcaactcgcgacgcgagcctctccgttcattggccaccgatcctccatcatccatgcgtattcctgcgtgacaacttgcggttcgtttttgtttaatctatcgcggaatctgtgggggaaaagacacggtacggaccacacgtctcgtggtacttcctgtcctttctttttgggggggtatggaacaccgttatttggcgcgtactagtacgtgacaaagtgacatgcccgtctcgatgtaaccccgtttggtgcgtgtgtgcacgtacgagtgagtgtatcacttcacacgtacgcgccgcccgtggttcgaacagaggatgttgtcctgatcgacgcatatgcagtatctctatgaattgttattcttggtattttctggggcgtctggttggttggtcgacagaagcatcaaccatgatgaaagttttttgctctcttttggtgtacgtccatgcgatcgaaggtgcgtacgattcgggtgtacgatgagaaaggaaccgttggcttgtcgcgctagtttaattactcctttgctaatttatgcataacaacaaatacgtacgtgcattaagctgtgaatttgcacgtatgctcccttttgttgtcagtggaacgtgctagacgaagacgagtattatgttcgtaggctagttgctggttgagtcaatcggtaacctctgccctctcgtggcaactggcagtgcgagatgtggacttggcaaccaaaacaaaacaaagcccaactagctcgtgaactactatggccaacgcaaaatgtgaccccatatgatcatcaaaattactgcagtattaaactttgcactgcattggttggcagctagcgctgctccagcgacgttgcctgtacgacaccactacctaggcgcccaggctcaggaccagcacgcacgaaccaggggacaggccacattccacgaggtgcacgtaatgcacggcagggcgatgctactggatccccgcaatagatgaccgggcgaacgtacgtaccgaccgacgtacgctcgtaccctgcgaccaaccacacccaaaccggccggcgaaaactgccacaaacgccgtagcatgccggctcgcgcggcctcctccccgccgcctgcacatttacttcgcgcgcctactacggcgtgccgcggcaacagccacggcacatgggtgttggtcgcgcgcgcggtgtgtggggatcacttgcgcggcgcggcgtttacccggggccaaatcaaacgcgcggcgcggcgcgccgcgccgtgccgtgccgtgccgcgagccgcgacgcgagcatattccaactgcccgcgcgcgcgcgggcgcaacggcgacgggctaacgaacgacgacgtacgcggcgcggcccaatccggcacgaaatcctcctctcgtcgccgcgcgcgcggcggcatgcacgtggagagcgcgccgcggccacactctctccactgcacctgggcgagcatgcatgcggggcatcttgctggtattcgtatcgcgttatctacctagcgaatcgtggagtccgcggcggccggtcggcccagccgggagcgtgtacgacgccagttttatcggagttctttttgcatgcaagggcgagcttagctagtcttttggaccatatgtacgcacgcagagcaggtacacgcatctgcgtgatttcagtgtggcacgtgcaacagtagacgctgcatgctgcgatcagtgactgacgactgacgagacgacttgggttaacttaattagccgaggtcttagctaggaaaagggaacggaagcatgcatgtgtagtctctagttgcttacctgggaagcatgtcgatgcttcaggacagttaaccggtatcacggcttttgacagggatcagattctggacggacgcacgactgaaccgcccggatcgatgcttaattttgtcaaagaagatgtaccagcgctatagctagtaagaatggaacaccctatatagtataacaaatccttactcgacaaaaggcttaattagttacactagtagagtgcacatggcggttagggatcgttaaaatgtcgtaatgcacttcctacccactatggatggcattgccaaacaattgtttatcgtactgcaaacttactgaactttttaattgaagaaggaagagcatggcaaccagttagtaagggcccgtttagttcacaaattttttttcccaaaaacatcacattaaatctttagacatatgcatggagtattaaatatagataaaaataaaaactaattgtacagttaggggggaaatcgcgagacgaatcttttgagactaattagtccgtgattagccataagtggtacagtaacccacatgtgctaatgacggcttaattaggctcaaaagattcgtctcacggtttcccgatgagttctgaaattagttttttcattcgtgtccgaaaaccccttccgacatccggtcaaatgtccgatgtgacatctaaaaattttctttttcccaacttaaacaagccaagatgaatcatcctcattttagccaaaatgaaatgcagtatcaaaaagggtggaggcgtgtgcaaataattaagctcgttaggtgcgagaggggacatgcatggcctgaaatctgcggtggagatctttgacaggtacaggaccggcagggattttttccatcacgcaggcgcaaaatctgatgagagatcaggaattcagacagaccaaattcgggcacatgtagcccgattgactgcccgctcagccccggacacagccgggtcacatgcacgagcacaccagtacaccaccaagctaagctaccctgcatgctcatgagttgcttggccaccctgaccacctcactgtcactggccgcagggatccaccacttgagcaagctgatctttttagttcccaaaaacattttcctaaaaacatctatcaaatgtttagatacatatatagagtattaaatataaataaaaaaaaattaatttcacagtttacatgtaaatcgcgagatgaatcttttaagcctaattagggcatgattagccataaatgctacagtaacccacatgtactaatgacgaattaattaggctcgaaaaattcgtctcgtgattttcaagcgaggtatggaattagtttttttattcgtatctgaaaaccccttccgtcatccggtaaaacgttcaatatgacacctaaaaattttcattccaccaacttaaacaggcccaaagtaaacgattcctcctagctcgtctctctgctcgacacagggacaccgccgatgtgatgggacttcgcgatgatgtgagattgtgcgcccagttaagcttaagctacagcttagctacagcgacccacgttactatgtacgacgccgctacgctagcttgcgcgagtcgagtcaccgatgcagcacgacaaatgcgcctcctgtttcagatttgtagcggcgaaataggaagtgagctttgctatagtggccctgaatgcgacgggcattcggctacacgtctgcaagatgccaaaatgtgctagacactgccttgtggtgcactctgcaattcctgtttcagaaagttcacaagcagtccgtggtttgtccttgcatctccaccatttttcaatgtgtgtgatgagcttattagaaaacataagaaatattaagttttgatccttataattgggctcatgttatccacgcgaaaagggagtttgttgataagttggagatggaatgccgtggtgcatgagtaggatttcttgcgagacagccaattcgttagtacaaaaaaaagaaagacaatatgtacacatgacatttggcgccctgtttcatcatgttttaaaaattaaaacacactgaaaatgcaagtgaagtcatcaattcgtttttatgcatactatcatgcatgtatgatgtatcgctgtgaacataaactaaaaagtgacacacaaaatttaatggctagtccaaggtacaaacaagaactatatcatggctacagttttcggatcctattcttagacaaaatagctacagcactctagaagaaaacgttcagatcacagatcgaccttcattggagcgttgtgaaagaggagtaatgagcaatatttatagatgacttacaaaattttgaaatgaaaaaaacagcacggctatatcatcaaccacatgtccttttccgatccttttcttctaatatgttgtacacttttttccagctggaattatttcatccaaccaaaagctcctccctccacatataaatcaaacctcttcttagacccaactcttgcaaattatgggaagaatgacaaaaagacatgcgtgaatgtgctgaccccgtgcatgcaaacgtgtcctattcccttttgcaagcgattttaagctttaactttcagcatatatatttttataggtagaaaattttgttatataaactttatatttttatagtataaactttctacaaataagattttaaagaaattataaaaaatcaaaacatttctactcaaaatcatgaaagtttatttgaatagttgaaagtttctactaaaaaaatcaataactttcaaccaaactaaaaaaaatctactcaaaatcatgaaactttcatatgaatatttgaaagtttttacttaaaaaaatcagaaaccttcaacctaaaatagaagggtgctaagcttatatgtgggccagatctaaggaagaaggatgtaaggaacctcatcggggttgcgatcatgaagcacaagtctagttcgaaaaggaggtagaagcaaatgcttgggatctttatcttggaggaagatgaagaggacctcaggctagtcgttgtctcgccaaagacgacgagaacctctaatgtgttgtggcctacaaggcgtaaacctggttgacgacagtgaagaaggggatgcaacgggaaggatgaagggggaataatgggagaggctagatttggtttcactctcttgtgttcacggagaggaacaaatagaaagagaagaggaatatgaatatcaaagactctagccttaatagatcacaagttggaagttaatagatcaccaagttggaacgtgttcgctcgttaaagtgacttgggtaagttcggcaattagctatcccaaagaatggtgcatctgtgggaggctaaaaaagaatttgattgttagatgtgacttaagtgttatagagaaaaaatttattgaccgacattgcgagtcagtctctaggaaatacaaacttccaatttaacaagcagcaaatccatacacatcaacattccattccgtcacttgaataatttggtatgtacaaacgaatatcaaaggagggtccaacaaaaaaatgaatatcaaaggagggagtgaactaaggttcattgtgacacatgttacacataattattatgtgagtggtaaattatatgcacattgatggtgatatacatgtgatagcttcgtctcaagatacattgtcctagttcctcaaagatagttataaggacatggtataaaagtgtatgttcataagactaacatatatataagtgtctgtgtttatactatgtatcgaaaaaaaggaaatgataaaaatgaacaagaaagcttacatttttttcacctatggaggaatggagcataccgtagaactcaattgaaattattttccttacaaatgggcttccctaccatagatagacaacatatgcatgcatgggcaaactactaatccaaatgaattttccaatgtttgtttcctatacataccaaacgatgattcaaaaatcccaagataaaaaaagattaaatacagttttcactttatagtaatatatcatgtgttacatcactattaaattaatttattttagggacgaaaggagtataaaataggagaataaagtcacatctcgccgtagtattaaaaaactttgcgagccaactggacgacccaaaaacattttcccagttcgtctgtcccgtcctataaaacgtcccgccccgcccactcgaaaagccagctcctccatttcaccaactcacacccccacacacgccattaactcacccaacagcagctagccgagccgagccaaccaacggacgaacacctctctggctctctcccccaccgcgtcgtcgtcgtcgtcgtcgccgatggccaaatgcagcaagatccgctacatcgtctggctccggcagacgctgcggcggtggcggtcccgggccgcggcgcgcgcggcggcggaggcggtgccggcggggcacgtggcggtgtgcgtgggcggggcgtcgcggcggttcgtggtgcgggcggcgcacctgaaccacccggtgttcagggagctgctccggcaggcggaggaggagtacggcttcccgtcgggcgcctactgtggccccatcgcgctcccctgcgacgagggcctcttcgagcacgtcctccggcacctctcctcgccgtcctccgccgcgcggttcgtcaccctcgaggacatccagagcggcgccctctcctgctgctgcgccgccgccggcgacgccctcccgctcctccgcggcattgccaccgacaaggccgtgtggtgaatgcgatgtgtgatcccacccctagctagccgctccgctcgccattgcgcgtgcgtgcatgcgcgcgaccgttcttgccaccattttttttttctcttctcttcttggcctcttttttcccctctccctccatggccatttgagaggagctgagactcgccggagcaagagaaagagagagaaatcggcgaccggccggcggtggcggtaaagtgagatggctgagaaagtcttaggattttgagacggccaagtctagtcatccattcccttgtcaaatccgggaaaattatttagcaccggagatttttattctttcttcttcttcttcttattttcacttaataattcgccagtgtaaataactgtactactgcgattattctgccaccatttcaagtgaattgaaacattctttctttacaaagcctcactgtctcttaattttctttctactgtacggtcctgtatgtacttgctgctactactactacatttctgtgtgagctgaagcttcttactatttggaccgtacggattattagggggcttaattaaaggtagcttaattagaaaaggatttgacacggtatcttctccttttgtgggaaaattaagaatggagcaggagtagtgcaagcttagtactggagtagaatatatgttcaagctgtcgctaggctgtttgcaatggtttaggtatgcattatcatggatgcatcgaccagctaccgatcggaattatgggctgataattgatactgcaacttaagtattcctagctactgctatcaatgttgtgtgcggtagtcaactattttctgttcttttctctgggactgaaaattaagcgacttaaattatccctgaagcctgaagatatcgtcaagctcttagcaacagccatagttcagaaaagctgtttttttagaaaaaaaaaacattttgatctactactttctagtcgaatctcaacacataacggtatggccgtccactttgcaccgaacaggcgaaacactgaacctgaagagagcagcttatcatttagtggtagtcagtaaacgactttgtatattgcactattgctcctagagaagatcaggttaattatgcagtggtagtatgcaaacacctctcaaagattcccctttcgaatgttcttcctcctctctctggatgattatttttgtccgtctctccttaagattactagattttcagcaggttagcctgcaaaaattcggcaatcagggaggaaaccgttttatccagtactggcccccggctaatccagtccaattattacgtggacgaaaaaaaatatcgtaaagttatgagctactcctgtatgtggggatggagagagagagagagagagtgtgtgtgtattcagtattctactgtgtaggctccgattgttcgagctataagccacagaaaaataaacatggtaatataaataatatatgaaatacaatttatatttgtgcgatccaaaagtaatgtcaaaattagattattgtaagacaactttcaaactaactttatagttaaattttaaaattgaaattttggttgtaattgacaataaactaataacgagaccagaaggagagggtcacttcagtactgttaatacggtagtaaaaacactgatgtgtggatccggagtggagaggatctgcatcccacttggtctacgtactccagtagtactcctattttttactgtgctgccgctgccgctgaaatggatgggtgcgattcggtggtgggggaggggaggttgagagggagggaggggcgcgcatgtgggccgtgggccccgctgcatgtgtgatgataccccggcccgggacggcgcggtgtggaccagcagccgcacgccgttgccccatcatcacctgcttctgcttgcctccgagtccgtagtcctttgcggccttttcttttttgcggtttagtcctttctcctccgcctttttgtgccccgtcctttctcccgtcctcccttcttcttctccgttgcccgatccgttccgttccgttctcgcgaagcaaaaatgcaaaactgcaagagtcggggcggcagccggtacgcctgcggcgctacacgtgcggctctggacacgtgggggtaggacatacaggcggcgacgttcctctccgggtaaatacggatttacgggcggtgaaatcctgtatgacgtcaaatttatttatttactccctccgtccgaaatactccctcctttcaaaatgtttgataccgttgagtttttaatacgtgtttgaccattcgttttattcaaaaaatttaaataattatttattcttttcatatcatttgattcattgttaaatatactttcatatgcacatatagttttacatatttcacaatttttttagaataagactaacggtcaaacatgtgctaaaaagtcaacggtgtcaaacattttaaaacggagggagtataagggattttaggtggatgtaaaatcccttatatttcgggacggatgaagtatttgttatggcaaattttatcaaaatgtactcaaaatttatataatttatccgtggacatctaaaaacctgacacggttagaggacaccatataaaattaaaaactagtaatttgatggagaatatcataatcattattctattattgagtaaagcacatgaacgatatctaaacttgtacggatgtattatgtagatccctcaactttcaaaacgtatttttggtaccgaacttgttttgggtgtcatataattctaaacgggttccaacccactctatgtactaacgtgacatgccatagcggtttctaaatgacattttttttgatagattaggaatctaaatgacatacccgcataattttaagaaccgtccgtgcacttcactctttactatttttatccaattggagagagatttttaaaatacaaaaaacacccttgatccatgagcttctaacctgtcacaagcaatatgatatagttggggtgatcacaggttgcgaattgcataatgtacggtttgaaatttttgggaaaaaaaagaaaatttcaaaaaaaatttgaaaatatagataattatgctaatattttaagaaaaaaacttttcatcctgcttttgattgaaagcaaataagtatgatatagttatatttaaaaggtttgaaaaaaactgtggaaagttgtatagctaatcccacattaaaaccggcataggattccactaaaaagaccgacgtaggaaaagaaacagaaatctagcaaaacagaactgaaaaaaaaaattcaggctcacacacggggcccacaaggcacgcaacgtcacggcccacaaggcccactcagcccacgccacaacacacacaagctcccacaagtcccaaccaaccctagagccgcgccgcctcgcttctccccgactcccgcgtgctcgccgcgccgcccaccgtcaccgcctggagcgtgcgaaagctcgccggtgcggtttctccgctcaggtaagtccacctgctgcttccgcccgcaccctgtaatcttcgtctccgtcggttcttgctgaatcgccggccctgccttgcagcgtgaaggatgaggaagctcaggttccacgagcagaagctactcaagaagaccaacttcctcgacttcaagagggagaaaggccaccgcgacgccatcgtcacgcagcgctacctcctcgtcgagagagacgactacaagaagtactaactcatctctctctccagagtatcaactcgtaccttatcggttggttaaaggattatctgtgtgttctttcgcgttttactgttcatcctgtccatggacatggatttgctgcaaatttgtgattttgtttttgggtggtggcaggtacaatggcatatgcctgatggtgcaaaagctcgtcaacattataaagcaaatggacccgagagacccttacagagcggagatgacagacatgttgctcgataagctgtaagtagcctgttgcgtggtctgcatacaaatttagagctggacagttacgatctacaattccacatgacccatcaaacacgttaggcacacaaatttgctgtttgctgaattgtcatagagtcagaatcgagattgctcagggaaattcagttcctgtatataatgtttcagagaattttatagcatgtcaactaattcgtgtgtttgaggaggggctgtgtgcctgtgtctatttttgaattaccaaattgattggatttgcaatcgaggctataaagtatatacacatgactagtttctcagtagttcatctgcttcttgtccagggacataattgtttcgataatcctgccaaagatttttcgaataattctcgctcttatgtttggatacgaacctcggtagtcctcttcttttttactcccaacattttgagcttggactggactaaaagattgatagacttgtgctaagcagaacttataatctaatgttactttctgcaatggattgcctatgcttgggtacttcatatagaactgtgcactcttaattttgtatgcttttcttgtttccagttgtctagccatttccagattttgtactactcatgtgtagtttgatgaagttcatgaaatttcaggtacaacatgggtgtaattccaacaaaaaagagcctgttaacatgtgaaaaactttcagtgagctccttttgcaggtcctttctctctctctctctctctctccatgtatatgtgctgtgtagccatcttttaccatttagtggcaaatgtttactcatctcagttcaacaattgttaaattgcacgtttcattggtcagctgtatgttaaagtgttgttgtaccactgcttcaacataaatgagacttaccatggctaaccacttaacaaacactataacctcgattagcacacaagactaaagttgtaggagatcagacatatcgtacatcacttattgcgtgtattggcaaattattgcaggcggaggcttgcaacagtcatggtgaagctcaagttcgcggagcaccttaaagaggccgtgacatacatacagcagggtcatgtgcgtgtaggcccagagacagtcaccgatccagcctttcttgtaaccaggaacatggaggatttcatcacctgggttgactcctcaaagatcaagagaaaggtccaggagtataatggtgaattggacgattttgatgctatggcttgagaatatcgttgagcagaatttctgggtccatcggggtagctactcgtgtatgattttttttttggaactttttaaggtgaggtcgtgatttgctgcagagctacttgcatgtgcattgttgttgtcaatgttgtgtaatgcagctcaacgcctatgacagttcattcacttactaatacaattttgtagccgtttctctattacagtagcgctttgcttatgttcttgagtgtattttcctgtcacattacaacctgattatgcaggataattctcatggtcagattcatcgactttcatgtcagtgcgtggccaatctaggctacggattacggatagatggcccttgcttactctttgatgttctcttagttgtgttcgttgggatgtgttgcctatgtgcactatagttgtgtgcacaattttttcgctgagttcaaaaaagctttcattatcttaaaaaagtatgtggagactgagtattatacgctatatgaaccagtagcagatggcgcatactgcaaaaaaagaaccgtacttgattccaatcttcagtatttgtttactgcacattcaggcactataaatttacaatggtgcacgttatgccattcagcaagaagctgcatgcacattcaggccatgcataggtgttacttctaatacagttttcaagccgacattcaactggaagcatgagacccaaagaaagaatagatagctcctcacacacaaaatggattttatactaccatcatgtcctaaatttcagttcacaacactaactatgaatcttgagattcttcatcacctggtaacgtttgagaatccctactgcattttgattcttgcatctcgacctcaacagtagtcacatcttttgccttcccattttctgtctccatccttcttaccttctccttttgtatggctcgtagctcatacctacaaataaaaaaaaaaacagaacatatgtttcaaatgttgatgctgttaaattgtctatggtaatagggactaggagaacatgtaaatatgaaattcatagacttctgcggataacatttgaaatagcagcctaaatctatgaggtctttgcacatcaaatatcagcctatctcgattgcataggtggaagcagataatgagcaaagctgattgcaaagtctcacgaggctacagaggagttaactgtatatttggtctagtgtttacatgcctgtctataattttagcctggatcctgtaacttcagcactcgcaaggatgaataattcattttacctataatttcacctatttgaagtatatgcctacaatacctctaaatcttaggacatataattcagaccaaacaaggatgaataattcctttttttcaggataggtcatttaggtaacttaagttagtgaggtacaatggagaacaataaccttccaacattccatgataattaacaaaatcacaggatgtaaacggcaattatatctggcagaagcactacttcaccaagaagatagcaattaatgggcaatctcatgtttttgcatactcatcacttcatcaggtacagcaaacccaacttcttaaatatgtacaagggctcacatttgatgtaacttatctgatgagatataaattggttgtgcgtaatggtaagtgcaaagtaatgtaatgtccatagtttataattatgtactgtattaaattggattagaaggtaatgcataactcattgaattatgaaggaaaaagtgagatgctactctgatgttagcttgtgttgcatatcaatactcataaactaaatttacatgacgataatcgaaataatttcagaatggaagcttacggagaagtgtaactcttagcgagcagaaagtatatcctccagaactgcttatccttcatgtggcgcgggcacagatcgtaccggatcttggccaattcctgcgcatcaa

SEQ ID NO: 33682 - DNA, 33224 bp, Oryza sativa
  unsure (1)..(33224): unsure at all n locations
ccagctcctcctcctcgttcccggccgcggcggcggcggcggcggcggcggaggaagcggaaggtttgctcgggccgcctccgcctccgccgcctcggcggcggaacggccacgagaaagaggagaaggccataggggggacgagctgcgtttgcgcctcgcgatggtgaattcggcgatgggttggagaggatggccgcgaccgcgacgattcgattcgctacggcttacgaattcgccgagtcgtaatcagcagacgcacacaccacgcaaaccgttctggaatctggaggatgatttcgacgaattttgtcttgtgccttgtgccgatggagtttggaacgggtttattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattatttattttacgaatttggccgtgtgcttttatttttcagagaacagtaacagtttcaaagtaggaattgggaaaaacgttcgactgcaattcatttcgaggtagatttacaacgaggttcagtaagtttcaaagtaggaattaggaaaaacctgcaactccaattcagccgctacatcaaggttccaaaaccgttcgctgatcaagtactcaacggttgtccatttttatgaaaacgatttgaaaattgcaaaaatagatgaaagataatccagggcagtttagtttgacgtcatgaattgaattagttcaccagggtagtttttgaactcgagccgaagcgaaaaccacctgtgtgcacccatcagcgctccattgacagccgccaactagagaacacatacgataagcctcgccaagaaaacctgtcctagcaacttgttaggtatcaattacaatgttgccacaagccgaacaaactaatggttttgcgtcaagtaaacatttactagaagttaatcgtacgacaatccgcatcacaaaacatgatgcaccccatgaaacattgtatataagatcaagatgaaagctcaagaggtagtatgacctaagctcacagaatgtaaagtttgccgttgaccttatcgtacatgaaataaacatcgaaagtgtaaaaccaaggtcaaagacaattggttcaaacgccatcatgctaacatgtcacaattcttttggcttccactgggtccaaaatctaaggcaaataaagcacattcagctcccagcagcactaggtatggcggttggcttcgaatcctcggctttctcatgctccttgtttagcatctggaatcaaataaaaggaagtcttacaataaatgacaagtatctcctaactcccgcatcttctatattcaatagataagacagaaacaatttaccttgttattgatcaagttatggagtgcgatgacactccggataagagaagacaagtatatgaccaacatcatatcgtttgttttaactgcaggaaagaacattagcatcgaaccattttaagataagaaacccagacgacaggttcagctcaattatagtaaattggtgagaacatgtgttattacctgcaaaggctttaataagctcgtttacattgagattggggagcagattaaacacatcctgtgatttttttaaaaaataaacaggttattaactgcatcagtaaaattgtttcagcaacagaactttgaattatatttaaattttgtttggcaagttacatgtagtaaactgtcatgaccttcattagtttttttagacatgttgtgtcacagttttcttattaaggtagtgacaagctgagtaaaaatattagacaaaaaaccaacaaatcataaaaaacatacataaaacaaatttggccatccaaaagatcccttatatctcgcgtccaatgtattgtgaaaactaccagtagcatcacagggaattaccagtggcagcatattccactttgtaagcaacttttaagcactttttttatttgatttgggagtgatatttagtgatactgaattccgaacaaccacaataatggaggtgtatatctcaaaggcacaaatattccataaaaccaaacggcggtagcatgagatagctttcaagtgctgacctcaataatatagcaaatgcaagagaattggaggtatatgtaactcctaagaataccatacagaaagcaatgagtagaaggcgaacctgcaagtggtacaaaatctcatgattcagtgggagcttcccttcaattacaagatctaagtacccacggatctccctgagccttgcgtccagtcctttcaaggctgcaagcttgctggttacctttaatgacaacaatgataaaggatatattagggcataataaagcaacttgtaggctgaaaatgcatattcttgtgaaatattacctctgtcgcaagcgtgcttattgttgtgtccttgacatccctcagaagatgctcaactcctataagtaggatgaacatacatcagtcaacaatcctttctgaaggaaaaagacttcaccacaaaaatattctttcctcttggtgaagaaacctcactagcatcaacaacttaatatatttaccgctcaaacaagctaactattatctgtaacttgcaaaatacataaagcatccctttttcctagtaaaaacagatgagacagacataccgatttcctcaacctcgtgggcagctatttctgaaggaacatgaacaaacaccttttgacttttttgagtagcattctgtaaaagacaacatgtacattaatgaaacagaacaagacaatggacaagcacaataaacctccagcttcttagatcacatgctaacctctttaacctcctccacagcatagtatgctttggtgggtattcctaactccttgggttgaacatcaataatcaccaggacagggttaggaacatagctacaattgagaagcacaagaactaagttagctactatgaagggtaagcaccaaaataaatatggcacaagcatccagggacaaaaacaaaaaggaaaaaaaatactttgaaggggggaaactacttccactttcattaacaaaaattacaagcacacttaataaaaagatacagaaggtaatgtttcaggtatactaacatcacctattaaactcccatgccaccaatatgtgcgaatgactttccaaacacataaattaatttgagggaacaaattaactacaaaactgcttttagttaggatgatgctttagttagcaccaagctgttcatatcagttcattatgttcgtaaccaaaactgatcaggaaatttccatcggccagggtagcagataaggttccagcaagaaagaaaaaaaggggggaaagataaaaggtgttatctatgatgcgggactagctatgcacttctgaggagcttacagtccagtgcagtagggccacagttttatgcacagacaacattcgacttgctctcatgttaacagtaggaagtcaaacagcaattgaatctaggttatatataaaacagttccttctgttatactagcaagctgaaaagtctacagtgctttataacttgggtgccagacaatttaataaagattacttgcaccaaaacaacatatctagtcaagaatataacttcatgaacaatacaggatataaagcttcggtacatcacatacttattgaatagtgcgtgtatatccaagtcgttctccctgagttttggaccggtgctgtaccagccaacaacatgctccttggctacacgaagaacagctcgtcagtacaacacaatcagttacacagggcaggtcaaacaaatggaagacttgcaaactgcataccgttgatcctcttgaacatggaaaacatcgattcgtggtaattatgatcgaggaaccagatccttggatccttgtcatcctcttcaaacggcactgcaaaaccaagtgccatagcatgctataaatacagtaaatcgtcactggaatagaactccacagatctaattgtgcaggttcaacgcaattcacgccaatagatctaactatacccacaaccgccaccagttgcgcgaaccctaaggcgaactagcagcgcagatcccttggaaacagaagggggctgatccgagacacgcaaaccctagtactgggggaaggtttaccggcgtaggagttggtgacatcgacggaaccgcgggaggaggtgccgaggagcacgccgacgacgcgcttgcgggtgtcgcgggcgacgcggttgtagtggtcgacgatgctgagcagcaccagcgggtgcaccaccaccttctccagcgtccgccccgagagctgcgccgccttcaccacgtccatctccgccgccgccgcctcctactggtcgccctcctcctcctcctcctctccctcctacttcctcgctcgattccggcgaagaaaccctaacgcggccacagatctgcggcggcgcggcctctctctcctcccctgacttgtgttgctgctgcgacggccgcctctgcgctttgcttcccctctttttctttctttcttgcggaggcggaaggtaggggtgcgcctcttcgaaaaaaggatttaatagagggacggaaacggaaaagaactcggattgaagcctcgtaaaccgttcgatctcaagtggacggtccagatgaagctcactggatcgagttgggctttttggcccatgaccaccaacccaaccctggttcgccttcggcttcgggtcggttcggtcgctcgtctccgtctccgtctccgccaccgccaccgccgccgccgctcgccggaggctctcgcgcccttcctcgaggttggcatccccatctgtgcttcgtccaaacaactgttcatgtttttcccattccgggtatagattctcacctctaactctggttcattctgcaccctaaatttccccaatttgcatctcgattggttgaatcaatgcccagatctctcgccggtttgttgaaatttagttcgtattattgccgcgatatctttaacacgatagccatctcaatcaggccggtaggcgcttgcttggcggggccagaaatttttctgagcctgggcaagtctaccgatgaacacaacttaacaagtgcttgcaaagaccactcacacaagattcgccatggtccctttcatatcaacttctcagtatgaaatttgagcaaagtgttagcacaggtgaaaaatccagttcagtttgtccaagtattttgctcctgctggtatgcctttgcatctgcctgctaattaagtagccaagcgcccaaataagatagtctaagcatagagtcatgtaccatgtgcctgttgtgtacttgtgttgctgcacgccctgctactctgctagacacctgctgcccgcgccattgcgccaacgtttgctgctcaaccgtcggacgcacgcagagcagtgcaatgcattcactgctgcaagcgaatgagccatttaccctgggcagctgcccagggtggtcgggcgcgaaatccgctccgcttcttccccctgttccactccctctgcttccttcttccttggcatcatctctatggtcctttcatctatgggattgatgtcctgtgggtaggcgtgggggttgtgaagtgtgggtaatggtctcgtgggcgtgttcaacattgaattggtgcgactgtactagtcgacttgtctgggttttatatcgtggtaagtgatcacgtggtaatcagtcaaatcggtgcgagttgtccttgcatttgttttggtttgcaatttgcatctgtaaattggtagtaatgggagtaactgattagttttgctttttgatgattcagtgagtcaaattataatctcttaaatgtaatgtttgtattatgttgcaagaactgcaactgcaatacctacccagaagatttgaccacagattcttaaaacaaagtataaatctgaatgaaaggggactggttttctagcgtgaagatgatttggtttccattttacatgtaaacaatagtttcaaattagattcagtttattgagcttaaggaaacataggccacatcaaaagttgtgattctcagattctgtgatgtgacagcttggaagttgagttggttccgtacctggcatggccacatcatcagcatatcctccacctcctccatattaccgactatacaaggattacgaaaaggatccttcatctgcacctgaacctccaccgccagttgatggaccatatcaactcttcggtgctacctacacagtatgttgcttattgtactcttctttatattatgttgttacatgtgttaaactgactatgcctttgcctatatgctctctagacagatgtggtgctcccaagcttagaggatcaaggtgttcgtcagctttatccgaagagcccagatatcggtatgtgcaactcctgactgcatatttagttcaatagttacattgtgacttgttaaaattattcgggcttctatggtaagcttcctacacttctggccatactgaacaaatggtttgtgttgttactttcagcactaaacaacttttgtattctttgatttaacgagctggctttttgaataactgattatctgcagatttcaaaaaggagctaaggaccctgaacagagagcttcagctccatattttggagctagcagatattttagtggaaagaccatcacagtatgctcgtagggtagaggatatttcactcattttcaagaacttgcaccaccttcttaattccttacgacctcaccaagtaagagactcagtttttatcccacagtatgaatgattgtctctatattcgccaaaatgatttcccttttcaaaatactttgtaggccagagccactctgattcacatgcttgagaaccaaattcagcgtcggaaacaagcaattgaagatataaagcagtaagtatctttagcttgaaaccttgaatagggctgctaactaagaatggctgttgaacttcaatgatcatgcatgctgttttagaacaaatgccgacttttaggctcagatcaattttgacctccaacccttatattatttgcgaattgtgcaacttacattcctcattgaaaaccactccagttttcatcctatgtatcactgatttggatccctattggcacaaagcacgtgaatcactttcctgagatttatacctttcttgctattgtttcgcaggaggagagaggaggcacaaaagctacttggggaatcactgctaatcttagatggaaaccagccgagtttgcctgcaatgtgaagacatgtgatgtatctgcttccctgcttcctaacgtgccaagttggctagctagagagtgcacttggcagttcacctgtagaaatagtctagtgagtagtgtgaccgtgggagatacttctggcttttgtgcaaactccttatttattgcctgtttgtgtgttgtgatttgtgaaactttaaacattgaacctatcctggacttgacggtagaaaagcttcaatgttctcctgtaatgcatacagtttcatgatgtttagaacctatagttctgtttaattgcttgacagttccattattattttttatctactctactagtagaagactggaagatttttttttagtgggggaaatccaaatacatgggtgaatagccaaagtggtcctccaagtttcatctaaggctcagtttagtccttgatatttcaatctatccatattagtccttcaagttttcattttagttcaaatatcctcgaaccaacaactctcttgataaatgacacttatacccccatcattcacatatataagagaaaaattgtatgcttgatttttttattgataatatatagtaaattatgtaaaacgaaaataaattaagtactagcaagtgtatacgatagtaattgcttatgttttatgtgcacatgttgaaataatgggaagtatatctgcaatgttgtttattcatcttggtttctcccttctagtatatagttgtatataaattaagggcaaaagggacattttctaatagaaatattgacttaaaaatagccatatggcatattaagtgggcccaaggatgatgtcaagccaaaacaaatatttagatgagctatatgaacaaaatgaaacgtgaatgaccaaattgagccttcggtgaaacttgaggggcttaattagctattcaccccaaatacacccctataagtaactgatctttccaatctcccacctacaacttaattgatagagaacactccttacaagtttattagtttcttccaacttcccacctctattagctttcagcaacttcttgcgctccataggcctccatttggtgattgaagttatcccttgccacaaaaggtgtgtgtatttcggtctcctttcaccttatgcttttgtactctttaattccatagtggtacggtggtaaaaccatggcggcaaacacatgctactatagaagtggtgtataaaatctcaagcctaataagaaaagacataggggcaactttgctcaccacgccggagccccacatgctgtgagaagttgatcagtacaacgagaaattattgaaaactagatagaggtggaggttagaagagaaaataaacttcatggagagtgttctctaccaaattaagttgtatgtgagagattataaaagacagtgacgtgttggagttatttggagagaccaatttatagagctagaaaaaaaaaggattcgcaatcattgtgtcaacatatttttcccgnnnnnnnnnnnnnnnnnnnnnnctgtgatgtgggttgagattcgtgcttcttttacacgggtccaacttattcatacatgtcactgccaggctgctgtctacttcttccgtctcataaagaatcaatctagtactgaatgtgacatatcgtagtaatatggacaggtaatctatctccttaatttttcattgctcaacaaactcatgtcacgtcatccagggacagagaagtcggagaggagaaagaaaacattggaaggtgaatatgagaattactagtatctaatcacacaatagttactcccccctccccccctgtgtccttaaaaaagtatttaatcacacaatagttactccccccatcccaaaaaaccaacctaggaccgaatgtgacacatcctagtactacgaatctagacatacatatgttcaggtttatcgtactagaatatgtcacatccggtcctgattcgttttttatgggactgagggagtacattatagttacgttgtagttatatattgtagttacactgtagctatataaaagttacaagataaatacagggtaattacaatgtacatgaatgcaattatggagtgaaaatattttgactattttctagtgaaaaatatgatgtcataaatattgctactcccaagaagataagttactttatgtgttctggcttgggccttccgtgtgaaactgggtccataacatgataacgtggacgtgcaggcggcccatagacacgggagcccagagctcagacagaaggccgaccaaaccgagccgggtaaaagcccctcgccgagctccgctgcgcgtgtccgtgtctctcttgactctcctccgcctcccctcccgtccctccgcctccatggacgcctacccccaccaccgccgcttcgccgtctccggcgacgcccccccgccgccgccgccgccgcagccgcagcctccacctccctcccacgcgagcccgcactggtaccccgggccgtccccaccgccgtaccctccccacgccaaccaccctttccctccccagcaccaccagtggggaccaccccaccctccgccgccgctgccgcagcagccgccgccgtatgggtaccatccctccctccctccgatgccgatgcagccgccgcctcctgcggcggggaatccctggcctcctcaccacgccgctgcccagccaccgccgcccagctacccgccgccgcctccgggccaggtatgtcgggggctatcctgtttcgttttggagtcgccgttggagactatagtaaattttctgttagggtttgtagttcaggatcgctgttggctgtagggtttctgggaagggtgtgatacggtgtttgattagggtgaggtgactataactctagggtggttttgtgactgtgtgaaactggtctgatgagtcactgagggatgattgtgtgaatagtgttgtccttgtacagttctcacttattcacaatggagactttcatatggatagatcatctagggtgaaggtctaaatcatcttttagaatgcattcaataaacctcctgcacttgttgtattttctttacttcattttggtacatattctttgtggcaaatccttagtgccttggaacaatttggttccctttagatatgatgccactccttcatgagctttggttaggtgctcttggtgaggttacattcagttggcttcaacatccaatctaaatgacataatgtttcccatgaccctgttttcttatctgttcttttgttgaattcaaataatgttttgttagttgacattgcttatttcctagggctgggccaatcattcgtgggctcaaagtcatggatacgcaggtttgtcattagatctaagctttatgttcatttggatctaattttattggtccagtatgcttgacaaccggatgttaatgaaacttgtgttgttactgatgcacagcactggttgatcattatgatgcagcatgcatctttcaatgtttaagctcataacactatgcatagggacaaatgtttattgaatgtacatgcgtttcaagaattttggggagtgtaagttgcctttaagtttttactaaagtagtcatcggctcatcgctagcggtgatcaaacaagtatccactatgccatctggagctattttctgcccattcccagtatgtattagtaaatttacatgagaactagcgtgtatgatgcacatgtttcccattatcccttttttctgaacttttgcttataaataattccttttctgattcaccaaatgcataggcttattagatgtatttatggtctgtgcttcaaaagaattcttacatatgtttgataataagatggtactaattgataataagatagtactaagctttcttggagcagacaaatcccttacagtaagaatgtagttactgatgatggttcaggattgaccttttcaatttgttttttctccccatctggaagggcatggaaatgaggaagattgggctacaaaggcgaaggcatgggctgctgctaaatctgttacagaaaaccatcatattcaacagcatgccatatccgcaaataggccagaagttcataattacggttaccaggatcagtatcagcaaccagctggtctgcccgcagaacctttacgcccgccaatccctcagtcaagtaatgaccagttgccatttcaaatgacaggacagcacagggaaacaaactatctgccaggtaccatatcttattactattgctcaatatatgttatatatggatatgtcagttccagagtggagctgaagataatattgcagatggaggtccattggcgccaccagcaaagaactttggttcatttccatccgcctatgagcaggaggtatcttataattatccttctactccaggtatgcttgcttggcaatataacttactgtgtagcctgaatcatattaaggctggtccctcctggtaataccttcagattcaaatatggaaagacttgcaagtctacagagctatttatttaagaaaaaagagcatatgacacacgttaccttctaaaaacatttgagctagcgttattgtttgtgtatgctccactcttcctatatttgaggcgattgcttggtgggtttcaccacctcgaaaggaggaatacgcagatatctactcagaatcactttctcagtgactatgccattttatcatggattcaataattacctctgatatatcatgaatgtaattgaatgtttggttgagccctttttactttgaagcactgaaaatcttcatttctcttgctgccagtcctggaaattagatggaaatcacattttagaaaagctaattactggctggctgtgctcaatgtatataactcagtgtttggatggggtaacctgcattttttatccaggcttaatgctgactatgcaatgtaataacaggtgttgggaatgctatgattcaatatccaagctcgcagactcagctacctccaactgcctcagcaatgcaagacggatttccacaagcgccttccagtatgcatattgctccctcactggaacaacctcattttgggcatgatgggcagtcttccaagattgcagttgatcccagtgatcaacctttagaatttaatagtaggaaagctcctgatatggcagtgcacagaacagcaaatttcaattctaatattccagcagctccaatagcagcatctgatcatgatgcacattcagcaccagcgcaatcatggattccatctactacagtactttttcctcaagcttcagtaccaccacaagcagcacaggttcaattctattattttattactccatatgattcctctgcaccatagatatgataattaacttttaccttacagatggacccttcagttcatgctgcaccactctttggagcagtttctggttcaagctatattccacctgcagcatttggagttggtaatgtgacagaagcattccctgtggatgcaaacactccttttaatgtcacagaaagatcaaagaaagtaagttttgttcttctcttccttttttcttccacccttatttttgagattcctgcgtgtgtctgctcatgtgcctaagtactttgactgattcccgcgctctattatggccagcctccagtgcctaactggcttcgcgaagaacttttgaagaagaaatctacatcagtgagtgcttcggtgcaacactcaacagagttccactccaagggatctgaagatgctgaaaaaacacttaaaagttctgatcaggctgacagcagaagcgtagattcagctaaatctactgatgatgatgaagaagatgaggtgcagtttgctattctattactaaaaactacttatatgacttcattttggtcacaagataattcactaatttgttaaaaaaaaaagattcatggccttttggagcatatagaaatgttggggccatatgctagctactgagaagctatttgcacttacagcaactccattttaaaggaaagctacctttagttcttttttaggtggataattagacaacgtatttgaacaatgtgctggttttatccccttctattttcttttatctattttatagtctagtatagccgcctttatttgtaataattttactggactaaaattatttgcaggacgaaattgaagcagcccggatggcagcaatgaaccaggaaattaagcgtgtattaactgaagttctcttaaaggtcttgtttttaacatggaactggaagttactttgctaggtctgacaaggtcctgtcatttctttagtttttgatcctcttgtcactttccaggttactgatgatctttttgatgagatcgcgacaaaagtattgaatgaagatgatccatcagctgaacgtgagtgatgtgctaaattgtaaatttaaatagacattctgcatttctgataatttcttctacattgtagcaaatgagcccactagagtttctagtgtgaaggggcctggtctgggagaatcaaaaccaaaggtctcagctaaagttgttgtccctgctaagccaactaatgttagctcagctgatcattctgatggtactgggttaagttcccctaaaggcgctcttcttggccttgctagttatgattcagatgatgaggacgatgagggtgataatgaggataaggttccagtttcaaacttatcgtctgaaactaaagctggcgcagctcgtccaggagaaggtaagttcttaaaataaatacctgcagagcattacttgtccatttaaatatattaactcgagtaaataatcaataggtgaaaaagccactgatggtgaacagcatggaaatcataatgaaagaaattctgtggtccaaaatgcttcattaggcgaagatcgtaaatttaatgatgaaatgtctcataggaactcaagtgcagaacttaaacaagagctacgtgttcatgacacacatagtagggaatttccttcagatgccaaaatatcaagtcagccgaaggatgtggctcctaccctggatgagaaggcacatggatattcccaaaatggaaaagttccaccttcaggcaataatgttgaaaattttagcaatatggagagcagtcaagggcatttagggaagagcagcaatgaggaagattttgtaaaggagccaaaggctgttcgaagaaaagaatccgaatcttcttccaaaagatataatgatgatgataaatctagcatgtatggaaatattgataaaaagggtagcttcaaggaggaaaaaggatctgacaggagtgtgagacatggagctgatacaagggaaccccgttccagaggaaactctaagcaggatgatgcaaaaggagagagaaaagattatcaaaaggacgtaagagagaaaagcagggattctgcagatagaagagagaaagggaaacatgaaaaggaggataggtcgaggcaaactacaaagggctcaagtagtcatagcagtagaaggtcaagatcaccaagtgcgagaagtcggaccaagaaggagagttcttcacatcgagagagtgtctcaagtgatgagccttctgataattcgaaaaggaggtatatgccattcttaaattctcataatgtgtattgtattaattgttatccctgcgtggtaatttgtccattactttttttttctgttacagaaaacttcattcatgtaaaagcagcatgtccccctcacccccaaaatctaggaacaggtaactatatgtttacagcatatttataatgtagattaatgctgttaaaaatgtgcgaattagcagttagcttcaacatgtttgtagatggtattgttttatggctggcatcattagttaatcctaaaagttgtttttatgtttggcatcaataatgtggctgacatacttactctgttctggttatctggaagccacaaattgcttagcatttgatgttttttaaatcatgaatacggctagtcatgccatggtttttctatgatttccatcctttctccccatgcgaggataagagatttttgtttttgtgtgtgtgttggggtgggggggaggggatgtattggttgaactattttgtactatctgtctggattcatgttctttgaggcagtgcctcaaggacactgctttcgcatatctgctatggtaagtcttgtataggaatgcttttattctatgccttgtgaatttgatatgagtgtgcaggtatcttctgagtgaagaaacatcaggttcatatatctcttatcctttcacttacccatttagttatgtttcatctctagacgagtttcgcggtctccacatagcaagcattctcaccgcaggcattcgccttattcatctgcggaaaggtaagagattaatcagttcttcctttatcattatgttactccaggtggtatttccacatgaatttttcaggagttctcagcttcagtaatatggtcgatcttactgtagctgattataggaatttgattagatgcagaaaaatatattaacgagtttgagaaaatagaagtcaacctttaggtgtcttaagaacatgtacccgattaaaaaatgtgttctgggtttacatgaaacctttgtgttttaaattcaaatttacataagttgttattgcatggacttccatctcagcttgagaaattgaagacccttggtacaaaatttttcctagaactagaatatatttgtcatgcataacacttatgggctgcttggttttaggaataggacaggttggttcttcatggatcattcgatgattttggtggaacaactgtcactttattttgtactacgcttgtgctttgagtgataaaaatattggtgtatcaacccactacattgcccaaagtcaaaccaaactagacatcaaagttcgcagttaggatcggcagatgcccaattcagcatccattcgtccaaagcaaacaaccctagtaatattactaatgttaaaaaaccactgaaaacagagaggccaccaattcaggttttattgggacagagctgatatgctggcctgcctccaatcctagacactgaagcaaatgcgtgaactcctataaatttggaaccctgtctgccctatgccacttgtgtagtaactgtgttactttgtgttatattggtggggtctttaaatctgtgtctaatcatttcaggaagaagcgttccagatccagaactccagtcaaaagaagatagaagatacttttgatttcaagatgcctcgacatccttgtgaggcgatgtgtggcatatcgctgcatcttctactgattcattgaacaacgcattcccacggtagcaagatgcccgcggatcaccagtgtagataagctggaggtttgcccatacagaggatattaaatcttctgtgctagcagcctagcagagagcaatgtacttaattattttgtaggcctagcgacccacgcaaatatgacatgtaccacctttcgatttcatgtattccatcttgattgtggaaaattggcaacgccaacgcccagtaggtgtgtactggcttgcgattatttttgtagttttgaagattactgttatgtttttttcttgaaacgcagattgttcgtattattctatttggctcgcctatccatcttgcttaccgctactccattgttgttcttcattatgattcgagcgtggtaggcagctgaactgtactaaaaaaatttaagtaactcgccacaatagaacccaccctatgacgctgtaaaatcaggtgccgtgtatacaaaagtttgaagggcctgtttagttggtgaaatgaaaatatgttatatcggacgtttgacctgatatcgtaaaggttttcagacacgaatgaaaaaactaatttcataactcaccttgaaaccgcgagacgaatcttttaagcctaattaagctatcattaacacatttgggttactatagcacttatagctagtcatggactaattagactcaaaagattcgtctcgcgatttatatgctaactgtgcaattaatttttctttttatctgcaattaatttttctttttatctatatttaatgcttgtgttcaaaaattcaatgtaatgcttttgcaaaaagtttttggtaactaaacgggccgaagttacaagatcaaatatactgtaaccactttatttgtcacactggtgttcgtaaggttcgggtgaagtgaaaacaaaacagtgagcagaaccaaaatcgtcactgcttagctccgagctgaacgcggctgggctaacgaaggaactgacaagctgacgaagtgaacgccgatagcccgcgaggaccaaattctcatcggccccgatcatggctcgcacgagcatcccctgccggacgacgcggctcggaaactccgatcccactggtccacaggcgcagcttcagcgtgagggacatggcgcgggtgcttctccctcttatcaccctttatctgcttcagggcgtgtttcagtgctggaagaagcgcctccatgcactccgcaacggcgttcgggttcccgggcatgttgatgatctgaaaagatatatcaacaggtttgataaacatgtgaacgtttcagagtgaggtgagaaattgccaagtttgagctatggtgtgtacaagtgttgatcctctgatccccgcagtggctctagatagcattgcgaatggtgtcacctgtaccacagataagttcaatagctcagattaaaggaaagttagggtactaaaatctattgaaatgaaatgccactaaagtttagccctagtgtcatatgcatggttagttgttatctcttatctctagaaaaagttgatgataatggatttccatgttaaaccaaagaacaaggggatatagaaaaatgtcagtcatcaccttcaaactttcctgaagcatgacatatgtgaggccaggtgcttctttctctatgacagattttgttgcctctggtgtgacatctctaggtgtgaaaccagtaccacctgcatatccattataaaaagtaagttgatgctcatctcactgtaaaaataaggattgtgcaatttgctaacttaaagaatgaaaacattttcacctagtgtcaagatgaggctgacacgatcaatgtcactccacttcaccaaaatgttcttgattttttccacatcgtgtggaacaacagcagtagcaacaacagtcgctccacccaatttctttgatgaagaattcactacagatattgcccttggcccactacagatgatattgtattacagagaagaaacaacagtgatttaagtattcatgaaaaagtagtcacatgtgttttataaaaatgctaagctgacagcataaggaattaaagcttttggttgatccactgttccgatggaaaaaataacagccttgtgaaatgtggagcccttactgagatgcatcaccatcttatgtgaagaaaaaacagtaattcgactctttagttttgcatcatggtgtgacccctttgcaactcaacacaaagaggtgtatcaggatgcgtgcacttcaaaaggtaagactttatattggttcattatcttttctgattcaatctggaacccaatcacaagcaaaagtacagcagcttttcagcaacaatcacgaggaaaaaggcgcttaatgaaatacctcctgtcagggcctgcacccaatgaaacagtgtcgctcactgtcagaattgctactttaacttcagtattctgtgaggctggaacctgagacaaatctgtggaaacactttttgcagaaggaaataaatgagatggcaacggatttgaagcagtgggtagcttgtcaaaaggtgaactggtcatatcagaaataagtatagcttgcatagatgttccagcctccaacatctgccccactaatggtacttccagtaaagcattcgcagatttcatacttaggaggcggctactagcttgttggcccgtgctttcagcaacatatctgccaagaccaatttcatcagccggtatcacctacagtattgccaaatataaggcatcatattaaaatatagctcttacccaggtctaccagatccatcatcaggcacccatctgatcactgcacgatggaactcttgacgatgtgggtctcctcttaaaggatgcagtagacgtgcgtgcactctgtagaaagtcatgtcagtgaagacaatatgctcaatgatatataatgggaataaagaacttaataacaatgctaaccacttatgcatgacaataactaccttggtagatgaggatttgaccagccagagagtgaacgtattgcaggaacaacaaagagattgaagcaaacaacacaactcactgggtttccaggcaacccaaatgcaagaacctttttagatggttttgatgaatcttctgttacgatctcagcaaatgttaatggtttccctggtttcatccgaatctgtacatgcaaacacagcaaactgttagaattactggaattgtacaaatatattagtgccaaagactaaaagaattttccatcaataactgttttaattggttatccagctggaaacaagaaaagcatatcataactcctggtttgtacttccatacaactgcatggtgcacgcctaattttggaggaatttccaagataccttttcaaagtgaattttccccatgcttgccaaacaaggtttgacaagatccctatcgcccatggaaacaccaccagaagtaagaatgatatcagcatcagaacttagagctgcatccatatgctccttaagactttcctcagtgtcttttgcaatacccaagtcaactaccttgcacttgtgctgaatagcagcagcaattaacatagcccggttggaatcacgaatctgcaaagcaagtacacatttcggtgaatatgaaatgcagataaaggtgagggatgcaaacattgtgaaatagtgggaataacctgaccacgactgagagatgctgtggctggctccactaattcatcccctgtagaaaatacagcaatggttggtcgacgatatacctgcagattcatactcaaaatgatcagttgtgcgagattctcttctgcactcagtgacagggtaactgaaagacttattcaccttgacagtagtcactcccacggttgcaagtaacccaatttctgcaggacctatgtgctcactagacttcagcactaccgaatccttttgtatgtcacatccctatggattatttattcaaataactaactcatcagttaccagatgaagtaatactgtaccaaatgctctgcatgaactatagaagtacatagtaattgagaactacagtacacagctaatagcgcaataataacaaacaagaatgttgcttccactgaaggacataaacaagtaaatccactcaaatacatcaacaatttaaactgaattaagatgcaattgacatagcagaagagcagagcatggatagtagcttttttgtttcaatcaaatcgtcgcacaaacgcaagtaggagggaataaagcaagtaaggataagcattaagcaaagcaacgaaacctattagcaataccacattgcgtatatcctgcccctgagttggccgcaccaatatcctaaccctcttcgacccatccggcgcgccggcgagctgctccgtgtcctccacttgcacgacggcgtcagcaccatccggaatcggccctgcccgagaaaccacggtcagtaaccgatcaccgccgcatcatcggaaggaacagagcgagccacctcaccttcggtcgtgacatacgccaccgtgccgggggtgacgaccacgccgagggcgtcgtcgccggccctcgactccgtaatcaccgggtactccccgggcccgtcggaggccacgacggcgtacccatcctgcagagggtttcaacccaagcaccctcaagcgcggcggcaaggagggggagcagaagagagggggaggaaagtgttgaccttgatggaggcgcggaagggagggagggggtcgggcgcgcggacatcctccgcgaggacgagccctagcgcgtcgtgcagcggcacggcctcgggggcgcgcgccgtcgcgctcgccgncgncgaggacagtacgggcgccagcgccttctccacctgcaacattttttttccttttttgctgttcttcttctactcctattttggtcggtttatctcgggcggcggcgtccggcggctgaggctgcccatctccattgacgagagagtatcgactacctactcactttgagcccttgatttaaaacccaacgcacaggatacgtttgggagcatggaagtatgctcctgtaccgtagcactcgatatattcctcctgactccgtcccataaaaaaaaccgtagtactagtgtgtcacctcctatcctatactcgttttttatgtgacatattaagtactacctccatcccaaaatgtttgacgtcgttgacttttttaaaaatatttgatcgttcgtcttatttaaaaaatttaaataattgttaattcttttcctctcatttgatttattgttaaatatacttttatgtatacatatagttttacacattttacaaaagtttttgaataagacgaacggtcaaacatatttaaaaaagtcaacggcgtcaatcatttagggaaggagggagtattactcaacttcacgagttgcgaatcgaatcctatttaaatggcagcctgccacaagtcgtgcgacggatgcttttcggtggatggtggtgccgcaatcaaaataagtcgaaagtccaaatcacgtttcatttagaaaaactgtaaaacctaaccgaaaagttactttgttgcaaatgatcatctcctaactagtttattgtaaaaaagctcagtatacacatgcttaacgaaatcagtctgttatcattgatgtagagctaccatatgctaaactagtgtttgtgttgaactcttttttacggatatagcgaaactcagtacgaccatttctatccgtggatttttccaaaaaaaaaaaggtgtccagactatactctagaaatacttaattttggtaaagaccacatcaatagctcataatttatgaaacatgttgattccgtaaaacgacgtcttggctgggatgggttttgcagtaaaattaaataggggattagtatttacaacaaaatgacctatgaggtataataccaaatttcaagtgatttatggggtggtttttaaaatttcccttagaaaaatgaactggccttttgaaatcgagaggaaaaaaaaaggcttgaactaacgtttggtcgcgggtaaaggtggcgaacgtcggtccgcgcgtatccctgccattcgcacgccggatttgcccgccgttgcgcgtccctgtcagaaccacgaagcggcccatcctacatcccgcatgcccatcgcttcgaccgctcaaagagccaagaggcaatgctgcagcggcacgctgccagcgcgaacgagcgagctaggaaaagatgctgatcgaaggcttcgaagctactagttcatgtacacggcaatcacaggacacgcatgcccttcttgcaacgcgatagcctctcccaaattctcttcaaaactagtactgtagtatttctcatttcatcgtgttcctaggagtgtctgaatgctcgacctgtcgatatgtcatatagctgccattgccgcctatacttgccagttactccctccgtcccaaaaaaaaaaaaaagacaaatcccgagtttccgtatacaacgtttgaccatacatcttatttgaaaaaaaatattaaaaaaattaaaaagacaagtcacgcataaagtattaatcatgttttatcatctaacaacaataaaaatattagttataaaaaaaattcatataagacagacagtcaaccgttggacacgaaaacccaaggtttgtctttttttttttgaacggaggggtaccactcctaggatattgcaaagaagtactccctccgtcccaaaaaaaacaaatctagtaccggatgtgacatattctagtataatgaatctggatagagatatgtccagattcgtagtcctaggatgtgtcacatccggtacgaggttgattttttatgggacggagggagtaatcgacacagaagcagcagtaggttattttaccagctggatgtttgaggaacactgcatgttctcattgctgcaccctcaggattctcagttatagctatgcctgaagatgttcgatcaccttctttctagccaacagaaaattcactgtatgaagatctaaaaagttctaaatgagatggtagacgacccagtattttgaatcaagtaattccatacttccgctcaagcaagtagctgttttaccagtaaaatccactaagacgaaccagataaacaatacctaactcagcttggcacaacagcggggttcagggaattttgataagtagagacgttctgcaaaataagaagagaaaaaaaaagagtttcagttaagctgctgaagatgcacaaaaatttactgcccatactaatatactattccatccagaaactaacactagatcaatttcttaattttattttttgaactttttaattttaaaaatgaaccctttcaaaacttatttccagaatctaaatcttttggtcacgccagcacgcttggtgtagaaaaacatcactgacacaccacctgcagccagtgtaaccaaataacgttgcctagctagaccggcgtggccaaataactgccacgccaggcggctggtttggctaaaaggttcagattctggaaataatttttgaaaggatttattttaaaattaaaaattaaaaagatttaaaagataaaataattccactagatcaaccccaagttttgaagccccaaaatctcttttaagtcttatctggccaaagtgacactagacaaaaggtacacctgacaacatacttatcataaaggtaaaatatatttgccttacacagctcaaacctaagctgatgcaagctacaacttacagcaagtaacactttttggctgtatgaatcaaagttatacacacacagacccaaacaaaaaaaaatcgaaaagatgggcctatgacatctgcggctgtataaaagtaaaacacattaaaaaaacatgggcactaaggaggagcttagtgtcaatgaaagaaaaaaggtgagcacgttcggggagaatcgaacgtggactgttgagcagcatgttggctgcccttgccatatgtgcagtttcaaagtaaaacactctgataactgtcatgttaaagcaggtagtgtacattgttttgcaacaacaaagtgattgttgccagaattacctacactatatgtagcagacttaccagttacatgttgtataactaataacttgaaaatgcaccaatcgagttagcacctggtgggcaggggatgggagttggatgaactacatgtctacgtgggagtagataaagaataaaacgaagaggatcagtggaccagacagcataaacataaacactctgaaagctctcaaaatgtttgcccattcacaatttcacatgctactcttcacgcaatcttaacaaaaaaaggtattacttacaactagtggcggagctagaaattattgaagagtagggctaaaatagtgcttaactagtgagttgtttattttttttcttaaatttacatggtgatgtaagataatttagccatgattttggaggcacgcccatgcttacaaccatccaattaaaccccactccctatctactatcaacagttgtccgcagcagaaaaaatatcctcgttaaattggtgctcaggcttcaagagtagaaaaaagggctcttcatgtttgaggtgattccagagtgcactttgaaaggccatttatacagcctaatgaaatggagcagcatggataaatgctctggagatagattgccctggtgtaattcccagtggcgtagctaggatttaaagtaaaagtggtccatctatatataatatgtcaattaaaagggtggtccactatacaatttttattatattaactagcacatatactataattttaattttttaggtggtccgtggaccacggtgccacctagctggctacgcccctggtaattcccaacgacaagccataatatgtgaccaatggttggtgtttcacaaaaaagtcaatgaagattcagccatagagggagagaaatatgtagaaatttcatcggtccacattgcagttttaccagtagtccagtacaacagctgaaacaaaactggataatgcctcattctgtttagactttatagcagtatactgctgaaacagaactagatagtgcctaccaaaatgaatgccattattttaccatataggaatcagggtttatgtaattgtccagaatcggagctctgacctgacagaactcttcccgtattagcataagcaaaacttcttaaaatcaattatgtcagtattttttcggtttcagctgcgaattaggagccgaatgaacccagattcacagttgagcttcacaatcaccgcacgagaaaagcaaatcctataacatgattcttgaatactgaacttaacggtgcaggaatgatacacaacacagttcaatcgaccaatgggggagaaaaatacctgttctactcatcgtctttcaggacacgctcgccggaggccatgggggcggcggctgctgctgcttcgtcttcctcctggaggatcttctgcatatcattgacgcgcgtccggacgacattggtaatcataactgcggacgaaaattcatcagatcagagtgcagtctgtggtactatgtgcgattggagagacgagagttgaggaatatggcgggattgcttacttccagcggttcccagggtccagatccacaggatcttgaggccggggcccttctcgctccatctggtcaccatcggaggagcagagctcgagcgcggcgggagcgccgccggcgttcaggctgatttcctttttgttttttttttttgggaaatcggtcaggctggtttcgtctgcactcggggttggggatggagaacgacggggtgcggaggggtgtccttttcttatcgcatttttttaaaaggaatcattgtgagattgtgctattagtaagttattagggtatagttcaagaaatactttcacttattcttttatttatcacttaacggttcagattatccctaagagatctgacgtctagaatagcatccgccttcccacacccctgcgcctcggaaatagtcgcactttccttctgatcgcgaaatccatctcctccgccagttctctcgcccatcgcgcctatgcacgtcgccgcccccgtcatctcccggcgctcgcgcccccacccgccgtccagaccgtatcgcccactccgccgtcgcgcgccgcacaccgtacccgccctcccaccccgccagttgtttcctccactcgccactccgccattcatcgcccttctcgccggtctcctccgcaccgcccccgatctccaccaggaactccgcctcgccggtctcctccgtgccgcccccaatctccggctcgtcgaccgtctccgtgcaaccaccgatctctgctttcagaacagtgtcaccacatcctcgatctgattcgccgaaattaaggtacagtaatcatccttcctccccttttttttaatccacaatgcagtattatatatatttcctctctccccatcagtcgccgctgatttgatcatacggttcttaatataatccagaatcaatcaaaagaaaaaaaccgaaagcatcgctttggtatctaaagaattcatgtttttagataatgataactaaagtatccatgtctatgaacaacgcataactgtctgcacatgtctaaacatctccaaagaacaatatatagtatctggttatttaagattttacacatttcagaaatcaaaccttaaaattcgattttcactggcagtgacagaatatttaagatgatgcaccatctatatcaattatcagtatagtagagattcattccttgattaatgaaatcaccatctccatgcatatgttaggacaatccaactgtttctggattcttgacagatttggtcaaggtgaacttatgacttcagtaagcttttgactaattctgtaccaagatggttcatttttaagcaaagtgcaataagcttcatgaaacattgcaccaccgtaatcttcctcctgattttcttattttgctgtataggattagggattattgatacaacatccggcaacatccacctcgggggaccacaccggcgccgctgaagcctaccctcgacatctccgtgccgccaccgaccatcgaggacaacaccagtgacaccacgccgatctcctccgtggccactaccaaccggcgctgccacacgcaccgccaccaccacatcacggcggcatctcccaaccctaactgccgccactccgtaggttgccatgcatctacccatgttcgtctcatctccgccgtctatccccgaagtgtatgaaagcattggtaaaaagaaaagaatataagataaaattttacaattttaaagcatgaatacaaatggaagggtgatttttctgaagtttgaatccttcttacaactggaagtgtaggactacttagggaaaacattttttttctctataaatgcggtgctgcttcatttactttggtattatcggatgattcatttcaggagactgcataatgtttgcataacattcattattccaatgcaaaacaattatgttaatattaaaactcatggtaggttcctggtccaggttagaataccaatttacaaaccggaaaaaaaacatgaacatgtttataagccatagcccttatccgtacatagaaacttttcttgaggtcttctgtgtcacatatttcattacatacaaacaacagaaggtaacctccagtcttccagtattattttgctccatagcgaattagccatctactcatatttgccttgtacttatggataaccgtgagatgttcaggtggatcaaacaagaaccgtggtttcaagttcagtttctaaacacatcacctcaagttcagtttctaaacttcaagtagcagaaaagttggtttcttatattatagtgtaaattattttctttattgtaggatcagtttccatatgctataaccatgggagctctctcagtttgcccaagttgtttgtctagaagtatgtcactgctttggttcatcaattcttttgtcaattcttttgtcagttcattggcagtagtactttggatgacaatgagattggcttagaaaattctgcctttgagtaggcagcacagaacagatttcccctgcaatgtattagggatcacaaataatcgcacacgcggtcaccgatcggtttcctttcccctccgtcaaatcgccaaccactgcagcctctctcctgcacctcctccagatcgcaaataatgctttattttgttcccgcaacaaataatgaaataactcacttttttaacataatagcgtactatatactgaagtgattatatatacttaattcttgtaaagatttattgtgcccatgcaggatcatattattatatttaacgttaataatatattaatgtacgacatgaattgaattaaagttcaaatgcacatatcatacaaaaaaatttccgctaacatgaaattttaacaattattaaagacaaatcgaattgcaccgtagcatttagcacgggcatattactagtaaaaatagtataggaaatttttccatcattaaccatgttcatataacatagagtccaatacttattacagtagttttaaaatatgttatcgacgtacctcatgcttggccaatgtacattgagccaccatcgctaacgaggacgctcttcggtgtctagtaagagctgctaggctccgtggtatctttactatgactgtgctgctaatgcaatagtttattttttttccattggttgtgtggtgttctgttgtatccttagtgggcgagtgtcgagtctttctctaacaccatatacattttcttctatgtcttagtggaatgatacgcagatctcctgcgtgttaaaaaaacatgttattggcataacccaagttctgtacactcttttaattcaaaggctgcgtgaagcgggtttagagcaatactagtagcaccggtagtcagatcaaaaaatatccacgtcatatgtatagcaaattagtcgaagatatcgagtgcaataacacgttattaaattagctatgtataggattttttatagtccaactttcccgaaaccaccatagttttgtgatatttcaacattggcagtagcatggatccaacaatcctcgtaggttgccattggcatgtcaacaaagtgggatgtagggtctcactttttttttgctaccacccgacgatagatgaagtacctccttccccacacacccctccccgttcctctatcttcttctcttgctcttccatctaaggttgagattatgtggattaacatgtatcctcatacttaattgttgattgcttttagcaacattatcaatgtgttatattctatttttacatgttagtgagtaaaaaaattgatgattggttgtcaatgttctagctttgttgggaaagtcatgtgcgcaaggattgaccctgacctagaccaactatgataaggcagaggccaatggggcttttcttgtaatagttatgtgtttgtgaaggatcacagtacacctttatatggcgactaatatccatgttttctcttagaagcacttcaagcaaactcaatgattcatttcattttatttggatgttgatccttccaatagagtattctttgtttaagttttctttttcttattgaaccttccaattccccaacattatagtagactaatttttttaatcgggcttgtgtacccatcttttaaatgctagctttacaaaataaatattatgatatctcatttgggctacttggatgctaaattttttagtccgcggtgtgaatgggctgggattgaggcccaccaaataaggctctaatggatcttgtgccgcatataactcatatataatcacttcccttccaaaccctagctattcccttccttgtcccgaacccgccgcctagagcttgtcttgctctccttccttgtatatgatggttgccactactagatccgttgttgtttcctgcctccttctagatctcttgctcgtgttgcccttgcttccatccctcgactctatgggcaaagcaccgccactcatcgccggtcctccaccaaccacccttctccccaaaaaagtgaggtcttctaatagtatcgagatagagtgactctagatctaaacctaaatacaaaccatggtgcttgagagaagatgctcgccttgaagtagctaggatcattgttgaagtccccgcgcttttttagaataaaacttcgttgcggatcgaaggttagaaatttggatatatcttatttttgcgctttttgtttatgcttgtaaaaagtacgtgtagtgaaagtattgattactagcccaactcccacttttgataattggttgcaagttcacgttatttatttattcatcttagagtcatttatttaaagttttttttactaaccaattggtacccgtagaacaacatggacaatgtgtagctaaacgttgacacccttcaagttattcaggtgactaacctacccaggcaattattttgatttgttgtgataatatcattttcctatccacctagttttcagcttgcacacatctttaaattcaaaatgttccaagggaggggcaacaacattgtgctttgaaagatagtgtttcaaaaatacttcctcctggtattctttaccttacgtcaaaagagttgagtagttaagtttagttgcatcaaataaaaatgaccagatgcatgtacattacaacaacaactctaactttagacatgcttagcaaaacataatcaatattagcctctcatatcatatcatatgataagcaaaacataatcgattttagcttatcatgtatgatagcaatcccctttacctccccggccagggagcccctaggacttcgtcgatgagttgatatctatatgatcttcccctgcaaagtaaagtaaagtacccagcggatgttagagtcaaaggaggagtcaccatagtcaaagccccacagacaggtaaagttgaatgcaattgccgaaagcaggcaaagtgaattcaagggtctaccctttagacgaatgcacctacagttttgatggacctcagtcacacatatagtaccacccaccaataaaattttgaaataggccttacccaccgccctatttcctttccaactctcaaagctaaactcctcctcgccgcgagtaattcgctgacttaagtcaatatgaaaaagtgtggaaaatgggtggttgtactttcatcgacgaaaggaacaaataactacagcaataataccgatcaatagtttttctttcaatatctattggtgcttccatgtctcattagccaaaatttagatttcaaaagttaatttttgatttgattttggttctttttatcatagtgcacttttagcattggctattggcttttaaactgctaatggtgtagatatgaagtggctattcggattgatgctaaaatgaaccttaccaaattttggcgaattggcaacattgccaaattttttgtaggattggcttaataatgttgccaaaattctatatgcattaccaatatttggtaacaaactaaacatagccacataattatcaattttactaaataatggtatggttgaaaatgccatcaatctgaataggcccgaagtcttactcaacatttttagataggaaaaagtatactttgactccctcaactatcgtccgagtatgattcataacctcaaaccataaaaccgggtatatcgactcctccaactatcaaaaacggtgcaaacaatgtccctcagtggttttggctgacgtggcgcccacgtggcagtcttgaccgagtttttgtcctacgtggcgcttacgtggcattagaataaaaacaaaaataaaaaatatgtaggacccatatgtcattaaaaaaaagtgggacccactattcatgtgggacccacatgtcatcctccctctctctccctcccttatctctctcacttcaggagcggcggcggtggcggcagtgacggtggggaacgcacggtggaggtgacggctatagcccgcggccgtcgggagggagggaggggtacgagaggggagccgccccggtgggggggtcggagtcgccgacgactggctagcgcggcggcggggg

SEQ ID NO: 33683 - DNA, 9040 bp, Oryza sativa
  unsure (1)..(9040): unsure at all n locations
cgcctgctctcctcgatgctcgccgcgccgctcgtccatggcgtcatctccggggcagccgccgccggctgcgccgacctcgccctctagttcttccgcttcgcctaccgccgcaccggctttagccccgagccgtccaccttcgccctcgccaaggcagaaaaattcttggctaggcgccgaacaatccaagaacgcacaccccacacatcgtcgatgacattgatcgcgcaaaagaaaaagacaaagagcgcggtggccggtggattggatatataacttagcctcgtcgtctccagatgacggagtgtcgcccgccttgaagcagacgatgccgcggcgaaggcatgcgccggccggccccccaccaccgccctggtgcagcgcgacgctgggcgccgcggccagcaccatgcgcctcgcggtcgtcgtcatcgcacaagcaccaccgcccggcgccaccatggcgacgaacgtggcaccggggacgccgacgagcgctccggcggggagagccagcatggagatggggaagagaaacatggggctgcactgtacctccatgaggatttcacgagacgagacgagaagcccttgaagatattctctcctcctacacgaacgaaacgaactaaccaaagctaacaccaggttcgagttggtgagctagctaaggtcctttatatagcccagcgatgcatatgcgtggtctaccgtcgtggactcatggggaacaggttctgggcgtattccgaccgccgccgccgccgttcccaccgccgccgctgccgctccccatcgccgtccatgccgccgctccggccaagagaaaggccgagaggagagagaaataagggagagagaggggagaggaagaaaggaaggagagggaggatgacatgtgggtcccacatgttagtggtcccacaacactttttttttgtgtgaatgatatatgggtcccacatattttttttattttgtttttattctaatgccacgtaagcgccacataggacaaagaatcggtcaagactgccacgtgggcgtcacgtcagacaaaaccacctctaaaaccaccgagggacattgtttgcaccggtttcgatagttggaggattcgatattcccggttttgtggttggaggttatgaatgatactcaggcgatagttgagggagtcaaagtgtactttttccttttagatataaactgctactagtagttagtactgtattactgtaagcccaaaagtaataatataacgattttgctatatctcatttgaaagattttttcttatctctcactcgattttctcactcaaatttacagtgtattttcttgtaagttacagtgtaatttatgaaacttacactgtaacttttgtaagttacactgtaatttttgaatcttcacatgtaaattttaaattttgtatttgatttggtctttttcttgaggatatggtaatttaatgttcattatggtgtttcttaattgcttttttctttttattatatctatcggattttaatacaaagattaaaaatctgtgtgatacgattataaaaatctttcgaaagatgtataggtactctcataatataatgtgcagtagttcatgcagaggcccgacagcccaacacggcccatggaggcatccacgttttgaacgagcctggtggtcccacatgtcatggcactagcaattttgttttgctttccacttccccacggggcccacactggtcgtcgaccatctcgccctctctggaccatcacacctaccctgaaatccgacggctcagaaccatcttccaaaacggatcggacggtcctcgaagccctcaagacagccacgcacgcggcccgcgccgcccaccattttcctcctcccccgcccccaccccacgcagtccccttctccaaccccgcttcaaatttggatcgcgtcgatttcacgcgccgattcccccaaatcgcacacacccccacccctcgaacgcataaatactgatccccaatcgaaacggctgctgaaaccctagccctagcaatcgagagagagggagaagatggcgcgtccgagaggcaggaagcgtgcggcggcggcggcggcggtggcggaggaggactccagcaagccggaggctgcagaggcgaagaagccggccgcgcgggggcgggggaagcgtgccaaggcgtcacccaagcccaagccggagacggagtacttccccgagaagcggaatctggtgaggaggaggcttccccgattacctgtctcggatgcgtgcttcgcttcgcttcgttatgccccgattaggttggggggtttgattggtctggattcgttttggcgttgtggaccgcgtggtgtatttggttgctgcttctgcggcgagattcgtagtggtcggattagtccaaatgatggtaatggtggttgatgttgaaatacgaatggttaatatgtgactggatttggctggactataggggctccccatttcattaggaatagtttttgtgttgaatgttatgttgtagagtttgagccacatctgcgtgggactgaattgtacagtttatgttcttctaagtcagtgttaggaatagtttttttattgtgaagtgctttgctatatgaaacgattacttgaatttgttatcgtgaagtttgagctattattggaacaatgaaaactcacatgggtttatttaagcagttctagggcaattaattgtttggaaatgtgtttgatggatataaaaggaacgtttgagcataatcagtttgtctttgcaaacaggcaaaatgattacttatagttttatggctaatattgtgttactgtgttcaggaggatctttggctatcagcatttccggttgggaccgaggtttgttactttctatgggcctatctatttctttcttttttatttatggctgagtcaattagtgatgcatgttttgacatactttcaactgtgtactatggatatttgctccgctaactattatccatatccgggcctctcatctgcagtgggaaaacattgataagataaaggagttcaactggaactttgaaaatttggaggtacgatgggcagatagtattccaatactactctttttttattatcacacttgctttcagcatgacataaggtttcctgttggtgagcagaaagcactagaagaaggaggggagctttatgggaaaacagtttacttgtttggaagcacggagcgtaagttttcatactcgtgctagttttaaaattaaatctccagttcgtgatacatatattctcctactggcttgctagcatttagtaactgaactaaactgattatattagcttgtttttttgtgtactttatgacatataacttgaaggcctgttttgaatggtttaatttcacagaaatagttattcccacaagaaccatgttatttttcttttttgacgttcctgacaggcctaaatatcaaatctatcagtttgtttgttcccctgaaattcactaattatgactgcagtagcaccctgagaaaattatatatttctctgaacttagatgcacattgttgtagatatacacttgcatgtttttgtcattactgaaagattctctggacatttccaacaatgaaattgtcccctttaggaccatacttctatttatttcttatgctgtttttccatgtcaatgttcgagttgctactgcctttcctaagttgattggtatcagcatttatttgttttaccatgtgcactttagatatgttgggtgttgtcgtggaaaaatgttttcttgtctctgatattttcatttgttcttgggatgtgccagattgtttaataatcatcgatacagtttatctgattaaattgtttttgctgacatgcagctcaactattggaggttaatggtgaatcaaagatagtgcttattcctatagttgttgctgtaagttcgcttccattctcttgatatggaaatttgcatgaggaaacagtccactttagcaaatactcttaaatctgaacatttatctcatgcttatgccaactcaacatcttatcccgtttatgcaccatcgctaacaagttgattttactaaggtgactatgtttgtacttcctacctctgtcatttttgaaagatgccagtacaaacatagtcaccttagtttcataaaagccaatgggactaatttccttggcgctgtttggaagagctagctgcaggggagccagccagagtctacaggtgctgcagcctgccagcagtaagcggctgcttcctgcagcagccaaatacgctgtgccgcagggctgggcagggcagcacagcatagcctagaacactgcagtaatggcctacccaatgcccccttttttttttatcacactattttactctggaatttgtttgtttgctctttaaccctaacctctttaaaattgagtatacagtgcaatttggaaaacattgtttggatactttatggttacaacgtcattggcagttgacttgtttatatattactgattttactatttacttgcctcatgttgaatctcatttagcacttgctaccttttctgtgctgcaggttgactgcccttttcctccctcagacaaaattggcataaattctgtccaaagggaaaatgaagagatagtgccaatgaaggccatgaagatggcctgggtgccttatgttccgctggaggatcggtactcccatactattaattctgaacaatatttcttaccatttcttttgagaacctgtatccttaccttgctccctcattaatggcttctgtttttaccaatcatcatatgcagctttgtgttttactcattcttttttgttggtctacaggcttagtaggattgacagtttgaaaacaaaaatatttactcttggctgcacccagcggaggttagtaattcatgctttttccctcctgactcgcgattaatgctttatggcatttctggttctattttatttttgtttgtttgttggaacgttatcatccagaagcatgcaacataaattcactgttaacatctttccctagatttttttctgactaattctagagtatcctcatttgtatgttttgcaggtctgcgctgaggcacctcaaaactgagagagtcaaattgtttgactactgcatgccatgtaagctgacttgggattatttctgttggcctgttttgtgtgtacaaatatctgttttcataggattctttgagtgcctgttaacttgagtgtggttccttggcttggtccagtccaattgcaaaatatcctgcaagacatcgatgatgtcttagttaaatggttgcaatgtcagtatgccatgggataagaagctttttactagtcattctttaattcatttccattctgtttctgtatgacaatttgttaatttcattggaatgggtgaacgctagatatatttacatgctattgctgccatgccttttgactttgataagctttttagctggcttatttgcctgcgttggatggttagtacttaattttaatataataatttgatgccatttacatatcctgtgttaacttaggaaggcacttctttccagctatgtaacattgtctgtagtgagccagttttcagtgttgtcccctcctttaatgttagcaattgtggcacaaacataggcacactgtgtaagtcttgttataaagtgtgtgagcatggcgcaaggtcaacaatcatgctcaactggttgatcagatcattttatttacattgttacacttatatgatgcagagtgttttatgaaaatggctgagagtgatgtagtctgcaaatgaatctcgtttaatgttgttgcagattatatgccactgaaccctcccgaagacgaagatgatacagttgtcaacatcatatatcccctagaacccccggtaatcttctcttagtgttttttgttattccagtattgcctaataaattttcctcaacataagctattagtttattttatggaggtatcttattagtgcaaacctaaaatattatgtgtaatgggcaaaactaaaataaatttcttggattgtgatcttaattaggcctatatttgggattcattaagtcagctagtcattttagggaagagcccagatgcagctgtatcttctccactgctataaactgcattgttaacctgggcacctggcctatgtgagaagataaaatttatcgtgtttcactgtttcctgcagctaagaattgatcttctcttatttgtatgcatctctaggctgcttgcatccatgtcatgattgccagttatgaatttgtgttcttttgtctgtggtgcttcatttgccttagcttgtgaggtcaaaaccaacccacatgctgctggttccccttgcctactctatgaaatcgtgacttttgctgctgtcatttctcgcactagcactcctgcaatgttgtattgttgtcaccctcactattttcagttggatgcttctgaagtttggtgtcttgtgtctgttgagtcaggagatgtgtacttctttatgcttcattaatctgaaaaaatatttcctattttggtttatttatgtgtgcttctagttgcctctgcatgcggactattttcatctttaattgcttctgtgtgctgattgttttcctctacgattgctgctccaggatgattatttcctaactgctgccacatgcttataaattccctcttaattgctgttgcatagacgtactgattgtttccctctaaatcgaataattgctgcttgctgggctggcgttatggcattgcttagtctgtcagcataattgcataggtgtacatgtggtgttttcatgccacctacactcaagtttgaccggtaggcagttgtgcaatcatgtcagtcttgatctttcaggctggtcacttacaggttgttttggtttgaggaatcaccacatgaaaaccatcttggacaggacgatccatcataggatcatcccacaaaatctgaggaatggctccattcctcatccaatagcttagcatttgcttttgaggaatgaggtgatggacaaacccatttcattcctcgaaccaaacaggatcactattgagtcactggatggaagcttagttgcagtgtttatttcctgctattgatacaaacatttcattgttctgaagcgataatgtagcctgagtcacttggttcttagctgatataaacactgaagttattatgttcacgtagatgcctccaatgttgatatttattagatttacttgtattgcttatgttcacctagatgcctccaatgttgataacgtagcagtcatcaaattattttgtattcacattgtactgcttattgcagatagtatgtgacttcgactgggagatggatgattacgaggtttgtactaatttggttgttttgcttgatgcttcctatgaaaggcacctgcattgagtcattctgttgcaatgcaggactttgctgatgagaaagttaaagatgaggtgctaccagaggatgagaaagaaaaatttaaggtgcatcttaattttttgcttaagctgtcagaagaatagtcagtctataataattacctcactgagtactccttcctaactgctgacacatttcttttaacaggaattcataaaggagagggttagagaaaggaaaagagagctaaaacaggtcatagtcaaacgaaatgttaattgccttcaccagatactttaatgcattcaagtactaactgtttctccaaatcttatgcaggctaaggaagcaagaaagaaagctattgatgatatggaccctaaggtcaaagaggcatttgaaaatatcaaattttacaaattttatcctgtaaaaactccagacacccctgatgtaagcaacgtaaaggtatgtgacattgcagctcaggtgtatcttggaacagttgattatgcatatagttgtcttggctttaactcctgtatctactgtattgcaggcaaagtacatcaatagatattacaggcatgcacatcatctgatgtaattgcatcctatcttgaaatgagctatccaacttggagagctgacaccgaaattttgaaagccgtgggagagattcctggcgacatcttcaaattgggtctcttatagacccggggtgaaaacttgttgcaccttaactctgtactgcagttttcgtcagatcctgccattccttagagtatcgcttccttcggcattcttttttgttgtgcgtcgtgtaacattctgggaatagattatgtaaccatcaggccgtacatcttgtaagagcaaaacaattggtttaggaaaaatgctgattcctttcaccgtcctgtgaaggttgcttgggtgcaaaccccttgattttgtcttaactggtcttgcttgacatgctatattgctgtttgtagtatccgtggcctgtcgagcaccgatcttcctcagcttcgacctcgcctcccctcgtctaacttcattgtcttttttttttcagataatgtttgcattgttcttttgaaatgttacattcgagtgtcttttcaaatattcctatgtaaggggatcaattagtccacgtaaaatgttgaatctgactcggcagtgtaggttccggcgtttttttcgttcgatgttggtttggcgttgaaatcgcatgattttatgattatgattattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33684 - DNA, 2888 bp, Oryza sativa
cttggaagcctgcagattctgtgtggggatggaggtggttctgcatgagggggatgccaaagattgggtttacaaaggagaaggtgcagcgaatctaatcctcagctacactggctcgtcaacttctatggtatgcatcgaataggttctgcttgtgtcattattggttactgacctatagtctcccgtaaatcggcgaatttgatgcatgtgcttcaagaaggatgttttacttttgatgttctgatgattatagctatgaatgtttgggtgtctgggaggcgacagtagttcaagctcttttcatgagatgttttggatggtgttttatgaggtgatctggagatgtagccttgtgcttgatctagctaggacccagcagttggtgtctagtcgtttctgtcctagtttagctagctgtttttattttcctataagactctgtttgtttggctttcctcacaaagccggtttaatgaatgcctgatttccccccaaaaagatgttttaccaactttgatgcaacgcccagggatgcatgtcctatggccagagctgcactcttgaaatggcaaatgtttgtatatgtaaattagaaaatcccatacagctttcatgtagtcaaatagtttcactttaatattatataattcaaaagaaaataatcttagttgtgtgatcacacaaaaagaaggggtggtggcggcgccatcttagttgtgtgatctgcctgcccggtctagttttgtttttttgttcaattccttttgctgtattgctacaacattgttgtttcctgtaatggaaagagggagagcaaggttcttctgttttttaaaagaagagaggaaaaagagaaaataatcttatcttgacttggttgactaaaatttttagtttgtgaccaaagtattatgtttccctcgtatgatatgtttacaggaaaaatgttttgatgatgttttcttgaacagcttggcaaggttctgcgagtcaaaaagattctaaaagacaagggacaaccggcaccaaactgtatagtcttctcaagtcatgaggaacatctgtggggcaagatcccaggattgttggaatctgttaaaaatgattgcttgccacaagcctatgctacaattgttatgagccaacatttgggtgccaatcatgttgatggcggggtatgttttaaatccaattatttaatgttgttacggtgatatttattagaaataaatcaaccaacgttttccaatttaaaattcttttgctctataattaatggaaaattcgggttatttgaaaatacatccttgattagataattggatccacttgactaaaatgaataaacgtggtctctttttcatgttcaggtccgtgtacgtgtgtctaagaactttttcgagcttgctggaaagaatgtgcttgacaaccgtcctgcatggagagtgaatgctagtgcaattgatgctggagctgattctgctcttctaatttctgaccacacattattttccggtaaagtcttggcgtttcaatgttatttgaacgcttcatctctttcccttttgagtataatgtgactcttgtttgtactaagaaagagcaaatatcagttaggtctggtgatctattaactctttatgatataacatttgcagcaacactgttactcagtttattatttctatttgcatcacatgctttaaccttatttgtttgttaagagtggcaagtttgtaatttatggttttctagtctacaaccaaatagataggatcaagattggtaagcccaactttctccatgacacttgtgaaacttgggatatgtttggaaggattcatacaatttatatttctcaagattctccattattctgaaacatggaaagaatgaaagaacctgcttgttttttcgaatttctagcttaactctgatctgttccatccgcaagagcttgtttccgtcctaaaattggtagttggtccaaaattgattagtttgaatgattaaagatgattcggtagttttttacattgcgccattgctaaattattattcgtaactcgctgctagattttgttttttaacactatgtttgtttttggtaatttttctaaacctcaggtaatcctagaggaagcagttgcatagcagtggagataaaggtacattttgagctttatttatttcttcactgttcatcttttgtacacatttcttttaacatgctttgccttccaggcaaaatgtggatttcttccgtcatctgaatacatatcgaaggagaattctatcaagaaacaagtaacacggtataagatgcatcagcacctaaaatttcatctgggagaggtatgttggttttgggtaccagattttgatttcaccgcagccataattttgagtactaaatatataatagcacactactcttttgctcactgaaagacaacaaactactcttctagctgaaacagatattaatagatgcttcatattcattctgtcactcttggaagttgcaatgctatatcatcccttttgcttttcaaatcagcttggttctaaacatatttttaaacacatttcagatatcgaagacaagtgaatacgatcccctagatttattttctggatcaaaagaaagaatacatatggctatcaagtcatttttttcaactcctcagaacaactttagaatttttgtggatggttctttagtttttggtggcatgggaggtggcgcagatagtgttcatcctaatgaaacagagaaatgtcttgaagatctgagcaaggttactggcttacaactatctgactttattgagctcctgtcagaggcaatctttaagtctggagtgttgggtaaacttttagcc

SEQ ID NO: 33685 - DNA, 32967 bp, Oryza sativa
  unsure (1)..(32967): unsure at all n locations
gtttttttctttctaaaaactcttttaataaatgtttctttcccaccaacccattgatttgcacatttgttgttgcaggcatattttattgatctggatgtgaaacccttggataagatggtacattactttaaattggatcaaaagatagtcaatttctacactagaaatggagaagttgggggagatccacgtgatcctccaaagggatgtggccctaggtgacacaaaggttcagctccaaaggttcagctccaacattgacgaccttgaaatataaagggcataggacaagtgtctgttgtatcttggtgattgttgtgtttctacaagtgtgcatgtccaatgtgcaggttctcctcccttctagggaaaacgtgtaagagagtggtagttgttgtagtacatcctgtataccgtgtggtttgcctcagcagtaggccgaattttcagtagacaaacattaagaagagttaataaactgtatactgaggcatccacgtttaccttggaaatctatgataaattcccgtatactcagcttgctgtgaatctgtgatctgagttctgacatcctagtgcggcctggcaagttagtcgtttctgtactttcttttccggagtattttcagtgtaggcgtattgtgattttgttgcgctaaatgtctaaaatgaggtcatccgaatgcagaaagtgtttcttattcttctgatattgcttgtctatatatgcaatatctaggctctagaatgctaaaggctgttaattatgtataggtatagcccatggagtcatggataggttaaagttgttctaaccaccaacatccacagaggagacgtggctgcgtattgcgagcgcaacactaacctacaagtacgaacagttaggaattgcagttaaggttcgttgcctacttgcctactaccaaccagccgttaatcttgaagaaatgtccatatatgactatactgaaggacacgggacacctgcttggcatcaccagacaccaagtgaaaaatgtgaaccgtgttctataaatgtagagtagcgtgaaaaatgtgaaccgtgttctagaaatgtagagtagcgagctagagagttgttgatgacaaattggtagagctagccaatgaagagacgcatcaaggagatacttctactcgaggagttgagctaccattcactgccacctgaaaggctgaaaggcagcagtataaaagccaagcaagatatttgtaggctgtagttagttagctcgatcaaggaccgcggcagcagagcacccgctacaccggcatgcacggctctgccgtcgtggaagactcgatctacacggatacgtagcagctaggggagagctgagctctctcgcaccagtccgtccatgtcgaagaagacggtgctcagggtggacacctcctgcgacaaatgcaagcgcaagatcctgcaaaccgtctccggcctccaaggtacttttttatcatcaaagaaaatactataattttaacttatatctaattgtatttatattattctttaaatatgacgagtagtcaaatattatgtgataagtcaacgatatcatatatatatttttaaacaaatatactaatatgaagcattaacagatcgaagaaacaagcaaatgaactgttgattctaaattacaaagtgcaaaaagaatgtgaagcatagtgtgacatgtgtccatgttgatcaggtgttgacaagatcgatatcgactcggagaagggaacgatgacggtgaccggcagcgcggacccggtggacgtgatcgagcggacgaggaaggccgggaagcgcgcggaagtcgtgaccatcgggccgccgccggcgtcgtcgtcgtcgtcgtcgtccaacccgtcgacggagcagcagcagatcaagaagcaggcgccggcggccgaggagaaggtgtacacggcggccgcggagaagagggcgcctgagccgccggccaccgtgtacgtccactacatccccgcctcgacgtggtcggctccggcgtggccatcctacgagtacgaccagagcgtagtctaccaccagcaggatccccctccagcttgctccatcatgtaactaactaaataactatatactcatcgtttcatcatgtaactagatcgatctcgtgtgtatcctcattagtgatagcttcttatgtcgatcacatctactggaaatttagaaattaattaattatatcatgatcaagattcaagagcatgaagccatcttgctagatagtgcttcaggaggacggacggcctcctgcagctggcatctcactctgacaggccggcgctggagacgaatggagccggtgacatcgacccagacgccgttgggtgcaccgtacctcagcatggacggccgggatgcggccagctctcatcattctgatcgatcttgcaagagcatcttcattactaaacttaatcaccgcggacgcggacgactgcagactgcaaccaatcggcgtcggcgccgtccacgccggcggagcagcaagagatgccgccggcggccatcgtgcacgtccacgatgtcccttcgtggtcggcgccggcgaggccatccgccatccaacgagctgacccgtactcgatcatcatcttatcatcagagatattcagatcatgcatgccatttatgatgtgaagtaaatctcgcatgcatcctcattactcaccagtgaagtccttgcatctgtcgtttttcagatggtgttcttggggtcatcgtttcaaactccgaccctccttgggacatctgacagccgttggatcatgccatttgcggcccagataaacggaaaattattcagggccacagcctccggctcggtcagtcacgatattattgctggtttgaggattcggagagtaaatctccgaaccctcttgggatatatggctacggttcgatcaagcttatgcgtcccagatcgaacacaggaagtcgatccccttcagctccatgcctccatcgtacagcagactacgaagtactcatcagatcatagtatcatcatacaaggcatctgatagccgttcgatcacggcctttgcggctcatataagcggtccatttgtgggtactgggactactgggtagccatgtcaggcacgtgacaggttgtatgggcttttttttatatgggccgtaaacgcgatgcgtccagtagtggcaactttattattaatcacaccaataataaatcgaattaattgatcatagagtgatctaccgtaaccaatcttgctagctactggctagtgcttcaggaggacggcctctggagtggccggtggcgagtcctcggccgccacctctggctcgcccttgtagcggtagaagtaggagcagacgaggaagtagacgaagttgatcgccgcgaacacggccatggcgtagtagaagtggtccagcttcccggcgttgatgtcctcggcgacccagccctgcccgccgccgcgccgcctcgtcctcgcgttcacgacgttcacaaccgccgtggccaggtagctgctcgccccctgcgcgcagtagaacgccgcgttggcgagcgtgcgcatctggtccgggaactccgtgttgtagaactccatctgcccgatcatgttgaacgccgccgagacgcccatcacggcgagctgcggcgcgagcacgaacaccgacatcggcgacgtcccgccgttgtccaaggcggaggcccggcgcctgcgctcgacgacggccgcgaccacgagcgccaggccgctgatcgccacgccgacgccctgcctctgcagcaccgtgatgccgccctccaccccggtgacgcgctgcgctgcgcgggcgacgagcagatcgtagaccggcacgaagagcacgatggcgaggttgaatatggcggcgatcgacacgggcgggatggtgaagctcctgcccatgtggaggtccatggtcagggcctgcaggaacgtgtagttggtcagctccgccaccgagatgaaccacatcacgccggagatccacacggggacgatcttgacgaggcacttcacctcctccacctgctgcacgctgcacaggctccacggcctcgccggagatccgtccggccgtatctcgtcggcgtcggcggttacaatggccgccttgttcagaaagctcagctgcaacgtgagtgggagcttgaagacgcggctggttcccgttccagctgcgacgacgacgggaggattgtacagaacggcctcctgctgccgcgcgtcgcgcgggtgaggcagcgtgagcctccgcttccggcacgacgcgacgaccacccgcgcgacgctcgagaagatgctgccctcggccggcacgcggacgtacagcggcgtgccggcgaggaacacggcgaaggtggcggccacgagcgccgtggggatgccgaagccgaggccccagctcaccttgtcctggatgtacgcgatgaaggtgagcgccatgaacgaggccatcatggtgaccacgtagtaccagttgtagaagcgcttgagccccgcgggctcctcggcgcgccgtcgtcgctcgtcggcttcgttgctgctgctgccgctgctcgcgtcgtcgtggtcgaactggtccgcgccgaacggcaggctggtcgggttcgcgccgcccgtggccacgacgagcagcgccatgccgatgtagagcacggcgcggtggaggcccgacggccccgcgcacgtgccggcttgccgtgccacgtcgctgcacgacggtggcttgagctgacggatcgtcgccgatagcgtgatgaccaccattgcctgcatgggcgagaggagatcacggataagcagccattaatttcgtctcttaacctgataagcgagagatggatgatgagaggggactccaaactctccagaacattccctcgttaattattcgcatattatccgaatagttatgaaaatatttttaaaaaaatcaataaaattgattatgacaaattaacctatattcattgcatcttatatttaaattaaattaaattttatatgtttctaaataaatttatcttgtttatttaaaaaatcataattatttgaatgacatgtataaataacaagatatatctttcgagaatttttaaatagttttctgatgggtcatggatgcaatgctgatcacttacaacaaaggcggcgacggctccgaacaagagggtccagaacctgccgcagaacgcatcggcgacgaaggctccgaccaccggcgagaagctgtaggtgccactgaagacgttggccacgtttgttgcggcattcggcttcatgttgtaacgtttgatgaggtagttggtgacgggctgggcgaacgcgttcaacgccatggcgattgccaggtagagccctgcttccacgcacaccaaaaagcatttggtcattagctcacaaagcagcactcttaaattgttcttgcttttttaaaaaacaaaacagtggctcaaattttgaacttatcatgaactgtagtactacctctgtaaaaaaacaatttagtattgaatgaaacattttttatattcagatttattgcaatagaaaatatctcgttcaatactaggtgggttttttcgagatggagggagtacgaattcatgagcagacaggaaggagagagagaccgatcatgaacccgacggctttccatcctctcggcctccgcgacgccctgcctccggcctcatccacggcgaggctggtcgtctccggctgtcgccgggacgcgctcgccgtgcgagccatggatgctgctgcccttccgccctcacacatttccagttgccaatgtggctgattacttctgttgacgtgggtgatttgaattgagagatggacagatacagcgggcgctgatcccagtatttgtacccgcgagccgcgagaaaaagtaatcaggtgtggttttcccttgtttctcctgggctagatcggcactgtctcgtgtaatcctctgtttcgttgacagaaaaatgagccgggtgactttgtgaaagagtcaaatgtcgtcaaatttcacttggttggtactgttgcatgcagttgtgcatgaatgatttttttttccttttattgatcggaaaacagctgaataaactatctttccttttgcggcatgtggatgtgtaccttttttcccggaagaaggctgttagcagtataatatgaaggtttaagttagccttcaacctgaagaattctgttaggacatgtcatgtaattaagtataggaactagaagcagccccatctccttcgaggaactaacgtacgttcactcagatacatagaacgagtcttggtaattattacacgaatcccatattaccattcgtcttttggaacgtgttcggaatggatatgtataaacgtacttgtgacttgtgagtgcgtatgcactgtaaagtccagcgggatcaattttaaacccccaaatatcacgtccctaacgagccggtctatattcaaatgggatgatacatcagggaagacgtatctgtgaacggagcaacaaacgtcaatgcttttgtcttctctcttcttcgcgtgtgaacgtgtgatccgaactccgaagaaacacgccttgcgcacgacggtttcgccggccgcgcgttcaggagtcacgaattcacgatcatcatctagcgaaagccgaaaagctgcttggtcctgggaactactggaatgtgacagcaagcggcgcattttgttaatgtgagatgtgaaccatatcctccttatctgtctttatttaataaaattgcttaagtttcaaaaaataagaagaagatgtgaaccatgtcatgtgaaatcagtgatcccccgaagcaggactgcaggaagaacagtgagtgcagagagccgcgcagccactgctaatgggcgcgcccagccgcccccgcggtctcctcctatagtacagtactagtaccacctactactactataattactagtagtactactaccctattttacacaaattttacatacatgtacataaattaaattttatgtacaacagtgtagtattactactagtaacagtatagttgtagtagtactactactagtagtataaaagtagtagtagaggtagtaggcagtcctagtagtaataggtggtacgtatgtaaagtatgcatatttaaaaaaccgaaaacaaaaaaaaaacaccacgtgtatataaagtttgttgtatacacgtatacaaagtttatatatataaatacatacatatttaaaaaaccgaaaaccaagaaaaaaacaccacgtatacaatttttttattcgtatgtatacaaactttgtatacgcatgaatacaaaatttatatatatgtatatgttaaaaatcgaaagaaataaggggaaaaaccaggaaaaaacaaaaagaaaaactgaaaataaaaaacgagaaatgcacccttagactagaggcttgatctactagcgcttgcccgaatccgctggggtcgctaattttttttagataatgggaatttataaaacccggcttctacaccaacgggggtgtatacagccacagaaaatctgaccaaacaagctcagttcatacacacatgttcacaaacaaaaggatcacaaaggctcaagcaccttacataaaactaaaagagcacaaagacttccaacgcctttcaaagtgaaaagaccttccaaacaaactaacgaccacattactcctttaaccgctttctcatgttccatccatctttaccaaagaagtgcatgatagatgtctctaacagtttgcatccttctttcatcacatcgcgctaatcttctttaagcagcaaggaccattgtcgagcccaatacgtccccctgaaaataacctgcaagtaagagttaaaattggagccattgaagaccacatcatttctacaaatccacattacccacaacaacgccgcaatccctataaaaatttggtgctttagcctagattgcaaaccctttagccaaatcccaaacatattagcaacattgttaggcggatttatcccaaatgttataaaaagggtactccaaacaaatctagcaacatgacaatcaaagaagagatgttgtatcgtttcattgtggttacaaaaacaacacttagtgttgcccttccaatttctttttgctagattgtccttagtgagaatcactctcttctttaaagtgggggacctccacctcccccactttcacccggcctgcaccaccattcctctccgagctagcagctccccccttctcctctccctttcttcccatatcatccattttcctatcaaaagctggacgttgtgacctgaatcctcttgctgaccctctccctggtcttcctgcaaaactgctgcgccttgggccaaaaccacgagcccctctcaggcggtaaccatgcctctaccacctctgaccgaagctaccctgctgcccaaaaccatagcccggatcaaaccccatgcgacttccctgaaagcctgttccaaaaccttcctcctcctcctccctgaagctacctctttgcccccaatctttgttgctgcacccattgtaatcatctttcctccttgccatccctcccttccgaacctccttcttctcctcttcggctctaacctgcagctcgccgcctacacacagacccccttcttcgccgcctctttgcctccctaatggggaaactgttataatcaatcgagtaaatgtttatttgattattctatgttaattaaaggattataaaaaaatattaaaaatattttacaagatgattaatatataatatatcactttacaaatatgtaggctcaaattcaacttctataaattataacaaacataacaaattaacacaaaccgtatatacaacttgtagaggtgaagtgatatattatatattaattcatattgtcatcatttttaacaacatagggattctaacaataaaacaactcacgtcatatcataatttgagttattttgagatatagaaatatatatatatatatatatatatatatatatatatatatatatatatatatatatatatatagcttgatatcttaagggtttcaaaagtgtttttgaaagaccaaattaaccccaaagttcttatctttctttgacgtacgtaacaaattaagctcgatcttatgcttaacggtcagaataatattcaactgagatcatcaaggaaaacgtgtatattagaacagcgcaacgaattaacgtcaatgcttagtcgtcttagcatgtcacgaagtcatccatcgcgcaaaaacgtttaggaacagcaagcgcatgcagagatcggcgttttttcttgcgtgtcgcccgatcgaagcaggaagtccagtgtagtccgtgcgcagagccaccgcgactggatggtaataaggagaaagaatgatctaacttaacggaaaaaatcagattctggtttctagatggtagtacaggtcgatcaattgtaattacctctatgagattttgtggagttgaatgttctagctccacaaacctataaatctggatgtttaatttcattaatatcatttaaatgaatcatcttattttcatgatgaaatataaaattttaaaacactataatttaacacataaatttcaaatcaactgtggatttaaaatatgaagctacaccaaacagaatagctatggtcgcaaccgtgatcacaaccggtcttttacaaaattggtgtgcatgcacacacgcacgaactgatgcactttctcgtatttggtactccctttcagattataaatctttttgattttttttgaaattaaactatttcaagttcgattaagtttgtagacaaatattgtattatttacaatatccaattagcttcattaaatctgtagttgaatatatttgtcttggtttaaaaatattattattattttatataatatgaaacaaatggagtagtgaatttgatgccaaaaatgagcaacaattcaaccccacaccgagagaatacttcatcagcataattcatcaccggtcacttcttgttggttaggctcctcgacccgtggaacagaccatccgaatttcttgtgatgctcccaaattccaaacgcggcgcctaccaagaaaatccccgaaagctgcacaccgaaggccctgtactcccatgatacgccgggcgagaggatgctgaggagcgcacacacgatcccctgggagagcgtggtgcctacgaagacgacggaatcctcgaacgccatatactttgcgatgacctccgcacgatcacgatcagaatccggcgctgccgccgccgcctgcatcgtcttcggttggtaaggctcctcgatctgggagacgcagacagaccatccaaattttctgtaatgatcccaagctggaaccacggctccgatcaggaaaatgaccgagaacaacaatcccaaggtccggtgatccactgatatgctgggccagaggaaactgaggagcgcacacaagatgcccagagagagggagatgactgtcaagacgacggaacacgtcagtttcccacgcattgctccgcagcttgcatcaaactccattgtcttttctcctccctgcagatcagtcataataacaccagtcagtacagtacgtcctccaagttcgcctagtatacattgacgggccgggagccggatatatcgaatccgacacggctgggaaccgcatcgactccgacacggatgcggtgcggctggaaaaggaatttcgtgtagatgggcagcaaatcaccacgccgctgtatgagagcaagtataatacgtagtaagaaagtttagccgaccgtagtgtgcctatagtggcaaaagtagtgaggtggcaggaaaatgagtggagagagggagggagcaggtggctaaatagtcgacgacacactccctcccaggcgtaagaggcagcacatgattaattgagtgttcgagaaggacgggattgaggagactgagaagatgcgtaaaatgaggtgagctattagtacatgattaattaagtattaattattttaaactttaaaaatggattaatatgattttttaaagcaacttttttatagaaattttttacaaaaaacacaccgtttagtagttcggaaagcgtgcgtgtggaaaacaaaactatctttctctctttctcctgcgctcgaacgcagcctcgtcaacatgattgtggggtccacgtgaggtcagactagttgctttcttatgaaaacgagtggacatgaagaaagaggcagaaaattagaagaagaagataaaaaaaagcatttaaatctgtgggtagatgatgtaggccgtgtttagatttaaactttttttcttcaaactttcaactttttcgtcacatcaaatatttagacatatgcatggagcattaaatgtggacgaaaaaaatccaattgcacagtttgcatgtaaattgcaagacaaatcttttgagcctaattacgtcatgatttaacaatgtggtgctacagtaaacatttaataatgatgaaataattaggcttaatagatttatctcgcagtttataggtggaatctgtaatttgttttgttattagtctacgtttaatactttaaatgtatgtccgtatatttaaaaaaaatttagcacacgaactaaacacagccaaaatagctaactattgtacacaataaaccctcgttaacctaaatctagcttatcctgactcccccaaatgtgcttgttcacatggcgttgtcctaagtgatcatctttggcgtaatgacatccaaatgagcaactttctgcttgtccatggcggcagccggaggagccacggcttgtgtgtcggtggcttgaggagccactctgctcggcatgtcggtgtccacagcagccattttcttctcgctcacagccggaatggtggcggccggagcgatcacgaccaacttcttctcgacgggcatggacgcatggtgatgtccaaagccaaaggcacctccttttcatcgtccttcatcggcaagtcggcgcccggagcgaagcagagctactcgatctcaacatgagagacctaaactaaacttattccgtacaacaccggtgcgcaccccatcacatgggcccacttgttctttacagttttgtgggcccaaacttattaacaggccaaggcccagataaggagcccgggcccaattcatcgtgtcgtcttctctacccctaaaccgactacacgtctgacccctgttcctcttcgctccgtctctccccaccccacctccgccccgagacgacgagacccagcgagcgatcccgagggaagaaagagatcgagagggaagggaagggagaggatcggagagctttccgccggccatggggttctgggtgaccacgctcatcttcctcctcgccggcttcgtcgcctccctcttctcgctgctctgctgcaaccgcgggccgtcgaccaacctgtacgctcttcccccccgctgattctcttcagatagctgctgatctggtgtggtgtgattgggatcgcctgtatgccgcctggagctttcggatcggggcgggcgcgattcgggcggatttgacccgccggatggtggttttgatctagatttgggcgtattgtgtagggctaaggatttcctctattggtagatttctcgttgagattgcgtcgtcttttcgatcggataacggttgaaacggttggatcgatgggggtagcggctgatcttagcccatgttcagtaaaagaagtgacttcgtgcgaaaacccccaaatttgttcaatctttaccctatgttcctctcttaagatgaaattggtaggctgtaaccaggtttggcttttcagagctaattcgagtggttcaattactctaataatatgccaattagatttttcttcaaaaagattctgacacatgctgccgtaggatgatattgtttcagtgcatattacgaggttctaatggacaaaattaccggagccgggaaaacatgggtcattagatcacacagtcacactcacgcattattttcgactggaaactacaatgccagtttaaagtcagatgcattaagaatggcctctttttagtatggacttattttcattgtgaatgagagaacaggaagacgttactttgcccttttgacttctgagtatggacttttcaatagctatgtataatgcatagaaaagaaaaaaggggcataaatgacattgaatattgtagagggtcaatacgatgcatagaactacaatttagggtaatatatgtagactgaacgatttataactgatcttgggagaactatggcataatgtcatggtatagtcctgcctcaatttctgtgggttagtataaagtttgtgctgatttgttatcctgtctttcaagtcttcaaggattggttcaagaaaagagtccgaatatactactgtgtttttttaattattgtatcgtgactaagagtatttgtatctctagcctgtgttcttaattatttgatcgtgactaagagtatttgtatctctagcctactatgttcatgtgacgaatatcgtcatcgttcatatccattattggtactgtatcacacactttcttttattaatattcttctcaaagcatggtgactctatctaaattgtgtggctgtgtttctatcatattactaccgtcttcttatcattaccttgtcttgagaaaatactgggatgtttgaaatatggcagttagctgttgagctttgtctacatgcatgtggttattttgctaacctattaaattaacttatgtttaatttgtgcagattccatttgaccttggttattacagcaacggtttgctgttggatgatgtaagttctgatccatttgttcacttacactttctggtttgtctatccaaactggattgctcagaaaatatgattttaacagtaggctgattgattaattgaaacccaaaagtattgctggcaaacatgaaaagcacactaccagcaaaacttggcatcttatggtctacatgtagtctactttgaatcgcacaatggtgacattattttattgactagtaggtaatcttgcaaggtctaaatttctaggagcaatatgaactgatgattaactcttgttaaagtagaacaggtggtattagttgtacgctgaaactcaatctgattctgacttatagtttcactccattggttcttgtaacctgcatgtgctcaatataagtctgtttattctttggttgtgggtccatgagagccagatatcctggatagtttattgaaggagtaatgtcactcatatttcttatggcttcttttttaagatttgatatctgattgtcgttgtattgccgccttgcttacatgatggttccatcattgatcttccctcttttgcttgataagctccatactgggtgtgacaatccggatgccaatttttctggtagtaatttgttaatgcttatctgcaggtgggcaatcgtctatcttgcgcagctgaagccactgatcaaccctatcctaagcggcgagtgagctgtgttacaatttgaagtctgctcatgctgtatcactatttagttgaggatttctattcattttggcacgactgaaataaagaattgttgtgagattttggaacacttcctctagacactagaggatgcccactgtgattagtgtatgcaattatattatatacacaataatcggatcaatgaccttgtccattcaaacttccaaagtttacccaagataaatttctgcttccagctctagagagcaaaagtactttcttgaatgtttcttgtcagtgtacgtatgttcttgaatctttgtgcatgtctttaagttgcaaactgcattgccatcaatattgaagaaaaatagccaattctctataaaatgttcaagttcactcacaaggacaagaataacatgttcaagtggcagccacattgtgggtggcaaccaactgacctgactgcgtcgtatattcgtatccatgattagggttacttctatcgtacaattagcgtgctgtgatggtatggtatggtagctgttggcgcgcgccgacacgtagtcggcagtgccatgatgggtgttccaccgcgttgctgagaaaaagagaagaagctgcttgctgagtgaaaggttttgctacacaagcgaatatgttgtttggtcgtcagtttatgagagtctagagaagctgctaaatagagcttatgattaaacctagcttatgaattatacaactatagtttcttataatctgatgataatctattctaggataaattatagttattagaagctcacatattaactgctcacatgtacccgcaagaaatcttccaaaatacgcttaaagagacaaagatcaacaactgaactatgatcttgctaaaatcctatcaaaaagacgaaattagcggcaactctataatcttactaaaatccaatcgaaagcatacccatgagtgcgccgtgtctctatcgctgtatcattggtgcttcccctccctgccttcatttcctaccaacatcatccaattgtaaaatcgtccagattatttcttaagctctatgctgccattattgttacattggtgatttggtgtgatgataaatatatattgttgcctataggttatcatggaagttgaacactccgttaatttttagttgatttcttccaaactatagacatgtaaattttctttattgagtcacataattaataaaaatgccatttattttgaatttcgaggcagagatgattgtgaaagcaaccaacatcattttattgttggaagcttagatatggagagaatgagctaggatgcggaaaacaaataaagagagttaccagctacttatctaataatgctttattaacaatgattctatatagtacacaactactcaccatctttttatcagtcgaccatatatatatattaatcattatctattattttaataattattctatagtctttgtggtccttaaggttgttcttgtgcacaaggacactgttgcaacgccgacgacagaaaccagcctagtagaaccaaataaatataaaaatctccttacacgccactagagaatgaccggaaaagaaagccatggaagaaatgacgcaagcagcggacaaaaatggtctattttttcctttggaaagaaaaatcgagggggccccggatgatgtgctacaaaatcgcggatgctagttgaggacagctaattgacagtggtttcctccgcttatctctcaatatcctcgttggcttccgcccacttcaaaagtacacccccgagtataaaagccgccctctcattccgttagattcccacgccccccgaaaacaaaataattacggaaaagccccccatctctcctccccttctctctctcttccatcgcctccgtcttcttcttcttcctcctgcttccgcctcgacctccaattcccttcccacccaaaccctaaaacctaaatggccctcgcggcgggctcgccggagccgttcccgtgccgccagtgacccccgatccgcccgcccccgccgcggacggcggcgtccggggcccgatctcggggtgggtgtgtgtggggggcggggcgagatggcgtcccggcagcacaatgcgcagttccacaagaacaagacgctcgacaacaaatatgtgagtgttccggagcctaccgcctcggatcccggtggaattcgtgttctggtggtgttaattttgggtttggtttcgctcactgactgtgtgcatggtgggggggggggggggtgtggggccggtgcagatgctcggagatgaaatagggaagggagcatatgggcgagtgtacaaggggcttgacctggaaaatggagacttcgtggccatcaagcaagtatcgttggagaacatcccgcaggaggatctcaacatcatcatggtgaggttttctttttgggcctttcttatgatgcataacgtgtgccaaaggaaaaaagatgatgtatgcgattacgtgaaatgtggctgtcgggagttgataaacgggcagcagcgacctcaacagggataagtgcgtctggaaattggggaaatactgcttgttgtttgctatatcgatttgttcggtagcgtgacgtggaactaaatcatagagtggagttctgttagctcagttattcactagtcagcttcctaagcctatccaggcatgtaatagaagtcctgaacacatggccagatacgctagggtgatactacctctgattcaggttataagactttctagcattgcccacattcatatagatgttaatgaatctaggcacatatatatgtttagattcattaacatatatatgaatgtaggcaatgctagaaagtcttataatatgaaacggaggaagtataaaatagctggtttaattgtgtggtaggttatatgtttatcgaatgcaatagtatggagctcatgttctagttacttccgtttgtgtccagatcataattaccagatttgcggcaatgactgtgagccacgataaccctgcagtgaagtgattcaggccaaaacttagtatgattcactatctggttgtgaacccatcaacgctcacactgacaccttatccttgctgttgtcctccggtcctgtgttcatgggggcttttggtctccatagccacctctgtttctccccttcattgctatgaccactgctgtcactcatccattttgctgcccagtgaagttgtcacccttgttcctttttaattttttattcccgcacacattgtcgcagctggcttgctgcttgctgaagccatcgccattgctacactcaccaatgtctacttcagtttttttttgtgacttctcttgtttatcagtctaccttcatgtggtggacagagagaagaattttcagtgggcaggtaaggacagagggagatgactgccttgggtttgaagggtaggaggcaataactattcatttcccttttctcctttttatcattaacccacggaaagctgtaatacagcttgacctttttatacaacattttgtactagagttgggtgtcgatgttgggttcacggaccccatttctgatttcttagctagagtggtattcactctgctggaaccctaaatgtgaatcatcgaattgtcaacttgaaccatgaaccaaaatctggccacggtaggttcaactacagatacacattttggtgaaaatattgaaacactatttgacttaggaaagaaacttgaaaaagtcagtgaaaaatctacatgattaatgtttatttgtgccaacatgtgctaagctaaaatttacaaaggagctgttggtgttgaggttcataaaggagtccaaaccaaaaaattttagaagtttaatctgttggtgttactttttgctaaagtgaactaattgcacgagctattgtttatttttgtcatttggtgcatgcatggtttagtgcttggagttgacatttagcacaacctgataaatcctatactttttttatcctaccaccatattgtgctatcttattcagtgctttcattgtcaagattttatttgaatatcaccattttataatttctattgtattgctgtagtctgctgttctaataaattgttttttattgtgacttttccgttcatggtatgctgctgtggctgattcagcaagaaattgatctcttgaaagtaagtcttcattttctttcacattatttacttatcatatttgtacttgacaaaaaactaaataacacatcttactggttaaataatctcttatccccgcctatccttgtttttgttgcatctgttcccctttatctttggatgtaagtgttgctgttatcattatgcttctatagctatagccttacatgaacaaatttatgaagaaaattttggagttccatcaatgtatacttatttttatacacccaacaagcttctatttaaatgtttagctacatgttcctatggatgccctgatgcccaaaatttaatgaaaaatgataccgttccttcttctgtggttagtggtcatgtctataatctattgtacttgaaattaaatggttcttgatatctgaaatgtatatacgttcgcaagaaaattgtattgctgcgaattctaagttctgccactttacgcagaatctgaatcacaaaaatattgtgaagtatcttggatcattgaagacaaggagtcacctccatatcattctagagtaagcagttcacaatcctcatgacagtttcttgatatgattatacctattaggctattagtttttttttttttttagcttggaagttttaatcctcatgggatgattgcaggtatgtggagaatggatcacttgccaatattatcaagccaaacaaatttgggccattccctgaatcattggtggccgtctacattgctcaggtgaatatgatgattacctgcaactttcctgtttttgctatgtccggtattaatttttttacatatcgaaccaggtgctggaaggacttgtttatcttcacgagcaaggtgtcatacatagagatatcaagggcgcaaatatattgactaccaaagaggtttattgctgcatcacatccatatttaccccttttgtgatgacttgagataattgcaaagggaatatcttaagtatacaaattttggaaaaatgttttgaataacatccttgtaagctgtcgtcttcatgcacttctgttaacatgagaacacaaattaaatactatgcaggagttaggaaagggtacactgagatgagctcattcacatatatagcaatctagcagaaattatggaaacagagaactgctggaatgaatacctcataggcagttatgtaccaaatttgtctacatgttctcattaatccccacaatctcttgtttagggccttgtcaaacttgctgattttggagttgctactaaattaactgaagctgatatcaacacacattcagtggttggaactccatactggatggcccctgaggtttgctaattatcttcacttatgctgtttcaatgaatcaatcgattaggtttaactcctaattctactagtactatcaacataaaagctaattactactgccaacaggatagaacttattgctattttccatgccagcattacaccaagcgttatcaaccaaaattatttgcatcttgtgattctgaaacatactttttcttgcgagatgctaatgtatttgttcattatttatattgtgcattaggtcatcgaaatgtcaggtgtttgtgctgcatcagatatctggagtgttggttgtactgttattgagctactcacctgtgccccaccatattatgaccttcagcccatgcctgcgctgtttcgcattgttcaggttgattacttgcagctgtttacttcccctacattttcaaaagtcacaatatccattcacacatgagactatgattacatagaaagtttttatctatggacaataggatgtgcatccaccaataccagaaggcttatctcctgagattactgattttcttcgacaatgttttcaaaaggttctgtgtcgtttctggctatatctttgagaatttaatgattattttatcaaattgtttgctgttctgacttcaagaagcacctgtaggattcaatacaaagacctgatgcaaagacattattgatgcacccatggttgcaaaactcaaggcgagctttgccatctcttcgacaacctgttcaatcaccaaggtagctcacatttactgcctccttcttttcaattgctattcattgtaaatgataaaccaacaataatagccataaagatacaaacaggacggaaaacagaaaaatatagctccatagcttgtcatttttcagtcacctgatcactataagtctataataatggttgtatattctgcatattaaacctgtactggtcaattttattcaagcattgctagagttattcgtttagcaagtaggatgtgtacacaactacacatgtccaggggttaattgcagtactagtgggtttaagttagttatagatgcaacttcctgtgagagatgttccttctggaggtttgccactggaatttcttatagttttactctctctgcttttacatagtacatatacgtataatcccatttttttctttatgtgcctgtttaaattttgtggttagctaagtagcattttgccacttgcatcttttaactttttaagtagtgttattttatttgacataggcggcatatctcggtctgttgctgattttggttgttggttgttcacatggattttgcatagccttgtattgtagtctaccaggaattacaactgcatagtaattgcccaacaaaatcatagtttaaaatctcagcaaaattgatctctcaaatagctggcaccaaaattattttgaaccgtctttcgaaagtgaccttgataagccattgctaagttcctggtttgttagtactgtcagggatattgatgaggacgatgaaggatcaagtggtgacaatcactctggattttctggcccaccacgagatacacaaacacctactgcttctggccttgaacaggtatatatgcctttcagggttcttggcatgccatattctactcatattttgaaattagtccaaaattgtggactcacaagattattacgctatcataatgtgaacttttttattaacattgctttaggaggatggaagaaaagatttggtttctgaatctgccaggcaagatatacctgatgagtttcatgatggaatgttaaaaactactgggagtagtagttcgaatgatgtggaacttatgaaagataacgtggttcttaataaagatcctacattagttttccatgagaagctatcattggaatcttcactaggcgcaactgatttaaatggtaaactaactcatgaggtatcacaagatggtccaccaaacaagttaactagcagcggccaagaatcaagaaagagtgatggtaaatatgtagaagatgaaagtaaagatggttcaagtcttgaggatggtgatgctttcagcttccaggctggaggacaaaatatcaacttccaaaaggtgataattttatgcacatcattttgaccttgcacataagttttttttttttggggggggggtcaaagatgtacattttaacatttctaaatgcagcacattgaatattttatacttcctctgtttcacaatgtaagtcattctagcatttcccacattcacagtgatgttctatctagattcattaacatcactgtgaatgtgggaaatgtatatctagattcattaacatcnctgtgcatgtgggaaatgcnagaatgacttacattgtgaaacagagggagtattaagacatgcatgactagagtggcgcaatgtttctatgagaacattttttatccaatgtatgatagatcatatttttgatttgcagcttgtcagttatcgcctttcccccccaaaggcttcactgtcaaagccttgagcatatatgtgacctctgcatattctcatttgtaggtgtttttagctaattaattgccgttgaatgtttcatgtcttgacaggaagctaaaacttcagttgagatggctaacgagctaagtagattcagtgacacacctggagatgcctcctttgatgatttattcccacctaagaagcgaggagatcatggggctgaagcttcaacatccattactggtgaagagcttcaatacaatggtgcacaaaatgatctcgagaaggaactcaagactaggatgggtcagaagcagaaggaaaatgatactgagcacatgaatggtggaaaactttttgaatatgtcatgcgtttgagggaagaagatattgatggaacggtattgctttcactaatatagttatagtactatgtattttattttgcctgtacctttgagaatataaaataagtgacacaactctgatgatttcaggcatttgatgagactattcctggagagagtctttttcctttgcaggtatgcgatgccctaaagctctgatgtttctgtgactgatgtgtacctttatcataatgtagcaatgctcttgcttaaccttttctttttaagtttgagtatgtatttgtcttatatatggatcaagtgtccagctacgcaaccaagaagtgacatttgccatggactttggcagcactcatttgccttctcatgtattcaaatattgcattaggtgtcatttcatgtgcatgctagcaccaaggtccagcagaagcatccagagtactgcagaagttttagaatccaactgcatctgctggcaaactgtctacgtaggaggatagattgtgctagttaacactttattcatcttttttgaaagcaggttttctgtgcctaaaatgtatggaaaggttttttgtattttccttccccaaaacaatcataattattgtgtatgtttgaaattgcagtaatatttgctgcttaggttttgatacatttatagttatcatgtcttgatcatgaagtatttttccttgtctgtttttttttttgtagtctgtggaatacagcaaaatagtagcacagctgaaacctggggaaagtgaggacgtgatattatcagcttgccaaaagcttgtgtcaatcttcaatcaacggcctgagcaaaaacagatttatgtgtcacaaaatggtttccttccgctgatggagcttcttgaacttcccaaaaaccgtgtatgaagtttaacttttgtttgagagaacctttttactggatcttcacgctgaaaagttgattgttttccctgcagattattacttctgttctgcaactcatcaaccaaatagtaaaagataatacgaccttcctagaaaatgcttgccttgttggccttgtaagaccatttattcagataactatttacgacttataaattctgttgacgtggaattgatatgtgctgtttaaaatttatttgcagattccggtggttatgaattttgccgtgccagatcgtgcaaaggaagttcgggtgcaagcactctagaggatcccccagctttgtcaagccaggtttgttctttgacttaattgttagtgtctaactatatttagatacaaataaaaggaattaaacgttgtgggctaattttcaaatttgcatcctcagcaccttgacattgcaaatgttcattgcatgccaagggatccctgtattggtgagttttctggagcctgattatgcaaaatacaggtgagtccactcttctcttaacactccctttggaattttgtggtgtaatttaatgattatatctaattagtgtattccatatattttaaattagcagggaaatggttcatcttgcaatcgatggcatatggcaggtcttcaaactccagcattcgactccaagaaatgacttctgtcgcatagcggcaaaaaacgggatacttcttaggctggtcaatactcttcatagcttgaatgaagcaacaaggtttgcttccatctccgggtctggtgcttcagtaacacagaatggctccacccccaggcgaaggtctggtcaattagatccgccaatgctagaaatttccaaaacgaggctggatcatcaccattcatctggttcactgcaatctttacaagcagatgcagataggcatcatatcataatggatccttcagcatcgcctagattcaccgatatggcggctgctggtcacatggagagaaatgataatgatcccattaggccacaacggcttagtgtttctgcaggaaggacatcaacagatagatcaccaaagcatatagagctagtatcaaatgggcatagtagtggtcaaaatgatcaaattcgtcccctactgagcctgttggagaaagaaccaccctctcggcatgtatctggacaacttgattatgttcgccacttatctggtctagaaaggcatgaaagtattttgccattactgcatgcttcaacagagaggaaaactaacggcgaacttgacttgttaatggcagaatttgctggtatgcttaattcctctctcttcatcactcagcagttatgattaccatgtcttgggtcatgtgggctatttattcatctgccttttatgaacccaatatacacagtttttgttttgactgttctaaactctgtttgtagaattcgtatagcagtatttaggactatagaatactgtgtgtagttagtgcgaggtggttaggtacgagggaacaacctttctttatgcacttatttgtctttctatttcatgcagaggtctctagacagggaagagaaaatggtaaccttgtttcaacataaaaacttcaaatagggttccaagcatgaaatatgcaccatcatcaggtccaacaacttctaatgagggagcatcacatttggagctgcatcacagacagcatctggtgtgttatctggatcaggggtgttaaatgcaagaccgggaagtacaacatcatctggcctattagctcagatggtatctatgagtgctgacgtggcatgtgagtaccttgagaaagttgctgatcttcttttggagtttgcacaagcagacactgtcgtagaatctttcatgtctagccaaagccttcttgcacggcttttccagatgtttaacaagatagaaccgcctattcttcttaaggtaaaacttcaagcattttagtgacttagtgttgctactttgtgactgatttgtttgtgtttctgtttctgttcttgaaccatctttccttttctgcagattcttaggtgcattaatcatttgtcgggtgatcctaattgtctcgagacactccagcgcacagatgcaatcaagcatctgataccgattcttgaacttcatgatggccctctagtttatcaaatacatagtgaggtgggtagtttctttttaaaggcttttcttatgctatgtgctttaaacatacggagttggctgcacatgtgattatatcctgttgctttggatgaatttttagatgcttactcgttttcttttttttaaaaaaaaatgttttttatcctggttttctccctcttttgaatagtaaaatttctgttgctttttaaagaagagtttatgttatctctggcagacaaacagagtctagatgagcaaactagtgaacttatgcttgcattttattcaaccatatcattattcattaggtacagtgtactggaatcaaatagacaaaaccatgatattataaagtaaatatggtactccctctgattccaaatgtcagtgattttagacttctgcacaagaattaagaaaagaactcaaaatgactttgatgcccttcatttatacattggaaaagatgaatcatttgtttgtaaaacgggtagtagcatttatttaacaatgacaaacatgtaagaacagatgaaaaattgcatagaagttctaaaacagcttatgtgtaggaaagagttgagaaggctcaaacaacttacattgggatcgtaggagtagaaaaacgaatggtgacatcgcaaaattacaatggcttgtgcaactgcactttttctggaattcgcaaactttgtgttagggacaaatgtcaagacagttggctattcagaatttgaaataggtctgcacgatttctcagcacattataactctatgcaattttttgctgttttaggtcctcaatgctctgttcaatctttgcaagatcaataaaagaagacaggaacaagcagctgaaaatgggatcatccctcacttaatgaattttgtcatgtcagactcacctctcaggcaatatgctttacctctgctgtgtgatatggctcacgcttctcgcaactctagagagcagttgagggctcatggaggattggatgtgtacttgaacttattggaggatgatgcatgggcgtgtactgcgttagattcaattgctgtttgcttgtcccatgacaatgatcacagaaaagtggaacaagccttgttgaagaaagatgccattcagaaattagtgaagttttttcaagactgccctgaacaatattttgttcatatattggatgcttttttgaagataatcacgtaagaccaaagagttaccttcctttttgatgacattatataatatgaacatgacaggatacagaatattgagacatgcaattgcattgacttgactacaggaaatcttctcggataaatacagcaatggctaccaannnnnnnnnnnnnnnnnnnnnnnnaaggcttgaccaccgagaagctattgcccgtttgacactgctaaaattaataaaggtttgcattcctcgctttaaatttctggttacatggttttaatatatcaaccttctactagcagtgatcaaataagtctagaatttcattttactcaatatcaacgatatgtttaatgtacctttgtaaagtttgaactccatgatttaacgttcgattgtttggaattgctttcaggttgtctatgagcatcatcctcgaccaaagcagctcatagttgagaatgatcttcctcaaaagctacaaaacctgatcgaagaacgaagggatgggcaacgtggcggtcaacaggtattggtgaaacaaatggccacctcgttgttgaaagcactgcacatcaatacagtactgtgatttgtctctcggccattgtgtatttttcctctcaagttgtatatgttcgccccggaggaaaagttttgtttcttctttcgctgcctcttttgtacctgtggtttccctggcgtgagagccagtctgttgcacgcctgatccctcttttatcgggagaaaggttcaacgttcgggtgctagatacaaaatgggttcctagagcccttcttggtcgtttatatttagtgtactattagtgataattggtgtaaattagttttccccagtttcctttttagaactcatgtagactttcttgcatctgatgttagtaaaattttgctctaggtgtgctggctattcttatccttagcctgacttcatgatgtttctttctttgtgagcatgtttccaccggtatgtttatgactctgtgtgaattactgaacaacgaacaggaaaagaattcattcatcccaaacgggacaagtaaaattatttcaggcgcagccatgggcgcatttcatatgaaaaaagtcattcccacgaacgtgtgacggaaacagatgtctgaaaactatgaacgaaatcaccattaaaaaaaactcctgatgtaacacacaagatacacagcattgctttgcatatcactgcttgtctttgaaaacggcacgagtattggagcgtacactaacgagaaaattcccagcatacaggaatgcggtttattcagtttcataacagtgggtatcgaaatcagatatgctcataacagataaccaaatttcagcctaagcgctttgagctccgtgagatttccagagtttggtccattcctccattgcatcagcagctttagcgaagattgcattctgcggtcccagtttctccttgacaatgctggttagttccttaacacagtcttcaacagtaactgaagtactcgatagcttcagagattcgaagaagggaagaacgacgtccatgactttcaccccttcccattctttcaagctctcgagagccttacctgcttctgcatcacttctcatcacataaggaagacctgtcttcacgccataccgtaagcgatcacacaccactttagcacacaagccattccaaacgtcttcaagtgtatcccatctgtgctttccttccttgcgcagccgcagagcagggaacattacaggtcccagcacctcacggttgaatgcaacatttatcccgctcacaggcatcatcgcaccaagtggaactgtcatcacagcatccacatacgttgtgttgcgttgatttctcttcacaacatgagtcattgggtcatagtctgcattgtgaagccacagcccacaagagagcatgcactcaaccccctcgcgcagactaaatgggtatccacggacaaagtcagcccctttgcggaatggatcatacaatgtgttgaaaaagaaaggtgtagcaggtgtcttcagattggacatatgctgtgcaactgcatcaacagtcaacccaccattgtccttcgctgggaggcaattgtcatcaattgagatgacatacttcttgcgtgagacaaggtacccaaagtaacggcatgagtgaccagagaagtcgatggatgtggctccaagcactcccatatctgacttcgtataaaccttgagatcaaaacctgtagggatttgaagctcctcagccatatctggatctttgacaacaatgatgtggaaccgagagaaaaatggcctccatgcctcaaagaaagtagtcaggttgggctggagtgctgcaatcacaatgtcgacctcactgtcctgaatttccaaagacatcttttctcaggtaaccaagactgacctaatcagtgtcacttctagaacttctcagagcaccctacagccaagaggatagcgtgtcaaaaaccaagatcttttgacataaatcacatgacaatcaaatagacagagataagctgatgaataacatactcgtgggaaggaccggtacaagcggctgcttaatgttgagcaactgaacaagcaaggcgatttcctcgcaatccgttgccagaaacaacttcaggactttttctgtcagcttaccggcagctatagttctctgccaacaaagatgccttcagagattaacaaaatataatagcaaaactattactttcagtttgatctatcataataataaaaaaaaaagtgagtaggatcacaactacgagtctaaaccccagctcatggccaaatgttcataaacccccatccatcctctcagcaaaattgacaggttcaacgtagcatcatcagaccacttggtaatcaaacatgggccgcattgggcacctcgtgtgatatgatctaaatctaaacacaaaacaggtggtgcaaatcacctcttcccatttcccaatccgataagttccactaattgcgcgcacgatgtaccacatatataacctagtctcattaatctcatcaatctaagcagccaattgccacagatcagccaaaccaaccaacataaacaataataggaaataccacaacacaacactgcatccgagcatcgggacgagaggggcaaaggggggatcaatcgagcgagcgatggtgtgggggtacctacacggaagaggtcgatgaggaggtggtcggggaggcgggagaggtcgtggaggtgggcgatgcggaggagcgcggagtcgagggtgagggagagcatggagggggggcgcatcggcgccagatctggatctcgcgccccctcttttataatccccacgcttccgttgcaagcaaagcgcgcgccacgttgcgcccgctgcctcgatcctcctcctcctcgcttccgctctccctcttccgcttgccggcaatcgaggaggaaacggatcggcgactttttttttttccttcccttgtcctttttggcccccccaactcttgtggaatttttccaccgtcctccacttcctgtaaccgtacgagcgctgggtcgcgggctgcgtgggcgtggtcaccgacagacagcccacagacggcccagcgtgatggattgatggatggggcctaggatgatctcaccaggccgtcccgcgtcgatgggtccgtgtcatgtctgcattcttcgcctactatagaaaatgggaatactataatactaaaaaaatctagataaaagttatagtattagtatgtgctatattataatttatttattttaggactagttataataactattttttcgttcaaaaataaataaacttatgataagaatatagatatataactattcagcattttattttatgtttgtttgttttagaacggaagaaatgttaccttgacagttgctattcggattggtcatttgaattacccattatctgctgggtgccacgttacggtagaacttcgtagatattttccttttaagcacaaataatcgaagctgatgcagagcctactagtacacgaatatacacgtgtgaatgctctcagttgatgatcgtgacttatcgacaaaaggacgctgaatttcctcgagcattcataccatctaccgacatttctgtcgaaccggtggagtagattaacaaagctattaacgaacgagttaagcatggacagcttttctaaaacagcagggattgctggaaatggattcaatttttgccaaaaagaaaggagccaccttttattatcaatattttattttagatcgtcctttaactaatattattttaattagacggagtagacttatctatgtttcactttgaaacatcagactcttttctcaggtatatgaacaatcttgattatgttggctcttatttatcaatgaactttcacacatgtatacgtaagactatttctttggtttataataagttgaatgtagatgaataaaaaagttaaatatggtctagagtacttaaaaaaaataaaaaaatctgattcaaagtactattaagaaaagatggtttaaagcgaaataacctaaagtaaaatttacttaaaagtattggtaaacccagaaaagtttggaaagacggcgcagcgcaagcaggcccgcgtgcgtgcccaagagtacaggcccggtccacggaggccggaacagaaggaaagcacagccgtcgtcttctcgcctccgctgtcagttacacacaccccccccccccttctttccagccaggctgccgcccgtccgtccgcccccgcgcaccacgcggcgtctcgtcttcctctcatcggaccaccaaatttgaggttggcttccacttccacctccacctccacctcctccgcctccgcctccgcctccaaaccctagcgcctcgccgcccaccgacccccgcgcttctcctccatccatgcgcccccgtctcgtcgccgccgccgccgccgccgatcatggctgcctctagggtttcccgggcccagccatggtgatctcatccccgccaacgaaccactcttctgcatcggtaagtccccgttggccccccacccccgcccacctctcgctcgcttctatgacctcgaggggattcgatctcctcgcccctcgctcgcggatgcgcggagcccaatcgcgttgctaaatccgaacctctaatgtgagtgtctctccagctttgtacgattcgcccgagcctggatcccgccttcattgacgcgcccgctgtccgggaacaccatgatgtcgaggtcagctccgcagctcaaaatctactgagcttattggtgcttaatttggtgcaatgtagaagtgtaaatggttttcctgttgcttccaggtttatgcaaatagggaagagcagaaaactagttcatgatgtattggttaactcgaaacccaatagtttcactgcacataacattggatccaactttgcgttcggtttggcacatacaggcagggcctgtttgcacgggaaggttccgcatggaccgggcacgtcatccatgcttggaagagcaaaggannnnnnnnnnnnnnnnnnnnnnnnnnnnnnnnnnn

SEQ ID NO: 33686 - DNA, 7400 bp, Oryza sativa
gatgacctcgatggacatgatcgaattaaaagcgcccttgcacatattggcactcatgctctcctgaaaatgcttctggtaatgctttcagccatctcttagaattgtcattattgttttgcgtttggagatgagagcatgtatttcatttgagtgaaacaatgaaatgttatagcatacccttttgatgaatgatgactcttgtgtcttatggtctatttctgggttactgtttatgctgtgagcccgtgagttcaattgagcattgttgcatttaacctctaaattgaactgcctgtttataaaagttcagtgcttgtttagaaacatctctggttcatattgatataggttagcaaagacattcagcacaactgtcacttcacttctctagacaaaactaatccaaatatatctttacacaagtttgaaaccaaggatttgaaaatatgcaaaatgtgacatattttggaaagataaagggtttcaatattttgttttatgcatataatatcactttagctccttcgttcttagtttcttacagaactattgtgtatgcaattcaacacaatattaaaagatcattatttttattattattttggtccaaattgatgaacctcactggaccttgaccatctctctttagtacattctatttgctagttacacataggcacttaacattttagggcttttaattatggttagttttcaccacgttgcagcattgttaacatccaccttttgcaggttgataactttgttcatgcggatatgcaccctggaaatattttggtccgtgttatacaaccaaggaattcaaataacacccttttgaagtctaggccacatgtagtattccttgatgtaggaatgactgctgaactttcaagtaatgatcgtgtgaatttactggaatttttcaaggctgttgcacgccgagatggtcgtacagctgcagaacgtacactgaggttatcaaaacagcaaaactgcccaaatccaaaagccttcattgaggtaattattatttcttgtcactggtctgtttcttggcagtaacacctctgcttttccttgttgaggtcctcggtgcaccctttagtcaagataattatattgctgctataataggtggtatatgcatctttaagatatgaattgatggcaagatgtatttgggcactgtaccttgctggaaagcacctgggatgtttaaattttgagtaaatttcataaaaccccatctatatggtccaagatgcagaaaactatagtgcttttgacaagtggcacataacctcgtgtaggtactaaagtttcacaaaaccacaccgttaaccattttggcatactcctatatcaaaattttaaaaaccggatataacagttatacgatggattaaaaaactcataaatttgagatgtgattgtataaccccatcaagtgtggttttgtgaaactttaggaccataatacctggggttacatgccacgtgccaaaatcactgtggttttgtgcaacttggacaatattatgtgggattttatgaaatttactcttaaatcttaggtgttctctttactctcttgttgacaaattgcgccactacattaaattgaattgttataatacctgatattaattaatttgctgatgcattatgggtttgtgcttatatttaatgtgagtcctgtgagtttttggtcaactatttggtggtttgatactaacatgaaatatagttaccttatatttggtgttagtaaagtatacattttagatgcatgcatttctaggtccaaactttcggtgcacttgaatatttgcctcaactcatcaacatgaactaatctatcacaagttcacaatgtcacattttatgtaaatgcatttagctacaaattaattaaaacaatgttgtgttggtacaatgcctttttatatatttgatagttacaaattacgacaagtcctacatgtcttgtttttgtcaacaggaagttgaacggtcgttttccttttggggaacctctgaaggtgatgctgtccacccagctgagtgtatgcaccagttgcttgagcaagtacggcgccataaagtaaacattgatgggaacgtttgtactgttatggtcactacattagttcttgaggtatgcttcaactgcttgtctcatgctccagtcagtcacttattatggtgtaacttaggccctgtttgtttcaacttaagattattgtaatctagattattgaaccagattactataagctggattataataagccggcatagaataagctgttagctgtttgtttctctggattattagttgttagccgcccaataatctaaaaaagcacctttagagtggattaccagattatagtaatctggtttatagattgtaatacagtattatctatcataataagttatatgtttgtttcagcttactcctaataatccagattataataatcctaagctgaatcaaacagggccttagatgtctctgtcatatgtccaatagatcacgatgagctgtttctcaagattatagtatgtgctgtattgccaacgagaaaggtatatggagatgtatttaggacctaggagttaggagaactcgacccctagaattcagtcacaacgttttctaatggcatagtcagatgactgaacatgcactccctagatgtcacaatatgacaaaagacttcaggggtattaggtttatgcatatttgtaccctgaccttagaccttgatggaaatgcatgaatatgagaattttcatcttcattgaatggtctcaagagcttcggattcgttgataatgcctactagttgcctaaggataaaagtgtcttgacatagtaggtcacagttaaagtgattctttgttggttgcagaattgttttcaaaaaaagtagtgggaaaaggtgctttatagcagaacatctttagcaacatatttaaaactggagaaatggtgtaaataaccaaactaccatagcggaacctcatgaaatatcatatatatgactcttatagcttacttttagtcagtgttctggaaatctggctctgtaattcaaagtacatgtgcctctgtactgctttgtgttcctacctatttctgcttctgcgttagtttccttttgttaaaagggaaataattgtcatgaacttttgtttctttctcattctctcatactatctatagcctattgcttattgctccattacagatccttgagtttgttttttattttacagggctggcagcgcaagttggatccagattacaatgttatgaaaacattacaaactttactttttaaggaagactgggccaagtctcttcagtacacaatcgaagggcttatggcaccttagggatgcattggaatccactaaaaaattttgaccccttttttgcgcagttgatgagatattggaggatgctccttcgcaccagtacatctagtttctttttcctgtttacttttaaattccacagttttgtacccatcttggccagtgctgcttaaacggccatgtctaattaataattgcagcattttttcaagctaccagagaagtgtgctctggacccacaataccctgggattatctgcttatgcactctgcaggccaaaggatgcgttctcctccatgaaatttctgttaatagctcttagaagatgtagcaaaaggccttcgctgatgatctttttgtaactcgagaggtgtcagtgaacaagaggttttttattgtatacacagatacagctaactgttccaaaaaaaacctacgtcatgcctgacaaaattcatggattgcccatataactgagtgctttcgcatttgtttggaatgcagaagacttaactgtacaaatgtttgctggtaagcaggcatagagtttatttccaggttgcttctgcgtttcaaattcctgtcttatgttgatacaaaatactagccaaattcctccttttatacgtccgcggcaatttacaagttgaatacttgaatgcaatgcccattcttgttcttttttctttgctggtcctttgcaggtatagtgattagtgaacctggagttctatttctttctctttttttttgaaaaaaggttttctgttgggacttctcttgtagtaaaaaaaaaaaactgtgccatatatggaattcagggtctacctttctgttgggtgctctgatcctggtaacttagcggtagctcggttttcatgaaaaccaacaatttttaaacatttcttttaaaaaacataaatttgaatccaaattctcaggttcagttgatcacatgacaaaaactggtcggtttcactgaaatgttgattgggaataacaaaatttcgctacacgaactagaatcaaatcgatctatgtccaagaaaaacacccggttttgttgaaaagctgaagattactgcagaattaattttgttttatgaaaatgggggaatagggaaaattaaggaaatgtgtaggaaatgagagaacttatataaaaatgctgacatgagctttcctacattgtagttctctccattgagaaacacacgattgcaatacactctcatgaaaacaattttaaagcacaggcaattgataattcaatatgcatcaccaaacataggccaaatccggctgtggtcgctcggtttctgtgtggtcccggatggaaatcgacacccggcgagcagcaaactaccgcagtggtagggaacgatcactgtatccggcggaggaacgtcgttgccgcccgaatcctttcatctttttcctaaaatgggctggttgaccctatttgtcattgccttttggcccatgaaggtcattttccttttaatatatactacttttctattattgtgtgccgttaaaagaacacacgaaaattcatatttttttaaagcatgccattaatgagttatatgaatatcatagtacttttaggaattttaaaatcgctttcatttttcttcagatcaaatttgaattggaccgaaatgcatcgaattttccaatggaatattctttcgagctaggttcaggatgtctggttttcgtgaaaaccaaccgaattttatctaaaaggtaaaccatgatggaattttcttatcttcgagacatctgttggtaacctactcttagttggtgctttctgccatattactgcagatgacgaaaagtagtggccatatacttcggacatgttaacaaaagagtttttttttttttgtctcttgaaaccgaaggcagacttgctggtattatattaagtaggaaaaggccctgtttagtttcaaagtttttttttctaaacctccaacttttcatcacatcaaacatttcatacacacacaacttttctatcacatcgtaccaatttcaaacaaagtttcaaacttcagtgtgaactaaacacaaccaaagagtatatttatatatttttcccaactgtgaaaagaagaaaggaagaaaaataacaaagatacattcatatcttcacagaggtacgagatagggactaaggcaacattcaacgaaagagttttcattttttacctacaaggtgactaggtgagacttgactctttttgagtcttgagacgactggttgaagaacatcactattttttttcaagatacgaacagggtactgagtttctgataaaacctgacctgtgtggctgtggccggagtagctgtctacccgtgcacattaacaccgatggcacaagccgagcgcgggagcaggggcgatcacccatcgatccttaaccacgatgtgcccctctcatccgttgaccaattctgcgtcacaagcaggatggccaaggatcatgtcaaaccctatcccgaatcattgcgcccaacccaaaggatcgagcagagaattaagcggcgcgcaaatgtgtgatcccggcgagtttgatcggttgaacatgcgagaagttccgggttgctttccccgtttctgtcgtatcaaatcggagaacttttcggaccagctagcttgaccaggtacgtacgcatacccgatcaatgcccgtatctgtatgtattccagacgagcacacacaggaaacggaagaatacggtgtcttaattgctgtgctgtctgacgtatacggcggcagggtaggcgtagtactagtagtaggacctggagcttgaaggagggtcaaagaggaggacaaaatcggagacatggattgggcccgtgtattgtatatagggcccggttagtttccaaatttttttcccaaaaacatcacatcgaatctttaggtacatgcataaagcattaaatatagataaaaagaaaaactaattgtacagttatggggaaaatcgcgagacgaatcttctaagcctaattagtccgtgattagccataagtgctaccgtacccacatgtgctaatgacggcttaattagtctcaaaagattcgtcacgcggtttccagacgagttttgaaattagtttttttattcgtgtccgaaaactccttctaacatctgttcaaacgttcgatgtgacatccaaaaattttctttttcccaactaaacacacccatggcccgttggtggcgggtcgcggtaggaggcaacaaggcagcaaacgcacgcacacgcacgcacgcacgatcgcacgagcagctgctgcggctagcgatcgatcggtcatccatccatccatcggtcgctcttcggcccacgcccccttgcctctcgttatcccgcgcacgcgtacgtacgtccatcggtaggcgcggccggccgcgcgcgcgaggcccccacccatgtgcagatgcgcgtctccagctcggccgccgccacgtccgtccgcgccgcgcgaatcgcccgcccctttttttcccctgttccccagcagaaacgcccgcgcgcgcggcaagcaatcatcacgagttggggtttactcccgtggaacgatcgatcgacgacgcatcatcgatcatacgtacgtcgtcccgatcgaccttgtactagttaaaaagcctcgcctcgcggctcaaaaggaggatcgatttggttattatcattagctaacttgtacgatagacgacgtcaccagatctgctgggaaagctagcattagcccccgttccaatcgcgcctcgaccggtacgtacagtgcaaccaccgtacgtgaggtcgatcgcctgcagggcgtacgcacgatggtgcgtccgtttgattagagcatgatatttgattagcaccgaataaaaagaacaagaaatctgattagcagcagctcgatcggcttcatgaatggagtaccgggcccggtcatgcgtatctccctgcacgtacgcg

SEQ ID NO: 33687 - DNA, 3783 bp, Oryza sativa
attggtggttggtgccgtgtcgcgcgggagttgtttcaaccacatgcgggacggggacgcgcgcgcacgcacctttccgggacccgcgcgcgcccgcccgcctcgatccatccatccatccatcgactcgactcgattcgatccatccccctgccttgtcgtgccgttagccgtgtcgtacgtcctcccgcgacaacgaccgcaccatgcaaacacacacactagtatgcaagtgtgtactgcaaccgcacgcacatgtgtacacctccatccatcgatcgatcgatctctccgactcgacgaccgtacccatccctgcgtgctaccctcctccggctaattaaaccacaactatagctacatacataatcaaatcatcgttacactactagcgtagaacgtctcgccgattatagagccactcatgcacgacagtatacccgcgtgccgtgctgtgtacgcgcgatccccgcggtgagtcgtgattgatataggcatatcgtggcgccatacgggccgtagcccgtaggcgaaccaccgccccgcacggctcacctgctcacctggtttgtcatatgagcccatgaccaataatttcaccgcacgcacgcccgccccgcgcgtccgaggagaaaacggtggcggtcacgctggattgaaggtttttccttctagttttaaaccttttcttttctgctgcaacatcatatcaacggagcggcctctattccgcattactcttctactgttagcggcagttgaacaaattaaagaaccaatcatgaacgattgcacgagcgggtaatcttgatccactcgtcagatgtcgtactttcgtgctaactggttcctgctccagccagcagcaagcgactactcactccgtctcatgaaaaaccaacctataactaaatgtgacacatcctattttataaatataaacatacctctgtttcgtattcgttgtattataaagtgttatgtttcgttttagatttattttttttttggacggagggattacatactgacgatctggagatagtaccggccagaacgcaaacgcacacgtacgtacgcatcgatcgaccgatcaattcgatcacctcatcatgcatgcatgtcgatcaacatgccaagttagcgatcgagagctagccataatgataagcactgttgaccaaatgagaggacccggccggcagcaacccttgattctgtgcatcagcatagagctctagtggatgaaacagttgcaataatgaaacagcagcaacatgcagaagacatcaaaattcttaaacctccaagacaagagtcggccggccggccgggtcgccttgttggctacagctccacgatgaccatgacactctcccctgcaaatgttgcagcaaattaagatctcggctcgacgacacaaacacgaaacgattgcatatatacatgtattggtccccctctgattagctagcaactaatggacgtctaaccatgccaattaatgggaaattaaggtgcagcattatgtaattaaaacagtacctgtgctgattgattcttagctggcttgggtaataagacgaaccaaatttaaggggaaattaacagatactcctcctagctgtgatatactcatagtggtgtccggccgtttgtatatacggatattagacatagcgcgcgcggcatgcatgcagaggcttgttcctttcatgaaaaagaggtggagtgtcttgtaaggcatgctacatggaagcatcacgatttaaatacatttggcaaagttcttgcatagatcatcaggtctaacctcccaaattgagcatgcccggccggccctgcaggctgcagattgcttaaactgcttggcttagcttgtagcctgcatatatattatctggaactacatgagtactactattcgattagcgtagctggcataacatcttaattaattagagtagtagaaatgtctgaaaaatgcaagcttgtttgcagtcagaattatattttttttcttgcattcggctatgtaacttaatcccttctattaatataacgctaaccaatctgtttggccgttaaaaaaaataacatcttaattgatggactcgaaaaattaatagtactgtaaaaatctagcatgaacaatctatataatataatataatgctgctgccacccccgttgctcagcatgacttttgcatgtttggcgccgatatggatgaatcgtcttgtttactacttgttgcatgcatgtgggctaaggcctctttaggggaccaaatcaataagatgtatacaaagtggccctattgtaatctccgaaagtaagtgggatcccccatctcctagtcctacttcttggaaccttctttaattataatctgctgctagcggatcataaaacaacggaatctatccatcatgtcctgcatagataagggaacatgcacgcatattatcacattcgtcaaagcactctatcatatcatatacacttgtaacttgttgcttcctcattggctatctctagagccatttaattatttatttatatgtgattaatctctcgtttttttaactagttgtgagtctcaaacatgtactgacatcgattaattacagaggtagtacagactctactttagttggagacatgggtgtgtggttttggaaggatgtgtcgtagtagcgttagttgaatgcagttggatgagctagctttactcttcggcttggcaaccgctacctttcgtaccatagtgcacgagctcaacatgaacaatgccattaaaagagcggcggctacttcaaaagatgaaagtgaaagcattatattgttaattaattaggtcatctgattttgagaaatgttaaattcttaatttctccaggatttcctatacttctcatcaagcgtccggcgatgtatactatcttaaactacatatcatactcatatagtttattctgcacttaagatcagaatgcatgatcaatctgcgatttgaaaatatttttcagcagctatatatacatagcatatataggtcatgcgatcctatagcttttttttttttgcggggctatagcttaattagttaggaccactgttgatgtagggaaaaaaagcatgcatgtatgcactggcagattctttcattcacacgtacatatctataaagttttattgcaactcaattgttaaagtgcatactgtattaattctcacgtatgaatttaatgtacagttatatataattcagtaatttgtttaggagctaggagaattaatattctgactgaacttgcatgtatgcagacaaactatacacattcacttcaattaattggactgtgatatttttggtgcatacgttttttatatacagtaattgtttaaatctgtatttatgctcttcggccacatatgacgaactggacatttaaacatgataatgacattagaaggtagggggtatgtttctgacaggaactttaattatgtatcttaacacgtatattttggacattctgagacgtttgtggagataaccaaacttggttttaatgatattttagaagtacttattgtaaacggtgaaatttagaaattttcgttagttaagatcgggtcaaagaaggaattcacgctgtgagtatagaagattcagttaggcaagctgatccagatttggtattaaccttctgcaataggaaatgtgtatcttagtttttttatatatataaatagagtcctgaatcgatgagttgt

SEQ ID NO: 33688 - DNA, 968 bp, Oryza sativa
cttcacttgtattggttgggctgtactttctcaattaagtctgatatattaatttgatctttgcatgcgttgcctatctaatgtatcagatctatctttgattgttttgctctcatagttagggtattatatcaaatcactttgaattttaccaatcggctagtttaaatctatcaaacttaccattaatcttgaattatcttggttatgtccaatctactaaaattataatttgctagataaatttattcaagtcaataggtttaaacaattgtttcattggagtcttaaccgatgagttatgtgtttattataaattaatttgctacatcgtttgagttacaagatttagcataatcggttaactgctatttttgttatcttcaatcttatactgacggagcgtggggctcctcaccgggagaccgcgcaggcccccctttgccagttcagccgggggcgctaagtgaggttcttcgccctcgatctgaggaacgtcagcgagagaggaaatgcacaagacacgggcgatgtagacaggtccgggccgctgagaagcgtaacaccctactcctgtgttctggtggatctatgcgtgaaggaatacagagagccggagagcgagagagagttcaggctctagaacccattccccagagtcccagtccccttctcccctctcctcccttttttctcctaggcctgggcctcctttttatctggtcaggggtcaccacatgggcctctagctgcctaagaagggaaacatgctttttacaatgagggctagtctacagccggaagtgacctctgacaagcagagcacacgtctcctgccccgctcgcctgctttcccggtggacgcccatttcaaccttcatttaatggccagcgacttccttaccatacttgcgctgaagcctggaatggatttgaccgggactgacataccaactccaggagttagc

SEQ ID NO: 33689 - DNA, 881 bp, Oryza sativa
aatctcaaaccagctcggtgcacttgagcaacacttccagaagcaacaggctcttcttcaaaattctcaaaaagatcagatagctttcgaccaaaagctttctcaacagtctctttggtataagcaaagctgtgagcaggtgcttttgtgtgtagttttgacaattcagcacagaggtcactttcaaataaatcagggcgagtagcagcccattggccccatttaataaatgcaggacctgctttctccagggtacgatgcacaagacggagccatgttttcctgtacttactgccaagagtatctgcaaatggggccatgagtatacttggagtgaacaacaatgccaaatatattgatctgaagattatgatgaccagctctactgctgaaaatatcaaggaggtgacatagatacgaccatcttgagcacgcgtgtaaagactatcacgaattggtaagtactctccgtctgcactggtcttctgagctagcattatctccccagcaacgaaagcaaagaggtaaggaactaaattagatctagtggcagccaagctaatggcacaagcaaccctacttaaaatcggagatgcctttggtacatgagaaccgattgtcatgagttgcttccaagcaagttgaccatgaaatgcattctggctacatgttgagagaactgaaaagtttcttgcagctggattccggtataaactctcctttgctcttccaagcatggatgacgtgcccggtccatgcggaaccttcccgtgcaaacaggccctgcctgtatgtgccaaaccgaacgcaaagttggatccaatgttatgtgcagtgaaactattgggtttcgagttaaccaatacatcatgaacaagttt

SEQ ID NO: 33690 - DNA, 1547 bp, Oryza sativa
ctctttttggaatgacttctcagcccttcttaagcttaggggcatagacatggagagggacagccattctgcctccatagcttggtgccctttaaggtctcatgatgtcccagtctgcaatgggcactgcaagaaggctacaaccaacggtgcaatttcacccaaatcagtaccagctccctctaatatggtttctgctgttagctcaatgctcttatcccttggagaggatcccttcaggaaagaacttgtaggtactcctcagcgttacgtgcaatggctgatgaagttcagagcatgtaacctagatgtgaagctgaatggctttacactcaataatttgagtgtataccagagtccagctggagatgctgctgaccatcgagcaatccattctgagctgcatttgccattttgtgcgcagtgcgagcaccatcttctgccgttctatggagtagtgcatattggctaccttgacggcggagatggtgaagtgattgatcgatctcattttcaggccttggttcatttttatggatgcaagcttcaggttcaagagagaatgacaaggcagatagctgaagcagtttattctgtttcgcattgtggggccatagttgttgtagaagctaaccacatttgcatgatatcaaggggaatagagaaaatcaggagtagcactgcaacgattgcagttctgggtcagtttttgacggacccttctgccaaggcacgctttctgcagaacgtagtagatacaactggtttggcagtatgaatcacttagatcatacaaactagaatatcagctaagaatacatgattcagagaagtaccgcagccactttaatatggttgaaagttggtacccagttcggtgtgttaccggcaaacattgcccattggttcgagaccggggctggtgccacgtctctctggaaggaaaatgtccatttgcttggtgagggaaaattttcgtcacatggaagattatattgaagctgtcactggaagcaccaaaagggtttggttttctctgtgttgtaccatttttcatttgcacggcacttgaaatctatactgcactaattgcagatgtgccgagaaagatatatacacagaagcaatgtttgtcacatcatttttcactgtagcaaattttgatgagatcaatggctccagctcctgtgaaatgaatgtgattgttctcttgagtgttgacccgccaatgcactcgctgtcttcttctctctttttttcctgagggcatcatatgcatatttttggctcgtggggtttgcaccaactggcattttgcccttttggtgcttgtagattgcagatacgcggggctagcgatttactggtattttgacgggctgttgcgacaggttggtggagcacgcgacgtctacctccccgccgggagaacgcgcgccacggctacccgcccgctcaccaccaatcgttcaaagcggccgcgcgaactaagcagcgggaccggatcttacattactgtttacttatcgcgtgccatgcagacaaac

SEQ ID NO: 33691 - DNA, 666 bp, Oryza sativa
gtcgatcaccatgtctgctctgttgcttcgtcagagcagtgatcaccgaagatattcctatgccaatgttgactaggttgcaattccaatggtttgtcgtattggcctcggctgctatattttcaaaagaaaagaaaacgaatggaatccttacacaatcctgaattctccaaaaggatctggtaaaatattcttgtgttatatttcccttcattagccgacgaacagtttggagagacgaactagtcatgaaggacgaagacaacaggagtatttttttttttagaaaataggagtagattactgtcttcaattcaacaaacaaattgacagatcccatgttgcactctaaacttcaaattaatctcatttatactgtttctgtacagtctttgtgaatggacagacccgtacgaccaatgagaggccaagaaccttaacctttcaaacttccaattgtttaccaccgtttctatagctgcataacttcctattctttgtgcaccaacgtttctgtagctatcatcttcgttgaaacaattaaatatatttcggtaaatctaactcaagagcatctcgatttagtcctaaccagcgacacgacattgaccggaagaatttacttaactatagtaatactagtccaacaagtaagtagagaaatat

SEQ ID NO: 33692 - DNA, 589 bp, Oryza sativa
  unsure (1)..(589): unsure at all n locations
atttagtaaaattgataattatgtgcctatgtttagtttgtcaccaaatattggtaatgcatatagaattttggcaacattattaagccaatcctacaaaaaatttggcaatgttgccaattcgccaaaatttggtaaggttcattttagcatcaatccgaatagccacttcatatctaccccattagcagtttaaaagccaatagccaatgctaaaagtgccctatgataaaaagaaccaaaatcaaatcaaaaattaacttttgaaatctaaattttggctaatgagacatggaagcaccaatagatattgaaagaaaaactattgatcggtattattgctgtagttatttgttcctttcgtcgatgaaagtacaaccacccattttccacactttttcatattgacttaagtcagcgaattactcgcggcgaggaggagtttagctttgagagttggaaaggaaatagggcggtgggtaaggcctatttcaaaattttattggtgggtggtactatatgtgtgactgaggtccatcaaaactgtaggtgnnnnnnnnnnnnnnnnnnnnnnnnnnnnnnnnnnnnn

SEQ ID NO: 33693 - DNA, 623 bp, Oryza sativa
gcattacttgtccatttaaatatattaactcgagtaaataatcaataggtgaaaaagccactgatggtgaacagcatggaaatcataatgaaagaaattctgtggtccaaaatgcttcattaggcgaagatcgtaaatttaatgatgaaatgtctcataggaactcaagtgcagaacttaaacaagagctacgtgttcatgacacacatagtagggaatttccttcagatgccaaaatatcaagtcagccgaaggatgtggctcctaccctggatgagaaggcacatggatattcccaaaatggaaaagttccaccttcaggcaataatgttgaaaattttagcaatatggagagcagtcaagggcatttagggaagagcagcaatgaggaagattttgtaaaggagccaaaggctgttcgaagaaaagaatccgaatcttcttccaaaagatataatgatgatgataaatctagcatgtatggaaatattgataaaaagggtagcttcaaggaggaaaaaggatctgacaggagtgtgagacatggagctgatacaagggaaccccgttccagaggaaactctaagcaggatgatgcaaaaggagagagaaaagattatcaa

SEQ ID NO: 33694 - DNA, 582 bp, Oryza sativa
  unsure (1)..(582): unsure at all n locations
gtggtcgaccggtcgccgtctcgtgcaccgnatgcggtgtttggtaaggtggggggcggtgctttacgagcggtaggtgggtggtgctggtaagccacgaccacgaaggtgtgggtggccaggtcggctgcagggagctgcgcgtcacggtgaccgttggatcgagaacctacggatcggatcaacctatgggagagtcatcacgaaccaagaaaattggggcgtgtgtttcgttgcggtcgggttactcaaacgtgcggtaacagggtcagtgggagggtcgggctttcgttgaaatttgacattttttgtggttgcccgtggctgcaagctatatccatccccgcatttcaacgagagaataaaaatgattctcctagtagaaaagataataaaaatgataggtgggtatattcttccgtttatctctgcttttataccggataatttttttggaattgaatctctttaagagatacttcctccgtccttaaaaaaagataaaccctgagtttccgtgtccaacgtttgaccgtccgtcttattnnnnnnnnnnnnnnnnnnnnnnnnnnnnnnnnnnnn

SEQ ID NO: 33695 - DNA, 524 bp, Oryza sativa
tggcaaaatactttcatgcctttctagaccagataagtggcgaacataatcaagttgtccagatacatgccgagagggtggttctttctccaacaggctcagtaggggacgaatttgatcattttgaccactactatgcccatttgatactagctctatatgctttggtgatctatctgttgatgtccttcctgcagaaacactaagccgttgtggcctaatgggatcattatcatttctctccatgtgaccagcagccgccatatcggtgaatctaggcgatgctgaaggatccattatgatatgatgcctatctgcatctgcttgtaaagattgcagtgaaccagatgaatggtgatgatccagcctcgttttggaaatttctagcattggcggatctaattgaccagaccttcgcctgggggtggagccattctgtgttactgaagcaccagacccggagatggaagcaaaccttgttgcttcattcaagctatgaagagtattgaccagcctaagaagta

SEQ ID NO: 33696 - DNA, 2565 bp, Oryza sativa
  unsure (1)..(2565): unsure at all n locations
tacccagctaggcaacgttatttggttacactggctgcaggtggtgtgtcagtgatgtttttctacaccaagcgctgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaatccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcggggcagaattggtaaagagagtcgtgtaaaatatcgagttcgcacattttgttgtctgattattgatttttcgcgaaaccatttgatcatatgacaagatgtgtatctaccttaacttaatgattttgataaaaatcattaggggattcatcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcagttaggcaagctgatccagatttggtattaaccttctgcaataggaaatgtgtatcttagtttttttatatatataaatagagtcctgaatcgatgagttgtgttgggatcagacttagggtgtgtttagttcacgctaaaattggaagtttggttgaaattggaacgatgtaacggaaaagttgaaagtttatgtgtgtagaaaagttttgatgtgatgaaaaagttggaaattcgaagaaaaagtttggaactaaactcggccttaggtgagttttctcttttgatcagccgatcaaaagttgtgtcagagtcaaagttgtaatgataatttttttttagagatagagtcctatatcaatccgattgtagtagaatcggacttaaggcatgttcagattgtagctaaaataaaccttaccaagttttggcaatgccaaaattttggcaggatggtaatattgcaaaaattttggcaggatttcttatgtattgaccaaatttggcaataaactaaacgtagacatatttttggtaactttgtcaaaaaaaaatggtatggttgaaaatggcatcaaagtgaacaggcccttagtatagcctatgggcataaatatgtgcacccagggcctttgtaaacaccaacagttcaataatcactttttcgacgcatcgccaccctagtttagcttcaactggttcttgttcgagtttgtgctgcatcgatttcgatctccagcaagaaagtaagccccgtcaacttcacttgtattggttgggctgtactttctcaattaagtctgatatattaatttgatctttgcatgcgttgcctatctaatgtatcagatctatctttgattgttttgctctcatagttagggtattatatcaaatcactttgaattttaccaatcggctagtttaaatctatcaaacttaccattaatcttgaattatcttggtt

SEQ ID NO: 33697 - DNA, 3534 bp, Oryza sativa
  unsure (1)..(3534): unsure at all n locations
nnnnnnnnnnnnnnnnnnnnnnnnnnnnnnnnnnnnnnnnnnatatcgtggcgccatacgggccgtagcccgtaggcgaaccaccgccccgcacccacacacgtggggccaaaaccacagggggtcggggcgccccagccctcggggccgaaacgggagcgggccgacccctcggggagacagagggaggggtggccacgtcaccttcgggcccgacccccccgagggggtcaggccacgtgggtgaccgcggctacccaagcctctagtcacgatacccccggccccatgtcaccgacatatactgtctcgatttgatccgatctatcaagattgtggttaataatcataggttgttaatgattatactttaacttgttatagctgatgttgtttttttctttactttgcgaatgatgataagcttcaattaatattttagtgcattggcctacatctaggaatatatataattgttaagttgatatctttactactttcaatcttatattgtcacagtttgatttgatctatcaagattggttataataaagttagaagattttgcaaatatatattatgtagattttggtcgatgtcactttgatcctaaatatttatatccatcggttacagccaatcgatccaaaatttcatcggcatcggatgggcacacgatacaatatcggccctatgaccaattgactccacaatctaatcttttcgttgtctatcttgttaattctaagatcaaactaactggcatgccctgaacccgattgataggacttgcactagatctaaacaaatctcttatgcctttgtgtatgtgacgaattttacatcaacacttatcaattcaacttcctaatgaaatttaaaattttgacaattagtccaattttatgaattatataggagtatttaaatttgccatctactccctccgtcccaaaatgtaaacatttttagaatagtgtcaagtcaaactttttaaattttgactattaatagcgataaattaagaaatattaatcatgtaaacttgatgttactatatttatcattaaacgaactatcataatatgcaactctttttatttaaaatattttacttttgtagatattgtcttggagaccgtgtcgagatccaaaaatacttacattttgggacggagggagtactatataatactctctaaaggtttcttggatgtttatgctcgatttgtaagctagaacccatgccaccacctatatatatattcatgtcaatgtatagctagcctatttgaaaattaatgaaatgcataaagtccaaagaaataaaatctattagtgttactttgtaaggcaagaattttacaggatttcacataattaaatcggttcaattcctgcaaaacttctcaaagaaaatcatccattccaaacacatgggaatatgagaaaaaatgccacacctttttgaacggagttctctttatttaattaatttacaattaatggaatgtctttaatttctccaactaattagtagtatataaaaaaaaatgacacacgagttacctgtatgtggtcgatttgtcaattcgttataattaaaaacaattgctacatataaacccgacagctctaagaacatgatccatgcattggtggcccatggttaggaaatgccggagatcaggcgcagcatggatatatcattagaggttgggcagagtatttatctcgttgtttaagcatcattattgggctcgaaccaatctgatgaaaatttggtagctttctagtgacagcattatgagcataaccactacaaaattaattaagaacgccaaggacatgtacttataaaatttttacattagctgcaggcactaacaatattaataagccaacaattgatgattggtgtgaatatgctcatatgtttagcctggtaattaaatggggaagtatatatctcgactcttcaaatattgcatgtcaattcacatgatgtgattaattataggaacattacaagtccgttcttaattggcaacatatagacatagataccatgcacatgcgtgcatgatatggtatgatcgatgcatatgtatggaatatggatccatgactagcttagcctcttgcatatggtcgatcggtcggccggctttgctccaataattagagtttaatcgtcgccttgcacgcctaattaatcatcccgttgatggcaacaagtcagcggtcacggaggcaacacacgatcgatgatcgattatcaggttaatttcccctgtatatatatagcttaattattaatttgattctctctccttaattagctttctagctacctccctgttgatttgtgctcatatgtgattagcaagtcttaaccatcggcgacaactgataagtcgttgggtttagacgtgcgaccaaaccacgaccagattaattagcagctaattaattaggcccccttcgatctccctctaatttgattaagcctgaaaaatgcatacaataatgcactccgtatacatacacttttatacgctaatcaatacattaaaatcaatcgaactagtattataattaaaaatcgttttcagttgacccggcaggccgggggatcgatcgagagcgaattaaggatcagattttatgagcacgatcgatcacgattgagcaggtagctcgatctgctacataacgtactcagaaattaattaatttatatttttaagaaacacggtataaacacaaacgttctcgcgtgtgacactcacctatatgagcatttttagaagactgggcatattgacgtttcgttgtcgacgggtacgtcgtccactactgaacgaataattaaccgtaaatgtgaacacccatatcaaatttaagatttgaacctaaacctgctccgctcatttcgtgaaattaattaatttcgttaagaaggaaaaaaaggaaaaaggaagaagaaaagtacatacttgatgcgtacgtagctgcgtagtacgcttggatggatcggtgcaatatatgcaatgcaatcgagcggctttgtagtttctctctctagctagctaatatagcagctagtctctctctaccgaatccatcgtccgtccatccgtcggaggaggtaggtgggccagggcagccatgtgcgctcatgtggtggtttgcaacgcttggccccaccaccactttctctctctctctctctagactttctctctctttctcctcctctccaacccaccactcactaacctgtagtacccccaacaatgcgtacacggccgtcaccctcttcctcatttctcttttataatctctacaactttaaaaacatagtgtcctcggttcgttcttctcatatatgcataaccatagtatgatccagtaatttacctaggtcaaacctgttacaaagcagagggcatattatactatataagaaatttcacgatctttattatttaattataacttattataaactgtaattgtattggcgccctt

SEQ ID NO: 33698 - DNA, 650 bp, Oryza sativa
ctttctcgtcctctccaacccaccactcattaacctgtagtacccccaacaatgcgtacacggccgtcaccttcttcctcatttctcttttataatctctacaactttaaaaacatagtgtcctcggttcgttcttctcatatatgcataaccatagtatgatccagtaatttacctaggtcaaacctgttacaaagcagagggcatattatactatataagaaatttcacgatctttattatttaattataacttattataaactgtaattgtattggcgcccttgtgactcgaactaccccatgaaggagggagaagctgtaacacttgcgttcgcgaaaaacaactgtgtaacacttcaaaaatagtttataaataaaacttatatatatttgttgttagtaatttaaaacttaatgttgagaaataaactaaaaaaaacatcaaaaaaaatctaaaattaagatttaaaatttaaatttcagttacgactaacaaagctaaaaagcaaatgatgtagcttagctagggtttaaagtttatccataaattgatctctcctacaatttcttcgatctatccaacaccgctatatttattactcactgtggtaatattatatgctcctagaggcattggaatatttttt

SEQ ID NO: 33699 - DNA, 206 bp, Oryza sativa
  unsure (1)..(206): unsure at all n locations
nnnnnnnnnnnnnnnnnnnnnnnnnnnnnnnnnnnnnnnnnnatgcctgcggtgagaatgcttgctatgtggagaccgcgaaactcgtctagagatgaaacataactaaatgggtaagtgaaaggataagagatatatgaacctgatgtttcttcactcagaagatacctgcacactcatatcaaattcacaaggcatagaataaa

SEQ ID NO: 33700 - DNA, 544 bp, Oryza sativa
  unsure (1)..(544): unsure at all n locations
attcgagctcggtacccatcgtgattagctgcctgttcaaatgatgttatccaaagttatctgtttaactggtgattttattgttcagtggttggaacattcgttgcatggcttctggtaacatgcaccacgttgttggtgcagatgattcttgcataagctggggaacagcccaaaatggagagcttggctatggccctaatgggcaaaagtacgcctattgaatactgttaatatcattttaatactaggctagcaattgttaaaaccatagaattcctcttacagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33701 - DNA, 719 bp, Oryza sativa
gcacgcctgcaggtcgactctagaggatccccacctgctccacctgctgcacgctgcacaggctccacggcctcgccggagatccctccggccgtatctcctcagcgtcggcgggtacaatggccgccttgttcagaaagctcagctgcaacgtgagttatcgtatacacttgctagtacttaatttattttcgttttacataatttactatatattatcaataaaaaaatcaagcatacaatttttctcttatatatgtgaatgatggggggataagtgtcatttatcaagagagttgttggttcgaggatatttgaactaaaatgaaaacttgaaggactaatatggatagattggaatatcaaggactaaactgagccttagatgaaacttggaggaccactttggctattcacccatgtttttggatttcccccactaaaaaaaaatctttcagtcttctactagtagagtagataaaaaataataatggaactgtcaagcaattaaacaagaactattaggttctaaacattatgaaactgtatgcattacaagagaacattggaagctttcctacccgcaagtccaggataggttcaatgtttaaagttttacaaatcacaacacacaaacaggccattaataagaagtttggcacaaaagcccagaagtattttccacgggcacactaattactagaatatttctacaggtg

SEQ ID NO: 33702 - DNA, 578 bp, Oryza sativa
  unsure (1)..(578): unsure at all n locations
gaagctgactagtgaataactgagctaacagaactccactctatgatttagttccacgtcacgctaccgaacaaatcgatatagcaaacaacaagcagtatttccccaatttccagacgcacttatccctgttgaggtcgctgctgcccgtttatcaactcccgacagccacatttcacgtaatcgcatacatcatcttttttcctttggcacacgttatgcatcataagaaaggcccaaaaagaaaacctcaccatgatgatgttgagatcctcctgcgggatgttctccaacgatacttgcttgatggccacgaagtctccattttccaggtcaagccccttgtacactcgcccatatgctcccttccctatttcatctccgagcatctgcaccggcccccacacccccccccccccccaccatgcacacagtcagtgagcgaaaccaaacccaaaattaacaccaccagaacacgaatttcacccggatnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33703 - DNA, 529 bp, Oryza sativa
aagctggagctccaccgcggtggcggccgctctagaactagtggatccccctgagcggtgtagccgagcgcggcacgggcgtcgagcgggaggcggtggcgcgtggaggcgtccacctccttccactgcgcgtaggtgagcgagcaatcctgcgtgtggtcgcgccccggcggcggcgccgtgaactctatccctggagccgcgatgggtggggaggggctggccatcatggaagaagacatgacgaagaaaggaagacgaaggagtacagtaggagagaaaaagaaaaaaaataatattccctaataggtgggtcccacaggagagtgagcctttattggggttcaagggtaaaaccataatttcacaactgtttctctctctattttctccagaaataataaaataatgtcgtgagtgtacatcagctaattaccagtgttttacgatgctctccagcatatacacattcttccggtgttcttcggctaattacatgtcctgtagcaaattttgccttatgttaatg

SEQ ID NO: 33704 - DNA, 1151 bp, Oryza sativa
cgtgccacggcaacgaaagtcatatcggttttaatatagttagagcgattgatcgatatatacttcccgtttaggttgatggttacgaaatacgaaattcggctaatagttgagggggttacattggactttgtttcattccagcctacaagaactgtagaatgaaaaccttggcccaacccaaacacaaatagtcttgcgcaagactgtgattattattagtttgttatctatctatctatctatctatctatctatctatctatctatctatctatctatctatctatctatctatctatctatctatctattattattattattattattattattattattattattattattattattattattattattattattattattattattattattattattattattattattattattatatactaaaacttcatcaaacttactacaaacgctctcaagccgccacatgatgctcctaaaaacactcctaagtcgtacaaacactcctaagtcgccacatggtactttaaaaatcatagaaaatctaagaaaaaacaaaatatctagccattgattttcatttaatctggtgggaccattatttttaaccattagatctatcttctaaattaacaatctaatttatattatatctccaaagatctacatcgttccatatttgtacgtgagtacgtgcatttgtatcccgaaacccacacccgaccaaaaaaaattgtacgtgtacttctctttcctttttttttatttctcacttagtcgaaaaaccaatctaataatcagcacatcttaactataatttaagttgtaaaaataaaaatatatgttatttcaagttatgttcaaataaaaaatatatctcatgaaaacatccatgaaaaatataaataaattaaaattataaatatattacttaacaacatgtataattattatatactaaaagtccattaatcttcctacaaacgctctcaagccatcatgtggcactttaaaaatcatagaaaatctaagaaaaaaacaaaacatctagccattgattttcatttaatctggtgggaccattatttttaaccattagatctatcttctaaattaacaatcaaatttatattactaggtgaaac

SEQ ID NO: 33705 - DNA, 8376 bp, Oryza sativa
tgaatattttcttcttcatatattgctagaaaattaatgatgaaatatattcttttgataccgtgtcgatgccttttatctcctacataggccttcaatcgatctggctgactttatctagggcacacaaaatgatacatgtcataaaaaatattaatcaagtattaagtattacaaaattgaaaataggtttatttgattttttaaaaatacttttgtatagaaagtatttagaaaacacgcatcgtttagttcaggaaacttttgtagttcgggaaacatgctcatcttaaataacaaagtagccaatcagataagcactttagaagtcaaccttacgtactaaaacacttaatatgtagtatataatatactttgtcaatcaggaacaagccaaatatatcaattttatgtttccactaatcccatgtatataagttatatatagaaaccactatccattaatcgccaagtcataatggttatgaggcatccatgcattgtgcaactaataattagctgataaccaataagcacgtgtgttatgaggcatctacttctggtgaggttatcgaagaagccacgccgctgcagtgctgcttcacaccatcccaccaaatctcttcaaagtatttattttaataatggtataaaatggaattgtgagcactcatataaatgtatgcacatccaaattataaatacaattacacacctaacatatcagagaaaaatatttatcaaaaaaggaaaaagtacattcgtacatgagactactattcgctagaaaaaacatacatacttacgataaaaaatatcacatggaaccacattatatcacttttaattatgacattctcatctaaatagtgttgataattagcacaaataattttgataatatagattattccatcgtatattacccctgaatatgcatagatgaatcggatgtataatgaaagaaaaaacaaacacatattaactcatatttttgcaaagaatgatgataggcgagttcatatgtaaccgggatataaatatttctttaattattattaatcaattttcttataaaatatggtgagatatgacttattttagtattctttttataaacaataaataaatttcccgcgcatctgcgcgggtttttttttctagttactgtataaaagaggcagctgcccccacgatatatagttgtgcttaaccaaatcaaatctgacagtttgccagataacttttacctacttcgcagcatttaggggcataatgttcagcatcgacaaatttcaataagctgcagaagaacaaagtgcacactgcgcacaggacaatttgttctggatttgacatacaataagttcagaactcagaatatatcgcagttggacatacagttgtgttgtgaagagaattcaatgccaagtgaattgttcaaatattcatgtcgaaataagagtacaactctagagttgcaacacagtgaaaagtggagatccaatgcataagagagatatatcaagaggaaaatgtgggtaccattgtaccatctctctctggggtatcattgtacccatcagaattaacaaagatagtgaaaactgagcatctgattacaaaagaggaaaatatccagagttgaataaggatgtaccatctactatactgtggttttttgggatgtatcagcaggaaaaagagacctagtataaggaatacaactaacatgaagtttctgcagcatcagcattcgataaaaaaacattctgaactgcagctgtatcacattcatagggacaaaaaggaggcatatgccaaggcagacaacgctcccgttgatccaggcaaataggtatgcaccagctgaccggcctaacagtaatcacaggtacctccaggtagacactttcttgtccttgaaaatcaatagcttcagaaccaaagctgtaaatcagtactttgactgcattagaagaatcagagagctgttttgttgtcgatgcaactcacttatgaacactctcattaacgcaaattctgtgatagaattttgcgcgtgtataggaattcgtaaatgtcgtcatggcttatagcatatccctttccttcaatccggccatgataaactgcaaggatatcaccagcatgattgagtataggtgagccagatgctcccttttcaacattgatctttagctctataaattgcatattatagcctttatctctttctgttgtcagttggttgaataagcggcattgatttgaaacttgcccaatgacaacagtatcaggcctattaggtggccaggagatcatgaccacatcatttggtgctgaggatggattttctgcgagctttaatgactgatgaggtaagcgacatctttgagcatactgggtggcatagagtgtggacaaattgaactgaagcaacataagatccttacgctgatcaattttcaaaacagttgctacagtgtaattccgcttatcacgctcagattcatacaagtcaggatggatagtcttcatgtgatcttcattgtgcttgcagaggatgagaaacttgaaccacctgttggcctgctccttactcagtacaatattggctgaatagaaatcctcgaggatatgagcacaggtcaaaatgtatccaaaattctcatcctgataaatcatagatccagtagcaaagaagggctccttaattgtgccttctgcttcagatggtttcatatggaatttattctgcaggtgctccactatcttagcatggcagtgaggcactctaaccattttcacaaagaatattgattccctcttctctgcatgcaccagttgatgggcaatatgggagaaccggttgggcatgtctggagctgccatcctaaatgtggtagttcatgcatgttatacatcatataacacaaaacatatgtaattcttgagaaaaaaaaaacaaagtacataacaaacaagtacggaatatattaagaagatattctcaagattacaagttgtgtgtaagcaatatatacaattttaggaatcaaaatgtttctctgcgaacaagcaaaaggcttacgtgtcattatattagcaagagagcaaatgagtttacacccggcatcctactggcagcaggcgccaaaggagaggaaaagaaaagaggattacacttaggtagacttagaaaaaacaactaagactccggaatgatggaatcaagcatatgcctaagaaggccctgataccacaatattgaaggtaattcttaaaaccattaaccttggctacgcatgaccaccaaattcttatgaggaataaatatgttaagacaaataaccaaatatgcttaagattgatacaagtttgtaccactgacagatgcatgctttaataatataccaccattcaatgatccttgtaaacaaacataccatcagcccagagaaaaactagaataccaggcatcaacagattactctgttaaaaaatgtcactcctgcctacatatctggagactaattgccacaatgccactgtctggagacaagcagtctaggaatccgagggcccaacgaattgtgtttaaaagagtataaattaaagtccactctgcctacacatcaagaggcaagcactaaactattccacattccagaagtaactgcgtgttcctgcgatcaaagtggtaatctaactagaagcaaccagattctaacaaggactccatttaagaggcgaaccacacacagatgtatccctctttcaacaatccgaaccaaacaaactaattagcacgagccctagattcagggcgctagaagcaaccagattctaacaaggactccatttaagaggcgaaccacacagatgtatctctctttcaacaatccgaaccaaacaaactaattagcacgagccctagattcagggcgcggtcgcatcagcgcagaaccgatcccgcgacagcaaaatcgacccgcgcccccacgcaatgtgtgaactgaatccccgtcacgggtacacccccacaaccccgcaaccgcaagcaagcactcgtagggcacgtcggctaagcatgcagggttagagaagagagctcacccgcaggaaccacggcgccggcgatacctcgttcccctcgctaacaaccgccgcggagaaacccgagcggagagagcaggaggcggtggcggcggggagcagaagcgagaaaagaagcggacgccggagaggacttgcagaggaggacgaaccgacaagactcccagactttagagggtagttagagcagtggcggattaatctctgttgcactcgctgatatgtgggccatgttgccaatggtcgccgtttcgaaccggccatcggagcatggaaagttctacggggcctcccatctcatggtctccctatatatggccaaacgggccgcccaggccatgcctgggccgatgtcagtcgggccatgtcgtgctaacccacgggctgcatatatggcccagacacagtacaataagattcgggtcgtgcccggccagcctaaagacacgaccgcacatcgtgcttcttcctaaaataagtctattgtttgtccctcaactctttggaatgtgtcttatatggctagaaataagtctattttttattcctcttttttttttgctttgccttatatggtttattaagtatattttggatccctctagtatttttttatcgtgccatgcctcgggttaggcatgacctaactgtcgggccgtgccggcacaggcttgacactagttgggctatgccatgcttgggccggggccaaatggccgtgctttgggcggggctatcgggcctcgggtcatatggccatctattgtctacttcgttgcgcgcacgtgggaccatgttgccagtggtcgcccatatagtaatgcatactacatcagccaaaaaaagggaaaagtctggattacgtccctaaactattgagtgagtacgaattaacttctcagacccgaaaatcatatactacatccgtcccaaaataggtgcatccatagatatcagtgtccagtgttttgatcgtccgtcttatttgaaaaatttatgaaaaaaataaaaaaaatagtcacacatggagtactattcatattttatcatctaataacaataaaatactaatcatattttttttcaaataagacgaacggtcagacattggacttgaacagcacttattttaggacgaagggagtatctttcactctcaactattaatacatgataaattacctcccaactcaactcaattcaaagtggttttgatcctatgcggtagtccagttagcaattcttttttaaatccgtgaccctacttgtcaatctctcatcctttctatctctttccccaatcctatctatcttatctctccctcacctcctctctctctctctatatcacttaagcaatggggagggtagccgagtacggcgacggggcggaggcagcgacagaggggagctgaggacggtggcgggcatgggcggagacaaaggcagggtggcgggcgggagcggaggcagcgccgaaggagagctgagggcagcagtgggggcgttggcaggtaggcagtggtggaggggaaaacaaggacgacgacgggtgagagcggggacaaaagtggaagcatcggcggagagggaggcgaggacggcggcggggcgaagagggacgaggatggcggcgagcatgggtggagacaaaggcagggcgaccgaacacccgaggctgacgccaccgttgacgaccttggggagtttgacttcgaagacgaggacggcttcaacgcttaccctttccttgtcgtcgatgatggcgtaaccgaggacatcgataacatcattggcaaactcagcatggagaagaactcagtggctgcaacccacgtggacgccgttttgtacaaggccgccatacgcccatacctaataagcctcaatgcctcgtagtgcttaaaaaaagggtagacgcttgacggggagagccaccggcgagctcttccgacattggaacattggagggagaaggaagaagatccaagtgtatttctgtctaatatagtattttggcgaaggcgctcgggttgtggaggttatttcggcgaaacctatttaaataacgttattctagctaatccaaccttatataatgctatgatattaggtatgtaattttctcgtctttgcctagggggaaaaaaaaccccgaaaggcctcccctccgccgccgtaaagcttcggccgtcgggatctccgaatcgccgcctccaccctaatcccctccgcttctgtcggcgtgcaggctgcgcgaactcatcagaagcgccgcctccaccctaatcccacttctgtcggcctgcggcctgtgcgagctccgatccgccgcctccaccggaatcgcctccgctgccgtcggcctgcgggagcgcttcgaaccggcaaggatgaaatcgcgcagggcgctgtggatttccagggaacggaccagaagaacggcgaactacgaagaccgggagaaccccttctgggcccttgcaggtatgccgccgccgtcgtctgtgccatgccaactacagtcgactggtggcactgggatggagtcaagcccggagcacctcccttcgccgccgtgccaggcaaggacaccatcgccgcccccgagtgggagggcatcatcgccgtcgcagctgctcccctgggaacagagggagagggagaggatacaatcaccgcccatgagtgggagggcatcatcgccgtcgcagcaactcccctgggaaagagggggcatgcccggagagggtacgatcgtcgccgatgagtgggagggcatcatcgtcattgcagcagctcccctgggaagagaggacatgcccggagaggataccatctctgccaaagaagaaaatgtattggtttgctcgctctcgggaagccaattccgtgcaagtatcacgtccaggggaagcatcatatcctgaggcaaccgagggcaaaccagagtataatctgcacgtcttgaagagcatgaagaagaagaagaaaaagaagaagaagcggggcaaaaggaataagagaggtcaaggcggctccgaggacaagagccaagagaagcaagaggtagcacaagagcatctgggctcggtgtcgtcctcatacagctctccgctgcgtgaaccgcaagctccacttgtgcctatgtggacgagtccttctggagaggtggtgtatggcatcaccgatgatcccacagctgcagaagcctatcattgggcttttcacgagtacaagaacaagagaggtacgctttttgtccgtctgtttttaccaaaattgtgataagcacaataattacaccaagtactattttaatgtaaggctgaactgcatcaatccacagtctgctctagtattaaaaaactttccaaggtttgccttatggtatccaagttgaaaggtataagttgtatgctgtcctttagtagtaggataaactagcaaaacaaaattggaattacctgcaaaaaattgtgtgtaaattgcacttgcactgggtaaagcataccttatttaactgtgcaccaggcttagtttatgctttcgctttacaccagggtatataagttctactatgcaccagattgcttcacaaaattggagtgatattgtaaaatatgattgaaacttatggaattcttaaatttagaccatatttcatgaagtttcgttcagaatttatgaaatttctataggtttgatgatttatcctggtgttatgtgacacattttaatacaaagtgataatactaccaagcgcaacgtgcaatttgttgaaaaattattcaagctcaccgaatttcacatgtctttgttatagcacgccaggaactattaccgacagtaaggtcgtcaatctctgctgctattgaacactataatcccgagcagaagaaaacacaaataaatgcttccaaatccatcgtgagcctttcagcttatcacggtattatatattcttcgactaatcttttttatttgatggtagtgtcggttgctttttagctaacttcttttgtgtatatgtagatggtagagagattaatcagggaactggtataattatcgagtgcgatgaagtgaagaattctgctatcattttaacttctgcttggctcatttgcataaagaaaccttttgatgattggtcgcataaagattatgctcctgaggctaaggtagaacacttcaatctcaacatgctcctagctataacatttttgtttgcttagttggaggtgttagcatgaa

SEQ ID NO: 33706 - DNA, 2447 bp, Oryza sativa
tgaataggatggtcacatccagttttttaatgatgttccatgcattttgttgcttaagttctaattttaggggatattctctctagatgcagaattgtctcaacctccccccctcccaaaaaaaacaatgacacagtgcatagatgctgttgctcctaaccccttgcgtgtttgtatccaccttgtgtgccatagctacctccccttctcaccttgtgtgccacccgccattgccctgtatatgttgctatctatttcttttgattgttcatctgtgcatttgcacacaggtttttggtcctaagttagaacttagaaataacctttagattacattttatacaggaaaaaaacaatcttttcttgcattgcgtgttggtcatataggtcgataagttgggaagcttaggaagaaaaggaggttactcgttaatgttgcttctcactatgtcacaactacctgcaaaagaaaatcgtacctcagtacctcacttatgagaaaaaaatgtactccctccttccacaaatgttagacttattctatattttgtttttttccaaataagttggtcatatttgtagttttcatgtatctaagacttaaatgaagagataaattaaatgtttaatcgaaacctaatgagccattttaatactcattggttgcatgcatgcatgcataggctccttgatctttgttacatgtaagatgagttctttgttacatgtaagatgagttaatttcttcttggttttggtgacaaaagtaatatgtctaactcttgtggatggagggagtatatgcatacaagaggcaacaaaatttagcggatattactgccaaagacaaaaatactctataaatttattttcatagaaattatacaaaatttgattacacgatacatattatacataattaaaaatttcacttgaccaaaaatttattgcaagtactttatcgtctatccagccaaacaaacaagctaattgtatcacccaatccatcttgatccccgccaatcaagcacatttttagtctctccaacatttatttgtgttgctgtgttttatgcattattaattctatccaaattacgcatcatatttgcagtctgtctagctgctctctttgttcacagagtttacttcgtgtttacttattgatatgttccttgatttttaattcaattctgctaaagggatgttctatcctggttgctgcttggatagttgcattaaagcttagacaacgacactacttgttgtttatgtttatgtaaagtacccgacacaaaaatcttttattgaatatgttagccagccaggtgtttgcatggcagattagtgcctcacacgaataacatccaaaagcttccatccagatcacagaatcggtcatgaaacttgagtcttgcatgcagaatcaatcatgaaactgaaggaaaatcatcttcaaaattagcctagccattaaactagagtatatttgaaagatgacctgatcttaaactttgggatgttctaccctggttggttggttgcataattgcacattaccttaaagcttagacattgactctacttgctgtacaaggttatataaagtacccagcataataaagatcttttatttcttatgtcacctagccatgtgttcgtatggtagaatagtgcttcacatgaacaacgtccaaaatcttccatgcagattgcagaatcagtcgtgaatcttgatagtaaaatcttacatgcagaatcaacaattaaactagaggagaatcttttgtgcagaattagcatagacatgaaactagtgtcttttagagctgacctgacctttgggatcattagttattgagaactgtattagtgtaggagcattgtatatacaatacaaaggactccccctgttgattttaataatccacggaaacagccaggcacttagtattctccacatggttaacttacttcatgcttggtgttccttgattttaaactcagacatgcttcatatatacttggtgtttcttgattctcaaactcgaacatgctccatatatgcttggtgttacttgattcttaaactcagacatgctccatgtatatttggtgctcctttattattaaactcagacatgtcacatgctccatatatgctctatcctgcttggtgttgtttgctttactatatttgtaaaagaaatgaacatgcaaactgtatagctcataatagtataagtgatatatcttccacattaagtgtttttaacctactctttttatttatttattattttaggtcactgttcacatgttggatgacacgatctcagtgtgtcgattgctgtacttcagcaagcatttcgatattgccttatttgaaactgtaggagggctaactataccgattatgccattgaaatctgatttggaatatggcc

SEQ ID NO: 33707 - DNA, 8748 bp, Oryza sativa
tactggaggtgcattggcagatttcagtggaaacactggtgggatgttattctgcaccttgcccatgggtgcattcctaccgagctccctgatcctcacgtgcctaagattgtggaagaagtttgggtaggcatttttatttttgttcatcctagttggctatatacacttgcttaattcagaaacttaggacattagtttgagatatgcacttatgctgccagcacaaactatttcccttccattcaacaagtttacatttaaacctgtacagtatgttatattttatataatataaaaatgagtgccaacttaatatgcatatgcacaatacctctgtccatttgctctcaaaaccaaatgtacggtagaattcacagacagatacatacaagtgaggtgctgaattaagaatgataggtgtgagactgttagattcaggttaagaatgtggggataggtttgtaatggcctctattcaacatcaacaagtactgactgagatgcaaagtgaaatgtatttatatgttttaggcatgcacttctacaaccctaaacatgtgatacactataattcttgtatattggacttattatgtggtatgattatgccatctgtagcaaccaagtggcattcagcagctagtataaattagtaattattaccatctgaccatcatgtttacagaaaacacatcaactgctgtttttttttgtgtataatatttcactttagatataattatcttatataaaataaatttaatagtctaataatttcatataggcaaattgttcgacctcagcttggtttgaagtttaaaacagtggattttcaagagatgacgcttattgagttgctgtctcgtaaatacaatattacctctggtcttattgtaggagaggtaacttttttatttatgacatctatttatatttatgtgtatataatataatattttcatgtatatattgtattatttctggattgattttaggtttcagctgaatgtgctgctgagaaacttggcattcgagttggggatattattctctctctctccagggagaaagcatttcaagtataatccaggtagcaattgacatccttaagactttatttgaatatttcaaaatctaaattagctctttcaaacaaaaaggcataaagtataggtagcatgtgcattagtttatttaatacaaatttgactcaatccttttgtgttagttggagaatatattgctcagtattggtgagagatatcttgaggagggtaacgactccagctctaaggttgatatcaaggtaaatttccgtgtacttaatgaatacacttaaaaccatatactggtattaggattatttattactctataggctgtttatctcctagatagttaatctcctagacctttggtttttgtaactctctagcattcattgtaactcagcactagcattcattgtaactcagttatatatatgagagatcacctaccctcttttgtgtgtgaggcatccattccacttcttctacatggtatcagagcataggcccttaccttcttttcctctgctctagcacgtcgtcgtcgcagctgtgttctccaccatgtcaactgaatccactcagtcctctacctcatcatcctccagtggtggatcctcttccaacatcactagcgagtttcttcatccctacgccaccgtcgccgtcaaatcacacgtccccatcaccctggagaacaaccacccaaactacaacaaatggagggccttcttcacctccctgtgcggcaagttcgggttgatggctcacatcgacggctccgctcctccacgccctgacgacccggcctgggaacaggccgactgctgcatccgtagttggatcttcggatcagttacggacaacgtcgttgacctcgccatggagctagatcagaccgctcgggagctctgggtcgccatcgaggacatgtttcacgctaacaaagaaccccgagcgatcttcctcagccaccaatttcattccatgcttcaaggggactcctccattgccgactactgccagaagatgaagacagccgccgacgcccttcgcgatgtcggccacgccgtctccaagtcccaactcgtgctcaaccttctccgaggactaaacgaccgcttctccaacaccgccgatcagatcgcaagcgcggacgtcctcccgagcttcacatcggcgctcaacaccctcctgttgaaggagttgcgcatcgccaaccaggccaaggtggccgcggcgacggcgctggtcaccggcgccagctcgggctccggctcctcttgccctcccggcggctgcgcttcttccggaggtcaagcatgcactggcggcaacaacagccgccgcacggcaagggcaatggcagctggatcggtggcgggaatggaggggccggaactggaggcggatggggtagcggcagtgggggtggtggcagcggctgcccgcttcctcctgctggtggcggtggctaccagggggtggccaaccctagctggaggccggccgggccctgggtctgttttaacccttggccggcccagcaaccagcgtggccaccccactcggcccactactctcaggccggccttcttgggccggctccggcagcccactactcaggcgaacaccactttcgctggcccatcgatgtcgcccacatctgttcctccaggctagccagacccagggcccggccttcttgggccggctccggcggcccactactcaggcgagcaccactttcgttggcccatcgatgtcgcccacatctgttcctccaggctagcccaattgggagcaagctggcctcattgaatccttgaaccagatggccttccaaagcccaaacaactaggttttggacactggcgcaacatctcatgtcctctactgacggtatcctcgttactcgattgcctaactcccacacttttattactgttggaaatggtcacaccatccccgttatttgtcgtggcacttcattccttcccataggcaccaccaaatttgcactaaaaacatccttgtcgccccctccttagttcgtaatttactttccgttcgtcagtttactcgtgacaataaatgttccattgagtttgatgaatttggtttctctgttaaggaccttctgacccggcgcgtgattcttcgccgcaatagccacggggaactctacacccttccagctgccactccctccagcgcccactgctccctcgccactttatccacactttggcaccgtcgactcggtcatcctagtgcagccaccatccagagtcttcggaatatgtcctccatttcctataataaaatagacacctctctttgtcatgcgtgtcagttaggcaaacatacctgattaccttttgataggtctttgtctcgcactttcattccctttgagcttgtccattgcgatgtgtggacatctccggtgttgagtacttcgggttttaaatattactttgtggtgcttgatgatttcagtcatttctgttggacgtttccactccgacacaaatctgatgttcatcgtcatattgttgagtttgccgagtatgtttccacccaatttggcttaccgctcaaatcccttcaggctgataatggcggagagtttgtcaataccgccaccacttcctttgtcactaatcgtggcacccagctacgactctcctgcccttacacctctccccaaaatggtaaagccgaacggatgctccgcaccatcaacaactccataagcacccttcttatccaggcttccatgtttccgtcctgctgggctgaggctctcgccaccgctacctaccttctcagccggagaccctcttcctccgttcaccactccttgcctttccagctcctacatctcaccactccagactactcccatcttcgggtttttggctgtctttgttacccaaacttgagtgccacgactccacataaacttgcccctcgttcaacagcttgcgtttttcttgggtacccggcctcccacaagggataccgatgtctggatctctccactcgccgcatcatcatttcgcaccacgtcgtcttcgacgaatcccgctttccctttgcggcgactcccactgctgcctcgtcttttgattttttgttacagggattccctccagcagtcgcttcctcctccgaggttgagcaaccgcgaccactcacggaggctccctcctcagaggtcgagcaaccgcaaccactcacagtggctcccgagcaaccgcgatcccttacggtggctccctccgtggaggttgagcaaccgtaccttccccctcttcggccgccgcttgccggacggcacggtcaccgcggtcaacgatgccattggtgccccctcggtcggtgcctccttggccggcactgcccctttggccggtgccacctgagccggcaccatcgtgtcacccttccaccatgtgtacacccgtcgccctgccccgatggtccagtcatcatcttcagccactgtgactgcgacggctgctgctccacagctgcattccatggtgacgcgctcccagactggctccctgcggccggtcgaccggctgacctacacagctacccacgccaccgtctctcctatcccggccaactatcgcagcgcgttggcttatcccaactggcgtactgctatggccgatgaatacaaggctttggtcgacaacggcacttggcgcctcgttcctcgcccccttggggccaacgttgttacgggcaagtggatcttcaagcacaaattccactctgatggctcccttgcccgccacaaggcccgttgggtggtccgtggttattcacagcagcacggcatcgactaagacgagacatttagtccggttgtcaagccggccacaatacgggttctcagcattgctgcatcccgtgcttggccgattcatcaactgggacgtgaagaatgcgtttcttcatggtcagctcaaggagaccgtctactgtcagcaaccctctgggtttgttgaccctgctgcccctgatgctgtatgtctgttacagaagtccctgtatggtctgaagcaggctccccgtgcgtggtactaacgattcgccatgtacattcgacagatgggatttatgccttcagcgtctgatacatttctctttgtttacaaagatggagatcacattgcctatcttctgttacgtcgacgacatcatcctcactgcttccaccacaccactacttcagcagcttacggcgcgccttcacaccgagtttgccatgacagaccttggtgccctccacttctttctcggcgtctccgtcacgccttcctttggcggcctcttcctctcgcaacgccagatgctgtggatcttctccagcgggccggcatggccgagtgccactctacctcgacaccagtggacactcgtgccaagctctccaccactgacggcttgcccgttgccgacccttcggagtacaggagcatcgctggcgtcctacagtacctcgcgctgactcgcccggatttggcatatgccgtttagcaggtctgcctcttcatgcatgatccgcgggagcatctcgccttgttcaggcgtatcctccgctacgtgaagggtagtctccaccagcctccacatcggctccggaccggttcagtccctgacagcatactccgatgcggattgggcgggttgtgccaattcttgttgttctacgtccagctactgtctcttccttggagacatttggtttcttggtcctccaagcgccaaactactgtctcctgttccagtgctgaggcggagtaccgtgttgttgcccatgccgtcgccaagtgctgccggttgcggcaattgctccaggaacttcatgtcccggttgctttggctattatcgtctattgtgacaatgtgagcgctgtttacatgacaacgaatcctgtgcatcatcgctggacgaagcatattgagattgacatccattttgtccgtgagaaggtggctttgggacaaattcgggtgcttcatgttccttcatcacaccagttcgcggacatcatgaccaaaggcttaccagttcagttatttactgaatttcagtccagtctttgcgttcgtcatcctcccgttgcgactgcgggcgggtattaggattatttattactctataggctgtttatctcctagatagttaatctcctagacctttgttttttttaactctctagcattcattgtaactcagttatatatatatatatatatatatatatatatatatatatatatatgagagatcacctgcccccttttttgtgaggcatccattccacttcttgtacatattgttttcgtacacttgttattgattacaactcttaacgataaatgtttttttttatttaataggttggtctatttcatgtgcgtaaatgtaccagaagatttatcactttatcagtacggttgtctggtgatattgaagtctttcgctgaggtaacaattatttctcatatcgtgtcattatcaattttcatgttttccttgttgaaccgttcatgaactgacaagatgtttgtgttagctcgatggcgacctcctgacgaacagaagagatggtgagacgacaagttagtactgcatgttggaaggaatgaagtcttttaagaggagtggtgttcaaagtttttggtctggctggttatactctgatgtctgcaagtctgttcgtggtcttgatacatgatttctattgttgggtttccaagtgtgtgcttgcagttgcacccattagtcccttgccacattcttgcggttttacacctatccttgtgtgaattttcggtcgggatctcgtcaggtgaaggaatcgcactgatttgcctgctgtggttcaaattgtttggtttgttgattttgttaatttattactcaatccgtcccagaatataagaagttttagagttggacatggttattaaaaaggtaggtagaagtaagtagtagagggctattattggatgagtagtggaggttggtgagaaaagtgaatagtggagggttgttattggttgggaagagaatacccatgtgttgtgatgggtgaagacggtacggacgaagctcaaagctgacaggtggtagaagcactcgatcaggatttgcactcgggcaaattcgtgctccgctatgtagagctggatcgtgctcagacacgacttcgagctagccgtgaggaataggtggcagcacatttggatgaagagcagtggtcgacgtggtacacgaccatgctaaggtatggttggaccatcggaggatctgaggtaatgcgtggagattgtcacgttgctcttgctgctcgacaacatggccatgtcgtgctccctttggacaacaattcaacgaaggaatgcagaaagatcaaacagagatgtttcttatctcgttttcattaaactttcataccaggttccttttctagcaatttagatttggaaaccctctatgaactgcgggagaggctctccctccccaggctactgtttttctctgattactattcaactatgtactcgtctctcttctggctccccaaaattttaaaaatgaagaatgtatttctgttagagagagagagaaagaaagaaacatcatcaccctgaaggaatttttaccatagcatgcacaatcaagagttgttcagcatttttaaagagcaaaagaccccttaccaagcaacagattgccagcatttgcaaccagcaccagcatctggggatggaagtgcatcattcacttgcggaaaccgttgcatcttgcctttggaaaaagaccacatattctatcatggaaaagtaaaaaaaaaagaaataattcagaaccacaaaattaccttggggcaaactatgaatatcgcatcaggataaggagttcaacgtctcacacactgacctcacgtggagtttgcacccttctttccttggattgggaccagccgcaccgcaccgcgacacatatctgagatcacagcggcgcggcgtatgcagcagcacggctacgatccgtctccggcatgcgcacgcgcgtgcggcccttgcccctatcaaactacgaggtggcgacggtggttatcttttccggttcagcacgcacgctcctccagcctgaccataatcctcgccatctgccgccaccctcgttgacatccccgagccgtgtcctgcgctcctgcaccagcgcaccctcttgagccggcggaaagccggaaaccgcttcgaggcgagatccgtagcttgctttatggcgctggcatatgtcctactacccgtttcgggttacaacacgttttgactttgatcaaagccaaactattttaaatttaactaagtttatagaaataataataataatattttcaacccatgacaaatttattataaaaatatattcaattattgatttaatgaaactaatttggtattataaatattactatatttgcttataaacttagtcaaacttgatatagtttgattttgatcaaagtcaaaacgtcttgtaacttgaaacagacgtagtagttttttttcaacggcggcaacctgctactggcctactgctatggcccgtgccctagcgtggacacccgaagatgaattggaatcaaagacaaaa

SEQ ID NO: 33708 - DNA, 10988 bp, Oryza sativa
aggtatttaaaactatctaaaattcggaataaatataataaaattaaaagtagagtttagagtccgtataaaaatataatttctaaataactaaaattcaaaattaagaaaaacatgggaagaagagtttaaagtcaatataggaatacaatttagaagtaactgaaatttaaaattaaaatttaaagaatattgaaatatgagtttatatagaaatacaatttacaaatagctgaaattcggaattaaaaaataagaaatattagaagaggagactagagtccatatagaaatacaattaggaaatagttgaaattcggaattaaaaaataaggaatattagaagaggagactagagtccatatagaaatacaattaggaaataactgaaattggaattaaaaataaggaatattagaagtagagtataaagcaaatacaattaggaaataatagaaattcggaattaaaaataaggaatattagaagtagagtatagagtccatatagaaatacaattaagaaaaaaatagaaatttagaattaaaaaataaggaatattagaagtagagtattgagtccatataggaatttaaaactaactaaaattcggaataaacataataaaatgaaaataatgtttagtgtccatataaaaatataatttacaaataactaaaatttgaaattaagaaaaacatgggaagaagagtttaaagtcaatatagaaatacaatttagaagtaactgaaatttgaaattaaaaattaaagaatattgaaagatgagtttagagtccacatagaaatacaattagaaataataaaaattcagaattaaaaaaaaagaaatattaaaatacgagtctagagtccatataggaatatatataatttacaaataactaaaatttgatattaaaaataattaataactaacacgtatataaaatacaatattaatattacacattagtagtttcgtagagttattacaaaatttaaaattatgttgtcattgtaatatattttaataatataatgagaaaacatatatgctattatataagagaaaacataatgatgctagccgcgcaatctgcgcgggccaccatgctagttaaccgaacaagacctaagacctaaggtgggggttgtggaagtggggatagactatgcccttttacggagaaacgcgaggcttgaagttgctgcggaataagcacaatccaatccgagttacggtataggcgtggacgacagaatggcgggatggttgggtcggttgggttgagttgagctgggaaggggtgtgtgatagttattttagattcacatcgatcaaatttgatacaagcgacttacaaccagctaaaaatcaaatcaaacacagactacgcaccaaaattttgataaaaatatctcaaatttttataatagtagagaagagataaacactctaagattgtgttctgcacggaaatgtggtggcttattaatgtatgattaattaagtattagcaaacacaacttaaaaaaaataaaataatacgattctgaaatcaactttcagatagaatttttttttaaaaaaaacatgcacgcgaaaaacaagaaatatgagttgggaatggaaagggaagagtacgggtggggatgctttggagttcactccaactccatccgaaggatttgatgaaatctctgtcatctctatataagaatggttgggatgaagtaactaattcctaatagttttttttctgcatcttaatatttgtaacaaatctaacgaatactatatatatatctagagaatatacaaactgattttacttgcataacctagaaatttcatggttcatccacagtataaaaatcgtattgggctttgtggctataatattttagcaacatttttgtgtgtatatggtttatgtatgtttgcacgtactaaatgtttaacatagttttttatacatgaccatagcttcttatttggagaagagagcgtgcatactttgttaatgttgttggcagaaacatactcactaggaacataaaaaggaagaaaaggtaagtaattttcattcaagcatatgtgattgagggagttaattaggacaagttaataagtggcttcatcttagccataggaaataattgatggtatggatttagtcaaatccacctggtggagttgtagctaactctagggggatctggacccggaagagcaacaccctaatactcgtaataaaatagcaatgtacgttgctaatgccaattcgagggtgcgatttgttttgggaatacgaaattgagccctataaattgtccaccctataggccgcagattcctcaatccttactgcaagcggcaaagccctcctcttcagctcttctgacggaaaagaccacagcgatggccaattacacatggataatacaatttaagtagtgcacgttggcaatgccaaatcaagagatgcaattgcactccacccaaccctacaaatatccacccgcagcttagctcgatccttgcccacttcaaagttcaaacaacaaagccgtcctcttctgaccaaaaagaccaaagccatggcgccttccctcgccacctcttccaccctcgctctcttcctcctcgtcgccgtctccatcgccgacgccgcgacattcgccatcaccaacaggtgccagtacacggtgtggccggcggcggtgccatcgggcggcggcacgaagctcgacccggggcagacgtggaccatcaacgtgccggccgggacaacgggcgggcgcgtgtgggcgcgcacgggctgcggtttcgacggcagcggcaacgggcagtgccagacgggcgactgcggcgggaagctgcggtgcacggcgtacggcgcggcgcccaacaccctggccgagttcgcgctgaaccagtggaacaacctcgacttcttcgacatctccctcatcgacggcttcaacgtgcccatggccttcctccccgccggcagcggcgccgggtgccccaaaggcgggccgcggtgcgccacggccatcacgccgcagtgccccagcgagctgagggcgcccggcgggtgcaacaacgcgtgcacggtgttcaggcaggacaggtactgctgcaccggatcggcggccaacagctgcggcccgaccaactactcggagttcttcaaacggctgtgcccggacgcctacagctaccccaaggaagacgcctccagcacctacacttgcccggccggcaccaactaccaggtcgtcttctgcccatgatcgaacgcgcgcgcgcgcgcgcggctgatcgatcgatctctgatgatcttgggatttgtatgatcgatgcatgtgtggatgtaaccgtgatatacgtacctaagaataagtttgcacgcgcaaacgaggataagtttatgttatcgatctttgaataagtaaaaacaactgggtttatgaattgatatatatgaacgatgactttcagtaagataaacacggttaattacgtgttcgatcagccatatgttattatgcgtgtaactatggaaactattctaactataaaaattaagaagatgtattaatatgtgatatatcaatcaataaatatgtaagtgtaaattcaacttctacaaatatcaaccaaaaaacaaattaaactatatctagacatctagttaatgtatattcacagttaaatttgttttttcattgtgacatgtagatgttaaattttaacttgcatatttttgagtaatatattacatgccaatatatttttttaaaaatctttcatgactatttaagtgacatgtaaataatgagaggatgtttcctcgagagtttaaaatacactatagtatatataactatgcttcggagttcaattctatgatttctccaacatttccaaattccagtcgaggacgtgtacggttgtaaattaattgagttatactagcatggcgcgcgattaatacatttggacgaacacgcccaacaaataaccatgaccactctatcacggcgcattaacaagaaattaactgtgaacagtagtcaggtcgaatccttaaaccttagcggtttggacaccacatgctataaccttagtgcttaagaacttttaagaataccatagctctgttaatagacctgatccagcactggatttatcctaaatccaatatccaggccaaaagcggtcagcttgagtggacccacccaatacttgcaacagcactcaatcgactacgcatgcatggaaagtcaaggattttgtaattagattccacgtgccaaatcggaatggaattaactaacccaagcagatatataccctatccatctcaaaataactcaaccgagaatgagatatgattcatcttaaaacaaagaatctgaacatcacatctcattttaaattaagttattttagaacggagggagtaaactacattattaaattgtgcgggagaaagtcatcatactttcatacattcaagcggtcaagagcctccactatcattatctagagtagtggaccgagcaagcatagatcctctagcaaattaatctgtcaaagaacttattattatatcacgaagaaaagacttccattctgcaaaaaaaaaaaaaattctagagacgtgcaacaactgagttagctggcacgtagtaccgatgaaacagcagagtggagaccgcacaaaacagaaaagagatgctcgcgtacgtacgcacgatgcacgcagaagctacccgtgcacgcgacctcctcctccttgttcctcgttccctcctgcccgggaaatgcatggccagcagcagcggcagatcgggtcatcgaggcctgcgttgcagccgatcttgaacggatgacggaaatcttaaatgaaattccattcaacgcgaataatgggcgcacgggagcacgcaaccgtccggctcgaccgattttggaattctaaattcttccttggttggttctggtcctcgccatccaagtctgaagaattcctcaccacgcagagtcgcagctcgcaggttcgaactggtatgtagagagagcactttgccttctgtttcgtttcgctccacctataaaaggaataagttcatctgagatctcttaacttgtcaacgaatccgattttcgtctctcaaccgaaaaaccaaacacaacggatttctcaactatcaaaactagtgcagatgaggtccctcggtgattttgagggcggttttggctgacatggcgcctacgtggctaatttgacctgatattcatctggcatggcactgacatggtgcctaagtggcaattcggtctagaaaaaataataaaacccgtgggacccacatgtcagttccacaaataaaataattaaaaaatggtgggacccacgtggaccccacatgtcatcctcactcctcactcctctctctctctctatccggggcggagcggctggccggcggagcagggcgggcagcggccggtgcagcggcgaggctggatgcggcggcgcgacctggcgaccgggccgaggcaacggcggtcgggcgctagtcagcccagcgcggcagaggcctgagggagagaaggccggcgcggtgaggagggagcttggcggcagggggaaggacagcagccgctggcggtgctcggagcgggcgcgtcgacgtggccgtgcccggctgacggcggctgggcggcagcttgccttgcctgaagaacaaattcaaagacacaactcactagaactgttgtattgatttgctataagaacctgcatgttttgagtttctgcaggaactctggagattcaattcctacaatgctaaaactcctcaagattcagttcaaatccaaagtggggaagaaaaaaagcgattcgagaagagcagcaatgtgggtcttagataagcacaacgatatgagaaaaaaaaattgaagaacagaagcagaaaccaaaattcaggccaaaaatcatcatcatcacagtgggaactctttccggcaagagaaagatttatgcgcattggctaatactagagattaacagggaagggggagacaatggtaggtacctaacctcagacgctgctgcttccatggtgatggagctccatctcctccaaaatttgcaaagcggagagcctctctctgttaatttggagtttggagggagcagagcagaggcaaggcaaaccaggtgcagaactgtggactcactctggtctcggcctctcgggtcaatccattcctaccactctcgtgttcccctctcgccaccggacacagtgaaccctagccggctagccgccatggacggcgtccagccacttcgtcttctgctcctccccatattgccgcatacaacttcgccggccggcgtggctggctctcgcgccggccttctctccccattcgcctgacactgcctgggctccctcaggccgctaccgcactgggccgactggcgcccgaccgccatcgccaaggctcgcgccgccgtcgcctcggcccagtcgccaggtcgcaccgccgcatccagcctcgccgctgcaccggccgctgcccgccccgatccgccggccagccgctccgccccgcccgtttcccgcttctaccagccgccgctggccccgctccatcggccggagagagagaagggagaggatagagagagagagagaggagggaggagtgaggatgacatatggggcccacgtgggtcccaccatttattattattattttgtgtgtgaaattgacatgtgggtcccatgggttttattatttttccggatcaaattgccacttaagcgccacgtcagtgccacgtcagatgaagaccaaatcaaatcagccacgtaggcgccatgtcagccaaaaccggcctcaaaaccgtcgagggacctcatctgcaccggtttgaatagttgagggactcgttgtgtctggatttccggttgaggaatgaaaattgggttcgttgacaagttaagggatctcagatgaacttattcccctataaaagggcagactgtacaacaaactcggcccgaataaggccgcatccagcgcaacctcggcccaaatctctactgtgtttttttttctttttcaggggaaatctctggtgtttcctgttttcacttttgggtgtgaaaaaatcggtgatgctgcccagcccttgccccaagcagtgacggagctaaaattttctcaaaagtagggctgaactagtataatttacattagtttatctttttatcttttaattgttttcaaattttaaatcacaatttcaatgggtatttaggctaaggagtagaggctctagccctaactaccctactcctatatccgttcctaggcctaagtgtggtcagacagtcttacagcttgttcgagtattagatataactattagtagagctcaagccagcagtgttttggaggcccaagagactgggggaattgatcgatgtgacatcctgacttaattaggatttggcatgtgtgaactataagagcagtgcacgcacatttaataccacgttgctagtttatcaaggctggaaccaatttataaggcatcctccctccaaccataccacaatcgggttaacccttttacacgaaacgaagatgaaaatgtaattgggatgatatgtgtaagtgggaccgtccatcggttaggctagggcatgtggggcacatggcatggcatatggcactagtattggatgtacgaacgtatacatgtgtggcaaccatactactcataggttaacccttttacacaaaccgaagatgaaagtgtaagtgggtctgcctgccggttgggcttggctacgtagttctggaggacccttttacacaaagcgaagatgaaagtgtaaatgggtccgctcgtcggttaggcttggctacgcagttctggaggacgagcgattacaatcgagaactatgaggatttaacaaaggaggcttcgccgagctcactagcatgacaacatccaacgtcttcccccatgcacaactgatcccttttatttgtgtgccacaaagcccccatagccacaagaatcttaatgaatgaaccctcatgtgtgacaaacaaaaacctataggtatgtgcgggagcaccgtcgtggctcagccgcagttggtaaacaacggtgtgcaaggtcattgcatgggaaagagcgtgaccagctaggacaatgggtagggaggttgctgtggtgagaagacggtggcgctattggccatacaaggtgggagggggtcgaggaggagggaagatgaaacaaatagctcacctagttgccatgactggctagccggaggagaggtcgtcatgagatttgttagcattgcatttgcgggaattgagtttgccaacttttcactgttgaagaagagaagatgacaagcactggagggtgagggtagagggaggagaggtgggagactaggagcggggaatgttttttatgtcagcaccatcgcaatcgccagtcatcttataatctcagctgcaacttacacgtgaagattgtcttgaactatggacaaaaagtataaggtggaggggctcgcgtgcaatttggtttactcacgcttgctcgtgtatttggagccccttataatcggtgattttttttctttgaacaattttaattttttattatagtaaaaaaatattttcttttggctatgccacttcgtctagcgtgacgaaacaacacaattatattgtcaatgtattttatatcaccacactaccacaccaatgagactggcgtgactaaaaggtttatattaatttttaaaattttaaaatgttaaaagaaattcataacctgccctgctctgctatatgggactctacacccacaccaatcagatcgtacgaagagaataattctccatgtgagctgataagtgaaaggattgatgggacaatatatttgttctaaaactaatcccaccaatagagtatagtactcttatacagctaatatgctgcagttaggccgagtttagggcctgtttagtacgcgaaaataaaatttttcaatgtcatattggatgtttgaccggatgtcggaaggggttttcggacacgaatgaaaaaactaatttcataatttgcctggaaaccgcgagacgaatcttttgagcataattaatccatcattagtatatttgggttactatagcatttatggctaatcatggactaattaggctcaaaagatttgtctcgcgatttcctccctaactgtgtaattagtttttttatttatctatatttaatgcttcatgtatgtgtccaaagattcgatgtgatgtttttggaaaaaaatttggggaactaaacggggctcttagttacaaactttttttcaaacctccaacttttccatcacatcaaaactttcctacacacaaacttccatcacatcaaaactttcctaacacacaaactttcaacttttccatcacatcgttttaatttcaaccaaacttcgaattttagcgttagctaaacacacccttagttttgttttaacttgacaagaccaaaagtccctgaatcacgcggagaaaacttcccaggccagcttctaatgtgactttttcttcgttgtggtacatttcttgctacactactagatgccaaggaaagagcacctaacaaatcgaaaacgtgaatcacagtaatcacaggatcatacttggattctttgctcctcttttgtccgcgccaaatcggtcaatcctacgaaattactgaaatctagcactaaatcatactcccttgatctttaaaacatatttcttttattatcaagattaaggagaaattaacttatccatcatataataaaaccaagaaactatatgcatgtatatttcttttatcttttattgactttgacagagactgaagatataaatcatcttcattatctaaacaatatatatagatgcaaccaatgagtattaaaataattttatggattctgatcaataatttaatttaacacataaagactaaaaatatatctaactcatttgaaaaaaccaaaaaatgaaatatgtttagacttttagatagagggactatgtgccgtagtgaatatacctttcttactgtagttaaaagaaaacctttctatataacttcatttctagacaccccgaatcaattagatatgcacaatagcataagccccgtaatgggctcgtggcaccaatgaattttacacatacctgtttagagcgaaacaatttgattcccgctgtggcatcaggaagaatttcctcgaacgtaccgtctgtttttttttttttgagaacactcaaccgtctggttcgtggtgaaaaaaagaatcaagagtagactttgaccagaagaagctgcgctaatgatagaaaattccgaataactccaaccaaatctgccgggatcaccaactctaccatatttcaacccacgtactacccaatcaccggccgtaactccatggagaagaaacgcgtagcccaagaaactccaagaagaagatgtcatgtttgtttggcgagagaagttataataaaccgctgacaaacatgagtgttgctgtgtggctaaactagaggtttccctccaggatcagtcaaatggcagatgctagtagctgatttcactttcttttttccgaacgaatattaactgattataaatttgcacaagaatgtcccctatcggcgtcagcgtctcagcggtgctgctaggttccctcgtcgatcttccaaatgtctgcaccagtacgtctctccgagccaagcagtccacagcaatcaacaaatgacgacggattcagaatttcagatcgcccaaggctgtgtgattagctgcaaccaaacggtgacacgcataaatcttctctttt

SEQ ID NO: 33709 - DNA, 6516 bp, Oryza sativa
tagcgaaaaactagtgcagccgaagcccgcgaaccggggcggctgctgcctgcctgcctgcctttgcttgccggctttggaatgatggcgctcccaggcttttcccctgcgcgcaggctgcagcattgtggtccacccggccgtcggatcagatggatcccatggagttctcagcttggatcatggggaccggccgggatgatgccgaactctgcagcttgtgcttgtctcactagccagcactattttactctacgaccgagtgaaacccataggccggcggccatagcagcagtagtagcccatcagtactcctgttcagtgggacggtgctgtgcaatccaatgcagcttctgatcatcgcaagtcgcaacagccatggtcgggatgggtgtgtttagttcacacttttagaagtttggttgaaattagaatgatgtgataaaaaagttggaagtttgtgtgtatagaaaaatttacatgtgatgaaaaagttaaaagtttgaagaaaaaatgacgaaaatgttcacgattgccacttgggtaatcgtcgattcgacggggaggggtgttccgttgaatggcagcgagaatattcttgcatcacataaaaaaaaaaagaaatagtgtatcatcaacaacactagtgcagccaccaacaacaccaaggtcacatttaaatcgcagaaatgagaaaaaaaacaaaaataaaagaaaaacacataattctaatagaaataaaagtgtaaaacagaatattacaaaacataggataaacacatgaatgactgtttaattggattgtaggaaaacacatgaatcaaatgagatagatagactcaaagaaaattttccaaaagtttgagctcttactaagttttcttcaaaatctttataggattaaccattccataggaaggattcaatcatttgctttaaaggcattcataggaatttttcctatagaattgaaatcctccaaaattcctatgtttttcctatgatcatgagaagtttcctcctcccgtcgctcccacctcagggctgacttggatggtgaaaacttgccacagtcgccccctcccccctcccattcgcctcgccaccgcccgagtggctcatcgacaaagccgaacggtcacaagaatggtaacagagaggtgcttccccctcccggagaaagcctgaacagctggggtccgtggttgcaccacccaaccccggttctccatcagagctagtgagaagtccagtggaggaggctttggaggagatgtggctgcggggtagagggcgtggaggcggtgtgtgcagagggacgggcaggaggtgggggagaggtatgcacggcggatcttgtgtcctctaccttagatccggtgcccaccccgcggttccggagatggcagcggaggagaggtttgtggcaggaggtggggaaggagcaggcgcagtgacaacggagcgtggatccggccccaatggctagatcgaggcccttccacaccagatttggccggaagagacggatgttgttgtggcagtgggcgagggggcgacggtggcgaggctaacccggtcggcgaggggcacaagtggcaacagcagaaggccacaggacatggctggtagcagtaggaggacttgcgacacgtagtcacagtcgacggcggtgcatggccaatggtaagagatcagtgcgcaacaggcagcgacgatggggcgccagcatgataaaggtgattgtcgagagtggtgtggtggcgggggctatgggagttcgcggcgggcgcacggcttgaggtgggggtgctgccatgggatatccagccgaggtagcggcgatggtggtgttgtgaggtgggtgctgtgggcctgcaacgggcttggatatagacgcttgtcctcttgcgacgacgctttgtcgtcataagattgccacgtcggtgggctagtgcaagggagggaggatccattcttctctctcaccctctccctctccagcccaactacctggatggattcggagtgcgtcagtggtcgagctccctcctgaaggctgactggcgacgaggcgctggcacggtggctgcgtgtcgaaggtggacgggtggtgggctgctgtttccggattgacctcgactcgggagagcagaaagatcacggacaaaagcccagccttggggccagtaatgaccacgtctgcgggcaccgcttttcccttgaggtgttgttgtatgatctcctatgctctccctgttggatttcttcgagtgaaaatcttgtcttggattctcacgacaggcggtggcgatacttttgggtggcatcgtctagaagattcttttcttaggggtgtcgtgttcatttacccttcagtagcgcgatttggttgtagaagcatgatgtggttgttttcttttcgaggctatgccttcgagggttatacaggcttgtaattttttctgctcaatcaatagaatcatcgcactatcggattgtttaaaaaaacaacacggtgcaaagaaagctgtaatcctaaggatgaactgcagacagatttcgggcgagactctaaggggatgtttggtttccagggacttattccaagtccctgtcacatcggatgtttggacactaatttggagtattaaacatacactaattacaaaacccattccataagcttggactaattgcgagacgaatcttttgagtctaattacgccataattttgacaatgtgatgctacagtaaacttttgataattatgaattaattaggcttaaaaaatcgtctcgcggattagctctcatttataaaattagttttttattaatctatgtttaatactctaaattagcgtacaaacatctgatgtgactggggctaaaaagttttagcccatctaaacactacataacgttgttaagttaacattgcacttcgagttccgattcagtaaggaatgaatgcaaagcacgaacgacacgagcaacaagaacaaatatttatgtatttgctgcttctttcttttgtcactcaactctcccctttcttctgccactaatttacatctttgggtttgatcctaaaccaccatgtaaagctccgatcgccgttgccgtcaccgcccgccggcaatctctgaaccgagctaatgaacacgccgcaaagcacggtgaacacgacggccgggagcttgccggcgacgaggcctacgagaacgacggcaacgacgaggagcgcgacggaggaccgggtccctcccacggcgtcgccgtctccggcgaggacatcggccggcgcgtcgatttctacccgcgtggcattgctgtaagcgtcggcgtccgtgtcgcctccgttcccgcggaaagacggcgaagaatccatcgatctggcgacgaaggcgtccgcggccttggtgcgcattccacggcgagagtccgaggaatccgtcgccgtggcgtcacctcggttgccttcgctgctgcggaaagaacccgacgaatcctccgcctccttgcccttcatgcccttctgtaacttgcggggaatcagcttcctccatgaccgtttcttggtcttgaccttggcgttgcttgagtcgtcgccgcctgccgcgattctctcctcaatggcgactatcgaatcgtcgcctacctcgcttctctcctcaatggtgaggatggataactcgcttcgcctggaggaatcggagaagcttgccctcgccggctccacctcccggatcggcgagacgtagccgcgcccgtccaaatccagcttgttgttcgccgccggccgccgcggccgccgggaaagcgcggaggacctgacggactcgagcaggaagagcgagaaggaggcgacggtgacggccgcgaccaccttcttgctccagatcacgaggagggcgagcgacaccacgccgacgagcgagacgaaccccagcccaaggccgaacacgcggcccttgggctggcggcggaggacggcctccaccggcggaagttccggtctcggtctcggctgggttggcggcgagaccgagacagcggccgcaggcggcggggatggtggtggtggtggtggcgaggaaggctgcggcggaggggaaggcgagggcgagggcgagggcgaggggggagcctccggcccgccgcgcttcttgcgcctggacgccgaggcggagggcttcttgaggcggccatggttcttgacgacgaggtcagcgagggaggtggggaagcctgtctggacggggagcgggccagcgcgcgccgggcggagcgcggcgaggaggcggccgagtcggccggcgggtcgctccttcagcgggctgggcatcgccggcggcgagcataggaagaggagttctccggcgcgccggcccgtggcacactgctcgccgcggttgggcttcttggcgctttgggttggtggcggattggtgggttagttccgcctcagactttgtgcgcgtgcctggcgtgggggccttggtagaggggagagcgagaatagtagtggacgacgcgatagccagtggtgcgtttcgacgaaaagaaaaataaaaaccatccaaatttcccccgtttcgcatgcgttttctcgtccaaaaaaagggacctgggagagtggaagagggtttcaattttagaacggctaaatttgaaagttttgttggataaggttgatgatgggtttagcaactccttgatgagaagggaagggattgtttcttcacatgacctgattaatccgtcacaagaactttgccaatttctacatactttctcgagattcatgtgacgtgaggagagagagagagagagagagagagagggagagggggaatgaattggtctcactgccggaaccaaccggcaaccgtaccgcttgactaatctgtctcgtgccggtctcacaacgttccagtggctgacagcgccctcgctaaccttccacgtagtcaattaatgcatcattgctttggattgattagtactaatcaagtgtatattaaatcgattggctaaggcgctaagcatttggggcctttattttggtgttttcttcattttttttggaggtttataggaccttttgggtctcaggaggttaaagtacgtactagtaaaaattaagcttcgatcatgactcttgatgtgaggtcaattctcttaacagggtcgtcacatgcttgcacgtgaaaataagcttagctatgcgaattacttagtttgttaaccttgtgtatgtctcgtaatctaattagttactagtttgttgatgctgtgtcttaacgagaagaacagactatattctcttgggacccgcggttgtactgtttgtctccctagttcccatcccatgtagctatgtaggcatgcaagcccattcggaaacccccaaatagtttctcaaaaaaaagaaaaaaagaaacccccaaatccttcttttaatactacaaaaatactatcttgttgctatctaaaacatatagtaattctaaggaaattcatcttgtgtgtttatttttttttcaatcacttctacatcccaaagttttgctctatttctttatagctgtactacctcacagttctcatccgtatgtacaaatcatgttagttgacctcattttagaaattttttgtagtttcacattttgttgatttggattcgtctaatttcacaaacaaattcacacaacttaaaaaataaccgcccttttaaggttttgacgtagggatcagggcataggtctaccactcaagttttataaagtaaatttcacataactacaattattttatcaaaactatcacttagctacaacttaagccaaacatttcataaaattacaaaaataacaaactattttattaaaaaactataacttttgttgcttacgtgtatttgatacgtgagactaacttacaagagtgcaagtaccacatatgtgctggacaagtgcacccaacctttttattagaaacaatacaaacagatgtgcacactcatccctataaaacgtacacacgcacaccatatcctcataagtacattcgaaagattacactggtggagaaaccatctttggacggtcgaccaaattccacaatagtcccggttgcaataaaaaccaggactaaagattatctttagtcccggttgaaaaggttagagctactttttgatctttagtcccggttggtagatcatctttagtcccggttaaaaaacggtaggtgatgtcaaacccctctaatatctttagtcccggttagtgttaccaaccgggattaaagatcaatctttagtctcggttggtaacaccaaccaggaaaaaagatcagcatgcgtggagagatcgaggcgcggagagatcaaggcgtgcgggatcgagatacatatctcctcctcccctcctccctcccggttctatctcttcttctcctccccttctcctcgctatcttacacgcggaggatcctctcctcctcccc

SEQ ID NO: 33710 - DNA, 7428 bp, Oryza sativa
  unsure (1)..(7428): unsure at all n locations
tccccctccccccactcatccccgatctgcaggcgcggcaccggcctcgcgcggcggccggcgcgcggcgctggctggcggaaggcggaaggtggcggctgggcggcaggcggaagatggcggcttgttttatttttttttgagaatttgtgatccggatttgagatgtatttgatttgtgtgtgatatgaatatgtgatgtatttgtgatgaattttgtagaagttgtgatgtaatttttttaaaagattttgtgatgtatttggagatgatcgatttgaggatttggaggtgataattgatttgggattttggggatggggatggagtgaaatcaatatattaaaaacaatgaagaaaagaatataataaaggagcagccagggatcggcctggctctatctacaccaaccgggactaaagatagatttttactcccggttatttcacccgggactaaatatagcgatctttagtcccggattcgtagttccggttggaaaaccgagactaaaggggggttacgaaccaggagtaaaaactacttctccaccagtgttagcctgacatatatatcctgagaatgatgaagccaccttaggcatcttgttgttgacgagtacgtctcacataccgctgaaagagtaattaactgtaaatgcgagcactcgtgactaaattgttaatagctcaactggttaggtttcatgtggtaagtcttagacttaatacggacttgatagagtggtcaactagcagcactggtctagagagggtcatagataaaaactggaaggcgagcaaaactcatgtctgtgcaagggattgaacaaagaatcaagagaaggaattttcttagtaattctaaaaggacaagaaaaagcatataaattatcacattgataacaaatatagaaattcccaaaataacatgaaaaaaaataaagtatcaatttataacatttacatgagctaatataagatataatggaatgtatatacgaattagggaagggcgcaagtcggccacccgataatccttggaataatttttttaaaaaaaaacaacatgagaggctccaactgtgtcaatcctcataacacttttcaataaaatgaaggaaaaaaagttatgaattaccttcctgttctcgaaaaccaagcactttacatccttaactatgcaaactagataaactacccccgagcattgttttgggcggttttggcataaactggctgacgtggcactccggcgtggcaaaaaatatttttaaaaataatgggcccacatgtcggtctctatatctactctcactcttctacctccttccccctccatctctctctacccttgaactgagaggagatggagacaaaagaagcccaaggtggcggcgaagagtagtcccctgggatgttggcgacagagcgcagtcggccggagaagcctagtgtggtcagccgaagaagcctatggcggcggcggcggtgactagtcccccggggtgccggtggtggagtgcggtcgaccgtgtaagatcaaagtgtgttttgattcttattctgtgatgaataattggcatctatgattattggttttgatatttggagattatcgtcgaagtggttttggagataatcaattttcaggtgatgatcggattcactgttattttatgtgaccagtccgaccgggtggtgtataccggtgagaccggtggtgattaagcggtcagaccggccggcccacggtttgaccggccgacgctacgtcgatttcggtttcgggttgtttgtttggatatccgtgattgtttcatggttatggcttctagatggatattatacgtatgtaatactgttgtttgctaacaatgagtcaagttggggatagcttggtctcggaatatggtttctttgtttatttcatgtgtaggtgactcgatgcctcgggagagtatttgcggtgatggaccgggagtcggcttggtggtaagacgatgtccgtggtggttagatatcatgcgggatactaagactagagttgatgcacgtggttggtgaagattccatatggcatacgatggaggtattgtgtgcgtatgggatgcggagtcgaatttggaaggagtccaaatttggtacaattggttatgtaaagtttgtgtcttgtactatagggtttcctaagatgtttaggactcttagtatgagtttggttcgtggctttaggctgcctaccttatgtataaatagagggggagcgtgaggcttcccggtatcgcttttgagagcaattgagttgctagtttagttagggtttcgagtttagtcgagatttttgtaaggagtgctgttggtgtactttataaacacagacagaagtaataaagttgtcatctactttgagagttcttcgatttgtgtttcatcgggtttcagcggtctaaccggcgacataccggcggttagaccggcggcaggcggcggtcagaccgacggaggagaggcggtcagactggcagcgacttcacacgtggcaggcaatcttcaggcggttggaccggcggatcaacaccggtcagaccggcggcacgagctcggtcagactggcggatcaacctcagtcagaccgatctacatcgaatttgatggtaacttttatttccgctaaaagattgggtttttgggtatatcaaccattcacccccctctggttggcttagttcttgtgattcgatcctacagaccggacaagcctagggtggcagtggcggagactagtcccccgcggcgtcagcagtggagcatggttggccagagaatcttatggcagcaacgatgcgcggttgaccgaataagcccagtggcgatggtagactggtagacggcagtgggctcgtcgccgctttcatgcaagctccaactctgccaccgcagccatcacctttgtgcaagctccgctacctctaccgatgcctttagtgccctctccaaggcgagccatccacgagctctgtcgtgagtagagccccgccgctgtgtagctccaccccttggaggccactggctaccacggtcgccaggttatgggatccgccatctcctccctgctcagctcgattatagagagagaggatggggattgaggaagagagggatagagtagagagaaaaaggtgagaggggtgagtacgatatgtggggcccactgattttttaaaaaacaattgctgactggactgccatgtaggatcaaaaccatttcagattgagttaggggtattttatccggtttgtatagttgagggtgtaaaatatctggttttcgagttcaggggataactcggtcgatcacgatggttagggggtaatttatacttattttctaaaatgaactatgaatcactttttagacttcaaaaataaagtttagttaggccccgtttggtagggctctaaactctaactcccagctcccaactccaactgcagtgagagctagctcctataggagctgaagtgggtacgaaagtgtttggctagattagttagctccactctaccacgttccttgtaggcatttcgttgaacaccaggttggcatcggctgtcactgctgtcgcctgccgacgcccgcgcgcctgccgcgccaccactgcccgccgccgccaacgcagcccgtcgacgcccaccgctgacgccgacgtcaccgtccgtcgctgctgtagggagggaggaggatggggaggagagagaatgggaggagaggtgtgaaggggtagttcagtggcatttttatgtaaatacattaaaaatttaaagggtagtgggtcttttgaggtggagtggagttatggagcagtaaaacccagctccacccccgtagttcatttattaggagtagctatgccaactccactgccaaaaaagaaggatctggactgtttgacacagctccgacttcaagtaagttggagttaggagctggagttgtgccaaacgggaccttaattacagtagtatcaactaaagtgggccaagttttacctgcaagtcggttcttttgtaatgcatataagactattagccttattgctttggttatgcttatcttatctgtatggtttattagtaatctatatacagtttgtgagtaaaagtttcgtttaaaaaatttaaaacccctntggttattagcgttttgaaaacaaatattgtaaaataatctataacgaaaaaaccacaaaatcaactctagaactaaaactaagctctaaaatttaacttttagcttaattataagcataattagaagtgaaataatgggcataagtgaattaattttttgcttaattataagcataagcttaatcactgttacatgttactccctccgtcccctaatataagtgttacatgttactccctccgtctcctaatataagggatttcgtcccctaatataagggattttgacattttgtttgcgctgtttgatcattcgtcttattaaattttttttgaattattatttttttgacttactttaacatccaaagtactttaagcataccttttcgttttttatatttgcacaatttttttaaataaaactagtggtcaaacaatgtaagcaaaatgttaaaataccttatatttgggtaagggggagtagttggtaaaaattgttaaatccttttgtaggaggcaaaggacacaatataaaatttaattcgaattgtacagtgcatcaacgcgtcgattttacctcgatttttgttaacacgctttttaaacgattaaacggtatgttccgtgaaaaactttatattttaaaatatcaaatatatctatttattaaatttgtaataattaaaccttaattaattatgtgctaatgattttctcattttaaatgtaccaacttaatctccattttcatccgtttcaaacacctcaacctggctagattcactctagcgaagatgaactatcatattcgtacatacgcatgggcagatcgactagctcgtcggtatttccactgttaattcttcacaatataggaatgcgattggacgagttgaataagactactgtcttccgtccaattgattaacactaattaagctcacgtattataacttcctacgaaacagattttcccttttattaactagagtcgacggatagatgtagcatatcattgcagcaactagcaagttctcccctgaccagccaaagcggccaatgtacgtgacgcgatttcgagggtactaccgtactactaccagtctactagtactactccaacttgcaaagtccccatcacgcgggtggttaggtagcttgtgaggggttcacgatctccgtgctcacgcagggctcgagtcgagcgcgctgtgcagcaagcaacgatgcatgctgtgcgcgcggcggcgccgcccaccgcccaccgatctcccggggcatagccaccttcagttttgtgcagtaccagccgtggcaacgcttttcacggtggaaatattgtttccaacttccaaaagtacatacgtgtactactctgtagtccgtatgctctcagtttttgggcggcacccaattaataatacttattcatacaaataaaaatataatgacgtttgtcataaaattctttacgtcccattacgttttttttcaatcccttatgtatttttgaattttgtcttgtccagtatatataccttgaatttttattttttggatggaacggttcaaatcctgttgcaaagttcgttagaccccgggctagggaccttcagcagtgagctagttggatttcgtagggcaggaacatggttcacatcttgttcaaaattcatcgcctaaaatttgaagctctccctcaatctgctctgttttttttgggtcaaatttcaaacaaaatttagtgaatttcaaaaattcgctcgaaattcatgaaattagttatctcgtgaaccctcggcaggaacgcgtggcgagagcaagtgctcgcttgatcattagtctttggagaaccttccaaatagcatgcgacagtgtgacacagtgatagcagtgtaaagtggcgtgcgatgctaaccagggttttccatagcatccgtggagaggttatcgtcccccttgctaagacggttattgcaataacatcatggtaactgtcaaaaaccatgtgaattccatcttaaaaagataaattcagaatattcaaatctcatcgaagataatggttatataatggttaccgcgaggcatggttcgtttgacttggaataaaaaagacgaggataaaagaaaaccacaacctcacactgacaataatgtaacaaactaacatggtggtccgcacagattgcgcggctagcatcattatattttctctcatataatagcatatatgttttctcattatattattcaaatatattaaaatgacatcataattttaaattttgcaataactttacgaaactacaaatgtgtaatattcatattgtattttatatacgtgttagttattaattatttttaatatcaaattttagttatttgtaaattatatatattcctatatggactctagactcgtcttttaatatatatttttaataccgaattttctgtaaattgtatttctatatagactctaggctcttcttccaatattatttatttttatttctgaatttttattatttctaattgtatttctatgtggactctaaactcatctatcaatattctttaatttttaatttttaattttagttacttataaattgtattcctatattgactttaaactctttttcccatgtttttcttaatttcgaattttagttatttgtaaattgtatttttatatggactcaaaactctaattttaattttattatgtttatttcaaattttagttagttttaaattcctatatggactgtatactctacttctaatattccttattttttaattccgaatttcttttttttttcttaattgtatttctatatggactctatactctacttctaatattccttatttttaattccgaatttctattatttcctaattgtatttctatatggactctatactctacttctaatattccttatttttaattccgaattttagttatttcctaattgtatttatatatggactctagtctcctcttctaatattccttattttttaattccaaatttcaactatttctaaattgtatttctatatggactctagtctcctcttctaatattccttattttttaattccgaatttaatctatttctaaattgtatttctatatggactttgttttttctttttctccgattaatatgagaatttgtaggccatgagagcgaacgtggaagctccttttt

SEQ ID NO: 33711 - DNA, 45047 bp, Oryza sativa
cccatgttttttaaatttcgaatttagttatttataaattgtatttttttataaactctaaactctacttttaattttattgtgtttattccgaattttagttagttttaaattcttatatggactctatactctacttctaatattccttatttttaattccgaatttctattatttcttaattgtatttctatatgtactatatactctacttttaatattccttatttttagttccgaatttctattatttcttaattgtatttctatatggactctataatctacttctaatattccttatttttaattccgaatttctattgtttctcaattgtatttctatatggactctagtctcctcttccaatattccttattttttaattctgaatttcaactatttctaaattatatttctatatgaactctgtttttctttttctctgattaatgtggaaatttttaggccgtgagagcgaacgtggaggctcctttttctattcctttaataagttaatagatagattacaaagattatgacatccacaatatatatgtctcaagcattaaatcttcatttcaccttatagtcatgccaaaatacagagttagcttagtgtttttcacaaattttatcaacaaatatcattataaatcatgtagaaccactttggaccttttttttttgctatttcccccgccccccctcctttttttcaaaatttgaattcaaacaatttttgtcaaacccaattgtaagtaaccctatcgtgcccccactgcaaatatggtcaatgcggaaccgcgtggttaccgatggtttgggaaaccctaatgcttttttcgatagggttaattgacgttttacagcccatttaaaaagctactccatccgttctattttaagcgcatccatgagtttctgtgtcaaactttaatcgtccgtcttatttgaaaaaaattaaaaaaacataagtcacgcataaagtactattcagattttatgatctaatagcaatgaaaatattaatcataaaaaatttcaaataagatggataattaaagttggacacggaaactcatgactgcgctaaatgagagtgagggagtactccattatatgagatgcatgaagaaacgtaggagcactgcaatttttgtgttaccatcaaacagggcaacttctgaagcttttctccaacgtgagtaatgcgattgagacttgcgcgtccgttccattgcgtttctttcacactttctaactcaacattgatcctagctacttgttgcattccaatgagaatatcaaataatagagattacgtggtgtaggatgcccaaacaacaaacccagccattgccttttttgcatgatctgactgattaaacctacttttcatgcgtgatacatgtcttagcatacatatcgttgtcctgaatcctgaatatattgcgtgtcacctgcgtagcgccaagcatcactgtcaaatgaactgtacccagttactgagcagaatctcacctgtttattttcagcaacaaactcatcaggcgaatagaaattagaacctagaaggctagaatactctgcacagcatcatctttctttgctgcccttttccagagtcaaatttagcaaggaaaaaagaagctcagcctcatttgtttccttttgccttttcccctttttaacgtccttctaagaataaaggttatccactgcatatatttcgtccttatactgatgatcacgtgaatattcgcctcttcgtgatcttccatttgattcttcttcttttcaccgtgcatgtccccttcactgaaaacatcagctagctgttgttgttgttatcaaaaggcaaatctcatcagccaaaaaaaagttgcgtcttgtacccctaatataattggattggaacctgccctaacttgtgaaatacgggtttgcgtggccctgtgcttggaaagcaggtgcgaattcctcgccaacttgagcttcagaaaatagccgcactagctacctttgttgcttcatgtcgccctcgcgtcacagatgaacctcacaaaatattgctggtcgatcgatccacatatttccggggaatgatactttctgacagaatatatgtgtgtttcagatatgttatttgtgccttttggcttagctgaagaatagcatttcgtggctagctataatgtcattgagcttctaccgtcgatgcatttgcaatctgtaaaactctcctttcagtcttaacaatatttgattggtcgtctcttcggccaacccggcaaaaaaaaaaaaaaaagaaaaagaagagagagagatgtcattcagtttggctggtcatattttttatctgttctgtactgtaaacattttcacaagagaggatatatctcggtttgcggcttaggatttgtagttgtactatataccgcatcttgttgtaaataaggagtagggatgatggaagagtatgactgtatgaggtcagaattcagtgtgcgctaggacaagaattagcctgaaagtcaccactaaacaatgactttgctttcagaatgccaaaaggtcacacctagtatattagcagtaccatctcatcatagggggtttcatttgggtgagagataggcacaacacgtaagacagaaatattttgggcatatatacacttaaagcgtcatgatgtggcttttagatcttactagtagatggataggagagagatcaccacatttgcaggaacaactagacctttttagatgggactaaaacttttaaatccctatcacatcaaatattttgacactaattataaatattaaacatagactattaataaaaacccatccataatcttatactaattcgcgaaacaaatctattgagcctaattaatccatgattagcctatgtgatgctacagtaaacattctttaattatggattaattaggcttaaaaaatttgtctcgcaaattagcttttatttatataattagttttgtaagttgtctatatttaatactctaaattagtatctaaatatagagactaaagttaagtctctgcattcacctaaaacttactttaaataaaaaatagtgcttccaacacttctttttttcgaataagaagtgcttccaacactaggaccctgtcttttgtttgtgccactatgacagtgacagagcaacgggcatcatgctagagccccctttggcaaagctctccaaatgcaaagctatcacagttgtagagtaatttaaagcggcctatgctgatacattgcagcaatgtgtaaactaacttttgcttatgtcaattcatgtctcccttcaaaacagagaaaaaccaatgcaggatggtaaccgatcgagaaaattgcaaataaaaaaactgcacattgagatgcatgatgaacacagtagagtttagtcccatgaaaatgaagtagataacatttcctaacatatacagagatagaaaagagtaaaccacggttcatgtacatgaataaacaaatttagacagagaacaacgatgacaacgaacgaaggcatgcaacaagtagtagcgcacagtacacaagcagcagcagtagcagcagacacggcaacggcacattgtgtgtttgtaccgatcgaaatatatgtagcgtagcgtagcagagagccagagaggcaaagcgggagggatcgatcgatcgatcgatcaggcctcgtcggcggcggcggcgtcgtcgtcctcgtcgtagtcgtcctcggcggtggcgtcctggtactgctggtactcggcgacgaggtcgttcatgttgctctcggcctcggtgaactccatctcgtccattccctcgctggtgtaccagtggaggaaggccttgcggcggaacatggcggtgaactgctcgctgacgcggcggaacatctcctggatggaggtggagttgccgacgaaggtggacgccatggagaggccgacgggggggatgtcgcagacgctggacttgacgttgttggggatccactccacgaagtaggacgagttcttgttctgcacgttgatcatctgctcgtccacctccttggtgctcatcctgccccggaacatggcggacgccgtgaggtagcggccgtggcgcgggtcggcggcgcacatcatgttcttggcgtcccacatctgctgcgtcagctccggcaccgtcagcgccctgtactgctgcgacccgcgcgacgtcagcggcgcgaaccccaccatgaagaagtgcagccgcgggaacgggatcaggttcaccgccagcttcctcaggtccgagttcagctgccccgggaaccgcaggcagcacgtcaccccgctcatcgtcgccgatatcaggtggttcaggtcaccaactacaacaacagcaaattgatcattatttccatcatgttaatttcaagcaaattacacacacaaggtcaaggtgcatgatcgcttcgcttacatgatgggttggtgagcttgagggtgcggaagcagatgtcgtagagggcctcgttgtcgaggaccatgcactcgtcggcgttctcgacgagctggtgcacggacagcgtcgcgttgtagggctccaccacggtgtccgacaccttgggcgacgggaacacggagaaggtcagcatcatgcggtccgggtactcctccctgatcttggagatgagcagcgtgcccatgcccgaccccgtgcctcctcccagcgagtggcacacctggaatcctgcactcacaaaattgcatgtcactcacgttactacatactccctccgtatcaaaacaaaccaactatccatcagtagttataggacattactcagattaggataagtatatgagacatcttaactgaaaatgaaaatgatctgaactctactgtacattgaggtttagacatttaaccgagctaaagttcagatgcccctgttaagagtcatgaaagtgcaaacaattcaagaaactagcaccgcattatctgtcctatcagatctccggactaatcatattcctgtagtactaatttgtgtttctaataatatgtaagttgaatccgaaaatgtgtttatattctgtttctgatgattacgtgcactaaaatccatctcccaaatacgtccaaaggcaatcatgctaagtacatatgcaagtaatcagaacatcatcactaatataatccatccatcgatctatcatgtaacccaaccaccagagactggcaacagcctgtctgagtgtctcatccgctgtaaccaccaccgacggctctgttccattagctgatacatcctcctcctccttcactctttcttgtgttaggtcgtacaacattgtcactagtcacagtatgattgtttttctactactagtagtacattattattgtgatgatgataacctcatgaaccttcaccggcaaaagaagatggtgagatgcgatggtgatgtatttctgtaccgaaaactcgcatctgaccgacaataccagttgtttgccacctgaggaactgatgaaaactctctctcaacgacaattctattcgccagaaagtagcagttaggggatttttttttttagtttgttgctgggttcaattcgtttgggcatacgttgtacctcgcattttcaagaaaacaatgataattactgattactgggtaacatttttaacatgcatatcttacatcttggcaatgaatgaatgcataatagtcagattcaccttttatgcatagagggaaaaatagtattcagcgcacataagcagtactctgtacctcaagtattctgtgaattttttgtgcacttgaagtttttagaaccttcataacatgtatccatagtgttccaatttttaagcagttgattcaactcgatataagatttacagatctaacacagagaactactgaaatttaaaccaacaatatatggcgcctcaatttctagcctgtgttgatcccgatttcccatcatgccaatggatcaacttgacacaggatgaatgtctcattccgacaggtggaagtggtgtaatgtgatggggactgaaaataataatttcatcttattcgattttttttttgaagatattcccaatttcaaccacgagtaaagatgttgtgcttctgtctgattaacccgatccaaccagtactactatgtatcatgtatggtcttttccatgtatgtccaaatttgggttcaacaactggtgctgctggtattcctattcaaatccaacctaaaatggtatgataagtttgcacactgaaattcatccttgaaatttgcagcactactggtttgttttgctcctcaaattgaacaattcacactctcataactggaaccaccaattcatttttattttattttttttctgagacccacaagcaattcataccagattgctcattatcaatgctgccaagttggcgtattactctgttgtctaacaaaagaaaaaaaaaactccagattcttttcatgcggatcttaacacgctgcggtgataggctaataatgtgtagcataatactgtcttacctaaaaatacacacagaaagtacaaaccttgtccacttttaggatgccaccgtctaaaatgatcttgccaaaaaaaaagttaaagaatcatatgatcctattctaaattttcagcgacggtttacagaggcccgagaaacacgtatgcagagaaaatgcagaggaatgccatgaacgcaaggattcgttttttctttttttaacgaaacacagtgaatttaaagaacaagaggatatgtatatataaaatcgacgtgtacgttaccttggaggcagtcgcagttctcggcctccttgcggacgacgtcgaggacggagtcgatgagctcggcgccctcggtgtagtggcccttggcccagttgttgccggcgccggactggccgaagacgaagttgtcggggcggaagatgccgccgatggggccggagcggagcgagtccatggtgcccggctcgaggtccatgagcacggcgcgcgggacgtggcggccgccgctcgcctcgttgaagtagacgttgatccgctcgagctgctgcggcgacgtgccggtgtacgtccccgtggggtcgacgccgtgctcgccgcagatcacctcccagaacttggcgccgatctggttgccgcactgcccgccctggatgtgcaggatctccctcatcttcgatcgcttgcacctcgatcgatcgctcgccgcgcgccgatcggtgatccgatctctttcttggttgttcttgggaggtggtttgcgatcgatcgatggagagagggtggagaacgtgggaaggagaggaggagggatcgtgggcgcttatatcccgcgtttggagggaaccgcttctctttctgggtgttatggttgtgcgtggaccaggtgtatggacaaatgcttacacgtattgatatcgcttcaatttatttatttttttacggttgtcttcgaattttaaagagacggttttctttggaactttaaatttttataggtgacgcgttatttttggtctgagtgtgttttggttattgcaaaagaaaggttgatcaagcgaagtacttaatttgtgtggacatctgttttatattataaatcgttttaatttttttcctaatataaatgcaatagtatttttaacataaacaaacatattgtcaagatatactgaatgttacactaatatgatgttaaagatgttatttttttctataaacttgattaaatataaagttgaaatgacttataatataaaacggagagaatactaaaaattttgttgtggatttgttgcaggtcaggtataaatctagttgtactaaatgttcgttttaattagcgatatggaattatggatgtgagtattgaagtacctgtgtagaccatgactccatgagtatgtaaagatgtgccagggtagaccgcatgaggtactgtggtatcaaaggggtgtggggacgatcacgttgtgctgtctattttttctgccacattttatttttggctgggtgcagtggcgggtcaccaaataatgggatcaatgctaatttactacggatcaatttggtacctgcaagcacacttaggcctagttacagatcagaggaagaaaatagcaaaatcatggagcactacttttctactacagtattagtatggggtaagttttttttttggtacaactttttttgaaagatagttatatgttattagagggcacattatattggcatatttgccactagtagtatttctgaatgtcaaaattttttaaggcgtgtctcaagaggaatggatccatattaattttaaaggcctttgttacctggtagagactgtcataaaatctcttcatttacacgtccacatgtgtacatcctttgggaattttgatatgtactacttccttcgtcctaaatataacacatcctagttctacaaatttaagcagtcctcctatacaaatttacaacactataatgtgtcacgttttgtagtaggtttattttcttaacagaggaagtagttcactagttctctacttgcacatagccagaagttggctttttttgggatagagggagtagttcacatgtgagagtacatagtactggtacttatatgtgtcaagattcattaacatatatataaatatagacaatcgtagaaagttttataatctaaaacggaggtaatactattttagaggaagaagaaccttttaaaatgaatttctttcgtacgtgaatatatatatatatatatatatatatataatatacatacatatgcacaatttactactccctttcttttaaaataatttatattttttaaaatttaataatcttttgtatgtaaatctggacaagtcgattgattttggaacggaagaataccctaagaaagtacactcccctgccaatgaagagaaaatgagaaaacaagtacactgattgttattagtatatttaaaccaagtttggtatgacttattgtgtgctcgaaaaagtacggagacagcttggccaacaagtgttctttttatgattaatataaatagatatcaagagaaaagttagctgtcaacttgtccatagtgttacattgctctagccttgtcacgttcaaatactgtttgccatggcatttgcaaggagaagatgctgttcttgatttctttcgcatcattatcatgatgatcatcaagtcattgtacatacatatatatactcgatgattgtaaacgttaccataccaaccaataattatattccgagataggatccggagactggaggggactgttttgagtccatcagtccacatgcaccagcacatgttgtgtctgtcttaaaccaaccgatatcatatcatctaattaactattaacttctcttcctaacaggtgacagccatttttttgctagattaataccattgtttttttaaaattactccctgtgtacaactccaaattttctctcgtccaaaaataatgtcagatttctaaatggtcttttccaaaattgtccctgttgaaagcgacgtatatatcttagattcttgaaactgcgatcaaataatagcttagctataggcctgaagcttagtttcgtaaacagtttctggcccagtataaccaagcggcgttcttaacttgcggctatggttgggctgcacggcctgcaggttacccagaccagacaggtgtatagctgcagagctagagaacgaatatgtccacattgactccctcaggtatagctttaatctaattcttatacttcaaccgtaatacctgatatcttaaccccaactattaaaacttatgtaataatatgattcccttaatagttttggaggacagcttcgctgaattggcactttgacctggtccaaaccggctgacttagtatgtgggacccagtgcaaccgctagagaacgactaattaaagtgggcttggcacgataattttgggctcgacgtagtaggtcgctgataaagatggcctaggagctgcatgtatggtccagaggtggtgaaatggactagagcctagaggagtgcggagagacacaaaaaaggcccatatagaatagccattaacataaggcaaaatttgctacaggacatgtaattagccgaagaacaccggaagaatgtgtatatgctggagagcatcgtaaaacactggtaattagctgatgtacactcacgacattattttattatttctggagaaaatagagagagaaacagttgtgaaattatggttttacccttgaaccccaataaaggctcactctcctgtgggacccacctattagggaatattattttttttctttttctctcctactgtactccttcgtcttcctttcttcgtcatgtcttcttccatgatggccagcccctccccacccatcgcggctccagggatagagttcacggcgccgccgccggggcgcgaccacacgcaggattgctcgctcacctacgcgcagtggaaggaggtggacgcctccacgcgccaccgcctctcgctcgacgcccgtgccgcgctcggctacaccgctcagaggatcttcgcgcggttcatggccatcaccaagctcacgctccgctacgcccagggctccgggacggacagcctctctgacgacggggcacgccatgtggtcgccgcgctgccgtccgaatggctcgccaggctcaagctccgcggcctccggcagctcttcgacgacgggattgcgtcgctcgctggggccacgccggtgatccgtaaactgtccgtcgcatccatcagtttctgggccgagggcccccttgtcaccgtcctccggtcatgccccctcctcgaggacctctccgtcaagcgcctttcgcggcctcctgtaatctcacggcgtccggctgggagcaagagccagagaccacgaggagcacccaggcgttggcggtggtgaggaaaaggcccgtggggctgtggacgcagccggaaccggagacgacgaggagcagaccgggggagccggtgaggaagccataggggcaaacttgtctttaatggatatttctctctccattttctctggaaataataaaataatactgtgagtgtccaacagctaattaccaattttttatggtgctctccagcaaatacgggttcttacggtgtcccctagctaattaaaggttttttggatgtcttgtagcaaattttcactattccaaccaggatacgcatgaaaaacagagcgatccattagcgcgtgaataattaaatattacttttttaaaaaaatagattaatttaagttctttaagcaactttcatatagaaacttttttaaaaaaatgcaccgtttagcagcttaaaaaacatgcgcgcggaaaacgagggagaggggttagaaaaagggtgtgccgaacacaacatattcctctacaatagtcacaaacccgtgcgttacaacggaacgggatctggtgaacgtggttaacggagccatcgtttcgcttattgacatatttgcaaagcaaaaatactttgtgaataaaacttttatatacgtgttcttagcggtctaaaagcaaatattgaaaaataaacttcgatgaaaaaaccttaaaatcagctacaaatttaaagttgaaaattcaaattttggctgataaatataaacataaatgaaaagataaggccctaaaattttctgttcttctgtatttctctcttggctagtacaccagttttgttcatgggatcctataatcttataatactatacaagtgatccccacttagtgcagttattagggattttcctgagctgtggttaaggcacgtcaccctttttttcagccgttcgatcaaatcctcgccaaccgttcgattgcaatccatcacgcacatccctccgccactgatttgttgccgccgccgccgccgccccgggtctcccccatcgcgcactgcttcctcccaccaatccccacgcgcgctcgcttcctctcccccatcgcgcgcgcaccagcgcgggcccgccgccgaacgccctcgcttcctccatcgcacgtgcgccaggcgcgggcccgccaccgacgccctcgcttcctctcccgtgccgcgtcgcgtcatccctagcgcgagccagcctcttcggctccttggcatgtaggaatgaaacaacaatcgtcctatctcccccaatcgttgtgattccatgccgtaacgttaaattctttgctcgccctattgtgccacaaaatcgaagcaaaattaggatacgaatgtggtatattcatggttgccttcataagctgtctttaaatcccaactcgatctgtgcctatcatgctatggaggattgatcactgggttcatcattcgtgaaggctattgcaactggcatgcttctgatctctatcttggttggattattttgtgcaaatcatttcatcgtttcatctcggcttcttcacgtgagacaacagctgatttgtgtattccgtctaccctcaagtggataaggtagcattttctcatccctcatcctgtcatgtttagtttaattatgggctctccatactgaaacagggtggtttagcttttggatgagttcattgactgtactcatctttttctccctgtacaaaaaactgcaatgctgtaggtgttctttcggtgaggcccctgcatgatgcaattctttttcgttttgtattattatgttattttccctgtaatgttaaatcattcctatttgctgatcgatttggcagaacagctcttgcggtaattgctgggaagataaattctgatcattaatttttaccttcaattttttttaattccaaaagagaattcagttctcttctaaaatgcatgaaagtgatttccgaaaattcagcactatattaattgattttttaaatttattttcttacagcaatatcatttatttccattctataaccccatctctatcatatcgaccaaaagaacaatgcaactattggtctctgttttgtaccaaagcaaagcgcaatgaacatgtattctttctttcaggcctaaagtccatatgtgttaactacaaacattacctggcctcttcctgcttacagtttgcaagtttctgaccaaacttttaagagtagttgattttgccgattcccttcatccacatgatctatataaggacatagcctatttatgattgataaaggtaaaattaatactccctccgtattttaatgtatgacgccgttgactttttaatcaacgtttgaccacttgtcttattcaaaatttttatgtaaatataaaaatacttatgtcatgcttaaagaacatttgatgagaaatcaagtcacaataaaataaattataattacataaattttttgaataagatgaatggtcaaacgtttgttaaaaaatcaacggtgtcatacattaaaatacggagggagtagaatatagctgtaatttagtacactaaaaccaatatgagaggttagatcgattaatgttagcatggactaggctaatatatttttatgttagccttaattactttgctaattactttgttaatcaagcaggggacgtactactacacgaggcggagccccggtacttgcccgttgtggtcggcccttggctacacccatgacggttatttcctacccgtataataaattacccatttaacacatactcagaatacgtacccacgagcatgttctcttttggcacatggacactaaggatgtgtttagttcacactagaattggaagtttgattgaaattaaaacaatgtgatgaaaaagttgaaagtttatgtgtgtagaaaagttttgatgtaatggaaaatttagaagtttaaagaaaaagttgggaaactaggcctaaaagataggagagaaacgataaaactttgaacatgagagtaagtttaatagtatagtcaactactaactccaattcatctatagccaatcttatagctcattcatacaataattacatactacactattaatatatagtcccacctgtcgtatacatactacgtcttggagtccgtgctacagctggctataaatctgtagaccgctgcttttctctctctttatttatcttactaaaatatgtttgcagctggcttatagcctgctattgtatctgctcttatgtgcatagtcatacgtcaattactaacttagagctagcatctcaatcaaagtggttacatacggaccatccgatttgatatcctacgtgtgaattcgctcactaaagttgcacattcgcctcaattgagcttccaaaaaccactctcgtctgttccatttggtgctcggtgtaggtgacagtgtcgtaggtgacgttcttgaggaagatcttgatcacgccacatgttcctcgtagatgagcctggagatgcgcttgggcatgccgcgggtctcctcgtaaatgaaactagatgataccccgcgcgttgctgtgggatatcgtgcctaaataactttggagaaatgggcacatatatataataaagatctatacaaaaattaacactgcaagctagttttcagtggcatgcataatttctaatgtcaacctgcttagtggagcatcactgcgtacggctgcaatcacgtggatgaaataaatcggcaaaatctaacgagatctctaattttattgggtgcatgcattatatttattagattaatccaaactataaggtgataataattatttcttagtttttagctaaggtggttgtgctttatattttggaatggagggagtatgtaataattggttatagtttatttgaaataaagaccagaacaaaaatagtatgtgtggatggtgtgtatacacgtgtacaatcttctatgtaaccataaaaaagagctcacaaggtcgtacttaggcattaagagcccattgtcgacgtttgatgtcgcgattccggtatttgcatattatgaggatcattggtactaggatatatgtgagattgtaataaaagagatggggccctgaattgtcaggtaataaccctactcctgttggccgaagccggtcgttgctcttatttatcataatcacaccagtacaatatttggggtagtctatctatctgtcgtcgacttggcggccataaaaccatctcgtagtcgacaagagagtaatcttcctcctcgaatccgtgtccggcgagatcaaagacagcgctatgtctctcctgacagtatccgtagacaccgtaggggactagccatgcttatctctgaagtcgatatccggcgtcttgtcttggcgtatgttggcttgtatgttgatcttgtgtttgatctattgttccgtgtcccctctccttctagggggtcttgtatttatacccgtaggtgtccccttgtccaagtagaactagggaaaccaatatggatacaatccgagtagttcttgtcgtttccatgtagaactctattcatccttccttatgcggaactcctcctatatccgaaggttgtttccgtataagacatggtatgtggtgggtcctgccgagatttagtcaactactattagatatgtggtatccataaccctaacacctatcttttgggttatattcatgcttacccataagtcgtattagcaacttaaaaaaataatttgtaggtaaaatttatacatatgtactcttaactatgcaacagcaaatgctataaaataaattatgattaaaaaggaaaaaataactctgaaataagttttaaaatttaaatttaaatttaagtaaaaacatgaggctgtaacactagtacgacctatatagcccgtatacgcttgcaatatggatcagtggatgcggccacgtagggggagtgggccgttcaatgtggtatggccgggccgtccttcacgtcttgcgcgtgacggcgcaagtacagggccaacacagccagcctgagaggaccaacacaactctcttaagactgtgcaggtaaaatgccttcccctttaggttgtgtttggattcaaagtttggatccaaacttcagacattttccatcacatcaatttatcatacatataacttttcagtcacatcattttcaatttcaaccaaaatttaaactttacgctgaactaaacacagccttaatggctttctcttcggcctcgcgagggagcgaatacatagctacagtagctcgcacgacccgtgcggccctgccacgagtaactgagaatcctgactactcaaggacgacgcatcaatgcatactccagtatgagggaaatgattaaatttgcacggttcacttcattgttctgttttccgttcacatcgcacatctagatgaggaaattgttttattttcctttctaaaaaaaagaaaaaaacatctgtttgtaggtgcgagtgtgatacgcgtgcgtcccacatgtactcgaaaagataggttctcttcatgaaacaatcatgtcaaattcataaattttagtatgacaaactttctttggtataacttggcaaaccattaccaattcagaaatttcggacaagacagggaggcgatctccctctcgaccctcaaagtatctccaacagtctctccaaattccactctccaaatgtctatttagccaactctccatttaatttggcaagtcaattcgttgtttctttcaacagcatctccattcatcctctctattctgagtctatgacagcaggacccacatgtcaccctatatactactttctttctcatcatcctgctcccactcttccccaagcccccttttgcttgcggtagtggtagttactcgcggcgatggcggggcggcggtggccgtgagcagcaacggcgagacattcctgagctcctccccacctctctccctctgctgcggtggcgacatgcacacgacggcggacagcaaggggaggcagcgagtgcagggggctaagtccacgcgacggtgagtgcagggagctaagtccacgcgacgtccgccctttcttattcctcatacttctttctttcctccacacccctcgtctccgtgctagtggcgctcctctgcgtgcggtggtgtcgccggcggaggtgggggggcacggtttgtgtgcctctgctccggcgatggaggctgacgatgggggcgacggtgagggatgacgaagactgcggcggcagcgaaatgggagaagccggccccactgctgcctcatctcctatctcactagcgccacccacctccttcccccgctcgctggcgtcacgagcccaccacccccttttcgcctgcccccaccgcctccaacgccgagacccacctctccttccgcggctggttcggtggcccccttcatcttctcctggggtgaggccagggagggcgacggttgaggcggtggcggcggaggaggcagtggtgggctcgggggcgtcttttgggcaggcgcagcgccgtcaccaccggcagtggcggctgcggccgcgggcggcatcggtggatggatggcgcgaggccgacagcgcggaggacgatggatgatgcgatggcgtgaggcagacgacgcgaaggacgatggatgatgcgagagtggagatagggagcaggaatgtgtggggcccatggttggctagtcacttttggctggccaaatttggctagtggagggaaggttttagccagctagatgacttagtcattcggttggagaggttgttggagggtgtttttttggctagaatggagagtggaatagtgaggctgttggagatgctcttagctagcaatccccactaccgcgccagctgcccttccctgctcccacttcacaaccccttccttttttttctcttctttctttgccttcatcgtcatcgtcatgcgaagcttcccaggtgatgggattttgttgctcacgccatcaccgaatcacggcgacttccatgccacgtggatggggctcggctgaatggagcgcctccccaactaggccagttggagcattgtcatggcaactcattgaggttgtggacgacggcgcgcgggctactcgtcggcagggttttaaatttcgatttcggctaaaatttcgaccatttcagtagaaccaaaatttctaaaatttcagtattttttgggccaaaattttatgaaattttgacacaatttaattgaatttgactaaattcacaaagaacatgagaaaaatcgaaaatttcggctgagatattgacttgccgggggaccggaatttcggaaatttcgaaataaaattttaatccctactcgtcggtgctagggcaagaggcgttgtaggcagcatggcgcctcggtggggccatggtgttgacgacacaacgatctaaggggggtagatcgccgctgtttatggcatgtctggcttgcccgcctccagtgcgttgttcgtggtgtttccatgacaatggtattctccaatactcactgtgtgtgatgagcaggttatgggatggtgaaaaccttgtaggattctaactgggatttgatgacactctcgagcaccatttcctcattggaggcgtcgccactgtcccccaagtgaaaacattgctttgtttttctggacgagcggtggtggtgtctcacgccccgtcctctatggaggcattgctttggaggatttgtgcgacggtgactatttttttatcggctttgatggctgtgtcggtggcaatatctagactaacgatttatctactactcagttactctcagcattatcttttgcctcgatttgacttcaatcgtcaatagtgatataagcaaaataagatcaacaaaatgattggtcactgatttcagagatgctatttcctaatttcataacttgcaagccgctatgaaacaacggttatacaattcctcgctaggctacgttcggatatgggagatgggaactcattctctctgcacgaaaaacggagcggtctattagcgcgcgattaattaagtagtattagttattttttttcaaaaatggattaatatgattttttaaaacaactttcgtatattaactttttttaaaaaacgcaccgtttagtagtttgaaaagcgtacgcgcggaacacgagggagtggggtcaggaaccctttgcaactagggctgtcaacgagccgagctcgagtgagtctggctatgtaggctcgagcttgacagtttaacttggtgaaactccaaagaactttctcttgtataagagatattaatgcaaattatcggtagtcaaaattaatgggtgctacttgtcttgaatgaagcctcttcagctttcttatgaattcatgactttgaaacgttgcaattaacaaaagctagctactacatctaataggaatagtagtactattactggcagccggataattgctttattgagaagcatttataaggtcttgagacattagtaggtcaagcacgctgataagtatacattgacccatcaagaatatcttcctacatgtaatgcatcttatactaatcaagccctaccgagctattcgagctcgagcttgctaggcttgtgagcctcagcctaggcttgagcttggcttgtctagtatttgagccgagctcgagtcaagcctataacgaatcaagctcgagcagcttgcgagctccgagctttttttacagccctatttgcaacaaacacagcctaaccatagatgggagttgttttctctgtcttcgggttggtgtttcatgtagttttcgtgtcttgcatcaagttgtggttttggaagttgtaatcttaccttcaacctccgtaaaagttggttgtagctttttttttagcaaattaaagtcaataataaatttcattattagaaaattttcaaataacttagtagtggtgcctataattatgtaggaggggtatttttaattgggtttaaacgaggatactgattaatgattggcctttttttttgcttaaaaatatgttaaagtgggtaatactaaattatgggtatgtacgtatacatatggtatccggtacatagtagcgtgtatgctatgtacgttcctgtgtataataggaaaaaattgctgtcacagtacgtgtaacaggactacaggagtaagtagcagttgagttattgtactcgttcctgttcattgcacggaactgaaataaaggaacggtttttaattgcttcagaaccctggccattgattaacatatctagcaatgattcggctgactagtcagtagaagtccatttttatttttattttgcaaccatcaaatatatcggtgagtttactagtagtagtagcaaagaggagtattttaattataaatcgaagaaatttgagtgactaattaacatcaatggcccacttgaagtacacaaatgtatagcacggatttttggtcagtactacctccgtcccaaaataattaccgtcgtggatatccgtacccaacgtttgaccatctgtcttatttcaaaaatttgcgaaaaatttgaaaatatttagtcacacataaagtactatttatgttttatcatctaatagcaataaaaatattaataataaaaaattttcaaataagataaacggtcaaacgttgaacgtgaataatgtaaaactgcacttattttgagacggagggagtagtactctttcaagattgatttgtttcctggcaactgagcatgcaaggcaataatcaaattaaatacagtattaattagtcgtaaggtcgtgtgtcaaattgagagtatgtgtgtatgcatgattcttttctagcagtatcattttcgaattgaatttgccggttgcttgcatacgcgtacctggaggactaatactgttctatcatttatggctttgagaaattaaaacaagactgccaaaacccaaaccagttcaagcattcaattcaaagcgtgtatttaaaggacccgcaattaataggtacatttaatccctacattggccgcaggaattgattgactagctagctagagagacagttccatgctctctgaattccgaattaaaggaccgttgtacagtaaactgaattccgagtactttatagtagtatagcataaaaaaaatcattgttccagttcctctcgcatttttatgatagtaacagtagaattgataaatacatttgacaatattaaggttagagcaaggataataatagagcccacttcctactattagctcatcttaaagtcaacatatataatagattagctataagagcaggtacaattgcaggctataagctagctataaacatattttaaagagataaaggaagagagagaaaagcagcgggctacagatctgtagccagctgcagcacggactccaaaatacaatgtgtgtatgataggtgggaccaggtattaatagtatagtaagcaactattgtatgaattggctattacattgactatagatgatttggagctagcagtgggctatactattgaacttgctctaaggttggctacaattttcttctcctctctctatctctcacttatacatttaatgtatttgtcttggagcttgtgataagctagctcttgcattagagccaacatccttaatttttcactacctctctcctccacctaagtttatagtaggcttatagctcactattatacttgctcttagaccctgtttagatgggactaaaacttttaagtccctatcacatcggatgtttggacactaattataaatattaaacatagactattaataaaacttatccataatcttggactaattcgcgagacgaatctattgagcctaattaattcatgattagcctatgtgatgctacagtaaacattctctaattatagattaattaggcttaaaaaatttgtctcgcaaattagctttcatttatgtaattagttttgtaagtagtctatatttaatactctaaattagtatccaaatacagagataagtctctggatccaaacactaccttagatgtatgttgtcataactagggagtatattaaaaagaaaagaactgacagctttcagccacatgaaattctcatagattccaatcgaattcttctttttctccggcgaacacttcttttatgaatatataagcacagttgatttaatttattctataaataaatcatgacattgcacgtataaactagtatattcgtatcatatgatctacacatgtaactagacagtatattgaatattcaaaacatgtatcgaagattttggatgtatggctgcacaatacgaagaactcgcagtaccaggcgttaacgatagtgtgcaacacctgagtgcagaggaagacaagccgtgctggacgaaaagcaagtagtcacgtgaagtgattttcaaaaatcttattattgccttctccctatgcaagacatcgaagacgaaggttctggaggcgtgctctcccaataaccgcgcacgccagtgagtgggacagagttgactacgagtaacgagcgacgacgcaatacggaggaggaggcaaatcctagcttgattccgcgtgcgttgcgagaaggtggtggttcggttcatatagagatatcaggacacgtgataagagtgcctgcatgatctccataccgtgtaaccgaaccggataaatttcatataacttatccggactccatcccactctacgcactagattatttggtgtgtttccaaaaactacgtttccaaaaacaaaactgaactttgcagcaaaacaaaactgcaaaagaatggcacgtctgtgcaagggtgagtaaccaattttgacgggccattcacgcgccgtctcgcctagcctgacgagcgagcgcgcgtgtgttcctcttattttttccaccacacatgttttaagtggttaatagaacaccctcccttatagggagatctccctctcctagaataggcaaggtggtactaatcattctcatgtatgctagtggcgtttatgattttccaaagaattaatcttcaaatgtgctaaggcccatctattaatttcaacgatcttctcctcaagcaatggtctaaaggcagcgatgacacaacccagtgagagcagcgaagaatgaaaagaggagagagaggggagtgtggtacctatgacttaccaacggcgatgacagaatgtcccatacaactttccctacaatcggcgacaccaaaactctactccctccgtccctaaatataagggattttggtaggatgtaacacatcctagtccaacgaatctagactgtcgattcgttggactaagatatgtaacatcccaccaaagtttttatatataaggatggagggaatatctaccaaagaacctacagaatagggcttaagggttgggaagtggtggaggtggtaaggggcggtaatcaaggctactttcttaattgatactactcctatatgagtactagtactctataattctactcgaaagcggataaaaacatgctttgttagtgcagcaagtgtcaaaatacagtaatctgatcgacctgatagatacattttcaatgcctaagtataattgatactccctccgtttctaaatattagacaccgttaactttttagcacatatttaacaacttttgtgaaatatgtaaaactatatgtatacatataagtatatttaatattaaattaaatgatatgaaaataattaataattacttaaattttttaataaggtgaacggtcaaacatatttaaaaaagtcaacggcgtcgaatatttaggaatggagcgagtatttatttagctatgaatttcgctggaggtaattgaggtctgcatgctgaacctgacagactgtactatacaatatctgtagctgccaaaacggctgaaaatccatggggaacatgaacatgatcttcatttcagagcccaaaatcaggatgagcagatgatatatataaacacgatgcaacaggaatgcacattaacacagctagttacattcaggcactgaaattgttctgatcatgcatgcaggggagcgctacaggaagatgggtagtgataaaagagtacttaaaaaaaagacaagcattaggtttccttgtccaacgtttaactgttcgttttatttgaaaaaattataaaaaaaaatttaaaaagataagtcacgcataaagtattaatcatgttttatcatctaacaacaataaaaatactaattataaaaaattttcatataagacggacagtcaaactttggacacggaaaccagggtctgtctttttttttttttttttttttacggaggaagtacttcgcacaacttcaatgacaatagccatactagctaggtcagtaaaggctaattaagccgctgcactgtgggcttgtcaacatctggacaagtacccggtgagcaatcctgcagagtagcagtatgaatcatctgctaatgctagcactaattaacatctaaacgggtcccgccgaaattatctccattaacgtagggtaattaatcaaccatgcatcctggctcaccatttaattatacgcctccttttattgccctgctcttctttaacctgtgcgtaggggtacaaacggtacactagtggtatctaatcttctgtaccaacttgattctgcccagttctgaactaccataaaattgtggatactgcattgatcatcgtagccctgctcagctcagtggtggcgacatgtaccccatgatccaattaaaaacttttaatacaaattgtacccgttctctatttaagctcaatatgcatggtagcttgatagtactaatgttttccaaatttatttcgtttacaatattccttgatagagtagatgtgctcattaacttaccatcaggttttgtctcatggtacgagtcctggaagctaattagaggtatagctaggacggcaaaaggagggcacggccgaccttgctatgaaccgtgtgatcgtatttggagtagacgtgggccgctctatgtatatcgttgatctactgtcgtttaaactagtagtgtagtacttgtgtacgtatttatacggttgatttagtttaagatctagtatttcatcaattgatttttatctatgtagtgttcacacttctcttttcttcttcaacctccaataggacttaatttagcttctctagaacactcctagataggccatcacgtgtcttaataaatcctgtaaattctgaaaaaaaaagaagataaaatttgtcccttaatttttatacttaaatgtatgggttcaatattctaaaccattagagattagattagtagatagattggtccaacctctcccctccctatttttaaggtattcatttaagataaaaggaaattaattaactagttacttgttgggtgctcatgagttgtaacggggaaaaatatacatcaatatcaaatcacagctgataaaatgatgtttaataatcattgagtgtaagcttgttgacattgttgtaacgagaaacattaacttccctttaaaatcttcttctgatataaagaccaatccataggaagttgataggattcttgcggtcctagtccttaatttcttccaaatgaacaaatagatcattttcttatatgatttaatcctaaaaaaatcatcaaaagaaacctttgttccattaatttaggtcctaattgagttaatgggcaccaaccaaatgacccattcctcgtgatcttttaagtacccggtccatccattctaaaatataacaatattatagagtagtccaaaatttatttcaattataacaatcttgttattttaaaagaacttttattgctaaactattcattctggctacctctactactatctaggagtattaatttattattgccaagtagtttgggcttacatacacctcaggtacctatcctgaaaagatagtaaagtatttacactcatcttcttaatagtcataaaacgtgcaatcgcgtatggttagaggaaagcaaggcacacaaacagtagatcgataattaaccgattaactttctctgtaaaaaaaaactaaaacaggtaaaacaggatatgtcatttctaattctaaatttgtttttttaccgagagacatgtaaaaaaaaaaacagcttcagctccttcatacctatttggtcctagagcgtactccctatagtcgtccctactgcaacttgtgccgctctctcgatcttgtactgtgctgctttgaaaagtccacatctaattaggcccgagccggccggagctcaactaataattgtacgagtctaattaggacctctcgcagtcttgggatcgatgacaacgatgcatgccggccgtcgtcctttcggccatgcacgaaattgatcgctccgacgacgtagtactgatctacgtacacggtgggcttgttcatgttttatctgtgccaataatgttaattaattggggtacaattctatgactgtgtttagatttaaactttcaacttttttcatcacatgtaactgttccggtcggactgcgtgctcatccgtgcacgttcacatggtacgtagtgtatacttttactgcagatttgtattgcgatataaaagtactttcattagtacgttaattaacaatgtagtagtacatgcattccccccaacgtacgtgcagtaatattattcgtatgtatatatatacgaatacgatggtaacagctatacgtactatactgtactccataagtgtagctacagtacaaccgattgatacaccaaggaggtgtcctttttctgattattaaggtacacattgttttcagatgtataaacaagccctaattatgtactctatccatacttgtaaaggaaatcgttttggacagtgacatggtctccaaaatacaactttgacttcttttttctataaaaaaatatttattgaaatgtgatatatgtatacttttattaaagtatttttcaagacaaatctatctatcttctattatatactaaaagtccattaaacttcctcaaaacgctctcaagtcgccacatggcgttctaataaattagagaaaatcctagaaattctgagaaaaaagcaaaacatctagcccttgattttcacttaaatttgtgggcctgttattttagaccatcagatcagatctattaaaaaaaactgaatatacaaacgtaacgggagatcagatcagatctacgtacgtactgatctatttcagactagcagaaaagtatgaacgtagtccttgtcaaaaaaaaaagaccgaatatacaaacaaacataatgtactaccggaaaaaataaagcccaaaaaacatagaagatatagataactattattattattagtgataataaacttcaaataattataatttttacaaagattatatattattatattattataattttcaccgccgcggatgacctcgcctccgccctcgtggctgcaagagccatgcctccaaccttgccgccacgggtgcccatgcctccgaccttgccaccatgggaatccacgccttcgacctccattgcggcttgctccggcggcctagctattgctgcgaccagtggtgtaggcggaagtttcttggggtagggaagaggctgagaagtggtggagagtgatgggaaaaaaagagaagaggggaggatggaggaagaagataaatctgacggatgggtcccatgtgcaaatggggaagatgatgtaaaacgtgacggcgattgcatggttccaattttgaaaatttcgagtaggcggaggtttcttggagtagggaagaggatgagaagtggtggagagtgatgggaaaaaaagataagaggggaggatggaggaagaatgtgaatctgacgtgtgggtcccccgtgcaaatggggaagaggatgtaaaacgtgatgtgtgggtcccccgtgcaaatggggaagaggatgtaaaacgtgacggtgattgcatggttccaattttgaaaaattttgagtggcacggctatgaatagacgaattgtaattgcatctatctgaacagacacatttacgaaaacacatatcaaattagcccttaaattaataataaagaatatttcttttcttaaatcggtggaccgttatatattattattttcaaataatgcactgtttaaaaagaaaagtttacaatattttatattttgaacccattaaataaacaatttacgatctatattgactaatttgtactgattcagtgaacccactattttagaataatttttaatgaaaatattttaccattgatttttatttaattagacaccgccagatctatcttttttttaaataataaagcctttgaagacctctctcggtccgtccgcactacgcaagcacacgccattgccttctacatgcacggcgaagtgtggtgcctgaggtagctaaagtggtctaccaaggtgatcacgactgccacaattcaaccgctttgctaaggtaaagacatatcaaatcattattgaatatgatcgggtctgttaataacatgaaaacaatttaaaggagtcagtaaagtatactaacatgcaatgagtagatagagaatataaacaaatagcttacaaacatatatgagtgattgcatgatgtgtcatatcgtgcaaagagttttaatagcgacaaagacatcaagaaaaaaggtgaatatgtgttaatttcaattgcaaaaaaacaaattaggcgaactattttttgttaattaagtagtcattaccctttttactaagtttcattagtactgatgatgtaaatcatatttaacttattaattataatcgaattacatgtaaaaatataatttactgcaaaacacttcaaaatttataaatgcactatacatactaattacatttgtataattcaggtcctattttaaacaaataagttccttcaaaccctgtagatatgtttgacctttagttttcagttagtttaggagtcttaatttctgaacaaactatatataatcttataatccaacaatacggatgcccgcgcatatgcgccggccaccttcctaggtcatataatttttatattttcaacctcaacaatttgagagttatttatgatttatattcctaaggtattaatggttttttttatgctcacacttaatctttattatgcaacataactcgatccaaggcctatggattattggctctctaattcttttcacatgaaacatatgatgattgcttcagcgaaacgcaagtctctcatcccatccaaatccaacatccagaaaagtccccggccggaggccgtctatagaaacgcgcgtcgatcgatccgtccgtccgacgaccccgcccgcattaaaaagggccgcgagacgcccgcgatggacggggactccaccgcagtttgttccccccaccactcctccgcgcggcctgcacgtacgcgtcgatccccgccgtcgacgcgagatccgacggccggcgcgcgtacgaaacacgcacgacgaccgccgggccgtcaggcttggccgtggcccacactactactagtacgcgcccgcgagtgtacggtgcacgtatatatgcgtacggcgctcgagtcctcggattggtctcaattacgagtaatgtcgatgatatagtcggtatattaattaagttggagacgggacagacgggccagttttctccgtatatatgggcacaccggcgcagcagccagcaggatatatcagcctcatcgtttcggtatacttgcaaacagaaaaaaaattgtggttaaaatttttatatatgtgttgctagtgatcttaaaagtaaaggctaaaaaataaacttcgatgagaaaatcttaaaatcaactcaaaatttaagattgaaaatttaaattttcactgataagcataggcgatgagatgagcagtatatctagctgcgcatcaaacagtaccctgctcggccccatcgagttaagcaatggcaggattgcaaaatggaaagttttttttttgccacgactataaatccatccgttttaaaatagaatcactttttagagttcttaatatgtgaaaatcagatgcaagcaagaacatgcacacacgcaacttcacattcacaaacacacgtgcacatcctaagggcctctttgaatcgtaggaatgaataaatggaggaataagaaaaacataggattctaataggaatataaatgtaaaacagaggattgcaaaacacatgaaaaacacaggaatgaccgtttgattgaaccacaggaaaaacataggaatcggatgagagagatagactcaaaggaaagtttgagctcttactaaatttcctccaaaatttctatagtattgtccattccataggaattttaaaggatatggtaggattcaatcctttgtttcaaatggcttcatagaaaattttactataggattcaaatcctccaaaattcctatgtttttcctttaaatcaaaggggccctaaacgtatacttatatactactccctccgtcccataatataagagattttgagtttttgtttgcactgtttgaccatttgtcttattaaaaaagtttagaattattatttattttctttgtgacttactttattatccaaaatactttaagcacaacttttcattttttatatttgcacaaattttttaaataagacgagtggtcaaacattgtaataaaaactcaaaatcccttatattatgggacggagggagtagtacttttgtggataaagattgatgtgtttagatccctgctaaaaaattttcaccctgtcacatcgaatgcttgacatatgcatggagtattaaatatcaacaaaaaataactaattacacagattgcctgtaaattgcgatacaaatcttttaagactaattgcaccatgatttgacaatgttgtgctacattaaacattttctaatgacggattaattaggcttaataaattcgtctcgcagtttacaggagaaatcagtaatttgtttggttattagtctatgtttaatactttaaatgtgtgttcgtatatccgatgtgacacgccaaaactttacacccatggatctaaacacccgtagaggccacaaaacctcagtgcaccctggtgaggcaatgcaacgtatgtcctgcaggatcgaacgcacaccagttaattctcatcgccgatgaacagggtttaccttttcgatttcgaagtagaaaccgctcctcactggtttatcgaaatccgaccaaaaaccggtaaaaacgatgaattcatgtcaacatcgtacgaaaaccggctaataccaatagcgatttcacaaaaactgaccggttttcatgaaattccagcgcagtcctcattcaggaacaaatcttgagtggtagtttttgctctttttgaaacagaggaagttttggctcagtgctctcattcaagacatagctaatgaaaaaaaactgaaagctctaaataaatattaaaatcaaatactaaattaggggtgaaaacggatcgaatattatccgctccgaatctgtcagaaacaaggatatattacgtgcttttagaaatccagcggatagtacaatggggattcatatgcggatatggtatctctaaaattcggcggatgcaaattatctaatatttttgccagattatcggatagaccgtttgtcggataatccaaaattatcaacccatataaccactctatctattttgtataacatgagctgacccatctaatggcctaattcatcaattaacctagatttctttgtcctcaacgtctatctcacacttgattagctgtatttttatattattgatatcatgcatttatgttttttaatacataaatacataattattacgatgggtcgttcattgattattgcattgtagatccttgtgttactaactcgatggtgtattggttgcatacacaataacatccgataaatttaatttattttcgaactaggtctgcactagatatgatataacccctgtccgtccgaatctgctccgtattcacccctaactaaaatcgagaattgtctccagttttaataacaagcgaaattacaagacgtatgacccggttatccctgtataggtgcaggacagtgtgacgtgtgcagcatacacgttcgatcgattaactggacgctcgtgcaggcagtactactaccaccgtccccaaataaatttatttatcacatatcacacacacatatcaatagaaaagaaaaaaaaaagctagaatatctctactttatcaaatcccaatacaactttaatcagtttatctactttcatccaattattctctacttttataaatttcgatgcaatgattactttaataatgaacttattttggaataaatggaggaagctaaaaatgaactttatcgacgagggatacccgtagaccggatatagagggtattggggtccgttggtacgagaatctacgtaatacaacatcaagcaaacaaaagacaaggattatactggctcaggccccttgataataatagccctaatccagttggtatgggattatatgaagaaaatcacagattataaagggaataacaaaactcgatgatactgacgagaccgtagtcgagttggtccgactagatctcccggcgacttggctcctgtaggctccgtaggctgtggtgggtatgttggcagtgatattcgatgctttaggtcctgcccagggggtcccttatataccgcaggtcagttgatctccaagtaggactcggagatatcggacccttcacgatatgtaaaaaacccagtcttgtccgagtagaactccttccatccgtaaataccatccctatcacgtgatagatatctttaatgtatacggggactacccgtatacgcgtgggtataccgtatcagtattgtcgaggagtgatcctctctagcgggacatcgtgagacccccctttcgtgagttcggctgggggaaaaagctcgcctctagaaatcacgcattcgttcccaaggctcctagctagctcgaacacaaccaaattatacaggttcggaccgctatagagcgtaataccctactcctgtgtatgggatttagactgagagttacaagagttcctagactcgggagaacactcttacttccctcctccacgagctcaggttttctgagagtcgtcctgttcctcggtgggcaaggtcctccttttatacctcaaggggataccacatgcaccgcatctacctactcttcttttgggtggggacccaccctatcttgaccaaaacttggcccgcgccttccccctggaagctaaaccacagcttgtccttgagcgaggcccagcgcccttccctcgcctgacacgggggatagccctgtcattccctcattaatgggtgaatacttgcaatggccgccatccgaatgaccctccgatgggacgggtcatacctacctccactccgccggaagcagatgcaacgtgggagcacggttgtccgtccagtcagacgtgaccggcatcaggccagtcacagaccggtcattcttgaccatcacgcgtcagtttagcacgctgcacgtctgccctactgtattaaatgcgacagggggcagttggggcgctgcgcacattaaaggaggtttagccagggcccccctcctcgcttgctctccccgccaaatggtggctgggcgagggcctcggggcaaagcggcgcaagggcccgaggggcatgacgtggcaccccgaggctccgaccccccggccgctcctacggttcgcggaatgcgggggcaggaccaggctgtagtgacacatggcaggatgggaatgtagattcccctcacttcgcatacccccgggcccatatctctgacaagtatacaatttacatccaatgatagagggtataccttatccgtaaccctgacaaatttaatatgtaactaaggaagtaatattgtaacaagtacctgtaaataccgtcctataagtgaaaaaaaataagctagtacggagtaagagagttaatgagaggatagaaaaaaatacgaagaaatatttcacatgtaagaaaccacttttttatatatgtggtgtctatgtaacatagcgaatatgaataagtatttgggttgggatttccattagcatatacggtcctccatggattaatatagcttgctagcagttgtggtgcatgcgtgcatgacgtcatgctttgccacttgccagttagcacatgctaaaattccacgtgcggctaaacctgcgttgattctaacaacgttactactccatcaaacacaacagctgttttattttattttttttaacagacagctgtttttcttttgtttctttgaacgagatttttctttttcaattggggcgttgtcaatcgttatggtcggcaagccgtaacaataataacgctgacgataataagggaaaagtccgtgcaaatgtttgatttcaacacattcccggttactcgggtaggtgtgtgatatatgtcatatgtggatactactccctccattcaaaaatatttgacgctgttggcttttctaaacatatttgaccgttcatcttatttaaaaaatttaagtaattattaattctttttctatcatttgatttattgttaaatatacttttatattttatatatttcacaaaaggttttgaataagacgaatggtcaaacatgtttaaaaaagtcaatggcgtcaaacatttagggaaggagagagtattaaattatgaaagttgacacatatagtgtcacaactcagaaactaaccttcctaccacgaagttgtcactgatccaatctttgacctaattaatttgtcgacacaaaatagatactccctcctctgtatgacgcgttggctcatatataacgtatgacgagtacatttagctacttttccaaataaaaaaagaaaaataataaatccaaatttccccaaaaatttaaaaagttttcaaagttttattttctaatttttcaaactatacattatgcactccaaatctgccatcatcctaagaatattgctaccatacattatattctttgttcactccatgtgaagtaattttccgtattccttcgatcatccatttaatcccaaagcacctctcgtagtaataagttcttttatcggaattgttaaatgtcattcgacatattattggggttaaaatcttacagatttctaaccttaggatttgcatcgattcgtgctctgacgatcccagctcttctcctctagttcctgcgacaccttctcgttgccatcagaggaagacaatgcaagggcatctcattgctgccggcttgagggaaatgagagggtggaagggggtgaggggagggggaggaggccgcccgggggcatgggctcactggtgcgacaccttctcgttgccatcggaggaaaacaatgcaagggcctctcattgctgccggcttgaggaaaatgagagggtggaagggggtgaggggagggggaggaggccgcctgggggcatgggctcactgatgcgattgatgccttccagcagctaatgtggctaggcagcggcaatgacggggggagtcgagcgaacgagcgcttgatctactcagtcccatggcggctatgagtaaggagggaggagaggaagggaggagatatgattaagattgttgcatgaatcttgaagcagtcatactgtcgaagaaacaagaactagggtcccaattcccctagggcatcaggggacaacgatacatatcaagacgtacaagatctacatcttcaaggtatagtggcaggtgtgttcaagcaagggcctcatttccaagtcgtgcaaccatgaactccttcatcctcgacatcttcgagaagctcgtcctactccgaagaacagttcatgcctagtagtagggtggcctaagttcctagggtgccctagggatgtagggtgccccagatacgacggccgtccaaaaacgaagcccaatatctttgggtcccggagaggggcctaagtgcacttcatgccccgagcgagggccaaaatgcgttccatgcgctctcacttacgtttgtagtcacgtcaaggaaaagttatcgggctagggagttgctcaaccgctcccccatattaatagtgatatggtgcatgccttccatccatctcgtcgataacatggggagtgtgggggtacccatgcgagacgtcacctagatgggcctacggacaataaggacgggtgcatcttttttttactatcggcatgctcgctccatcaatcaacaagggaaacattgatccccgtctggatcaaaagacaatgattagaccaagcatgattcatttagtggtgtaggacccacttccacatcaatgtaatggcactgtggacttcccttaaactatataaagaggatccatgccaatggatagagggttttgattctagcaaactagcatacatccttaggctttcagttcccctcagttcctcaccatgtaaaccaatttcatcatccacacatagttcgtagataggagtagagtattacgcatcgatgcggtttgaacctgcataatcccatgtgttcatctttcgctcacggttagggcccgaactcaaaacttgcccctagtcgaatctcctaggggtagcacacacttacccgttagaggatttccacgctccgacatgtatggttcacaattcacatgattttatagggtatttttctgtcaaatactaatccatctgtttcatattataagtcgctttgattatttaaaagtcaaacttcttgaagtttgaccaagtttatagaaagtatagcaatatttatagaactaaattagttttattaaatctaacattgaatatactttgatagtttctttgttttacgtttaaaataggaaaaagtatgaattaccgccctgatctatcgtggtcgaccaaaattccctcatggaccacaaaaaccgaacattttaaaccctaaactatttataatagatgaataaccgcctagcggttttagtcctacattgccacacacgtggcacaagccccagatgtcaacctccacctcgttctccctctcttatgaagctagagggcccccacatgtaagctgctctctcctcttccattgtctacaggccacagctacagatgtctgcaccgcggtcctaggtcctgctgctgccctagggtcccgtcaactcctcgaggcacctgcgtcgccgccccatggtcccactgccgccactaggcactcacatcgtcgccctcatctcgaaccccgccttcttcagccggtcgtcactgccgttgcccccatccaaccgatgaagagagagggagaggggagagagagagagagagagagagaggaaaagagatgacaagcagcaccctccagggcaggtgggaaaagcggcgatggccgcggcagcctccaagactagcggggaaagcggcgacggctatggtggcggcatcggtgaaggtggcgccgtccagacaagttagaggaagaggaggatgtcaggagagtggaggtggtagcggcaagagagggaaaacgacaggcggctcctgcaaggcaggattcgacgaggcaagcgccatccgctgcggcccctcttccactcttcccccctgaagttatgtggacactggcgaggcgagccacgccaccgccatcccagtcgcgcccgttgctgctagccgccgactaaagcttcctctccgccgctcccatcgtcgcctggagcgcactcctagtcgtggcccctccccatcgctgcctagagccacccaaacatgcttgtcgccactcgccgccgatcaattcccactccccgctgcctgcagtgcactcctagccacgccccttcctcgctgctcccgctgctgaccagagctacccagtcacgccccgccgccccccttacaacaaaaggaatgtattaagacgcttggccgaagacgagattataatcgtcccaccctgaaaataaaggcgctccctgaccggttcccttcccattgtgcctaccgccagccggagccgcacccgcgcgtcgctcacctccaacaccaacagcacacaaagagagaaggggttaatatgacatgtgggccctatattttttattttattttttttttgctgattggatttccatatcggcgccacgtgtatgccatgtaggaccaaaacagctccagattaagtcggggggggggtaattcatccggtttcaatagtgtgtggtttaatatgtttgttggaggactgagaggcccctccttcttcagttcggccgggggcagcgggtgtagtttgaggaagcgagtatgctacaaagaaacgaggaggggggtcggggccgtgtccaagcggcgagacggcaaggattagacaggtttgggccgctgagaagcgtaacaccctactcctgtatatgatgatttttctgagctttggaagtctctgaatctctggtgtacaagctagggttgagtgtttttactccgactttggggaggatccctgtgattcttcatttaatggatgaagattggaggcttgcatgcactgggaacgtcatcccaggcattgcacctctcgtcaccttgatgggacagggcataccaaccgcgcgtggcttgccgctgtcccatctcgtccttgcaaggcacgctcgctccgcccacattgaatgcggttaggtgggcgcggaagggtgcctactaatcgcctttgcatggcggccacgtggtgaccaccccgaggggtcgaggcggcccgaccctctgggtcaggtatgggcggcctccactcgtccatggacgcgacccctcggggcgaacgccacgtggatgccgagggcggcacctcccctttaagcacggtacttctggtacccccaatccttatcatcgacaatattaattcgtactatcgcaatagttggagggtaattcatattttttctaaaagatattgctatattcttctataaacttagttaaagcttaaaaaaatttgactaaaaagttaaaacggtttataatatgaaataggggtagaataacattttttaacctaaaaccaccttaatagtttaactctttatattttttcacatggttagtatatatcgtagagcccactcataatttaccaatcccaaagaagatacctcgggcatgggtccctggaaatccccaacaaaagggccagtacgtgcgtgaatctggtagagtatggtaggagtactctatactcctactccgggtcatctacgccacctcccacatgcacacggattacataagcctcacgccccctcctctccattactccaaatcccctctgattagaaagagagagtgaaagcgagccatagatagatgctacgcgtagcgctagggagtagtagtagcagcagcagtcagcagtgcagtggagtacggtagtatagggagggctggtccaccgtcgcagtccgtcacacaccgggaggccttgccatcaatgcggaggggtcgggccgcattgattgcacatcatgtcctcatgccttgcctttccaacaccttaattaatggcgcccatgcgtgcctccaaaacctcccctgtttcccttccccctctccctctcccttgctctctcttctttaacctgtttatatttatctccccctctccgtctcgccgtctctcagctctctctgctactcctcctagctgcatgctaagctaaatcttctgttggattgcctagctttgctgctttgcttgcttgctgtggtgtggtgtggtgtgaattttgttgattggtcggagcttggggttgtgtatggtggtggtggtgtggtagctagtagctgctagtgctagatggtcgcaggggcgttggggtacatggcgagagcggcggacggcggcagggcggcggagctcgtcaccagggatttcctcggcggctgcgtcgccgccgacgacgccagggacgccgccgccgccgcagcagcaactgccaggcacgactccgtggtaaggccgtgttcttgacatatctctttcttcttcgctgttcaattgatgcttgattggctagtttggcttgtttagttgggtaattagagcgggagttaatgatcacaacctgctcagagtagtgatttatggccgtactgcgtgtttggtggaacagcaccgcagagtaacacaaaggggaggaattaattcgatccaagattttttctcttttcaaatttggtctctttttttaatggatagacaggtagataatcctaatctaagaaacttcgagcaagccattttaaatactagcaggagtatgttcattactaaattactttgctttgtcagaatatctactggccgattactcaatatgcgtaagagttggtacagtcaattcttttttttttctgtggccagtttatcttcctctgccgtgttatcttggcaacaagaattcttctcgtaattccaatggaaagaatgaaagcaaatattggtctcaattcattatttttatatgtaaccttgaaaaattcacagttttttttatccaaaattggtttatctttctcctctgatccgatttctaccttgatctgcttgtgtttgtgcagtccggcaagctgtccctgcagaagcagacgtgcccggcgacgccgacagacctcaacctcttccccgtccccggcgccgccgcgtccgccgccaagccgtgcccgtcgtctacggcggcggcggcctccggcgcaggcggcaccacgacgacgacgacgacgtaccacagcgtgtgcacgatcgagaaggtgaagacggcgctggagcggttcgagcgcggcaagcaccagcaccaccagcaccagcagcacagcgccggcgcgtccccgtcgtcgtcgtccgtcaccacctcctccgtgaagcgccgtggcggcggcggcgtcggcgacggcgcggtggagcagggcgacgggtgcgactcgccgtccgcggcgggcggcggcggcatggtggccgccgcgtgcccgaggtgcttcctgtacgtgctcatctcccggtcggacccgcggtgcccgcggtgcgagtcgcacgtgccgccgccgccgtcgccggcgccgaagaagaagccccggatcgacctcaacgtggggttcctcggcacctagctttcctaccctaccttcacctgcatcgccacggtggacacatgtgactagccatagctagctagccagccatgcccccaattctgttaggaaatcaatgaatcaatcaatcaaacacgtactccatagaacacgaggatgatcatgacgatgatgatgatgatactagtagtcctagctccactatgtaattgatcaaaaagcattttcgcccttaaatcaacttttccatttttgtcttcctcgaccaccatcctaatcatcatctcattagagcaattaatcaccagattagtagtagtgatctcatagtacagcagtagcagtactacatctgctcattaattgctcgacgtagtcgcagcagaaggtgcagttactacgattgctgcgcaaagtcgtgagttcgtgacgcgagttttaattagggatgtagcagtgcgtatcacgtttcgtctcgcgttcgtcgttgatgatgggggaggagttggtccagttggagttgacgtcgcagctgcagctttgatgaggtgcagtgcttggccgacatgaatggggggaagcaattaatggggcgcgatggagatggttgtccgtgccccgctgtcctcttgctcgctcggtcggggagggagggagggagggcagcctttgctaattgcgatggctgatgcccatcttgatgctgggcgcgagcgcgcggtggagtaggagtgagagtacacgtagtacggccatagcacagcgacgtttaaatggcgtgcagtgccgtgccgcgccgcgccgcaggctacatgccactccggaccgcgtcgtagttgcagtcgcgtcacgtacagtagtatcgtccctcgtatccgcctcgtcatttcgtgtctccggtctccccgatgattggacggacggactgctccccctgccgtacggagtactcccttcgtcaaaagaaaaaaaaaatcaacctgaaaataaatactccctctgtcaatataagaagtttcagttttggacatggttattaagaaagtagatataagtgagtggtggaggtttataattgaattagtagtagaggtaggtgggagaagtgaatggtgcaggtttgtgattggttgtgaagaaaatgtgggtggagaagttgttatattttagaacaaatcctaaagttgttatattttgggacggagggagtacttccttcgtctcattttaaatacaaccataagattccgcattcaactttgatcgtccgtattatttaaaacttttttataattagttttttattgttatgagatgataaaacatgaatattactttactcatgactcatgtttttaattttttttaaataagacggacgatcaaagttggacgcgaaaaaccatggctgcatttaaaatgggacggagagagtattcctataacaaatttagacaatctttccagatttgttagaatataaaatgtcattttcctatattgcttttttttttgacagagggagtactccctacatcctaaaacaagtataaccctgtaatttaaatttgaattacatgactacacttattttgaaatagatggagtagtttacactggagaatatccttagaataacttattttagaaatataaaatgaaccattttcatgatgtcaacgtttttaactaatgttggtgctgttgttcaacggttatttgacatcaatgttattgacatcggggaatctatttataaatatattttgttgcaaatttatagatccttttctttagcaaatatattctcgaggccaacataattgccgctgactcccttcttattattgagttagttttcgtggaaaggttaggggacatcgtcagacgctattatgttgaaccccaacatcaatgatgtcggcgccataaaaaagatctattccttaaataagtttttgaaaagatcaatttataaaataagtttttaaaaaagttttaaaatgtggaaaatccagcttgtttcacggcgcacactgagttacagtactaactactactacttcgtagtatacggttatatactgctcttgtgccgtggtacaacgtttcaaattcatcaaatccacggcgctgcacgcacgcacgtacgacgacggttacacattgtttccggtgactgcagcgacagtagttccgtgcgctgttgctacagggatgacacgatttaattaccctgcctcaacacccgctccggtctaccgtgtggacgagatggcgttcatttactgtagcagttttatctggagggttgattcacttgattgtactactcctagatcagatgatgagatcctgcgtaatggcaattactgtgtgcccctgtgctgtggaaactgttcatcatttactccttgagtggccgaccagcctagatgcaaacttataacaagggtaaactgcattagaatagaaagtcaagctattgaaaaacacaaaggctcaagtaattcatgctccactattctacagcgcggagaatttgacgataaattttctcaaaaaaaaattaacatatgtaaatataatgcaatcataatataattataatacaacttgaatgtagctttcaaaaatcttgcgataacatgctattttcgtgaagcggcagcaattcatgctccgctactctacagcggtgcggcattagagtaactccaatagaatggccaaatggctggccaagttaaattttagtaagtatggaaaaaaaaaaagccctccaacagcctctctatcctattagctaagctatccagatggccaaatcttatccctcactggccaaacttggagagtcaccctgcctggcaattcgtgggccccaccactccctctcccaccccatctctctctcccccggcaagaaggcagtgcagcagaaccgcacgacggcgacagtagggaggagagaggcgccggagccagccgccgtccgcactgtccccagccgcgcccaccgctgtccgcgctgtcctcggccgcacgcacctccgccgccgtcagcgtcgtccgcaccgtcgtcggaagtgctaacaggaagagatagagggtgagaaagagggggagaaagatgggaaagaatgggtatagatgctgacgcatggatcgcaatgtcatagactcaaaatagagaggacggatggagaggctgttggagtaaacaaccattttgacttgacaaatgaaatggagagacttttgaagatgctcttagcggagtactcctacagccatgaactgatctcagctgtagattttccatccgacgcagtatcgactacagaggatccgtccgtgtccctgaacttcaggttggggcggacttgtcttggactgtcaggcccatttcaccggatatctgggccgaaaaatttactggtctggattttgacaattctatgcggaataagttcaccggaggcccctcaacttaacagcgagaatttttgagatcacacaaa

SEQ ID NO: 33712 - DNA, 6864 bp, Oryza sativa
cggtgcccgccgccagccgccaccgctagaaccgccgccgctgccgccgattgggcacgccggcgcccgccgccgccgctcgatttgcatgcaacgagagaaggcaggaagggagaggatgaggctagaaggaaggagaggataaggcaaagaaaagaataagagagtaaaaatagaagaggagtttgagaggataagtcataggggttatatacggtacattgaaatttagtcccggtttgtgttaccaaccgggactaaaggtcccggggatatttagtcccggttggtaatataaaccgggactaaatataagatctttagtcccggttggagtctccaaccgggaataaagatccgggggggggggctgacagcacctgacaacacatgaaccgggactaaagatgatgtttagtcccggttggtgttaccatccgggactaaaaaacatatagtcccattctgcttataaaccgggactaaaaaccatctttagtcccggtttttattggaaccgggactattgtgatttttggctgaccaggcaaagatggtttctccagtagtgcacgtcagcgaaaccacccacatatactaccatgggatcttttttgaatgttttgtgtgaggttaggggtatacattttttgttttgtggttaagggacctcaaaaaatctcgttgttaagttgagggacctccggtgaacttattccattctatgctgggagatgcgaatcacattgggcccaatatgatgcattcagcactaaaacatttttatttagggcaaaacgtacttgctttaattggtagtgttatcatctctgctgtcggatgatgaagcaccaggtcgagcaatcaatcatcattgcgtcaggatcttgagttcttgtcgattttgggtgcacgctctagctcctgattaagtcaatcttgtggactgattttagattaattttaggggttctctttgtcagtttctgtgctaagctctccttttatgattgcttggaagataaataaaacaggatgactaaaccaaacttttaaattttggattgttttgggatatagtactaaaaaagaacgcctaccacttgagtgataattgaactgagtaattaaaagcacgtgagctgtgtgctacaccctggtatacttggcctcaaaaaatccacatttcacatttcagcagtccaaaatggaaagccaggaaagggacagaaaacagcggtaaaaatggcggccgccacttggctgccctcgctagcggcgagaacgctccgctcttctggcttttatacccagccctttctaatgaactagacgacgaacttcgttcggtgaaaagtcagtacaacatatgcaactagttatccgaagatgcaagaagccatgaactatatatggacggccgggatggtccagaatgtgcgtggtcagagcttgtgtttaaccatgaatggctgagaaagttactccctccatctcattttaaacgcagccataagtttccgtgtattgcatgtcttatttaaaatttttataagattggtatttttattgttattaaatgataaaacatgaatagtattttatgtatgacttttgttttttaattaatttttaaaaagttttcagatcagataaatgattaaagttggacacgaaaattcatggttgcgtttaaaatgggacggagggagtatgtctactgatgaaccgaatttacttttttttaagcaccacaccatttttattctttttaactttatacacctaaattttatacaaccaaaatttatacactaaaattttatatgcctcatttgatttcggattcaaatatagagtacttatattaaaaagtttatatacatgtataaggtctataatacgttcacatggaaagaaatatatacacggacatttttttagtaaagtggataatttttatttagtttgtatttcttttcctattttagaactttttgtgaaatcaatacgtgagaaatgcgcgggttgtttcagcaagggggaggggcgtgccgtgaccccacacgtggttggtcacccattagatgtacctaggaatggttgaggtattgacgtctactatcatcgaaattctgattaatttcaccattaatttattttatcaaaataagtttatcagataaggcaaaacatttttaggaccaatgtatgcatacattattttgttttcaaacgaagaattttaaattttattgatggtcaaagatgcgaaagtttgactaaaaaaataaatgatatactatatttgtagcccgaggagttataaatttggttgaaacccgaaagctgtggggtttccaatatatcataaatataacaaaggcgtagctagcgaaaacactatgattttaattaatctacaggaattttttgctatattgtactcttagggagtgtttgaggagaaggggattgaggagattgggaagatacgcaaaacgaggtgagccattagctcatgattaattgagtattaactattttaaattttaaaaatggattaatatgattttttaaagcaacttttatatagaaattttttgcaaaaaacgcaccgtttagtagtttgaaaagcgtgcgcgcgaaaaacgagagccaatctcccctatcacccctaaacgaacgatgccttagcccttcctaaccagctagatgggttacacgcgagattcaacacaaaaaaattcacacatgagactcaaattgattcgagtctatatctgatatctctatctctacttgaattcgtttggttttatttttcatactacgtaccaaattagttgttgactatctagctaagttgaaaatccaatcaaataggagtatatcacttctcgatctaatagatgatggttttggttgacatgcagtacgtgtgttaagtgttaactggtaagctcatgttgtagcaagtgcacgaggctcgcagaatttccaatacaaagacaaaaacacattatgatacatatgctccctgtttttttggtcaaagaatatgttgcatatggtagcatatctccacaagggttgcaaggtggtaagccggccatccgcattacctcaatatatcagatttatccggttaaagcaccgtagtatttactagcagtcattttcttttgtacatatatatcgtgcttaagtgaaatgcttgcaaagagaatatacaaaggactacctagcaaatattcgacagtaaatagcactgatttttttaataaaataatacaatcataatataattacattgcaactagcatgttttattataaattaaaaatgaatccagcatacagtactacaaacgtgatgggtaacatatgcatgcttccgatcgatcgagagcgtcgaaagaacatggttcgttagagtgaactcgctagtttttagagccgaacattttaaaattcgagcaagctgcaaacatagagctacagagattacatgagatcttacaatctttcaccccgagagacgaaccagacaaacgaagaaatgagaaaggctcaacgttaagtttaacaactaaacagatatatgatgctaattaagctacctcccggagctgtctctccactatgggatgctatctggaaatgcagagccccactgaaagtgaagttgtttgcgtggctcctggtcgaagacagtctgtccacaaagaaaaatttacagaagaagaacattgttcccactggcacctgtgacatctataacgaaggaaccgaaacgaccagccacttttgttttctatgcccgtttgcaaaaagtttccgggacaaaattggagtgcaaccgatgattcaagatgtgcatctgtttcattagctgaagctagtacatggagtgcctatacttcattttcagattttctacctcctatgtttctgggcaatgtggaatcacagatatgatgttgtttttagaggtcaagccccctcgattgcttcctggctgcaacgttgcatgcgtgaggctgctctgtggacagaaaacataaagactgaagatcgacatgtaatttctgtttggaaagaaatcttatcttccccctacaaactctcaattcaatataatgaaccttgcatccttatattcaatgaaatgataaattcgggtggggaagctctccccccgtgatttagtaaaacaagaaagaatcgagcgcaattcgccgtgtccgtaaaagaattaatcatcaaagatttaatcaatcttacaatagctagtctttataaaaaaatcaaagaataaacagacaccgtggcctgtgggggtggatttaaaaatttttttgggggaaactgatcgagccgcgccatcggagggttcatctcacgagtcatgccgtctggccgccggcggcgcccctccgcaacgcgcactcgacgactcgccggaaatgcccggcgtcgcagggcacacgcagcacgcccggctggccgaacccgtactgctgcgccgccatgtccagcagctccgcgatgctcgggtccccgagcagcctcaccggcaccatcacgcgctccccgccgccgtcgccgcagtcgccgccgccgccggcgaccatcgggacatgccctctcgggacctcatcctcgccgttctcgcggcacggcgaggcgccgccgctgccgccgccgctcttcctcctccacaccatgatgatatgtgatagatagtatatatgtcaggtttagcaccctggatcggagctggaggacggtgcgggggtgcagtcgtttgattcgccggcgtgcgctgcggaggagacgagagcgagtaggtgggaaatttatagaggagcaagctagcaagcagcgcaggatcaaggaagctagggttcatgaccatgcatgacgatgactgacgtctgaagattgacgaaacgaacttgtgtgtagacgatcaagccgcgattccttgacatggatggtcttccatggcgactggagagatggagactagcgtggagcaccggaacccgcgcgccgcccaccgcgcgcgcgggaagcatcggggacgttcgatctgcgcgcgctggacggacggacgtactgttcgctccataactagctcaacacgtactattgattgaccgattctgctaggaatatgctttattaatacggatttctcttttttaaaccaaagacaaatggagacgctcgcaacatatgcacactcactcatataaacatacatggtcgacagaacaaatgcaaccggtggacaggtctgagtgcaagcactccaaacgtaggttatggatggatgggagtagaacgtcgaagaatcatgtcactcaatccagctgcttcatgaggcctcttgtatagaaaatagactaaaatttcaacatcggaaaaagaattggttaagttgcataaaccaccccacctatcactctagttttgagattacaccacataaattattttgtcataaaaacccaccaatccaagactgtttacgaccagattgtgtcctctatgtgcacagaagtagttgattcggtccatttcttccaatataggatcgctgccgatcactgcctctgatcgcttcccacttcgaactagcatttgaggtcaggtgggtacagccagctctttgtgatgttcttaatctcgttcttgatgtggaattgtgaaactgtgtagctgcatgttcttgtttttagaaaactatgtcatcttgatgtggattatatgtgtaaacttcattcttgtgacttgttggatgtcaaggatatattcttgatatgtggttgatgagtcacgttggacttgatttttttatgaacatgttcatgatctgtgttgattaggggatctccagatatttgaggtcaggtgaccgctcgttgaatcggctcgatgaatcaatggattcatcctgtcgactaatttatttgtctcatggaaaccatcagtgtcgaaaagcttaatgttggttcaatttccagcactaataaggggttacgaattggcatagaaattgtgctctgttacaaatccagcactcataaccatgctggatgagtgatatggtccactgtaaatccacatcaaaacaaatgaacagaattagcaccggtggagaactggtttttactcccggtttgtaacccctatataatcccggttttccaaccgggactacgaatccgggactaaagatcgctatctttagtcccgggtgaaatatccgggagtaaaaatccatttttagtcccggtaaaacatttttagtcacggttaatgttaccaaccgggactaaagaggctagattcggttgcttctttattcttttcttttcttcattgtttttaatatattgatttcaccccatcccgtccctaaaatcccaaatcaatcattctcaaattgcctccaaatccacaaatcgatcatctcaaatacatcacaaaatcttaaaaaaaaattacatcacaacttctacaaaattcatcacatattcacatcacacacaaatcaaatacatcacacaccaatcccagatccgaatcacaagtttcccaaaaaaaacaagaaagaaagaaaccgccggcgcaggccgccaccaaccgccgccatgccggtcggccggcccaccgcgccccaccaccgctcggccgccagttgccgccgcgccggctggccggcccttcgcgccccgccgatgcagtagaaaggagaagaagaggaatagataaggttgaggagaggagtagatacctcgatccgatcgcgcacgcctctccgatctccgtgtcgatctttttttccggttgg

SEQ ID NO: 33713 - DNA, 8813 bp, Oryza sativa
ttcctgcagccccaaccgggactacaaatagatcttttgtcccggttggtaacaccaaccggtattaaagattgaaaagtactctggagcttttacaccgggactaaagatgtttttagtcccggtttttactacaaccgagactattatgaaatctggtcgaccgacaaaagatgatttcttcaccagtgtaggtactcacgcgtattgggtgagtgggcttttgccacaaaataataagtttatgggttaaaatctctaaattagagtgacagttcaggtggtttatgcaattttttccaccacttttagcgagtcaagaggttaggccacgttttaatttacaactcaaattgcacgtggactatatacatgtataatatatactatcacatcgatcagccggcacggttgaactaaataaattttccgaaaaccaccaggccggaaaggcagccgtggtggcccatgcgaatatatatgtaccgtgtctgttactaggagtaggcggagctggggatcgcgtcaactgtagtacaaactactgtaattccatcgtcagggacgaactagctagcgtctgcgcggtcaaccaggacatgagcacgagggtcgtcaaaaaatccaaatgcaacgcgagctcgatcgatcgagtgatcctggatcccccggacatatgcctggctagcttagcttgatcatctcgatcgatcgagtccaaagcgcgtacgtacgagttgatcaaacagtactgcatatatgcagccaactagcttggcctgttggccaattggccaacttgcatggcgatgatcagtgagctagctgcgatttcttccaaggaagcctgtaggtacgtacgtatttcgtcgctgttcaaagggatgtacgtggtcatcagtccttggcttgggcgtcacagccaagtcgatagggccgaccttctaggctgggaaagagacggctgcagatgtaaccggctagccattttctcttactactttcctttttcttgttttcttctttgcgattattatgtggatcgaagactatacaatatatctaaccacttggcattttcttgtttccgagagtgaccacgaaagctgcagggcctgcgactataggcaacggaacgtgatatgggaattgctccatcttgcattgcgcgagcgtaatttgatcgaagcaagagtttcaaggacaggaagcaaacttttgaaagaaaattcaaattgggtccactcgatccaaagcttgaacattcagaaataaaaaaaaatgtgttatgaactttttttacaaaaaattaacaggtcaaattaatatgtaatatagcacttcataaacatgcaagatcaaattcgacttttacaagctataacgaaaataacaaattaaactataacaagtatatatgcatccataatccaatttattgtcatttttacaacttgacaaattggattaatttaaacttgtatttcttgactagtatattacatattaatttatgttattatttttaaaatgttatatagccataacatgtaataaatgagtggacatccactcagatgaattaaagagttcccgtcaaagctcatcagaacacaaggtcctcctcaagggtagtgggaagtctggtgcatattagggttttagccccaagcttagctctacaaacccctaacgatttcatcaaaatatcataaaaatttctacaagagataaaacaacagttagatcagcccctaggcgtgtatatcctttcaagaggactgaataattaatggcggggtgaaacattaatttaatatggatatgtatatcatgtgttttattgattttaattggtgggactgattcgggaaagaagatgtctctgcatatttgtcacatctattctgtcgagggaggattggaaagggaatagatcagacgattcgcgacacaggtcaataaattacgcgcaaatattgactatggctgctctttgattagccgtgacgcgagcaagcaaagctcgttgtgagatgtctctctcctatacctgttcaggaatttagatcgttctgctaatcgcgaaccatcacagtagcaacaacaacgaggtaacgagatgaagcaaattaattacctttattatttgccaatctatacatgcacgaaaatataatttttattatgacaaggattgccggaagtagctggacatactgatagaacattaattgttgtgatacatataatatatccatgccgacaaaaaaaatctcaattatgtatagtttctgaattttcctctatatattttggacaaataaaaattgtaaactagaaactaagggtacattcaactttaagatcatccaattttaccaagaaaaaaacatatcattgtcttaaaaggctaaatagtttccccagttgtaacgcatggacattttttctagtataatcatatagttataaaatatttatttagcatccctacatactctctccgtcttaaaaaaatgaatctagaactggatgtgacatattctactacaacgaatctgaacagatgtatgtccagtttcataatactataatatgttacatctagtactaaattggtttttctatgggacgaagaaagaatattgttcgtgcggtggcaatgggtaaatttagtgccatggagggagtataatttcgttattgaagcacagtatgggtaatttttgacttttgagctaaattcaccatctccataaaaaaaatcagtatcaaattactgcaagaatcggcggccacctgatttctttgggaagtttagtcattgtcttggcggttgaaactcaagtcgctgacaagcatacacatattttcttgacggctatttagaaactccaaggttacaataatttgatcaatcaaagaatacacggacaacgtgtatgtacaccgcacgacacatcaggcgtcatgctgaccggccaccgtccttccgcagcgcgcgctcgacgactcgccggaaatgtccggcgtcgcagggcacacgcagcacgcccggctggccgtacccgtactgctgcgccgccatgtccagcagctccgcgatgcacgggtcgccgagcagcctcaccggcaccatcacgcgctccccgccgtcgccgtcgccgccgccgcagccggcgaccatcgggacgtgccctctcgggacctgatcatcctcgccgccgttggcgcggctcggtgaggcgccaccgccgccgctcttgctcctccagtacaccatggtgattaattgttagattgattcctggaggccggagcttggggatggcggtggtttgattgtctggccggcgctgaggagagacgaggacacgagtttgtggcggcaaatttatagggaggaaatggtgattagcgcacgtgttcttgggttcttgacatggatggtcttccatggcgactggaaaggggatcgactatggtttgaaacgagacctgcgatgagagtccatgcaattaatacatcatccacttgatttttctcttgagatgcccgatacttcgcggtaggatgggccgttgcatcgcgcggtcgtttttgacgtcatgttactccacgtctcaggcctgtttagtcggtaaatgggaaattttttctgtcacatcggacgtttaatcgaacattgaaagaggttttcggacacgaataaaaaactaatttcataacttacttggaaaccgcgagacgaatctttcgagcctaattaagccgtcattagcacacgtgggttactgtaacacttatgactaatcatgtactaattaggctcaatatattcggttcgcgatttacatgtaaactgtacaattagttttttttatctatatttaatgctttatacatgtatccaaatattcgacgtgatgttttttgaaaagtttttagggaactaaacaggtcctcgggaaaatatgttaaatgatgcgtatgtagagattagtacttcctttggtcaaaaatatttaatgccatgatatagaattgtaccacattttttaacataaaattgaagagtttcttagtgctagaggtacatagtactacctgtcaaggacaacaaaatttcctattagtattatagtactcttcaagacaaatttcgatacattttcttaattagctaagcatttgagaaattatcgatcatcaaaatttaaaactttgagaaaaacctgtactcaacgtcaaatatttatgaccagcgaattgagcttacataactcagcaggtaaggttctctgtagtggaatctacataacctattttttcatgcggtcaaattgatttttctgtgcggatattttccctgtctggaatcaggcgtttggaaaaataaatattttcatgtgcgggtgaccgaaccgcacaggatactcgagtatcccgtgcggtcaaattataccgcccgcacggaaccaacaaaaccaaaaaaaaacgcgaaaatcaccgccgcctgctagaccgcacgcactcggccatcgctgagcccgccatcgtcatcgccttcaagccggcccgccgccgccgcagtcgcgccggccgccatcgccgccggatccaggcgggggacggccgccactgccagatccgggcgggggccgccaccgctgctagatccgggcgggggatggctgccgccgctagatccggccgcctcgccgccgccccgctcacctcctctgccttgacaacgcacgcgacgacggcgtcatcgtcgagggagctgagcgacgacgtgcatgacgaggacgacgaccaggaggaggttccgcccgctcgccgtcgcccgcttgccaccgctgccttgacgcctccgcctcgccacgcgcacggaaggggccgccgccgacgcccgctgttgtcggaggaggggaggaggaggaggaggtagagaatagagataaggtagagagaggggggaagtggttgagggagaataaaaggggaaaaaggaatagagaggatgtcaaaaatttgaagtgggtgagaggaaaaggagggaggtattttcctgtgtggtccacttaaaaagcccgcacacgaaaatcgatttttccatgcggtcctcttaagttgaccgcacgggataatgataattatccagtgcgtcggattaagacgccctcatggaaaaacgcattttcctgtacgggcgacaacccgccgccggtccccctgttttcccgtgcggtttcacttatgaaccgcatggaaacaaaatggggcggcgtccagaaaaatatatcatgtagtatatctgttttgtttcgggaaaatattatccgtgaccaatgagagtataatataggaaaaaaattccaatacattttgaggaaggccttagtttttttttgttaccgatggagttggtatttggaacgcataaatttcgtgtcacaccaagcagcaaattaaaggttcaactagacttgtctgttgtttcttaaataaataaaaactggacttgtctgttttcacaccctgagtcccaaaacaggactgagccatgcatcctcacttgatattttattgcaatttgcccgtagtaagtagatgtcgatatcttgttaagtttggaagttgggtttggaccgctggtcccattaacggctagctaggccaccacgtaccaactgtcaagtcgatggggagtattagagagcacccaaatggccacatatggacgcctgggttggtgaaggcgggacgcgcgtacgtgcgatcacatcgccggcggacgacgccggaagcattctgcgcatcgatccacctgcagcaagtgcatgcatgagcacgcgagggtcaaataaacgcaacaatatcgatcgatatcgagctgcatgccgttgatcatcagttgatcgagtccaatggcgtcggagagtcagctgtggcggcacagtactacgtacagaggcacgtgccgaattgaatctacttttcttaaaatatataacccatgtatttatttattgattaaaattcaagcataatatgagtacatgtacgtacagtgcttagagcacagatcactggaaaactatagttttgcaaaggagcccctcaaaactggacaaattacactttggcataacatgcatcttgcataaaaaaagttacttaaaaagaaaacgaattaataaagcaatcgagtccttcgttctcctttgactgccttcaacgcccacggtgaaatcctagagctcgactccactggaggatgcatccaaataagctgcataggattaagccaccacacattccccgtagggggcctcatatatacacatagaggttcaggtgatgataagtgtcaggaaaatgaaaaccaagagttcccatcatcgaccactcaggacatccttgtcaccaatccctgagcatgacccttataggctgtgctcggagcacatcggcccgaacacgactgctcgaggcatatccgccctcgcccgtccaccgcgggcggtactcggggcacagccgacctccctccccccctccccccctccctgggtgaggagtgcttggggaacctctctcctcgagtgttcagcccacgagaaacacaaacgggatgtcacgccccgaactagccccgagcggaactagcccgtgacgctccaaattaacatgttaatcgatactagtcccaggaaacagtgctggtatcacaggaagacagtatatcacagcaacagaggtctatttattatagagtaggagtacagtcatgttgggctgcggacagatctcgagctcacatctgcattacaaaaggggaaaacggaagccaagacttgggccaaacatcacaggcgcgacttgggaactaggccgaaaccctaaaactcatcgtagccgacttactcctggaagaactcctcgtcagcgggatccacttcatcttcttcagcaactgggcgggattatttatatagagcaagggtgagtacaggagtactcagcaagccacgggaattaagtgtttaatgcaggcttcaaaggaaaggctattgtttttgcaattgattttatttaaactcctttttgaaacgactaagtgagtgtttctcaaacgacccggatgaggcagtgcgtctcgtccggtaggagtatgtgcaatgtatcagtctttgaattgatcaaggttggcacccggccaacagctttcaaacggccacccgggcctggctgatcccatcagccgccgattttccaaacatagaatccattccacagcagcaatttcacaagtagtagtcaaacaaaactacgctaggaatcacctcacatccgcccatgaccatgggcacggctgttcgaacagtttaataacctctgcagaggggggtacactttacccacatgacgttactagccttggtcacccagcccgtgcagaacagccacgtctggtgaccttgggactttcatgacaaggcatttcgaaagccgacacaggttcaccatatgccaacgagaggggtcccagaccaacaccagattaggtcccagaccatactgtgccaggaagcccgggggttttccccgacaccaccccgttgaattcacatgtcttttggcatcaaggctcccccgattagcaatttactcagccaggggtgtcccatttcacccatgtggtcgcacttgttttatgtttggatgaaattccaaggaaacggtcctttagtgcaaaagcaggaaaccgtacacccggtacgttccccggttcacgattttggaaattcatttagtttgcaagcaccgacccaggtgtggggttttccaagtgttttgtaaaacccaagttttacccatcggtggatattttatattttgagggggggtgttttgatgcgcgtacccgaaggcccgtgcatcaaagcacaacagttgacaaagaagtttaagtgttcaataattcaaggggggtaattgcagcaattaagattgggagggggggccagcaggctatctcgcaagccgcggccgaattacttgtataaaacctattcatgcaatatttgcagaaaagaaatacttagatttaaattataggtgcaagatgatcaaaggtgacttgccttgctcgagatcttgagcttgatcctcgaaatcctcgcactgggggtcttcgggctccgaaactacacgtgaaatgggacaactcaacaaacggcaaaaataaagccctattattgacctctaggcgtgccattagatagatctcgagatttaaggaattttggaagttgaacggagtcaaacgggcttacggttgggaagatattgaatttctaatattattagatttttggtccaaaggaaaaggatttatttaaatcctttttgaaaaaaaaaagaaagagggagggaaattagacttcgcgggcggctcggccgaacttaacgggctggccggcccgagaaagcggcccaaagcgcgcgcgcgggcagggaggagagagggagccgtgggccgggtccaccttgcgtggtcccgggtgggacccgctcgtcggcggcatggttcaccgtgcggagggagcacgcgacgcggcgctagggtttgggcgcggcgctgcgcacgcgcgcggcttgcggaggacgctggtgcggcgggcccacgcgcagcctcacggctcaccgtagaccacgcgcacggcgagggcagaggggagcggcataccgaggtcggcttgacccggtcttagcccagctggcgccgacgtggcgccta

SEQ ID NO: 33714 - DNA, 3375 bp, Oryza sativa
  unsure (1)..(3375): unsure at all n locations
ggagaagggagggagggtgcctgggctttataggatggcgatgtcggtttgggaaccgacctagggctgtcaagggagagggctagcgctcggtggtcgcggccaaaacggcgacagggggggagtatggcgctggcgggagagaaaagggaaaaaggaggagggaaagggggcttgccccttgccactttgggaaaaggaggagggagaggggcgacgcggcaaagggaggaggagctctgtctccgtcccttggaggttagcgcgcagagtggcggggccgggttgtgacgacggcgatgacggcggggcggtgtggagcggagcggcgacacgggcggcaggcgcgggcaggcgtggaaggcgctgacggcggcggcgaccaggcggtcggccaccacgacgtgcgtgcgcgggacgcaacgggcggcgcgggcggagggtgctcggctcggcgcggctcacgcgcacgcgcgcgcgggcacgggcagagcgggggagagagggagagagagagagagaggagggagggagagagagaggggaggagggatagagagatgggccgagagggattcggcccatcgaacctgagggaggcaaaatagacttttgcggaggaaatgaattgggaaggatttggattcgggatttgaatttgacgatagatcggggatttgagatccggaatggcacggagactgactgcaagcgaagaaacaattttcgcaattagggtttttagaatttagattttccagctaggcgccacgacgaaacgggcgctacacgagacatacaaaatctacatcttcatatctacattaattttcaaggtttcaagaggagagttgagaccaacaagatctatatcttcagtgtgttgaagatacagcatatccttcaagcaatgttcacgaggaaatcctttgtcatcgacttcttcaagaagcttgtccaaaccaataagtaaacctatgatcagcaatgggagcgatcatgggtgccttgggttgggcagccaaggcacgcggcgtgctccgggcgcacagctgccccgagtacggtgaccaccgaggaacaaggcacaagcatctgggggccccgggcccgggctaaggcccaaacatgccttttgtctcaggctcttctcggaaaacgtgaagccatattctttcactacaagggaacgcgaagctaccacgtgtcaaaaacactcggtaatacggcaaaaggtactcagaattcaaacatgcttccaaagcataaaagaacatggtcattggttagactttttttggataatggattttcataaatccggcctctatatccatgaaggatatacatagccaaagggatacaagagcacttagactcacatctcaataaggaggataacacacaaccaaaaaagaaaagaaaaacaaaacgacctcgacacaccactgcttctctgcatcctgacatactctcctgaaacggccagatttgatgagtggaattcgtctagacgccgccgcccctagtacgtcgtcgctgcgaacttccaatgatgccatcttcatccatttcaggtgagctgacgccacgcgccgccagttagcccactttcatccatcgtcaatcgtcggaactagccgacgggatcgacttccactttgccgaatcctaggcctccacacctaaaatgttgcaggcgtcgacatggatgctcttccaccttctagactctcagctcgccactgcccctagggctgccgccactgaaggggtcgacctccaattgctccttaccgagggccttgcaccgatgctcaggtcgccgtcatttcaggccgccgctgccctacggcagccaccgccaccggtgtcgacctccgtctgctcctcgccgagggccttgcgcccgctgctaccactagggccgccagcgccgacgggagtcgccgccataccgggccgacgcagaccctagggccgctgctgccaccctaggtcattggttagactggactatatatatgttcttcttggaaccaaacatcgtagacaaatttcagcgaaatctgctgtttccacaaaagaataatcaaagaattgctatatgtataattttgctaagaatctagaaaataaaatcaaagaataaacagactccagacgtacttgcacatctccctagctagctactccctggagctgtgacgttttctagtacaacaaataaatttagatatgactatgtctaaatttattatactagaaaatgccatatcctatcttagattggtttttatgggatggagggaatacaccacacagacatgtccgatctcatgctgactggccaccgcccttccgcagcgcgccctccacgactcgccgtagacgctcgccgtcgcagggcacccgcagcacgcccggctggccgtacccgtactgctgcaccgccatgtccagaagctccgcgatgcacgggtccccgagtagactaaccggcaccagcacgcgctccccgtcgccgctgccggcgactatcggtacgtaccctctcggaaagacattgcattcgtcgttgtcgtcgccgccgtggcgcggcgaggcgccggcgggtgacacgccgccactgctgctgctcttcctcctccacatcatgatgatctcgattttggccaagttaattggttagattgcctgcaggatcgatcggaggtgccggagtttggagccgggctgtcagcggtgcctggccggagcgcgttgaggagagacgagcgaggattgtggcggcaaatttatagggatcggcaaggacggttcttccgtggtgattagcgcacgtgcgtctgacatggattagcgcactgcgcacgtgcatattgacatttatggtggtcttccatggcgacgatggagagactagactttgaaccccgttgaatgtccatatgcatgcatcatccgccagggattaatttctgagatgcctaagagacgtccaacgacttggatatatatattccttagatgcctcaatatatacttcgccatcggatgggatctgtccgtttgtgtactatgtatggcacaaggttttcttcatcttgtttgaaacataaggcttgcatgtatactttattgggtcattttcttatttgcccttgtttattgcatagtctctgttgaaatacaccatacaatatgtttcactactgtatctgtttccaacgtgtttatatatactttctccatcccaagttgatcatcacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33715 - DNA, 4559 bp, Oryza sativa
  unsure (1)..(4559): unsure at all n locations
taggttatgcaatttcttaactcttcatggtgataacttgcgctaggggtggtttggagtagcactaattgtgggactgtgggtgtagtttcagtttctttttctctgctgctgtttgtggaagcctgagaggtgatacaaaccttgggtcccaaacacccaatgtgtaattggctaattgcattcccagaaaagacagagtttagccagtccattgactggtaaataacttgatctactcataagcatggagtgttgtctgcaatttactatatatagtagttgtagtaatgcgcacttttaccagaaagattttactgagttaatagattcacctgggaggtgacaaatgccttgggtaccaaactcccaattgtttaactttgtcatatcatgtgattgaactggatgctaatgagggataaattttgttagaaataggatggagttatttctgggagacaaatttctgattgcaatgcacaacaaattcgaagttcttttattttccccatttagctctcacactccagttagaagttgtttttaaactctcatatccaattagtgtgtggtaaccttggggtctgctagtatatgttgctgatagccacatgaggtgtttgacaaacataccaaattttaaaaaaattatataggagcctctttgagtaaactgactgtttatcttgtgatttcttctgttattaaactgctagtctgcataaatgcatccttcctcttagctaaaatagttgagactttgtagacgtagggatgtttaattgtttattattgagcatgttgctgggaagtttactaatggatctcatctgtgtcagtttaggtgataaggttcatatctcacttggacaggtatggcaggagaaatatcgtggcttcaacttatccaatacaatacaaaagttggaacgttggtttggtgttctaataaacctagaagctagtgatagataattggcctccaaggttggtggggaatgcagtattatatttatcccatacaatgctcgcttgtttataatatactagaagttatcctgcgcattgctgtgggaattcatggaacaatagtgggtagggaaagcaaaacggtgtattgctttaggacaaccttttggtgtgaatgttatggttttgttcaacatttaaaaaaatcagttgtggaatcggatgatatatatatcttggaactgacagtgtagatattgctgtgggcaatagaaaaaaaaatctaaatatgaaaatctagcattgatcagtcttggtataggaaagaaaaatgtttagtgatgctgtgagaactaggctaacgataataattcaaaatcatatactaccttcttttcaaaatgtatgacgttgttgacttttcgcacaatgtttgaccattcgtcttattctacatgttgaaatggagggagtacattgctccccaagtcgaataacagagttagcaaaaccaattcatagcaggggattcataacttaaacactaactactttataagaatgttagcagaaggtcctgttcaagtaagtcatcggaactgaaaaggaaaaaaaaggatttaccccacatctgtgcctcatgaatgcaatatttcagttacttgttcagtcttcatctctctcaggaggcaaagcaggctactttcaaaattcaaagattaccaagctgaaatatgggcatgatggaatacatctctatcagtggcacatgaatataaagtgtttaggtgttcagtaaaggtaagatagacactttcaccagataaaatggtcattcaaatacagatagaaaaaaaagctgataaagatgataattcatattcatataaagatcgctattaaaattcagatatcaaagaagtttgacaaactaaaaatttccatcaaatttaagagttttaccacctcatatagccattatgcttcgcctatgagtgaaccaacagatgatcttgtttcctgcattcttcaattgcttgagaagaagaaaaaggatctgacaatgaaagcaccataggatatacacataactggaagggccagtatatatgaagaaacctgattgaactaataagactaaaacatattgatttgaacctgtggtggcgtatcctgagaggctagttgagctgtggaagctcatcatcttgtctcttctttctccctgtgatgaagattgattggtctgggagtgcctgagagcacgttggtggtcatggcctcatatttgataggaaaaggaaaaggcatatatattgagggaaatgaatggccatggcctatattatattgctgtcgcttcaactcctagctgttacagaatttgatagcgcgggcgcagcaaatcgtttcaggtcaggggggacaccttttgcgctgatagtgcaagtgaaacgatagccagtgagatgggctgggccaagtaggaaagttgggctgggtttaatttgctgggtatgagacagtaatgaatgaaatagatgctcgggcatgcaatccgatgccgtcaatcaaagtaatccaatggatggaaatgaaggggtgacgtggcaaagcgtgaaggcaggaaaataccttaattgcactaagtgggggatggattggaataaaaaacatcaattgtattatccttgaaaagaaggcacatcacaaaattacacaatagttacatggtttcagtttctctcatttagagttgacactttcttgctctttcttctaaatgatgtgtgatcttttctcaaatagtatctttatgttaagtgttttctttaaatagtgttcaagtgtagataatactgtgcacatccattagattgtgccatggttaccattttgaaggtcattttaattgtttagtttttctggcaacctgctgattgaaacatataaagatttgaggtcaccttattcggtattgttcttgtatttatagtatttttacccaggtgtaacaaaatttccctgtaaaccttggtaaagccagataaatacatcacgaggttcttgctaaaatgctgatggaaacccagctgagttaccaaattattacttgatttctctgttggaagatgggtatatttcgagacctgctaattgtaaatgcattgtttggcttgctattgcattgcacctgacttgggattcttcttcatgatttcaggctttactgcattcatagtgaggcaaagtcttattttgcacaccatgggattaaattatcaaatagatttggctgccatgatggcacaaaaggacaatgtgcctgctaaaaaagaacaaggttgagtatgccagaggtttttggaagttcctgtacccttcagaagtacctgtggacttgcacggtaacgtagcacaatcttcaaagggaagaatataatgattgccacttgttcagatgtaaaatctctccctgaagttacaatagatgagaaaaagattgtcacctactgcctactggtgctcttttctttcagaaataccaaagaaattggtgattgttggagctggatacataggtttagagacggttctttctggaacgggccaggtctgaggttagtgttgtcgaatttgcctctgacattgtcccatcaatggatggacaaattaggaagccattcaagcatatgctggagaagcagaaaatgaaattcatgcttaagacaatggtagttggggttgacgcctctggtagttgtgtcaagttaactgtggagcctgcagctggtggagagcagagtattctggacgttgttgatgacaaatgttaagcgtgtccacacaactggggatgctatacccggacccatgcttgcacataaagctgaagaagatccattgcctgtgttgaattcatcgcaggaaaaggtcacttagattatgaactgtacccagtgtggtgtatgcacaccaagaggtggcctcctttggcaagatagaagaacaggtgaaggcatcaggagtggcctaccaggttgggaagtcctccctgttagcacacaggtgttcgaaggcgattgatgatgctgaagagctggtcaaggtcatggctgagaagcagtgatgaggtaacattccatggctcgtgcagatctgagcatgatgtggtcttggccacctgtcctttctttcctatatatgaatgtctggcagatttttgtctactacgaataaagattcacaaataaactttaataattgtttactccttatgtgttggttttattatttatgttattcttattgcttgagtgtttgctggctgtagctttgttgccctgtactgcttgatgttcagtaatctgttcatatctctatatgaaagaagataggaagccatcaggcacatgcatatcgtaacaagctggcgtagtcaaggcaaggatatcatagtaaagaaaaagaaacttcatcccttcatcaacccctttttacgcgccacctgaaattttcagtgagatgnnnnnnnnnnnnnnnnnnnnnnnnnnnnnnnnnnnnnnnnnnnnnnnnnnnnnnnnnnn

SEQ ID NO: 33716 - DNA, 14216 bp, Oryza sativa
  unsure (1)..(14216): unsure at all n locations
ggacttcttaactgagaaagaatcatgggaactttgcaaattcaaagcaggagttcctgacatatctggaacagaaaccgtggaaggaaaaatagcgaaaagatgtggccgtttacctcttgcactagatgtaatcgggacagtcctgtgtggaaaggacaagaggtactgggagtgtgcattgtcagagcttggagttcctaccctcttgagaaggccgaagtgttgcaaaagatatacatgcccttggaatccagttacaaccatcttgaaggggatgagaaaaaatctttgttcttgttgtgtagcttgtttcctggaggacacaaaataagtaaaaatgagctaacaagttactggacaggagaggacatcttcaacgagttcaatactttagaggaaaccaggcgaaaattacacatgaggatcacagatatagaagactcttttctgctgttgccaattaattataccaaatgtgtcatgatgcacgatatagtgagagatgtggcagtttttattgcctcaagattctgtgaacaatttgctgcaccatatgaaattgctgaggacaaaataaatgagaaatttaaaacgtgcaagagagtatcatttataaataccagcatcgagaaacttactgcaccagtatgcgagcacctacagttgttactgctcaggaataactcaagtctgcatgaacttccagagaacttctttcaaagcatgcagcagctggctgtcttagatatgagtaattcttccatccattctctgcttctctctactaaagacctagcagcggtccgaacactgtgtctaaatgattcaaaggtatctagaggcatttggttagtcagtagcttggagaacttgcgagtacttagtctagctggttgttcaattgattcacttccagaacaattgggaaatctaaagaagcttaggctattggatttatcatcgatggaatcccttgagatactggagggactaatttctaagctacgttacttggaagaactgtatgttgacacttcaaaggtaacagcatatctcatgattgagattgatgacttactacggctcagatgcttgcaattgtttatcaaagatgtcagtgttctctctctaaatgatcagatcttcaggattgattttgtgaggaagttgaagtcctatatcatttacaccgagttgcaatggattactctggtcaagtcacaccgaaagaatctatatctcaagggagtcaccaccataggagactgggtggtagatgcattgctaggcgaaatagaaaacttaattcttgacagctgctttgaggaagaatcaacaatgctgcatttcactgcactaagctgcatcagtacatttagagttctgaagattctgcgactcaccaattgcaacggcctgacacaccttgtctggtgtgacgaccagaaacaatttgcatttcacaacctagaagaactccacataacaaagtgcgacagcttgaggtctgtgatccacttccagagcacaagtaagaacttgtctgcgtttccttgcttgaagataatccaactaatcaacttgcaagaaactgtcagcatttggagttgggaaggaaatccaccaccacagcatatctgtccaaacctaaaggaactcaatgttcagcgctcagaaaacttgactttgtccttgttgcaagagtagctgctatgcttagtaatcttgagaggttgacactgaaaagcaacgtggctctgaaggaggtcgtggccgatgattacaggatggaggagattgttgccgaacatgttgaaatggaagaaactgttggaaacgaaattgtcagtgctgataccagatatccggcacatcctgcagatgtcggtgactcgttggatccagaagcatttcctagtctaactcatctctctcttgtggatttacctggaatggagtacttctacaaggtcggaggtgaaatcatgagattctcctggaaatcactagtaagtctcaagctgggaggttgccactccctgaaagggttcccaatccatggtgcaagtgctccaggactgaagaatgttgagttagtacataatggtgataaaagctggtaccaaacgctgatatcacaggatgcatctttggctgaacgattcaaaactacacaagagtaatcggccggtgactccatcttaatcttaatttatgtttcataaactattaaagcttgttatgtttcataaactattaaagcttgttgaaactatttgtaacatgtactattcctccagcatttccccccttcctatagaaactatgttatgcaaagtcaaaatgttgaaattataagcacataatgatttaatttattccataaataaattatgacattgcagatgtaaactagattgaacgcatcattagatctacacatgtaaactaagcagtaaaacatgaacagatcaaatgtgcgcaacatgtcgaacacgtaccgaggtggcggaaagaccggttgctcggcaagaactactcgcggttgcgggcgtcgacgaaggcgcgcagcacgcgagcggagaggaaggcgagccatcgcggacgaacagggagcagttgcgcgaagcgcttcccaaaaaccttaatgccgccttctcccggtgcaggacgtcgaagacagaggttccggagacctgctctcccgatcactggtgcacgccggcgagcgggatggagtagtctacgagtgacggcgcagtacagagtaggaggcaaaccctagattgatttcgcgtatgttgcgtgaaggcagcggctcagtttatatagagataggtcgcctgatcaaggcgcccgcgtaaccgaaccggataagtcgcgcgtaacctatccggactccacgccgttttcacacaccgaatttttcggaatgtttccaaaacaaaacaaatctgaatttcccgcagcaaaacaaaacagcaaaaggaggctgcatctacgcaagggtgagaagccaattttgcggaccattcgacgcgtacgtcatgcacgcgcgccgcctgccctgccatgccaggccaggcgaggcgagtgagtgcgcgcatgtgtttcccctcttctctccaccacacatgcttcaagtggctaggagggcatcctcccttttaaggaggtccccctctcctggaataagcaaggcggtactaaactccacatgcatgccatcccatgaggtgggcttttgtgattttccatagaattaatcttcgaatgggccttagcccatctattaattccaacaatcccccaccaaatctcaaaatcccactgagatttgccttttccaatgtactatttatataccagcggttcgatggagactgattaaggttgaacatccacctagaactccaagctacacttactcacaacttgaacaatggactacgccttgaattgcaagtcttgtgcaagcaagtttcactcagagtcttatctggtactagaccgtctgtagactacccctcgggtggagcgtataagtcatactcctaggtctttagtaagcttcctagaagattcacccaaaatctnnnnnnnnnnnnnnnnnnnnnnnnnnnnnnnnnnnnnnnnnaattctttcaagaatgctctgcaggacagcatcttcgctaattaaagccaatagaagtcattaaggcatagccaacctgccttgcagctcacgagagtacatgcatcttcacttagagagggtatagattggtactctcctctagtttactaatggtttattcttcccaggttctaattcacgggatctccgatcacatagactgggttaccaccatagtataactcacatgggtctcaaacccatctccttcgatgcattgtctatcacatttcgtgatagtcccttcgtgaagggatctgccaggtttctagctgtttggatgtaatccaacgttataactccggagtttctcaatttcctgacagacctcaatcgtcttttcacatgtctagacgatttcatattatccttagaactattcactttgacaattaccgtttgattgtcacaattcataaggatacccggcaccggtttttcaacaataggcagatccattaatagatcacgcagccattctgcctcaacagtagcagtatccagtgccgtcagctctgcttccatggttgacctcgtcaaaatgatctgtttgcaagacctccacgaaatagcaccaccacccagtgtgaagacatatccactagtggctttgatctcatccacattagagatccagttagaatcactatatccctccagtaccgcaagatacccagaatagtgaagccccaattccatagtaccttttagatagcgcattactcgcttaagcgtacgctagtgatcatctcccggattagaggtaaaccggctcaacttgctcacaacaaaggagatatcaggcctagttgcactagccaggtacatcagcgagccaatgatttgggagtattccagttggttcctagcaattctcttgttcttgcgaagcaacaagctaggatcataaggtgttggagaaggcttactatcaatgtagccaaagcgattcaagatcttctccacataatagaactacaacagtgtaatcccattctcacctctaattagcttaatgtttaagataacatcagctactcccaaatccttcatatcaaaattttgagacaagaatgatttaacctcatttatcacctcaaggtttgtcccaaatatcagtatgtcatcaacatacaagcacagaataactccctctcccccaccatggcgatagtacacacatttatctgcctcattgactgcaaagcctgtagatgtcaatgttttgtcaaatttctcatgccattgcttaggagcctgtttcagaccatacaaagacttcaacaatttgcacactttgccttcttgaccttcaactacaaacccatcaggttgatccatatagatctcctcatccaactctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcctttagcaacaagccgagccttgtacttttcaatagtaccgtcaggcctaagcttcttcttgaacacccacttgcaccccacaggtttacacccatagggtcgctctgtcacctccaaagtcctgttagcaataatggaatccatttcactacggatagcctccttccagtagtctgcatcaggagatgcatatgcttctaaaattgacttaggagtgtcatccatgaggtacacagtgaaatcatcaccagaggacttagccgtcctttgtctcttactccttcgaggagcttcactgacatcctcctcagtgacatgttcatgtgtatgttcagtttgttctggtggtgtgattggactgggaattacttcagagggttggctcaaactactatgtgcatccttcattgggaaaaagttctcaaagaaggtagcatcacgagactccataattgtaccaacatgcatgtcaggtacctcagatttaactattaaaaatctataggcaatgttgtgatgagcatatcctagaaagacacagtccacagacttaggtcccagtttgcgcttcttcgttattggtatattgactttcgccaagcacccccatgtgcgcaaataagaaagtgatggttttctcctaatccatatctcatatggtgttttgtccttatttctgttaggaactctgtttaacacatgattcgaggtcaacaatgcctccgcccaccgtgccttaggtagtcccgcggtgtccaacatggcattcaccaagtcagtcagtgtgcggttcttccttttagcaatcccattagactcgggagaatagggaggcgtcctctcatgtatgatgccatgttcctcacagaataagtcaaactcgtttgagaaaaactctccaccacgatcaaacctaagcctttttatctttctatcaagttgattttcaacttctgccttataaattttaaaatagtctagtgcctcgtctttcgtttttaacaagtacaaatagcaaaatctagtagcatcatcaatcaacatcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaaaacatgctggaaagccgagacatcaagccaaaattgatatgacataaacgtgagtgccaaacattagcctcatcatccacactgccacaaatatggttcacagatttattgcagaaatcagaaagggaaaagcggaacaggcctccgcactcataacctttaccaataaaatatccatgtttagacatgactactttattagactcaaaaaccaacttaaatccgtctctagtcagacgggagccactaacaagattcctgtcgatagaagggacatgttgcacgttcttcagctgcacgatctttcccgaagtaaacttcatatctaccgtgccaacaccatgaatagaagcatgtgacccattccccactaggacggtggaaccccgtgcgacctgataagaagaaaacaatgagatgtcagcataaacatgtacattggccccagtatcaacccactaattagtagactgattaactgaaaaaacaataggtaaattaccatacccgcttcgatctccagtgttgccaatggtcacattagcagacttagaagtctggcttgtaggtgtcttcatccccttgcgctgtggacacttcctagccagatgaccaggttggccacacacaaagcaagtcctctcatcctgattaggattattgttgttcttcttctgcttcttgaagttggtggtctgttgagctttgtatttccccttctcttgttctgggccttatgcacaacattggcactgtactgcccaccatcgcccttagacacaacatctttttcccgagctttctcctcaacatcaagagacgctatcaacccctcaacggagtattcctatctcttgtgattcagtgcagtaccgaaacttctccaagatggaggtagtttcgcaataatgcacccgaccacaaatttgtcgggtaagacacacttaaggagttcgagttccttagccatggtttgtatctcatgagcctgttcaactacagaacggttgtcagccatcttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcattccacaaagagagtagtggcttcctcaaattgcttctgctgatcagcagtaagaattccttaaggtttgtcagtactcacccagaagcatttcatagctgtcagccatagagtgaccctgatatgccatctcttaaagtgcacaccggtgaatttatccggcctcagtgcatcggcaaaaccagccatagtaaaatcacagcacctataataaggtttttggattgttgaaattataagcacataatgatttaatttattccataaataaatcatgacattggtgatgtaaactagattgaacgcatcattagatctacacatgtaaattaagcagtaaaacatgaacagatcaaatatgcgcaacatgttgaacacgtaccgaggtgccggaaagaccggttgctccgcaggaactactcgcagttgcgggcgtcgacgaaggagagtcgcacgcgagcggagaggaagacgagccatcgcggacgaatagggagcagtcatgcgaagcgcttcccaaaaaccttattgccgccttctcccggtgcaggacgtcgaagacagaggttccggagatgtcacgcccggaaattcactagtaatttccgaactaatttgtgcattaaatcctcgtccaggaatcagccgaggtacacaaactgacaatttaatatacagattcatcaatataataacgttacatacttacaaaagaaaagaaaactacagcggaattacggtctagcgaagctccggctccactcccacaggcagctcaactggggtataagccaaacgtcttctcgttcgcaacttgtcttcaactgaagtttgattgattattgcaaggtgagcatatgacatactcagcaagccacatagcaaatatgcaagtgcacaaggataccaaagaatggcataatatagggctcatttgcaaaagcagcatttagcaaataattgaggattgtaaaactgtaaagcaattaatcatcaatattaatcaacactgaacagcacacccatgctgcacaggcccaaccatcctgaacaaccataccctgctgcacagatctatctccaaaccaggaatgtaccattccaaaccaggagctaaattaattaccatcaattatcacattattattaatgagtagtgtgggactaatcacgaaagacattgttagacccgcccataaccgcgggcacggctattcgaatagttttactctggccaaaggtgtaccactgtacccacaagacacaacccaccagcatgttaccgtgcctggccagacacgtcaccatgttgagtgattgtgacaagacccctcgcataactcaactcaaagcagtgcaccgttcctggatcataatcacccccttataaaacaaggcatggactccccagcgacccccatgggcttgtctccgccacatctcagtctggcacaccacaatgagccttgctatacaaagtgtccagctgttgcccattctggtttgtggttagcacggttaatgtttcacaaccgaaactcgtgaaccggtccttaattgtcatgagcacgaccatcaaaaccatgtgctcacaacccaccattatcaagttttagttggcacattaattaattaaccaatcatgattagacatcgtgagctaccattatcatgtccatcattaagtagtagtgaaacattagttatcccaatcgtgtactaatgtttctaagcatggctaagcaattatatctaatatatctagttgaaccaatatataaatccaactagtcaaattataacccgaggtaatcaagaaataggataatcaatgcaaattggccataacaaaggaacaggttcacaccacccggtgacattcgaaaataaattcatagttgaaataaatagagaatttaaatataggatcaacatgctcaaaggtattgtgtttgggatctgtgtgacttgccttgcaataatcggtcttcaattaatcttcttgaatactcccgacgcacacgcgaaccttcgaaacgacggaaatgacaagctaacacgcaaaacgaggaaaaagactaagaaactccaaataaacaatacatataaagtaaacaaacatgtagatcatgattttagattaattgtgagacttgaacggcctcattccgatttcatatgaattagttatgaattttacaagatttaattccaattaaacctattaaagaaaaagactattccactaattaaatcatttacaaatgatttataactgagataaaagattaaagcaacctccggaaatagattagatcatatttggtagatgacatatgataataaggactaatatgctactgaaaagagaggaaatgatttatatggctgagattaatcttgaccgagagttgaccaaggttcaacggatgcaagcgagcctcacaagataccgacttaacgagtcaattctacgtgacacgggatcacccaaatgatcaaccgaaaccggcgaacggaaccggcggctctgaacggctctaaactaaagaacgattccacacggacgaacgaacgaagcatggggacacctcgttcgaacgaacgagcgaacaactcaacaacggctgcgactaaaccgatgggctagacacgattcacggtaaagccccggtacggcaacgataggccggtaggaatttagggatgcacctacggccagacaacttgactaccgagcaacggctaaagcggcggctagattaaagcggcacacagctgcgacacggcagcactagggcgacttggctcggctaggcggcagcgactcggcagaggcacgcggctagggttagggtgacggcatagcgatgacgacacacagctacggcagatggtggctacggtagtgggacagcagcgacttggcacgcacgagcagcagcagcacggctgtagcagggagtggcacagcgacggctaggcggctagtgcagcggcgacgctagggcagcagctaagcgtggcacggcgacggctactcgacgacaaaaacaagagattaaaaactaatccgagggaacacggatagaagtttcaccgaaccaaagcgatcggagaggaagggtcgacgatgatggtctggcgacaacacacggagacgatgaagacgcaacacttacgcagcgacgaacagcgaaggagatggccggggatgagctccgatgggcggcgaggtactgtccacggcggcgacgactttccagcgatgagcagcgacaacggaggggtggacgggcttcacttcgcagctgcgaatccaatggaggcgacggtgaagcttggcgatgacgggaggtaaaacagacttctctgcgggctgagaggaagggagagaatgggctgaattcggcccaagactaggaaggaagattttattgcttttccaaataaattaaccaatgagatgatctttcaattgttaaaaatacttccaacgctcaaataattccatgaaaaatcttgaacatacttggacactctaagtatttaacaaaattgaaaccatctcatttcatgattaatttaatatgtgaataattactgaaatgttctttgcattattaaaattaataattgagctctgaaaaattcgagaaaattccagagagtataattaatcatggagaatttaataaaaattaaatcctgccatgctttatatttaggaaattttatttcccacatttaacttcacttgtaaattaatgaacatttaatataaattctatgaacaatgtattaaataatttataaatcctgaaatgaaattcaggctgtgacaggagacctgctctcctgatcgctggtgcacgccggcgagtgggatggagtagtctacgagcgacggcgcagtacagagtaggaggcaaaccctagattgatttcgcgtatgttacgtgaaggcggcggctcggtttatatagagataggttgcctgatcagggcgcccgcgtaaccgaaccggataagtcgcgcgtaacctatccggactccacgccgttttcacgcaccggatttttcggaatgtttccaaaacaaaacaaatccgaatttcccgtagcaaaacaaaactgcaaaagaaggctgcatctgcgcaagggtgaggagccaattttgcggaacattcgacacgtacgtcatgcacgcgcgccgcctgccaggccaggcaaggcgagtgagcgcgcgcgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgaatgggccttagcccatctattaattccaacacaaaacacgagtaaatatatactccctctatcctataaaaacaaatatagcatggaatgtaacacatcctagaaatatgaatctgttagatcccatattaggtttgttttgaaatatgaatctgttagatcccatattaggtttgttttttatggggcgaaggaagtataaatcatcaaaagtaagaatccagaacagactcctagtcctaggaccaagcatacacctacccaggttcaactcctcccttctattttttttcgataatggaatcttcattaagactcagtcaaatacaccaacaccaagttgatacattccaactaagccaccctcggcctctacataaaatgcacacagcctacctagaccttcattacgataccgagatatcagtggctatcaatccatatactagatcgccacccatgctcctgagtaaaaactcccacctagtccaaacgtcgcgatactatcgcaatagtatcccgaagacccggtttgtggaggatagcctaggtgcgaagccaccgggtgactaaagtaataacctgcaaaggagaagacaccaacttattataaaaatttacctcgtttctgtttatctaaatggactaacaaagagctgctgcacccatcaaaagaagatttgatgggtgtaatttgtaatcctttttacatatgcaatctgtaagttttataattttaatatatttacacacggcaggaacctctcctatagtttctttttttcaaaacaaaaacagatttctcatttctttaggaacacatgtaagcaacgcccatgttagaaaaccggcctcgaaatcacatcggaaaccaaaccgcggacgaaaacaccataggagatccaaacatgatgacgacaccgaggcacgatatttgataacagagtttagccgaggcctagtacatctcaggggtactgattacgagcgctcctccccgatccagcatattacagcgtatcagagttacaatgactcacggccagtatacaactccaagtcctatactgtaaccgattacgtacatatattcgacacaaacaataacaaactccaccttgaagaatatgccaacctgaatttgttacttgctcgaacctctgtgtacccgaacttgagttgatcctttttcgccgctcacgctgaactgccccgacaagcctccaccaggctcaccgtaaacaagagactctcactatccctgtaatttctttctcttgactccacctgcaacagtgctccaccgtctctcatatcaccacagtcatcttaccaagcaaaattggattccttcctagctatcacgtcgtagacttccccaagaccatgttcacctccatctaccgtcttaaatttgacttgatctaatccatgaccagataaccgatgtcatcaccaaatagataaatcaaactcaccacacatgaagagaacattttcttcattgtcgccttatgaactaagctaataaatctaacatccacgctttcctgcattcgtagacttaattcctgataatttgagaaaatcaccgttgctttgaatcatccgaagaaattaccaccatagtgcttgctctttctcttcagtgacgtatatttcatatatcctcatcatgcaaaccccgcagatcctggatatatcctgtactgctaaacaacccgttgacgctctcaacgattttcacccgttgttgcccagcaaccatttacacctgcctgacaataatatccacttgcgctgcctttcctgccttaccaatactttgacttatcacgctaccattacttcgctgcatgtataaacttagcatggtcgcatcataccgtgacacttgggattgtggacgtttatgcagaccagcgtcaacatccaacaagtgtgctacagtagtcttgactcttgaccaagttcctatgcatgaagtccatgcagccgtattggtttccacgcacagccactagtacttcggctcatgcaacgccctggattgttcttgccctctgctgttgttcgctgtgaacagtaactcggcccatggacaataacagctccacacgaacaatatcaagcccaacgagacagtggcccaagttaccagcctactgccggtcaacccaatcctttccaccagggaatagtcgtactcatcccctt

SEQ ID NO: 33717 - DNA, 9985 bp, Oryza sativa
cctgcacgacaactacaccaagccgtgctcctaccgctcgcagtacgtcactcaaaccaccactgcccaagaaatcatgtccgatctcttcactgctttggttggtttgattaaaatttgaaaatatacctctctttcattggttttgtacaaatacactcatttagaaaactaggaagaaaatccgcgcagatgcgcgggcatctgatttattcttttacgaaaataatgcttacagaagtcatatatcaccatttatactccgtgaaatagattgtacattttaatatatttaaatgataaggaggcctcctagattaaataaaatcatttgccccgactacatataaatgttcttaggacccgttctatactccaactgcaaacttcaactttcttatttttcattagcacgcttcccaaattgtgaaacgctatatttttgcaaaaatattttatatagaagtttaaagaaaaaatcaaaatttcaagtttacaataattaatatctaattaatcacgtggtaatgaactttctatacctaatcacttcaacttactacatatgtacctattcatggatgatactacatatgtaccaagaaaatacgcctaatacatcattaaaacaccgaaataaccactacacgtaagtgtttcatgcctcacctattttcaaatccatatataaatattgtaaaaaaaacacatgtacaaatcaatgggacgacatcattgaagttacaaatagatgcctctctaatgggtgaagatggatgcgatcaaaataatattttttaaaaaggttttgagtatatttgtggtatattgtagataccatttatcgtgttaatcataaatactcaaatggttatggtatagatataggatactctaatttgaaaatgagcgaggttatcaatcgatggtactaaaaaaattataactaaagagacatactaccatgataatttctagggcaccatattattatttatattttgacaaatatctatagtttaaccattagtttattttcaacacctattgttggtaatcacatgagacacctttactaagttgaaaaacatatttattttttaaacttattaacaataactaatatgtgggcgaatatttatagtcgcatcggtgaggtatgtgacatacatccatcaaatatgcctgaaatgttgaaattccttaaccataagaaaatataacatgagtagttcatttgacatgttacttgattgttcatttgttgtcaaaactatttggcaaaggaaacaaaatatacatatacgaccataaatctcattaagaggttatgttatagcaatattattaactcaaaatattttttatgattattttcacatctacgtaccatgtatgatactcagttctcaaataccaaatagttttgaaatattcataaaaaactttgagaatattaatctcgaacaaattaaaattatagtaaatttcacaaaactataggtactttgatcatctgttgttttgtgaaatttagccttaaatctacattcttaaatcatgtctacttgagaaaatatgaaactaaattttggtgtttttattttttgttttacatatgtagatttgaattagcgtcgtataattttgaagtgatttttgaaaccctaaattatgatgtgaaattattttaaaaattatcatgatattaattactatttgtcagccccaatgcgtcatgatgtatttacgataacagactttaaaaatatttaactaaaggaatacaacggtatcacacattaaatatataatttgaaaatattttaaaatgtgaacatttatagaacgttgatttgatatttgatatttgtatcctagatctagtttgtggaataatatattttatttttatatggtataaattctattttagagatcctcgatttttttaatggttctacgtacgtatgtctttttttggctttatgttatatatgtagaaagttctatttttgattttttatactacatacatatatttttttggcttgatattttctttttcttttgcatatggttttttttttatcgtaagaacgtgggcatgtttttgttcttgctgtcggaatgtatttaaggtttaatgttttttcccaatcttacgtacttatgttttttgtttttcccgacgaacctattttctctcgtacatacatatggaaggtattagtattacatatatatatatatatatatatctaatcttgatctaacataatgggtccacttatttaaatgaaaagcaatggtacatatagatataatctaatggtttaaaataacgggtccaacaatttaagtgaaaattaacagtgagattaaacagtgtcacacggcggtttgggattgttagtacaagcgcgcgcggcacatgactgtttaggaatgtttataagaagtttaataaacttttagtatttaagttataaattgaagagtttgttctaattaaagtacttataggattagctactcctttatttatttgtagcgagtatgatcatcaaaaggataaatggtgcattacatggtgtgtgctttgcaaatactttctatattaaagttttctaaaaacaaataaatcatttttatttttgtaatatttaatactcaattaatcacgtgataatgatatgtatcatttcgtgtcctgataaggtcacttaattagctagatcaaacaaagccttagtattccttaaagaaaacaaaaagagtaattattaagtctatttaaatgagtaagacacaaatagctaaatatgattttatgtgataattttttaattaaaatatagctaatatgtgatgtactcgtaatattttttaatagaaattcagatacctccttttcttttatatagtaggttcatatatgtacttggaaacatatatcttcccaatcgtaagtacattatgctcttattcgtttttttgttactagcaataatgcccgtgcgttgcaacgggtgaaggtaattttaatcatgcatactggtgggaaaaaagataaaggaatcataatcataataataatattaatgaaatgaaattgcagtgacctttggtcaaaaagataaaaatatataattgattttccgttaattccattagctaaaaataatataatatgaagtaggaaaagttattcttgaattttagcaattttcaaaaagcttaaatagaacaaactaattatgtaaataaaaacaattttaatcacctaaataaaacaattagaactgcaattaaaaaatctgttgccagcttgtttaaacatgagccggtgggtgcgtgtggcatatatctctcactcgtacatcgtggtaaattttttacatagaaaaaatgactgtgcgttgcaattataacaaatataaaaatattatatgattaaggtttagttttacatgatatgagctctttaagaaaatatattcataatgaaataaaaaaaagttcagctgaagggacctaaagtgaacttattccacacagagcgtacacgcggtccatgaggtggcccaatagtgtgggcggcatgggaatagaatcggggaggaacaacttaagcgacctaaggtgaacttattccatgtgggtgacctgggaatggcgttcagcctaacgtgggagaagctgaagctgtccgatgtgatagatggtcctgattgatcccgacctatataaaagttcaacatcccaaaccctaaccctaaaatcatttctcctcccccctctctctctcaaaacaacatgacggcggcctggcatacctacatccctgcgacggcggtggctgttcggcagcgatggcaacaccctccccttccacgcgtcggtgttttcttagtattgttgaatctgatcttgtattcttgtagtagtgttttctctagaatttaggtccaaattttgatgcggcctctcattattttttttctttcttttcttttttttttggccatcggagagggattaaagcgggatcgatcgcacgtgcgatggaatttttttttgacggacgaaaactataacctgaagccatacaaattttttaattaggtatatatagaatcggactttctttttttcatgttttttcaccctttttttggttactacggacgtcggaaatgtctttaattttttttaccgcgtcatatataatcggattcgattttttttcgcccgatttctttttcacgctttttttcacggacggacgacggaaacacttttatttttttattttttattatatataagtagtagagaagagatagagatagagaaagagaaacgaaaaatattttttcgcaacttttctttttggaatcggacagaaaaaaatgttcacgcttttttttgacggacgacgagattttttttaatcggacaaaaatatttttttcactattattctacttttttaggaagacggaaaccgttttgtcgcacctttttttattggacagaacaaaattttcgcacttttattcgcgcttgatttttttccatacagaaatctttctttccttttttttagggaatttccaagggggtcggacttcttttttttgtttgtttttttctcggcatttttttttctcatggacgaaggaagcaggttttactttttaagtagttctagactagatagatagaagactagatagattctagatagatagaagtagtatacgtacgtacacggtaatttttttcccggtaatagaacgtacatgtttttctcctgtgaatagttgtacatacacgggagacttgttttttcttcagtttttttattgtggcagattatctaagataatgggtccaccaatttaaatgaaaatcaactatacacatagatatgatctaatggtttaaattaatgggtccaccagtttaagtaaaaatcaatggtgagattaaacagtgccacatggcggtttgggagtgtttatagaagctccacatggcggctcaggagtatttgtaggaagtttaatggacttttagtatataataactagtaaggtagcccgcgcagttgcgcgggcatcttatttaaatttgttattaggattttgaatattatgactttgtctctcaatgaaagaatttgaatgttcctttataacacatgattgaaaaaaaaagtataaaggccggaaacatgttagaaatacatgtgtaaaacagcgaataaacaaatttcggacagtaaacgaattttgtacagaggacataaataacatgaattttaaaatttgttaacccacatagatgaaatcatcatctttcattgcataaataaactgcagttaaccaaataacctttccgttagcagcttgattttatcgatcccatgcgaagggaaaaaacatacgcatgcatcttattactattttattaattttattgctatagagatataccgtaaccttttggatatcagctaatcgttatgtgcaccgtgcatggatacctcgtaagcaatatgatttagggattagtagatagtggtagtgtggatatatctcgtaataattgatcaagtatattgtatactacatattaagcgttttagtagctttctaaagagcttatcggagtagctactcccttatcctatatatctataaagttcattctcaataagtgttctcaataagtatagttaatgctaattctctcttctctcatgaagccataacacctcaattgtttttagcccttggatgattcatcaagggtgcaaattgcatctcttctccccaaaagccactccatacaaatcaaccatttataacttttgaataattgatgaaggtacaaaatattcaagcacatgaaagaaaatcatatagtaaataagatattttttctactactcatatctactattttatcacacaattctcctacagcaatgtgccggccatctagttcatagtgataacgtttcccggactgctaaacgtgttatattttatctttttctgataatttctattattttctctaatttattatagtactatgtacaattttaagagtgttcataagatgtttaatggactgaaacttttctatgtttatttttgcatggtatcagtaggatatgaattttttcatcagacttactataatgtattcgtgcaaattaaaggacggtatagtgatgcaatcaataggaatcccaatcgcacactttttttactataatccaaaggaggtttaaatttttaattttaaatcccaactatagttttgagctgagttcaaactttttaacaaagtattgctttttggatttcacagagaaaacaaaacgaaagagaggaacatgggacctgcgtgggtacatacttatttacacctagaagtggggacttttagagataaattaaattggtagttttttaagatagattcaatgcatggataaaacaatggtctagcaaaataaatgaaaaccaacggttaaatgctgtttttcttagaatttatgtgatttattatagcgccacgtgatagcttagaagcgtttataggatgctatgtggcggcttagaaccatttatagagatgctatgtggtggcttagtagtatttagacgaagtttattggactttcaatatataattaatagatagatggtagattgtcagtaataaaacgaattaagctgagcataaaaccaacatatattttttataagttaatacatgcaaggatgcacgcatgcatgtaaccctccatgaagaggacatggacagatgtaaccatggtgcttttgctctcaacaacttatgaaaaaaaaaaagaacagatgatgcatatacatgcttgagaggtgagcagattgccggattggacgttttatatgttagctgttaatttttcttttcaatctgtaattgttttttggttttttatcttttttttatttcggtattttttatcactttcggatgtattttctctcatatagaaacggtatattagaagtgagagattatattttaatggatctaataatctaatggtccaaaatatagatccacagtttaagtgttagatgtttcacttttttcttacaattctctaatttattatcgtgtcacatggcgatgtatgagcgttcgtaaaaagccacataacaacttgagagtgttcgtaggatgtttaatagacttttagtatataatagatatattgttatacacgatgtttaatttaatggatatttattatttgctagctagaaattaaggaggccaaagtgagcaaggagagatgacgtaaaattatttgcgaccacatgatagtatatgttattattttttgctatttgtaggagtatttgtcaaacgatgtatttcttatatatcaaaacacatggctaatatagataaatagaatatgttgtagaaaattataattatttagttatctaattattttttacataataaatttattatctaaaaattagaagatggatgggatgaagaaaagagaggttgtgagggagtaacgtacgtacacgtacatgtacgtgaggagtggaggcccatgaggggagcgggagtggatgggatcttggtttattttgtttaatatagatctaatggtgtaaaataatgggcccgctatattaagtgaaaatcaagggtgagatgttttgcttttttctagaatttcttggatttctctaatttattagagcgccaagtggcggtttaggagcgtttgtaggaagtttaatggacttttagtatataatagaaaagatagatagatatttacagaaatataccattgtcgcgaaatgaaagcgcgaaatcgtgcgttactgcatgatgtcgcgcgaggtgtgcgcgagaccgctcggtctcgcccagcgagtgcgcgagaccgcgacttcgcttacctaacccgtgtactcacgctatcaataaattaattagtgtaattagcaattaattaattactattactcctttaactaacatcattagtaattaattaatcgttaatcacttgttaatcgtccactgatcatgagtcatgtcaggccatctcgcaaggtgatgaagcgagaccgccggtctcacgtcctgctgttgcgataccgtggcggatccggcggaatcacgccatgattctgcgagaccgtggcaaagcatcacgttgtcgtcattttcgcttaacggcttagcgatatcgtttcgatttcgctctttcaatcagcgacgacgatatatttgtgctaaaaattttacatctcggatatttataaaaaagaaataaataaatagtttactttcaaatttaattcttacaattgctgcaatctcgtggttctcctttgctggttttgtttggaaaatctgagtccgatctgtgtccaatacggaatcctcttcgttttcccttcttgtgtccgacgtggtgtcttccttgattcttctcttgtgctgccacaatcacgaccaaaatagaaacagactacgtgaccgagtccatatcctatgttgcagcccttctagatcttagtcctgcacgaacccggcttttcccaagccagctaccaacaaaaccgctctagtctccaccttcggctcggcctcaacgtgaaatcatgcacaccgccgtggtcctgacctcctgagcttcacgtactgccaccacaaatttcactgttgtccaacacctccagtcaattccatcgacaacgaacgacatcaatcggactcgtgcctataacagtaccaaacttgtagattgtacgccgctgttgtaaccatccatcgtgcaccaccttgtcgtcaacacatctccatcagcaccaacgatccacccacaccgacttccgattgaacactattaatctagtcgagagccgaagccgacgagtcgtatgccgtcttcccagccgccgaatgacccgagtgccacgtctagccatctccctgtcgaacgcagctcatcgaaaggccccggccaccccgcccagagtgttcgattccaccgatcgagaacgccgatcgcctccagcttcaatcaaccccgagcgtgaggcctcacgtctccctgttgaaagtagctcaccggaaagttcgagccacctgcccgcagtgtccgacccatcgattggatcgccaatcgctttcgccgccatcaacccgagcaccacgtctggtcatctccctgttgattgcggccatcgaacggttcaaaccgctgcctgaagtgtccgattccaccgatcaaattccgttgatcgccgccgtgctccaccttgcgtccatgcccgtccctggacaacctgtgtagttatcgcaacgtggagcacctccctcgcacctctacgatggatctcccgcaggctctgataccacttgtttgaaaaccggccccgaaatcacattggaaaccaaaccgcggaagaaaatgccataggagatccaaacacgatgatgataccgaggcacgatatttgataacggagttcagccgaggcctagatctccaggcactgattacgggcgctcctccccgatccagcatattacagcgtatcagagttgtaacgactcatggccgatcgccgtcggcagacgctccctctcgctatgctatgtcgccatgcagttacaataggcacgcccctctatttatgagagatcctaggatagagttcgagtcttactctaatcctatacctagtacaactccaagtcataaactgtaaccgattacgtacacatattcgacacaaactctaacagcccaaacatatgagtcacattttgaggaggttgtacgttataagccatatgaataatcgaccagaccaagtgagtaacatgacattggaagaacaaatgttgaatggttccgtcctt

SEQ ID NO: 33718 - DNA, 1760 bp, Oryza sativa
tggcatcaggcagcttctggacattcgtgtcccttatgtcaagggtctctaagtaccgtagcttcccaatcttggaagggatgctgttgatgtctgttcctcggaggttgagatatttgagaagaagcatcttgaagatgtccttgacatgctgcttcttgaagcccttgcagccttccaggtccagcacctgtacaatgccgagcttgagcgacatgaaaggcagctggttcaagctcccaaacactgtgactgatcggacatgggacaggttcattctgtccatggtttctttggcatgcttcacatcgctgctgtggatggacaggcgacgaactttattactgggtgtccgcatgagccagtgcccgccaaccacggtgataaagttctcctcgctggacttggacatgatgtactcgaggatcatgtcatgaacctggcaggtcttaactttcccgtcgctgctgtgatccacaggcttcaatatgttccttcggatgagcagattgaagtttgtttccgcgcgttccttcatgctctgcccgtgctcctcgctgataaagccttccgctatccatcgcctcgtcaaccgcttcctgctgatcctgctgtcctttgggaacacgctcaggtagagcgagcaggtcttgaggtctgcaggtaagctgctgtagcagtagttgagtatccttgtcatgccttccggggtatggcagtccacggatactggaggcagggagacgcagatctcggcacactgtttctcgtatgcctgtggcttgcaagccacaagaccagctatggttacaatggccacaggcagacccttgcagaggtccaagattttcctcgagacatcaatgtgcgcctgaccgagcatcttgtcactgctagtcatggattcagacacgctctcttggaatagcctcttagcgtcatcatcagatagacgatccacatgatggagcatgtctttctgtctgtcaaggatgcattcccctgctacggcttcgaatcgtgtagtgaccacaactctgctgccttcttcatccggtagatattgtctgattgtctgccatgcttcggcggaccgtacgtcgtcgaccacgaggatgtagctgccaatcaaagttgatcaaatgcaggaagtcagtgatatgcgcgatgacggagcattagagccaagcttgttagtattgggattccacgtagtattgtttttcttttaagttgtatcggattgtatcgtaatatcaggatactatgaattttcttttttaagtttaatttaatatttatattaattatatatagctattctataaagaaatagagtaatagtaatagatgacataaaaaagagagatttgtcaatagaagacccacccactaatgctaatagttttatttaacattgattttatagatacataaacacaaaagcgttcaaatagttttgatttttaaatttggaaaaagtacgaattacccctctgaactatcacggtcgtccgaattacccccctgaaccacaaaaccggacattcttcacccccaactatgcaaaccggacgaattacccccctggacccaatccacggtggttttgatctacgtcgcagtccagtcagcaatttatttattaaaaaataggtggaccccacctgtcagtctctctcttatatctctctctcctccaaacggcgacagcggaggcagcggcgcggcgaaggaggcagcggcgaggcgaggccagg

SEQ ID NO: 33719 - DNA, 8949 bp, Oryza sativa
gaaggggcgacgtcgtcccccagccaaccacctcgccgccgctgccgcctcgcctccgcctcgcctcaccgccgggtgggagaggggagagaagctgccgctgccgctcttacccgcccctgcgccgccctgcctcgccgccgccgcctcgcctctccgccgccgcgcctcctcctccgccgccgccacgctcgcctctccgtcgctgcctcgcctcctccgctcccgtcgcctcgcctcctccgcccccgccgcttgcctcactgccgccgcgctcgcctctccgccgccgcctcgcctcctccgctcccgtcgctcaactcgccgccgcgccacctcgcctcctccgcccccgccgctcgcctcctccgctaccgccgccgcgctcgtgtcgccgccgcactgcctcgcctcgccgcgccgtgtgaaggaggagagagagagatagaagagataagagagagagactgacaggtggggcccacctattttttaataaataaattgctgactggactgccacgtagaccaaaaccaccgcggattgggttgaggggggtaattcgtccggtttgcatagttgggggtgaagaatgtccggttttgtggtttaggggtgtaattcggacaaccgcgataattcggggggggtaattcgtactttttcctttaaatttaaatattgtctagtttgaaataattagtatcccaatcccaacgcgattctgattatctcaatactagcgcgataccacccaaaaaagatcctaaaccaacacgtatcattttacccggttagtatcgtagtatcttaccatacgtatcccaatagagacaatcttgcttagagcaactccagcagagttgccaaatggctctctaagctaaaatatggtaagtttggtgacaattgcactccaacagcttgccaaccgatggctcccccactgaccaaacttgcctagccagaaccagcttgccaagcataggccccacgcggcctttatccccccctgccccatctctctctcgccacactgtttccttccccacaagcagagcgcccgccatcggtggttgtgcactcgggctgtctgtagttgcgcgtcatagccatagtcaaaggggactctgccaccgctgtatatggaggaaggggcggagacaacgtgggggcgggggggcggtggggaagacccccctacccctaatagaccattagagcccccataataccctctaaaattttaatccatatatttatagatgaggggctaatatagactttgtttgaggttgttagaaggaccaaaaggctaagaaggccaaaaaaaaaatcctaacccaaccctaaatctcacttagttgctcttggtcattttggtttagcccctgctataatttcatcctagctccgccacttgcaggaggattctactgccattgccatcatccgatttttgctgctgatgttcgctctccatttttcatctctgtgagctccaacacctctactcgtgagctctgcccccaatccacgcgtgggtggataggataagctgttgccatcggtggcgaggatgggagggtgtggcggtgggtcggctcgacggtgagagagggaggtaaggagcgacagcggagtggcacgccttagacaccgcctccacagcgttgccaccgcctcccctgctggcgtgagcaacaacagcagtagcgtcgccgccgatgtaccccatcgtcgtggttggcctcgtctcgcctcgccccgtcatcgcccgcagtctcttgcgtcgccgtcatcaagatccgtgcgcgccctgccatcattctcttgtgcactagggagaggattggagagacgatggaagaagaaaaaggaagaggagaatgactggtgtggtccattggtatctagagaggtatgtggagagtttgttggagcgaagggcaaatctaactgtaaaattttggcaagctggtcaaataggtatttagaaagacaaaaatgacactctgttggagatgctctaaagcaatatgcacccaaacatgttgtctccaactctattggagagaggtgagcccctgttgtcatgtctgccctagacttaagaaatttcacagttttcccccgaatatgaacccaagagtaggaatctttgttttcttttacttttttttaaattaatacagatataaatttataaacaaatatacatgtatataaaaattttatatacgtataaattttatattcatacgttatacatataaactttataaatatacctataaaagagctttgtatttataaactttatatgtatatttcttaattggctaatataaaataggcaaattttgctatagaacattgtgccttcacggttttagctgtaggacaccgtacgagtgacttttgagggaagacactcttaaaagttagatatttatgggtggacatgacacctattaaaataataatttccaactaaagaggagagagaaattgcgtgaaatgtcaaaaataatagtggacccacatgttagctctcccatgagatagacagaagagacatgagaggtgacatatgggtcctgtggtatttttgatatttcacgtgatttctctctctttttcggctggagtttattactttaataggtgtggtgtccaacatcaaatacctaaactgtgaagtcacgatgtcttgtagcaaaatttgctaataaaatatatacactcaaatgtgcataaagttttcatgtatatatgttttgaatttgtttcaaaacttatacttttgtatatatgttacttacggtacatctagaacgattgagagatagaagatatccagccgcgagccaggagcgaggcaggtggggcgagcgcgccgcgcattagagcagctacaatagtggactacaagccagctataaacatattttaaggatataaaataggagagaagagcacatgtgtgtatgacatgtgggaccagatactaattgtgtagtacatgtgtataggtaactattgtatgaattatctataaaattgactatagatgatttagagatagtagttggctatactgttgtcgaatgacaactacgtcacgtcgaacaacgtggaacttggatggatgttttgaacagtaaagtgatgtattgtcttaataaaatttttgggatccctccattacatagccctagggggctatttatagccttagtattggcttacaccttatagggtttatgttgtatggggaaatttacatggttactcttatgatagggacgttaacatgggtacacagtgtcttttgcatctatgggctctaatgggccacttaggccggtctggcccatggctaacgggtccccatgggcctgtcagccctctagttctcctttacataagactccagcttgggtgaaacctttgtgcttcgcgacatggccttcgccattcgcctttcgcccatgtggccctctagagccgagcctttggtcttcgcccacacgcttcgtcacatggccttcgccatgtaccttcgccttggtcgaagccgacgcctctggtttgatccttcgtcggatggatggtttcggcagggttggtcgaaggctctcgtgtcatgcctccaacatatactattaaacttgctcttaggcgttgggatgggctgttgtcattgatggcgattagcatggtggctccgcgcagattatagggttagcacggttatacttttttctcaaataatagcacatatattttcaccttatatgtaaaaaaaatattaaaatggcggccaaattttaaactttggcttccaaaccggcaaatgtcacatattctgaccggtatagtaattcatatgccgataaatcaaacatcatgaatcatttactatattttattaataatacaataaatcaaagatactaatatgtgttatatttgttttctcttctcccctcatctttatctttgtactattggttgtaatttcgagaatgattaaactcggtcgctcggtgcagagggagccggatcgggcgctccccccgcgcacccctccctccatgtgctgcatgcagatcctgggccccaccacgtctatgctcctatctgccattgcaacaaatcacccacatattttggaacccctctattaagggaattcggtttattttttgttccaccaaaaatgtttcacctagtgtattcacaatgtttcactatgtatagatctaatgttgcagtgaactaaaatactccattgcaacaaaaaaaacccacatattttggaaacccgctattaagggaattcggtttattttttgttctactgaaaaatgtttcacctagtgtacttataatgtttcactatgtatggatcaaatgtaacagtgaactgaaacattctttcgctatttgctgaaacattatttctatataagttgaaacaatacccgatttaaacgagtgaaacattttcgatctatttagtgaaacaattccgatatacctggtaggacatcgtgcaacatttaaaaataattcaataaaaagctaaaaaaaatttcgtcggaatatatccatgtgtggtcttgttttgaagatttaattgcaacgaatttaatggtgcaatcggatcatgatttggatataagtagtttaagagaaaaatcagtttaaagtagtttttacacgtaaatctggtgctgacgtcaacgcccgatttttcttcaaatcgatcgggcacccgagccgtagactcatccttgtaatttcttattatttaatgatattctttcacctattaaagatggcatattgcagcaacagagagaatagggataagtaatgtgtccatactggtagattgtatccaatattaggtagtaattatttttcttgcaaaaggacgcgcctacggatcggtcgcccgatctggggctggggaaatcgggcgctgacatcgacgtcagcgcccgatttacgtgcaaaactactttaaactgatttttctcctaaattacttatccaaatcatgatctgattgcaccattaaattcgttgtaattaaatcttcaaaacaagaccacacatggatatattccgacgaaaaaaataagcttattattaaattatttttaaatgttgcacgatattccaccaggtatatcggaattgtttcactaagtagatcgaaaatgtttcactcgtttaaatcaggtgttgtttcaccttatataaaaacaatgttttaacaaatagtgaaagaatgtttcagttcactgcaacattagatctatacatagtgaaacattgtgagtagactatgtgaaacattttttggtggaacaacaaataaaccaaattcccttaatagggggtttccaaaatttgtggtttttttgttgcaatgaaatgcttcgttcactgcaacattagatctatacatagtgaaacattgtgagtacactaggtaaaacatttttggtcgaacaaaaaataaaccaaattccctttgtagagagtttccaaaatatgtgggtttttttttgcaaaagaatattttaattcactgcaatattagatctacaaatagggaaacattgtaagtacactaggtgaaacatcttttgtggaaaaaatgggagggagaagtaggtgggtccagcagatacgcacatggggagaggggcgcgcgtagggagcgcccgatccggctcccccgcgccggtcacccggagtagagcattatcgaaaagattcgtccatgcatatgtccaatcggacatcacatgtatataacatgatttatctattatatactaaaagtccattaaatttcctgtcagggttatggataccacatacctactagtagtcgactacatctcggcaagacccaccacataccatgtcttatacggaactgacttcggatatggagggagttccagataaggaaagacaaccaaagttctacatggaaacgacaagtactcagattgtatccatattggtttccctagttctatttggacaaggggacacctatgggtataaatataaggccccctaggaggagaggggacacgaccacctcaatcaacacccaccacaatctacggaacaacagaagccacaacatacaagcctacatacggcaagacaagacgccggatatcgacttcagggataagcacggctagtctcctatggtgtctccggatactatcaggagagacgaaagcattatctctgatctcgctgggtacatattcgaggaggaagactaccctattgtcgactacgagtcagaccttcagaccgccatgtcgacaatagttagataggttacctcacatattgtactggtgtgattatggtgaataagagcaatatcggctccggccaacaggatgtagggttattacctgacaattcaggggcccgaacctgtataaaaatcctcgtctccgtctcttttacctcagtctcgcgtatatcctagtaccaatgatccccataccatgcaaataccggaatcgcgacatcaaacgtcgacagtggcgcgccaggtagggggactttggtgcttcaggatttcaacgagatgggttcaatagatggattctccaacaacaatctattcgacaactttggctgtggggagatctaacccgaccgaagtatatcccccaacgagatcggaatcatcgccatcaactagtcgatccggccagatcgatcaaattccaagatatcgtcgccgcggagtcaacccaatattaagttgctgatcaagccctccgcctgcgacatcagctagtacggctggtgtacaagcgtcagggattcatctgtacctgtgccccttgtgttgccgtgttctgctcggagttggtcaactggagtgtgcttgcttaatcatgtctcgtgcacaattatgggcacacacggccatactactacaggtcagcacgctcccagtcatatgtggactcacgtcctaatccactaaatgcatgggacttctaccagagatgttcggcataaaaaacaaagtaattagtagattaatttaaaaaattgatctactaattttgtagatatatacagcatatatctacacaggtacgcaataatctatatacaatttaccgtacctattttttctaatctatacaatattggcagatcattaatttattatgtttagctagagcgtgtttttatacaatatctattgtgcgagtgcttccgatgttaggccaactacggtctaacgctgggggctcgctctgttctcttctgtatgaatcattcttgtttacggtctacataatgcctgatatttacatctgctcgttatatcctgataataatagaagattcattcagttttttgagtacatactcgatattctctgctatatatctcgcattctagaaaatatttttcaggaacaattgagcactcgagtaggttgtggtcgagcacaccccattatcgagaacgatctcgacaaatgcagagtcgtcgcccccgacctaccaatgacctatctcatagcaccggccatggctggactattcgagaaaaggtggttaacggatacttcctcgcgaatgttgtcggcttgatcacccgacatgattgtgaacgaacatccggatatgctataaggtgggtatgtgagtcatgctggccacatgagatgcacatgtaataacccaactctagctcttccattggtgttcgagagataattctactcgctcgctggttcccgaaccagtacgtagcaatctctcgcaccgcaacctccattggtgttcgagagataattctactcgctcgctggttcccgaaccagtacgtagcaatctctcgcaccgcagcttccattggtgttcgagagataattctactcgctcgctggttcccaaaccagtatgtagcaatctctcgcaatcgcaccttccattggtgttcgagagataattctactcgctcgctggttctcgaactagtaaaaagtagcaatctctcgcaccttaacttcagatggtcgaggtacgactacagcaatagcgtagcggtcctcgcaccatgacttcggatggttgaggaacaactacgactggtcttcgaccggcagcgtagcggccctcacaccatgacttcagatggttgaggaacaactatgactggtcttcgaccggcagcgtagcggtcctcgtaccacgactccaaatgatcgagagacatctacttactggttctcaaccagttaatcgtagcgatctctcgtacatttacttctagtggtcgagttatgactactacctggttctcgaccaacggtgtagcgattctcccactatttccacttcaagtggtcgagttacgactactacctggtcctcgaccagaggtgtagcgattctcccactacctctacctcaacaaagttgatatcaggtacacaataatgccaagtgttttacccagagatcccttaccacgacgacacctagcgttgaaacctatgctattgtccctttacgccgtcttgacaaggcctccgaggaacctaagggatcttcggctgggaacgcccagagccgataaggccttgtcagatcctgtagagacaaaagaccatgtaagatctggtcgtgtaagagttctcgccgtgcgtattaaccaagccgtgtaatcggaaattgagttttccaacttcacggctcggggctaggatcagtgcttgttcaaccaaggcaggtcaagggtccaagagccttatcctccgagaacgattctccaacgagaaggctgggggctagggagagtgtatgactctacaaactgactgatcgaagtcggtaagagagaagacgctcatacacaa

SEQ ID NO: 33720 - DNA, 5186 bp, Oryza sativa
  unsure (1)..(5186): unsure at all n locations
nnnnnnnnnnnnnnnnnnnnnnnnnnnnnnnnnnnnnnnnnnnnnnnnnnnnaaaattctattcggcattgttgaagtctccatgtctctatggttctataccaagatcgactaaggcgagtacgaccaatgttgataaggctccgtcgcagactctgcgccttctcgatcactcgagaacagttggtggatctcgacaaggaatacagactgaagagatggtgtacccgccgagataaaatttcttgacttcaatccaaattctcgattacagcaagacgggagacttagttgtatgctctgtactttcttggttgacgtcggagattgactcagacaaaccctttaggtacccgcacgaggctgataaagcaagtctaacgttatctctgaactcaccgagaacggtcacttgagctcgataacagttactccatggttagcggccgagaatatgaattcgttcatttgcattgaagtcggggctactgtcagggttatggatactacatacctactagtagtcgactacatctcggcaggacccaccacgtaccatgtcttatacggaaactgacttcggatatggagggagttccagataaggaaagacaaccagagttctacatggaaacgataagtactcggattgtatccatattggtttccctagttctatttagacaaggggacacctatgggtataaatacaagaccccctaggaggagaggggacacgaccacctcaatcaacacccaccacaatctacggaacaacagaagccaaaacatacaagcctacatacggcaagacaaaacgccggatatcgacttcagggataagcacggctagtcccctatggtgtctccggatactatcaggagagacgaaagcgttatctctgatctcgctgggcatggattcgaggaggaagactaccctattgtcgactacgagtcagaccttcagaccgtcatgtcgacaacagttagataggttacctcacatattgtactggtgtaattatggtgaataagagcaatatcggcttcggctaacaggatgtagggttattacctgacaattcaggggcccgaacctgtataaaaatcctcgtctccgtctcttttacctcagtctcgcgtatatcctagtaccaacgatccccatacaatacaaataccggaatcgcgacatcaaacgtcgacacttcctacaaacgctctcaagccgccatgtataactcctataaatgcttctaagtcgccacatagcgttttaataaatttaaggaatatctaataattcttaaaaaggaaaaccatagagtggacccactttaaatccgtattgtgtatcaccagtgcacgttgtgtgcacgtatgtatgccaagtatatcctttccttactcctcttcatgctatattatgtagaaaatacataatacatcattagatcattagattatttaccacaaaatttatagttcaagacccaaactaactatatttagtaaaagaaataaaacacatttatacggaaaatcatatagatattttaacaatctatttaacaacacatatattttaatagaacaatatgcaataataaacaattttaattagaaaatagatatttaataagtacataactttgggttgggtcattattatgtttgtaaatatagataactcaagttggtgaaaccattgaatctatctcaaaggaagcaaaactcctctcctcctaatgtcagacgtacatgtgcacgtctcctggaagcaagatcacgatatatacatatatctaatctatctttattgatccatatataaatatatgtataacaaattatgttaatatgaaccaattaaaaggagggctagcttaatggtccattattaacaataatattttttaagatttgttaaaaaaaagtcccaaaacattcaatttaaaaagaaaaagcatcgtatttttaatttgaacttttagacatattttctaaataaactaagtctacctcctttttaaatgatgaagaagaaaataataattacttatagagatgaattaaatattacgtagtatgaagataacaaatacctaataaaaattatttaagcaaagctagcaaataaatttatgaagaaaacgtacttctaaagcttggcaagtgttatatggttgattttcaatccttaagtttttcaaatacatgcttatgatatacatgcccgcgtgaatacgcgggctaccatccttgtttttctaaaaagaaaaaaaagaaagagtccttatctgctttgaattctcatattttttattttactagaaaaaaatacacgtgcgttgcagcgggtgaaagctattttaattttattgttcttatacggtctagttaaggtgaaactcgctgtagaagttcacttagatatatattttattagaaattcataagctgcaattaaaagtccgatcgttttaagttagcatgagagtttttttaaagagaattcttatacgactctttctatattttcaaaaacgaacgaacttaaacccgacttaaaaacaatatgtattttcaaaagtgatcaaacttaattttgtatttccaaaatcgactcatacatggatgacttaccaaagtgccggcaaaaatatttttaatttttataatagtagatactttaagtaatgtgagaatttctaaactttaataagttaatagattggcaacgatgttatcgtgtctgcctataggaggaggtgaacagcggcgaatgctcattttctattcatcctccgccactatcggcgatgctatcgttctgtatgccacgccaagctatcgtggtatggcggtgacggtggacagacgacgatgacaccagcggatggacggacggcgcgtcttaagcagacaaacggaatggcagtttggcaccgaactacagtaagaaattcgcatgccggtgtaattgggaaaggcgcgcaaattactagatgacgaataaaaggtgtccgtatttaatgtcaaattatgaaatttatcccgagagcgacacccaaaggtggcaggccgcagcccgcaggcgtggtccctggctggtttagttgatatattttttattcaaaactaaaatttgaaatcaacgagttcaaagataacattgttttgtgactttgattaaattaaatcaatcaaataattatatatggatatgatatttgtgccgtgctcttgataaattaattaatttttatttgtgtgcatagataaagactcgtaatagcgcttaaggggtcattttggattgatgccaaaatatgcgctactaattgtttggcaattgaaatagtagtttgattggtttggattagagccgaagcattggcaatacacatacataatttggtagcactctaaaactttcttcactgtaacaagcattttggtaacaaatggtagcaaaccaaacacatattatatgaattctatcctaccaaagaattggaagtgccaaaatttacctaaatttgtgcactaccattaaatcgataggatagagaaccaaatagacccaagattttgtgttgaaatcctaaaatcataggtttgccactacggttaagcaagtattaattataagaagtgtgatctagttatagatggccaaaaggcccgccctgcatggcccggcccaggcacggccggcacttcgtgccgggccgtgccggcccatgggctgcgcctcccgcccaggcacggcccaccagccgtcgggctgtgtcgggccagcccgaaggcgcgggtggcccatcgtgccttttttaaataagtctattttttgtccctcctgtttgggctgtgacatatatatagcgaaaataagtctattttccgtccctccaatttagactgtgacatatatatagtgaaatactacctctgtcccagaatacttgtcattctaggttgtttagcatgtgctaaggttagaagaaaaagactataatacccttaataaaatattatatagttagatgttgaatggtggttgggggtatgatggagacaaatttgaatttgaagtggttgatgtgacaagtactacttgcaagtgacaactattttggggtgacgctaatgggcgactaatcgcgcgcacctccaggcgcgcgaccactactagtactaaggtacttctactactagtcctcctaatcgcacgccccaggactccagggctgtgtttagttcagcgcaaagtttgaattttggttgaaattggagatgatgtgattgaaaagttgtgtgtgtatgacaggttgatgggatggaaaaggactgaagtttggatcaaactttgaatctaatcacaacctaggagtagtactaccatcttaatctaagcactactactactagactacaattactactcatacagtgatactactacctattactagtagtagtaagtaatactactagtactactattctactactactataaaaaaatatacatgtataaaaatcctaaaaaatacgtatatataacctaaaaaatacgtgcatataaactttatatatgtgtatacaaactttgtatacgtatgtataaaaacctaaaaaaaatacatgtatacaaactttatatatgtgtatacaaaattggtatatgtacatataaaaacaaaaaaaatacacgtatataaagtttacatacgcatatacaaagtttgcatacgcgtatacaaagtttgcatacacgtatacaaactttatatacgcgtatacaaagtttgcatacatacatatttatacagaaaaaagatacggaaaagaaaaaacggatattatggaataaaaacagaaaaagaaaaagagagaaaccgagaaaaacaaaaaaaaaagggaaaacacggagctcctctcgcgcggcgcgccgtcgccgccccctctccgcgcgcgccacgtgtccagtcgcacggagaggggtgcgcgcgaccgatcgccaaatagcaatttcgcctattttgggacaaattttaaatgcgaaagagacaagtattgtgggacggaggaagtaagtctattttccgcccctcctctttgggctgacatatatatatataggtaaaataagtctattttacgtccctattctttcg

SEQ ID NO: 33721 - DNA, 25576 bp, Oryza sativa
aaaataagtctattttacgtccctattctttcgaccgtggcaaataatatgtctatttttactccctattgtttatgtgtcgggcctggcctgcggcccatcgtgccagtggagaggcccaggcacggcccggtggtcgggccgggccggcacgggcccgacccttgacgggccgtgccgtgcttgggccaggccaaaacaccgtgccgtgggccgggtcgtcgggcctcgggccttttggccatctattgatctagttgtactaccctgcggtcagtgcaatatacactctatgtaaaaacgttcggttaaggtagtaggtaggtacctcttattttgcaggtggttcttcagccctttgatgagttgttcctgggacatggtttcaatctttgcgtgtctgcttcctcctcgtcgcctgcggtcgccaccaccactggcagtggcaggcagcatgacctgactcaggatgctcctgaggaccgcacggtcgtcaaacttctggggcatcgtcacccacgctcggcagtcgaaattttggccatgcttccggtacagcgccgccgcgattgtgctcttgcccccgccaccaaacccatggatggctagcacaccgcggttcttgtgactttggcttttcatccacgcctcgagtttctcgatggcgcgcgccacgccgatgggctcctttacggttatgagccggcgcccggccacctggttctctcccgtggtctggtcaccattgcgggtctcgccgcgctgagggggaatcgggttgaggacgacgccgtatcgcaagcgccgctcgcccacttgctgagcacggttcttgagctcggcgagcttggcggcgatgtcacagcgaggcctgcaggtgtagatctcgtacagcgccctgtacacctcgacgaggcatccgtccccgcggggatcgtgacggagacggtgggcgaagtcgtcgacgcagtcctccatgtcgtaggcgatgtcgcggacctgcttcatccagtccttggtctgcgcgtcgtggccgtcgtcgttgccagagctgctgagattggtgaggaaggcgtggatgctggccatctcgtcgctgatgtactggatgtcgccgcggacacccctgatgagcgcgtactcctgggcgaggaggtttcccaacttgcccaggagggccttcatggtggcctccgaagcgcctaccaccaactccatcgtctagctcgaacctcttgatttctctgtgcctgatctttcaccttcttggcaaatctctcgtattttgtttgggaatgtgctgaatgaggtatggagtttattcctagagaggtctaccagctgttcggaagtaaacaaacatgaaacatgatagtctctcaacaaactacatacgggatcggaggagcatcaatagagagcgtggtcttaacgcgttacaccttagtgtcctctctccctttaactttcccccatattccacacccatgtgggcataaaagaccaacccggaagatgtgacttttgtccagcttggttcagatcacataaaaagaccatctataagacgtactattaaataccgcccctagcgcccccttcccttttctcattttttcatcatttccacgaatcctagcacaggaggtatttgttcatgtggcatactgctccggtctccgttcaccagcaagttggattttatcgtcttgttcttggcaatggtacggtacggtatggatcagtttcatcagcagcaggcagccaggcacttgctctctcgccggcaagccacttttgcatcttctcttgcgccacggattacatgcaccttctcctgctcaaattggaatttagagtttgctcagatcctttgacaaattatagttgagtttgatcagatcctcagaggacaaagtgtattaacggaaattttcagttgatgatgctttttttcagcacctcgatggtgttcattttgtagctttggctgcccgggatccgctccgggtggatagctaatatagctccagcatcctgagggagaggcggtagtagtactcgttcgtcgccggcggcggctatgtcgtggtcggaattaagatcgatgcagatgaaccagcaaaagttggacagcgttttggttcgtatagtacatgcaggcgggcatcggcattccgatgtaacggatcggactacgagaccagatgtgccacgcgatggagctacttgtcggggagaaggtacgacgtcaagagggaattggggctggaacttgtgttggttaattttatcggagcccacgagtcggatgtagagcatctccagcagggatctcaaacctagcccctaaacagtatttgagggttaagataaaataactagatccagcagggatcctattagagcccccaaagtgaagaggccctcaaatcctgccctcaagccctaagttctgggggctcggagcacagcctccatcgatgttttttcttgcgcggaacaatttcactccgccgctctcatcttctacccgcgcgtactggttctccttcggcagccgccatcgacatcccttgcactttcagcaaggttgcccccaaagggtgagattttccctacctccgttgcccgtcattgcaaagactccgaccgtcgccctcctgccatccgactagacacacgccgccatctgcacgccatcccgttgtcctccagcgccgccgtccacacgccacccgtcgtcggcctgcacacctcccatccgcacaccacccgcacgccctccgtcctcccgccgtttgctgcctccacgccgcccctcatgccccctgcagtccgcctaccccccacgccctccacctgcaagccgccctcctgccgcacaacagcacgccctctgcccgcacctgcgttacctctgcacgcaggcgaaagggctgccacctgcacaccgccctccgtccccctgtcgatttatctgaagaactgcgctgctgctgctgcttcttgtaggcaccatgcggctatagtgaagtgaagtagtagtacttgtggttgtagtggacaactgaacattgattttattcagtgaacagcagtacagcacttcattatattggagtactacatgtagcattgaatttgaattgtgatgtttcaaattgtaaatctaaatataattgaatttcatgctctagaaatatttatgttttaattatcatggtcttaaactatgcatgaacataaacataaacataaagtctatcttaaaatagaagagaaaagtaaataggggctgagaaataagggttgctgctagagttgaatgaaattttgagatcctaaagaattaggggcagccctcttttttcctttaggggctctaaaataggtggtattactggagatgctagataaagagagaaattagtttttgcgattggataaaattaattttgactcctagtataggagatgagctcctgtacaccaccagtgctatataaagatgacttcgcagagaggagaggacgctctaatatctcaccaaaaccctaagacctaatagccactaatcggcaattgcactagaaggcactcgagacgctgtctctcaggccagattcttgtaatttagaactccaatattgtggtatcatagtagcataatcaatcccttattgatcacatcatccctgttagaagccatctaagcaatttaaaattcaattatgtttcggtttgttttagttagatcaaaattagggtttcaagtactactgttttgcatattcaattttcaagttatttaatcttctgcttagaagaagggaataaggcaattcaatctatgccaaaatccacaataagccggattgaatcaaaaccccaattccccgaaatccccaagactcaagaaccctaattcggcctaaagatccaaaatcccaatttttggtgaatcaaaattaattttaagttcaggttatttaccggattcaaaacccaaagctcgccggatctatatggcctcctcaggagtggagttttccccaccgttctcgccgggaatgggaagcgttggcttggcgttgcttatgctccgggccctaccgacgatacccagagccgcttggcgcccgctgttgcttgcatcctcacgcttcgccggaccaccgaagccgtggaacggcttggtgccgcccttaggcgtgacccctccgatgaagatggaaccgcaccacacgacgcttgtcgccgtgcgcgcgcttcacatcgccggtcgctgtcagcgctattgccactgtccgctctcacgcatcaccgggggaaggggatcggggagagaaggggagataattgaaattagggttagggttctcaccataaccacccaccggtggttactacgacgtggagacgatccgtgccatccatcagatcggatggctcagatcatccctgcgtcgggccatcgtcataatgggccaaggttgtgggcgacatgcctcttgccccgcgcattcgcagaaatgtgtcggcccgattttgtgtcgattctggaagaaattgggccaaaattagaagtttaatttcaatcccatcaaattagatgtttaattttgtttatactttttcttagcttaattaaattgctaaaagtattatttgattaataagtaaattatttttggttaaatggaaccaacgagaagtttaactagaaagagtaatgatatgaaattattttttgaccaatgtgttagggttatggataccacatacccaatagtaatcgactaagctcggcggggtccactgcataccaagtcttatacagaatcaaacctcgtatatagaaggagtttcggataaagaagaacaagaaaagttctacatggaaacgacaaggattactcggattgtatccatattgatctccctagctagttccacttggacaaggggacacctatgggtataaatacaaacccccctgggaggagaggggataagccacaagacacaacatatacacaagccaacactcgttgccacatattgacatcaaagattagcctagacataccctatccggtgcctacggaggccggcaagaggaatctagcgccatctctgatcttgacgagttcatattcgaggaggaagactaccctatcatcaactacgagttggatattcatgccgccaagtcgacgatagctagataagttatcccaaatattgtacttgtgtgatccagaggaataagaggaacaccggctttggctaacaggagtagagctatttcctgtcagataagggggcccgaacctgtataaaaatccttgtctccatctcttttacctcaatctcgcatataccatggtccaacgatccccataccatgcaaataccatagtcgagatctcaaccgtcgacacaatattattataaattcatgtcaaatatatttattatattatcccttagtattttctgcccaacggtgatataattaaggaattaactttaaatattgttttatggttatttctgctcaacagtgttttgtctatgaaaattctatatttaattcgcacgtaatagattaagccaatttaaatcaattatatgcattattaatattttaaatgtttatgtttagcaatgggacattataagactgttgttccctttgatggatctaattacacttaaaggaagaacattatgcttctaaacttagccttgttggatgctagtatttcttacgttcacatataaaatccgcaagcgcacaaatataccgttgtagcactttatccggaagtattccaaggtattgaatttccacattgaacgtgtgtatttaactcttcttcatgttcatccaaggacacaagataaatgttgaccaaaggggaaagaagattatctaatgtggtacatgatcatttagaaagcttaactttaatctaatcgctatgcttcaggcacttgcttgcttgctattattagaacgcactctactccgtagccggatagggaggactacggtgatctcgagggttattaacacctctaacgtattgtgggatacgcagcaaacactgggaattaactacataaacaccatgtctatgcaattaattactactctagcgttaactaaacactaaaataatcactatttcttaatgaacaatactgaacaatgatccaacaagctaaatataactaacaaagaagtataccacacaagataaatcttaattacttaattaaaatattctcaactagagcaaagtaattgctatggtacaaaagaaatagagagataccgacaattccggaactcctccaactctttcttcctcactctctcccttattctaagtataaaaaaagaatacaaagagcctcttataattcagctcatatcttggtgtgtattgaaatgaaggaggagaaggccttttatagcttcctgaaggcggttggagcatgggaaccggccacaaccgccgtaggaaggtcggcagtaactaccaaaggcggttttggctgggctgggctaagcctagatcggttggccgacacctagctgcccctctagcccactccttcctcctgggccctagcatgtgggtccttattctattggcatggtggttaattgggtccagttgcaggtatttcgttaggtttatgggcacaagactccccagcatgctaaactctgggtgctacaaaaaaaaatgagtatgttggaatgtttgtaggggtgtcaaagtctcatctagttactttgcaaacattaagaaactagttaacatgaaaataagaggttggtgaatgaatgtgaattgattgaaatttttgtgattatatgagaaattggtagatcttgccttttttttattgccaatatataagtgctggtttttattacaaaccggcacctatagtcattgtcatgtgaccaggccggtcaaaaaccgacacatatatactacttataggtgccggttgtttaaaagaaccaccacctacatggatagccatgtggcatcttagtttataaccgacaactatactaccatgtaggtgccgattattttctaaaccaacacctatatgtctgataggtgcctgttctacaacaggtaccgatgaccagagacatcaggaccaactactaggtgcccgttagtaaatccggtacctaaaggggttttcctacttgcaccaaagagcttttctttagtagtgcacaattcacatggaggatatatatagacgccaccgatagtgtctgcctttgttgagagtataccctgaccggttgttgtagagagcatgcaattataacatgcagctctccttgatttataagactgcctgtgactatttcctaaccacactttgataaagaacccaagttcgtctttaaaaaatatttcaggtagcaagtgggatttgagaaaactatagaatgatggcggcagcacacaaatttcagccttttcccttgtttccattcatgcttggctaaagcttaggctagctttaacgattattttcaaacatcttctttctttgtagggactcgtgaatctacgcaataaaaaaatcacaagacctaaagacgggtacatgtcgccagaaaccttaactatgaccaaaatttgattttgaccacccaacgatgaaatggttcgctattgcctattggtccctcaactatcaaaacagttcatatttcattccttggtctgaaccgtgctgattttttatatttatggcattgtgtctacatggagcttacttagatgagctgtgatgacaccattgtccctgtcaataataaaccaaaacaaaataacgaaaatgcaagaaaccacatgtagcatccttgcttccttttcctctcgctcgcatcctacatatcttttgttattttgacttgtcaaccaggtgtgccacgtggtgccatgtcatcgaaaaacgattgcaagagtttgaaggaactatagtaaccgattcctgtgagggaaaacattagaatgaggtgatcttaatgtgaaaacagaagcaggatgaaaataattaaagctacctagttgtgttgcaacccggtaaacaagctgcagcagggtcgtaaacgtacgtgtctcagaaagtaaacggccatatgtcagtgactgtacaatatatgtccataatgctagctaacgacgtgactctaggatcgtacaagaccaaataaacctaccagaaaaaggtgaatggtaggaaaaaccaaaaacccaaatatcttttgcgtacttaaagattaccctcaaaagaagtcgatgacgaagccctgtcgccgctggtcgaaccacccacttgccgccggtcagactgccgaagcctcgccggtcagaccacccgaatacctgcggtcagaccgccgctatcccaacggtcagaccgtgcgcacaccagcggttagactgtcgggatccagaaacacaggtagatgacaaactcaaatatgtagattgaaacatttcgactttattacatcaactagtgtttacaaagtgcacaaacatcactcctcaccaaaatctcgaactaaactcgaaaccctaactttctctcaactctagtctctctacaaccgatactaggaggcctcaccctccctctctatttatacatgaggtaggctgtacaaagcccacgaatgtaacataacttaggactcctaacccacgtaggaaaccctctcctgcagatatacaactcatctctttccttatctcaatcaaacttcccgaattcggactcccttccaaattcgactcctctttccatacgtacacaattcctcttgtatactatatggatttcttcatcaccacgtatattgttctctagcctttagtattccgcatgatctcctaatccctggtatcaacttctcccaagttgactccgatctatcaccggcaacactctcgtgaggcctcaagcaacacctgcacatacaacaaccaagaaaccatattccgagcccaagttcgtcccaacttgactcacattagtataacaacagtaaccatacgcatagaaaccatctagaagccaaatccccgaaggaaatatccaaatccaacaaaacaacccgaaaccgaacacgatcaggatcctaccggtcagaccgtcgagccggccggtctgaccgccgcaacaccggcggtctgaccggcggcactcagccggtccgaccgccagggtcaaccgaaaacatccacttcacaaaatcaatcgtcttataaaatctccaacttaacattagcaaaccatcaatattttcaacacaaaacctaaatcaactccttaattttacagtgaccacggtgctaaagtgctaattccatgtgccaactaactccaccgatgctagaatagatatatagttgaaccatgcaacatgtagcttgctttcacgattaatactagttccagtgctctactaagtacattttcgttgaactaaataagctgacacattgtatttgtagtgatgtgacaaaaaaaattaggaggaaatagaacaaaatgtttctactcaacatccagtgatccagaacatattgagagattagtggtattaaatcaacatgttgaattaatattgtgtgcattagaggagttggattgggtttaatactagtttctaagttagagcggagaatatagaaaccacagatatcattgtcttgcctgtagaatgcttggacggttggaccggttattccggagtgcaggcaataacaacatccagctcagcatgatgtatggggcataacgcaccacaaaacaaatgcaaaagctaaagaaagacagagcgcgcctagactatttgctaacaactttgatgcatgtagaacccaagttcatcttttaataataatcttgcagcaagtggcatttgagaaagctctagaacgattatgatagctagcacaaatttcaggcgccgtttccctaattccctccaaatcttggcacgttactgctttatttgtaagctttatagatcactttcaaaatcttctttcaatgtaggatctcgtgaatctatgcactataaaaaaaattcaagactacgggaacatgtcaccggatacaccgagaaatgcaaatttagtttctatcgatttgtcccaaatgcatgttcttttatcatcaagaaaagttcacatttgattcataattatagccaaggttagattttagttacttgatcacgaaaacgttcacaatttgtccctcatctctcagaataattcatgtttcatccttttccgtccaaaccagggtgatgatgtattatgacatctaatctacatggagcctacttagacgattgggatgacaccatcgccacacatattgcatttggctccctcggcgggacgggttacacaagagggcgggcaggaacactgtcagggaagctgatgaaggaggtgtgcactgtggtgaagccgacggaagtgtgcacataagagatgcttcgaatagagacagaggtcttgggtttgaatcaagcttggcacatttcatgaatatgggttgaaaagaattatgtgacttgtgataagtgaaatgtgatgtggtaggtgcctaataaaatgtgaaatattttttttgattttttcacatctgcaaatgtaaaaaatggattcaccctacaagtgtcggttctaaataaaaaccggcaccataccggtaccaatgattacctccattagtgtcgctaaattggtacaagtttgaaaactgacacctatgagaggtttagaacgggcaccaataaaggcaggttttttctactagtgaatgtttctactcaacacccggaacacagtgagagattagttgtattaaatcaacatgttgaattaatattgtgtgcattaggggagttgggtctaatactagtacgtttccacagatatcattgtcttgcctggagaatgcggaccggttgttccgagtgcaaagcaacaacaacatccagctctcagcgtgatttatggggcataccgcaccacaaaacaaatgcaaaaagctaaagaaagagacagcctagactatttgctgacaactttgatgcatgcataacccaagttgatctttaaataatcttgcagcaaatggcatttgagaaagctctagaacgatgatgacagctagcacaaatttcagccgtttcccttctctccaaatcttggcacgttactgctttatttgtaaactttaaagatcactttcaaatcttctttcaatgtaggacctcgtgaatctatgcactataaaaaaaggggcattttcatggtccttaagaagctatcacgaggtaccaaaaatttagcgtaaaatttggtacctcatagtatctaagtaccaagaggtactaagtaccaagaggtaccaaaattacaatagaaaaagtggtacctcatagtatcttctcaaggaccgtaaaaatgcttaaaaaaaactcaagactacgggaacatgtcaccggatacaccaagatatgcaaaattagtttcgatcgatttctcccaaatgaatattcttttatcatcaagataagttcacatttgattcataactatagccaaggttggattttagttacttgctcacgaaaacgttcactattagtccctcatttctcagacgattttttatgatatcctcttccgtccaaaccacggtgattttttttatgacatcgaatctatatggagcctaattagacgattgggatcacaccatcgtcacacatattgcattcggccccctcggcgggaggacgggttgcacaagagagcgggcaggaacactggtggtgaagctgatgaaagaggtatgcatgaggtgaagccgacggaggtatgcacataagagatgcacgtgcattgatgaggacctggagctctgtcgtcggcggatctcacgacctgagctccagctaccagatctattatctataggacaggagaggaggacatccacacggccggatccatggtgctcgaccgccagcgctgcccctgagcatcaacggtgccaatcctaggtgaaggcgaggccgtctccacgttgcttgagcaatcgctggatccgccgtgctcaagcactggcttcgctggatgtggatggagccgacaacccgtccttttgtgcaacctgtcctccaaccgagggggccaaatgcaaaatgtatgctagcatggagcgtcatgtcggcaatcctacatgatcagacgaggtttgaacctgttgtggtaagactatggttctacatatgcattttacaagatcagtaagttaactgacaccaactcgcaattttaaagaccctgtcgtatatcattaacctaattcatttaatcgatgatggccacatgagtagataaaaaacaataaatgtaagttagtgggaaacaattcatcgtattatatactagtaataaaagattgtatttctaaagcacatgtaaaagtagtaaaaaaaaacatctagctggcaatcaatcttcctcttcttcttatctcattacaaatagaaaatactacctccatacattaacagaggaacattgtatgcaccaaatttcagttgaaagatatcccttataattgtggacggacgaatcagcatatatgcaggctataacccactctatcgtatctttcgaactacatatacagcacacagcccccgcagtctgcactcccaaaactcccaatcccggacagtgtcctagctagccacacgcccaaatttccccaaatcgatcacaccaaaggacgacgcatccactcaggtatttgtgtcggacttttgatttgttttccacttccagtgtggtttcttcctgatacgaggatgcatgtttctgcggttctagaattttgttttttgggcgatatatctccctcatcattttctacgaagaatatatgttttcgttcaatgaaagatctacttaatttttacacttgttatttgatctatttgtttgagctctcgaacacatttaatttgggccgatgcttgctcacttcactgagccctcgggcaaaatttggtcagcttagttcgttaaacttactacctgaccaagcgaatcaattgtatatatattgttagatggaatgatggatcaacagagctcaaacttaagaagatacagtttcttcactggaagattttcacataatgtacatccagatctggaaatactatatatttacagatgcaatgtatacctatatcatactatattagattaattatcagaaaatcattttctgacctccgggttgttcgtattgaaataagtaaatatcagtttactcggcgaatcatttggttgggtcagtaatggtctgttgtgtgtatcggctacgctacttttagctcaagaacttacttgctagataaagtagctagcttagctagctagttggcaatgcatgatatttcctagtttgttgcaggcacggactatggggaaattcagtattgaggcgttcatgcagcttggtgtttctgatgagatcaactggttaaagggcacggtgagctccatcaagaagacacttgcagatgctgactacagtgccctgaaagatgatacagtgaggtcttggtcgaggaagctgaaggatgtcatgtacgaggccgctgatattcttgatgtctgtgacgaaatggagggtgaagaacatggtggtcgctccaggaacagcccggtggccttatgcctaccgattcagggccacaaaatcaggcggcaagttaaggcactacgccagaaggcggatgcaattctggaggaggggaaaattttcgacctcactcatgtcagatctgatgaagatcacaacgtggatgctactactgcctgccatgttccgattccccgaactaatgttgtggggagggtgcaggagactagaatgctggttgataagcttacagggaaaggcatctcaggcccagggatgactggacaaaacgttgaagtcatcgcaattgtgggtatgggtggaattggcaagaccacccttgccagagaaattttcactaacgatatgatccaagggaagtttgacaagagactgtggatcactattagtaaaggtaataatagtattagtctattgcaacaggttatacaaggacttgggtgtgagcatgaaggtattcgtgatagcgcagtattggagcacatcatttccagtgaagtaagaagaaagaaagttttccttgtgatggatgatgtgtgggaagctagaggggtggtggacatttttaaaaaatcatttgtgggcaacgctcaagcaggcagccgaattctcatcacaacaagatctaaacaagtcgctcaagagatgcaagctgctatagtccacgaagtcagcaaactaagttctgaagattcgaggtcgctgtttcttcaggttagtaacataaaaattgatgcccaagaaaacatttcctcagttttctcatcaatacatgtcttatcatcactcctcgttcatacactttcgattcttgttacgatcataaaaaccggttcacaggaataacgtgtaccagcggtgatacttggggtatcactgtctattcttattacgatcattccggctcattacaagaactaattaacagtgatacttaaaacatcattgagctatgaattcacagtgacaagtatgtaggatcgcacaacaaaaccaaacctaccagagaaagatgaatggtaggaacatcaaaaaccaaatctttttacggaacttaaagattaccctcaaatacctgatgaagatgtattggtcagaccgccacctaaccgtcggttagaccaccgtgtcaccgccagtcagatcgctgccctgtcatcggttagaccgccaccaagcctccagtcagaccactcctctgtcttcagttaaaccgtcaagatccagaaagcacgtatcaacgaaactattgaatgtagatcaactttattgcatcaatatgtatttacaaagtgtatctaaatcactcctctctcaactcataaactagtattaaaacctctaagcgaaacctaacttttccctccaaaaagtcaataccttctagcctcaacccctcatttatttatacccacaacgtggcagcccctagccacccctagccacaaacccaatgtttgaggtatatcacaagggccttcaaccgaggctaccgaaattacatggaccagggtgaagcaccaaccgaagaatcaagttctcacattgggcgaacatcaggcgaagcaggaaggattcgccaagggtcttgacgccttcaccatagggccaaagcattgtaaggcctaaacaggttattcaccatatttgggcccattaaggggcctagagcaaaatagacactagttacccttataaatgttcccatcataagaggacccatgtaaattcccatgtactcattaactctagggtgcatgagcttatactaaagctataaatggccctcctaggggcatgtaatgggaggatccccaaaaattccatcattaatacatattgctttactattccactgtgtaaaccacgtccttcggcgtgcacggttgtctttcgacaacagctggtgccgtccgtagagaacccagggcgaaaccactgatgccacccaagaagtcgatgagagagagagttgtgcctaagggaaaggagggcgaaggcgaagcggagatggccggcgaagagtttgcgaggtccgaaatagtgttagagcaaccaagaggcgaagggggcggagggcaagaagggggcgaagtcatgcagacgatcgccataacccaagcagcaacttcgatcattcccacctcaactcaagctacaacgcaagctacgactcaagcaagcacaaaagccgaagcgtcaacggcacaaagggtagagatggaagctatgcgacaagacatgatgaggttgcaggacacgcttcgccaaatgcaagagcagcatcaagtatacgaagcagccctgcaaacctggtcaacctctttagcaagacccactccatcttcgatacccgcggcaaccactctagcgattcaagcttcgactcaagcaacgcaaccaagttcgactgttcaatcgatccaagcttcgtctcatgtggtgcagccgactgcgaccgtgcaagcgattcaagcttcgactcacgtggtgcagctgcttcgaccgtacaagtgcgacatatccctaaagcaacaatgttgcatgtacgtccgacggtcgccccgatcccgccgatgaggccaattcaggctccaacacctcaagctttggtggaggccgcttcggctctccaggcacaattccaagctttccttcaacaattgagtcaaccccacatgattccaagtgtaaccccttcggtccaaggcaatgggggatcgagccaggacgctatggcatggcagccgacgaaccagctccacatgtgcgcaccaacccaagcgccttcggcaaatcctcaaggaacaatggctggtcttggcagtattcgaaaagttgttcaaccaaacatcgtggctcagtcacatgacattagcttcgccatttgcacaaccatacctaggcctcacatcgcagtaccagcaaggcatggcgctgcgggcagagggtgacaaggtatggcgctgcgagaaatcatctgaatccccccccccctcccagttcaagtactcaccagtgacaaggtactcgggtgaaaccaatccaagcaagttcttgtcgatctatgagtcagcaatcgaagctgtccacggcgatgaaactaccatgtctaaggtaatacatcttgctttggacgggatcgcctggtcctggtattttaacatgcctccaagcagcatttacttatgggaacaattgcgtaatgtttctatcatgaacttcagagggacgtataaggagccaaaaaccaaaccagatttgttcggcattcggcagaagctaggcgaatctacaagtgagtacgctaggcgtttttcacaagcaaggtgccaagtgcaggaatgcaggatatcactgaggcctctgtgatcaatgccgcttcagcaggccttcgcccgagcaagctgacaagaaaaatcacaagaaaagagccccagattgtcaaacatctgttccacatcattgacggctatgcccgtggcgaagaagacaccaagcgaaggacccttcaccttcacatgcattgttctctagcctgagcatccctcaggatatccttgactacatagacctcaacttctcccaagcttagtctcgacccatcaccggctatactctcacggcctcaagtaacacatgcacataaacaacaaagaaactccatatctgagtacaagttcgcaccaatttgactcacttcagtacgcaatagtatcacatacgaatagaaaccatctaaaagtcatatacacgaagcaatctagatatacatgaagacagatatacaaacgcaatggcaagaaaaacactccccttttcaaaagaaagaatttcttgaatctcttcccctatatttgcaatcaaatcacaaaatcgacatatgatcaaaactactacctcaaacacaagcatatgaaaaaactaataaacgaggaagtagaaaaaaattatatcaattcaaaagtatattgatgttacccagaaaagcaattgccgtatcaacattgaatgcacatggggagtttgtcgccgaaatacctccaaacaagaacataccgaggcctccatgttggggttagaaacaagaaattttgaaatccaacaccgagtcacatgaccaatagaaccagtaggtacatatgcacgaataaaatcaaaaccagaattacctgaaaacttatcttaatgtttcacaaaagtctgatttgaattttgcatataatttgccgagactggtctgatcactgttctctagccagtctgatcaagcctggttgatctgacggactcgcccatgttagtctgaccatactcctctaaccaaaactcgatttttgccacctttgtttcgcataaaagcaatttctctttattttttctattacaagcaagtccaaaataaaaaccatccaaatatccatcttttccataaaaagaacaagtgtacttctcatgcaaaaaaattttttgaagttgatggtgtagaaattaatagttctgcaattaaagattttgtttcttgtattgttgaagaaagagatggcaaaatactaacagatttaaaaactgttttctctagttcagtttttttcaaagtttcacctttttaagttatactcaaaattgcaggttggtgacatgtataatagacattagtttcaaaacctacacaatgattataggtgtgcacttttgatttatcaaaatcatatgaaatttctttttaccagcagaatacatttccaaagtttttttttcaaataagaaactttttttgtcaaatttgcacaattttcgcaaccaaccaaaacacctttgttgttgtgacacttagaacgagaaagcacttcatgagttttcaaattgttttacaaaagctctataagggaaagtgcatcttttaatttcatctcattccaaacacacttcgagcaattttgagaatccaaaacatccttatgttgtttaatcatttttgcactcaaaaacattgaacaaagaacttacataaaaagcttatatttattcaaaactttccttatcaaaactaattcattaacaattcgagcatgcaaagcaaatctaagagcaaaagaagactcgagctttttccttttgtcaatcttagattccaatcttaagcaatgtgtagtattaacatctcttattcgtgaaatttcagaaaataaaacctcataacttttgcaattatcatcatcaggaagaagagattttaatctagcgacttcagcattaagagaatcaacaatgaaatcatgttgtttaagtttttctcgtattttttttattattggaatttagagaaaaagttattttcaagaaattctctttgggtggggggtcctttgcggtctgaatctgattccccacgagccataaagcgcacaccagagatctttcccttgtcattgtcatcgctttccgaatcaatatcacttgagcacacttgattacctcttttgatgttcctctcattattcaaagctagagataatttgttaataagcaaaaccacgtcctcctccgagattctctcaagatgaccattggacatgaccattgaagtgggcaaagcaaagatcaacaaagaatccaaataagaacttgatgacgagattaagggttccatcttttgtttacaaacttgaaaatatattccgtcaacaacatggaccttggtcgataatttttcagccatcgcaaaaactcaaagatcggtaaagaccacaaagagtaaacgtggctctgataccacttgtaggatcgcacaccaggaaccaagcctattagagaagggtgaatggtaacaacaccaaaaaccaaatctttttgcggaactaaaagattaaccactaatatgataacaattcggcccaggtagggttggccgaggcccaacaaattaaagttgcctagaccccaacagttcttaggcacacccactcggggaaaggcctaatctccctaaaagactagtccaataggggaagggtggcactcccttttaaggtggcttcctcctcccaagctaagcaaggtgggatcattcagaggctcacacggtcgccgcccgacttttgcgtctttgccagtgggtaatagtggaggatgtcctcatcagaatacctgaagaagcgttggtccaaccactagataaatgccggtcagaccgctatctaaccgcctgttagacaacggtgtcactgccggtcaaactattgccctgccacctccaagcctctggtcagaccgctcctctacctttggtcaaactctcgggatacagaaaaacatgtatcgatgaaactcttgaaagtagatcaatcaatagtttcgtctaaatttgttgtgtgcgtatggaaagaggagttgaatttgcaaagtgcatctaaagcactcatttctcaactcacgaactagtattgaaaccttgaagcaaacctgtcacgcccggaatttctatccaaaattccgaacgcttacatgcgtgttaaaccctcgtccaggaatcaaccgaggcacacaataacaaattgataatagagtacaaataaataactatttaatattcgtaaataataaatcattacagaggtggatagttcctctcaaagaataacattctacgcagcggaaaacaaaactaaaacaaactacggaacaactatggcgactccactccacaggcatgtcaaccaagaacaagcttaatcctccagatcatcaccttcgctgagatactcctcttctgatgaatgaatattgcaagaatgagcatatgacatactcaacaagccacacagcaaatatgcaagtgcacaggataacaaaggatggcataatatagctcatttgcataaacagcatttaatatttaagagaatagtaaaacagttaagtaattagtcaatattaaataaacaccatacaacacacccgtgttgtataggcccaacctcatatgaacaaccaaccccggttgaacataccaaacctccaaaccaggaatataccattccaaaccaggagtcacattaattaacacagttaccatttaatgtgtaatatgagactaatcacgaaaaacattgctcaactcacccataaccgcgggtacggctattcgaatagattaaactctgatcagaggtgtaccactgtacccacaagacacaatcccacaacatgttaccatgcgccttagtaccaccacggtacctcggaaaggaactgtgacattacccctcgcacaacacaactcaccacagtgcaccgttcctggatcataatctccccctcaaaatcagaggcaatgcagcgacccccacggacttctcgccgcttcacagtctggcacactataatgaatcatgctatacaaaagataaagccgttgcccacgctggcttgtggttggcacggtaaatgtttcacaacagtagctcgcgaaccggtccttaattgtcatgagcacaaccatcaaaaccatatgctcacaatccaccttaactaggttttaattatccattaattaacctcacacaattaaccatcgtgagctaccattgaatataaccataattaataataataatataatatagtttataattaaccccttgagttagctaatgtgtctaagcatggctaagcaaacatacatatagcatttagctgaaccaatccaatatataaggttcatgctaatcaaattataacccataggaaaataaagtcatcttcggccattacttatacgggaaaaggttcaccacccgatgatattcgaaaacaatgcatagttgaaataaaataatagctttaaatgggttcaacatgctcaaagggttgtttgggatctgtgtgacttgccttgggcttccgcaaacgcttcggaaccttcctcgacagaaacgctctcctccggaacgtcggaaactaaagaaaaaatgctaaaatcaataaaacagtacaaaaacaagcataaacagtacatgtggatatttttaacatgtagatcttgattttagaaaactttagcaacttgaaccacctgaaacggatctacggttatttagttatgatttttcgaagatttaatctattagaaaaagggaaaaagaaaaaccgatgatgacgtcatgatgacatcatcaatggccggcccaggttggcaacctcgccggagattggatggtcggctgcggttttggagcacatgtacacgtagaggacgacaagacgaacgcaacggtgctcaccaacacgtctaacgaccaccgacgacggccggcgacgagaggagatggcggcggcggctcggacctcgccggcggcgagctacggcggtcggcggcggaaaggagagggtggccgagcttccccacggcttggcgaagcccacgacagtgacggcgaccgacggcgatggcgaacgcggctgcgcgacggcgccggagatagccggcggcgacggcgagcaaagcggcggtggcgacgaggctacggagcacgggaaggcttgggagttggggcaaacgaaagaggaggactagggggtcctatttatagccttggattgaagagatcggactcctcccgcaagaaatcagctcgggaaatcaaaaactcggttttggagataaactcaaaaacgagttcgattcggataaaatactcaacgatttgctccgatttttgggggtaaagatagaggaggatgagaggataaaaacccctcaaaaatccggaagaaaagaggagagattggggcggattcggaggggaaagggggcggctcgggcggcatgggtgggctcggccggccggctgctagaggttagggaagcgtccgacatgtggggaccacatgtcggtctcccgagtggagggggcggctggcgggttggctgggccggctgggccgacttggccgcgggcgagagagagagagagttgggccaaaaacggcccaacaacttaaggaagggattttggaactttttaattaaaataatttgtgaaatgttgttccaattattaaaaatacttcccttgctcaaataattcccagaaaattctagaaaatagagaaacaagcaaagtatttaataaaattttatctagcttgtttttatgttaaaaattttcctagattattagggtttagcttgtaggcttttaatttaatttctaaaaatgacttaaacaatgcgttttaaaattaggcaatttttagggcgtgacaaaaccctaactttttttttctcaaaagtcgatgcccttctagcctcaatcactcatctatttatacccacaacatggctacccctagccataaatccaactagaactagaactcctaatcacataggaaacccaccaaaccaaggaaacaatatcccatacaacttcatacttcaatctttctaaacttggactccaatccaaatttaactcctctttccatacgcacacaacatcatggaaacattcacctccacatgcattgttctctaccaagagcatcccacgtgatatccttgaatgtctgaacctcaacttctcccaagtctaatcccgatccatcaccggctatactcccacgggctcaagttacacctacacatgaacaacaaagaaactttatatttgagtacaagttcacgccaacttgactcacatcagcatacaatagtatcacatacaaatagaaaccatatataagtcatatacatgaagcaagctaaaaattccacgaaaacaactcgaaaccgatgccctcctgaagtttgcaaattcaaaactttcagttcaatttttttaaaactttcaagtcaaatattaaaaaattcaagtcaaaagttaaaaattttcaactcaagtttgaaactatgaacttaaaatttaaaaactttcaagtcgatatttgaaactttcaacccagatttgaaaattttcaactcgaaatttaaatttttgaagttaaattttgaaaactttcaacttttcatctcaaatttgaaaaactttcaactcaaatttaaaactttcaacccagatttgaaaactttcagcttaaatttaaaaactttcaactcaaatttaaaaactttcaagtcaaaattaaaaacttccaattctacatttgtaaagaggttatcagaaagaaacagcgctaaaaaaagaaaaaaaggtccggaggcaccaaaatcgggaaaaaaagtacgaacataaaaaaacgcacggtgaggcgggccaagtggggcgcgcgccagctaaattgctagcgcgtatgcgcgcattagcaacccccgtttatccccaaatccgtatgaatcagttccgtagccagttttgatcatattatcaccaagatcaaaagctacatcattcgcgatccaagatcaatatgctacctcgacaactgtatgtgcacacccaaccttttttttttgggtccgccactggtcgtattaatggagataagtaaggaatctgatacaaatcaaatctaacctaaaatatcaaactaccaaatactgtaacaccgttagtccatttgagatttctcataattaatatcacatttattttatggatgaaatgaaacccagtggtatagtatagattaagagcttattaataatttgggatttaattgttgcaggtgattatgaggaagaccggccaagatgagaacgagagattaaaggaagttaaagagaagatcatagcaaaatgcaatggttcaccactagcaataatcatgctggcagggcggctcttggtaaacagaaaccgaagcgcaaatgaatgggagatgcttttggaatacgctgcagagccaacagatcatggagatattgacagcatattccacctgtgctatgcggttttgtcatttcctttgaagcagtgcttcttataccactcgcttattcccaaggatcatgtgatcagctgtgacaaagttgtccagatgtggattgctgaaggatttgttggggctgatgctacttcagagttgccagaagtcttggggatgaaatactacaaagaattagttgcgagacatcttttggaacctgttgacgagtatgatggccaaggtcattacaagatggataacttagtccatacatttgctaaaaatgtagtggaaagtgaatcattagtggttgaagagggagaggaaaatcctgaaccgttcgacgtcgaagagggacatattcgacgatcttgggcagcaaaagagaaaattgaatggaaagctccaaaggagctacactcattaaggacattaatcataattggaaatgttattgttcaggcaagcacaggcagaaccttgagctccctttcaaggctaaggacgctacacgttaacaaaaatgaacatgtacatatccttctcgatagtttgcatcatatgaaacacctgagatacttggacctgagttacacagatgcccttgctttgcccaatgatattggtgagatgaagtttttacagtacatttgccttcaaggctgtaaaaaattggtgaaacttcccaagagcattgtggaactgcacaagttaagatatctgaatatctctgagacaaaaataaagtcaattccagaagaagggtttggtggactgaagaatatggtgtcactgcatggtttccccagtcagatgatggaaagcgtcatagcaaaagattggtgc

SEQ ID NO: 33722 - DNA, 1446 bp, Oryza sativa
ttcgacacaaactctaacagcccaaacatatgagtcacattttgaggaggttgtacgttataagccatatgaataatcgaccagaccaagtgagtaacatgacattggaagaacaaatgttgaatggttccgtccttatgacaaaagcaacatttcttactacctttccatttgcgcttggagcgcaagtttaaacattagcatcaatccacaaatattcaaaccacacgcacaaaagatttatctgtccactcttacaaaaatctcagaaactctaaatataatggcaggatgacagattcaccaccatggcaccatccccaaataggaaaaccattcttattgggtaaactcaaacaagcaccagtcactacaaaagctaaacagaacagcacaaacatgaccgacgacgacgagcacttctgaatagagactagctataataattcatagaagactactctgggtcgtttggcgtatgtgacctgcttccgcgtccagctaactcgtaaacgaccactcttggtgtattggcgtatttacctgcctcggcctccagctcacgcactattgacttggtgatctcaccggctttttcaccggccgtcatgtgcacctcacgaaggctcgcgaggttatccatgccgaagacgccttccagcgtgttgaacttcatatcaagcctttcgaggttgcccatgccctctccgagaagacgagcaatggcaggagcggcgcgtccaagcggagcagcttaaggcagtcgaaccctccatgcttgaccaagatctgcccctctgagtccgacttgttcttttcaagaatgtccaccaaatcaaggtccttgctggatgtccaggacgaaaatataaggcagaacatacgaggtagcttctgaaggagctccaaggtatcagttcggagcaccgtaactgacagggttaagttcttcagttcagtgagatgagcaatccacctgggcaccttgatgaacatgccgtacagctggagggaatggaagtatctcggtggtgaggtcagagaatccagtgcgtcgatgaaaccggagcactcatcattgatcaagagattcttgagcgagctacctccaaggtattggatggaagagagcaaggccttgaagccaggagtaccctcctggatttgtagcttgtgtatcccgagcttcctaagggcagtgtacccgtggaaatcattaacggacgtcggctccccagtgatctcgatcccggacaggatgtgcagtgttcgcaacggcttcttcgttgcctccgctggcaacttgagtgttacctgtgccattgtgtttccaccgagtatactcgtcagccgttcaagctgaacgatggcatcaggcagcttctggacattcgtgtcccttatgtcaagggtctctaagtaccgtagcttcccaatcttggaagg

SEQ ID NO: 33723 - DNA, 1774 bp, Oryza sativa
aactttacatccttatgcactctaggcgtcatacgtttctaacagtgagaggagttctggcgctcccgggaagggaaaaacacacacactcctacgttgcttcttgttgttgaacccagtccatcatgattgttctcttatgggtatcctcatgtagtattgccaagccagcctctgaccatccgaaacgggcatccgccatccacctggccatccgaaccgggcatccgccagcagactgcttgccacatcacacacctaaaagaagaccactacgcatggatactgcctccgctcagctatctactccactaggtctatacccatatgagaagtgcggttgtacgggggtcgtttcatgcttaacttcatggctcggtccttaattgaccagggacagcactagcattttccggataccacccaaatcctccagccaccctagtcgaaaacagttctttaactttattttcctttcacaaatcatgccaccaatatcatggcaatgtggcgctcatgtctccacatgccacatctcaattaccttcccaaaggtaattgcccaagcatatagcatttgataaatatgagtatgcatgattctagaatagcatttctaagcaattgtcataattgactagagacttatacgtaaacatggtaaacaataattaaggcatggcataatcacaagtaggatgttcatcattgcatgcaattttatttgtaaacaaaataatttcgcaattgggatcaacatgttcaaagaatagtaatgacttgccttgctcaaagtcttgcggatctcgaccttcgcttggatccgcaactccctcgggctctataattacgtgcgaaggaataattgaattcaattagaatccaaatgaaatccaaataattcacacaaacatcgaacgcgaaacaccctttctaaattgacaacaaagttcgcggaatcgctcaattcgaattgttgggtcattttaacctaagtcattttgtgatttgaaattacgtcctaagaattcatctaattgtttagttcttaattacatttaaattactaccgcgaattgattacttaaagagattaccaaaaataatctataagaattcatctaattgtttagttattaattacatctaaattactaccgcgaattgatttcttatagaaattagaatagtctataataatctatgattatagtattattttgcaaatactacactttagttaatcctataattaattcctaatattttaaatatcctaaatctcctcctaatttcctatttattttccttttctttttctccctttctttttctttttccttcctttctttttcttttctttttccttttttctctcttctctcttttctctctcccggctcctttctcccttcctctcttcttttctctttctccctccctctctcttggctttttgccctcccggcggcgatggcggtggacgcaagggggggaaaggcggcggcttaccgacagcggcggtcggcggcgacgacggtgacggcggcgcaagccccgacgcggcacacggcgtggtgcggcggcaccgagggcggcccggcggcacgaaggcagcggcgcggcggcacaaagacggcggcgtggcggcacgagaacgacggcgcggtggtgagggtagaggggaggaggagggaatggagtggggagaatggggaaggtggggtttttataggggagagagggggaaaagggagagaaggagggggggtga

SEQ ID NO: 33724 - DNA, 10895 bp, Oryza sativa
tttagtttatttcccatataaatttgattctataatttataaatcttgcataaatgaagtttactcaatatgtgtattatccaaaccaatggatccactccagattaaagattaattgtacccatattttatttttatataatttacttgattttaattagagttaattctcattccgtctatttagatttaattgaaacaaatatgatcgcgataatattttattcatttctatcctcacctcaacctttattttaaattgtattccgattatttatttagcccaattaatttttagggtttattcctaattagttattctttattcgcgatcaacaaacttcgaaatcaaaattcaatggaataggcaaataaagtcggcatgatgcaatttatttaaaaagttttcgaaggtccgcatttttagagttttgtttttattggtcaaattttcagggtgttacacacacccagttgcttcctctcgccgtggcccacgctttatccgcactgcacggaagcatgttgttggttcctccactgtgttccactttcactacctagctcccctccgccagctgcccgtgctgctgccggccctcgataggttccgctggtctcttcgagtgcgccaatctacgtctcttcgactgaggagccgaccactggagccagctaggcaggcgaggagtagaggaggcagtctttagcagttgttcgggtgttaggcccttttgttccgctgccaactcttttggagtcgtggcgaggtagtgcgtgtgtgtgtttgatgtgggtgttgtatggtagtctggatatcctaggtggtgtgcgtatagtcaagctcgacgtagatctgtgacttgtccacacccgttttatcaggtgtctttatgatttgagaaattcagtttatgcctgtgtgtatgctatttgagttgttatttactttgcttcttggcttctttaagtacttatctgattcttaccttgcccttttctgggagtttagatggctagccgcccccgtcgcactgctcgtgcaccaaaccgtttcggttttgaggaagttagagttgagccagaggcagatcatgaggaagactccatcattaacatgttggtagctgatttggaagcccatgagcaaggtagagctgcaagacgggccccacaacaggcagggatgcagtgaatgatggagacaatggccaatgcagctcagtgccataatgtgtttcgcatgaggccagacaaaattcatgcattgtttgggatattagctatgtgcaacataggcctttagatttatcacatgacatataacatattagtagtgccagttgctctgatttcaagtgatcatatatatgactctacatgcattaagatatgagatttacagcactgctgtctgtacagatgcttaagttagttctgaccatatgtagatatgtcaaactatgcagctgtacattacttaatcatctacatgcagcatagtttccattttattacaatatgactgctgtaatttgccaactgcctgtcgaaatgtttggtcagctgtactgccaacacagataataaattctgagcatccttgtaagtttctgcatgtccatgtgtgcactcaaattgctagaaagtcgtactcagatgttttatgctaagtgcaccttgtattgacacatccatgataattacatacagttaacatacagaaatgttgttgggtatagatgcactgtaggttgtcaaaatgatgccaacttactatattagaagtgagctaaacacctttgtttgaattcaggatagctaattaaaactactatgaatatctgacagctaaacttagatggctgtacttaaattaatctgaatatatatgaatatgcaaggttcaacatatgtgatttacatggttataggtgtagagaagaaggattgactgaactgattttggacattttctgagtacatctagtttgcctcatatataggttaacttacaacatttaggttacagaacctacttgtaaatatacatgctagatgaatgaatgacttaactgaatctagagatatatctgagtacaaatgtttttcctgatatttagattaagttagatcgttaatcttagcaagagctacatacatctctatatgcatgctagatgaacttaacatgactgtactataggaagttgatacatctgtgaaactatttgtatatatgattgatggacttacctgatttgacaggcatatgtgagttcatatggttctgctgaaatttacaaatgctaatgtcttatttctaacgaaatcatcttacagcttactattagtaccatgtctcaatgcactatctatctgaatagaaaacatctagctgaattgaaaacatctagctgcataccttgcacaactaaacataatacatacatctaactgaagtttatgctccttttgcaccaaattgaaacctgttatgtgtagggcacaaccaattatgacagaaaacgcatattttgacttgattgaactgcacagctgaactgtgatttaatgtttttttggttctgtgtgcactgtctatctgaaatgcatgtacttctcacattattagctgccctctttgtatttcataccttcatattgaatccaaattgttatggctttgctgcaggtgaggagaggtgtccgtgtgtttaggaatgtacctctcaagttcattcctgagcatcacgcagtgtatagtggtaggatagttacgctcaacaagtctggcgttgttggacacaggccggcaccaccaccggtcctccaagaagctcagatcttagatgttgatgatctcaccaacctggcactcctaccaccttctccggagccatccttaggtccgcgcagaaggggcaagagaatcatgactcccagctactcttcaggtggcaacagcaaggggaccaggagggactccaccggagatgcatttaataggctggctgacctgagggttcagtccaatgaaagtaaggccaggagggaggagcagaagcaagcgaagagcgctagagcatgcatggagatgctcaaggctgatgggattagcatgcaggatcccatctaccacacaatcctgaggatgtttcgtgatgggtacctgtgtgagttcttcattgaggactgcaccacaccagagggtcgcatgtacttcatccagctgcatggtgcaccagacctcactcctgaccccctgttgtttgctccaccgccaccaccaacctgctcaggccatgttgagggctggtacaagaggttcagtcctcatgacgatgatggtagcgacggtgctaatggtggtgctgatggtgcagcaatgttttagcactgcttctgcttgcttatgtcgctttggtgccatgttctgttcgtgatgcatcttttaatttccctgtgatgtctgtttaataacttgctccgattcatatcgagcatcgtgcttgttgtaggccttatttaagggcccctttgaaacacaggataggaaaaacacaggaataggaaaaacgtaggaattgaagtggtatgttttcctaatcctacaggaatgaaaaacacaagaaatatgaagagggtccctttttgatagcaccataggaaacaaacaaagcaaaaggatagtttccaagaggttgaacctcttgcttattttcctatgaaattgagctataggaatgcaatcctaaggaaaatttcctatactttcctatgaatcaaagggtttcataggaaaaatttcttaggaaattaaatcctcaaaaattcctatgacaatcctccaattcaaaggtgccctaagttgagtggcttcttgaacaatttcagcaccattaatttgaactatgtgagctgcagtgcttgaataaattatgttgagctgatatttatttgcctttgttgattgcccttattttgtacaaggagctaactttttgtggtttgctaacttaatttacaattgcattgcactaatatgttgcctattttaatcactgtttttttgcagtactttaataatgtgaactaacctttcgatttctacctacttagaatcattttgtcattgcagcacataggcttctaacttaaccatgatttactttgtcatgtattgatataggaacatgagcacttctgaaagatcatatggttctaaggatggctactacagtgaggaggaggactcctttctggacatgttggttgcggctttgaaggcaaagctatgtgtgagggcagcacgttgggtatcgcaacaatctggaatggaatgggtgatggagacaatggaaaacccatctcaatgccaagcaattttccgtctgatgccagatcaaatccatgctctgtttgggttacttactaatcgatacaatcttcatggatcaattgaggtatgcccaatggaagcacttggaatatttttgtacatcatggcggggggcaattcaaatagggccactaataataggatggtaagatctgggtctactgtctctaagtacatccatagagtgcttaatgcggtttatgctgctgacataaataagccggtagatcctaactttgcaagagttcattatcgtgtccagaatgatgaagaattccagccatttgctggtgcggctggtgcagtggatggagcacacattcattgcattgtggcagtggatgattccattcaacacaggaaccgtcaccacataacttctaggaatgttcgtcgctattggattggacgaccgtgtcatttttgcagatgttgggtggctagggtctgtgcatgatcaacctaacagaagcagtacggggctatccgtttgttttcccaaggctaccatggggtatgttttgaattttaggttcaacaattgcaaatgttagtgtccattttccagaaataatcacttcgctaatttgttggtgcagggaaatatttccttgtggactcgggatatgctagccggtatagattcctaccaccttacccacatgtttggtaccacttggatgaatttgcgggtaataagggagcagccttgccccatggaaaggaagatacttttaactaaatgcacagttcgtagcgtaacatagtggaaaggacatttggagttatcaaaagccagtgagaatcctgagggaaataccttatttccttaggagtgacgaccataccaagatcatacattgtgcattagttctacataacttcaggattgacagctccgacatgtatttccttacacagaacccattgtacaatggataccccatcgtttcagatgctccaccctacgtggctggaacgatgtacctaacagagcggcggcaatgaatacactccgtgataccattgcagatgaagtttacaacaggtaaatggtatttagtttgcaccgtttaaaataattaacatagccatgtctgtcatggatatgttctctatatgtattgtgtttctaaaatctgtctgtactcgtccatgtgtagttcactgtgttcctactactgtcgtgtttgtgtgatttatctctagcatcctctcatgcttaatattaccagctttgctctaatctcccgaagtcccgatttaatttgatatcttccattaagttttggtgacaccttcgttagcagccggctgctttatagctgcacagcacgtgaagcagagcagcagccgttcggctgcctcaccgacagctgcaccgacagcttgacggtgctcaaacggcgcttcctcactccgttcctgctctgttgccacacggcattaaattgcttcccagctgccgttgctccgttgacgttgccactcaactgtgtttgcatgttcaggtttgaaacatagtggttccgcacagaaaacagaaaaatctattcgcagtaactaaatttttaatcttttaaacaactttcatatataaatttattttttaaaaaacacatcttttagtcatttgaaaaatgtgcgtgaggaaaacgaggggaagctgctagtaacaatgccattgcaccatacgaacgagcccgagctggtcgtagcactgctcctaccttgaccacaaacggctgcgttcgtctgcaggagatcatgagaaagtctcgtttttgttgcgcatgctttctaaactactaaggcactgtttagggttgaaaaaatttagcatgtcacatcggatatacggatacatatttcaagtattaaatatagtttaataataaaacaacttatagatttcgcatgtaaattaatccgtcattagcaaatatttactgtagcaccacattgtcaaaccatggcgtaattagacttaaaagattcatctcacaatttatacgtaatatgtgtaattagttttcttttctatatttaatactctatacatatatctaaacattcgatttgacatgctgaaaagttttctaaacagggcctaaattagtgttccaactttcaatatcatagggactaaaattagtcccatgaatccaaacactaccttaataaaccaatgctgatgaggtttttttattttgttttttaaagacgaagatacccatctttgtatggccgacagaaaagctgctgtagttggaaatggcaaggaatgatctactgtgggcttgaccgacgaaatcataggaatgaaggtgatgtcatcttctatcactcgtagaaaaattgacaaggaaaattaaagaaaatcaagagaaatggaaattggaattagcaccaggggattgaaaggatagaggtgttgccgtgtaaagaagagcttaagacctcagccaaaccagccatggataaagattaagtacgctcacataaagatgagaaagtcattataccatcgccattggagtttcgtctattccgcaccgttaaatatactattcatactatagcacttaacggtgcagaatggatgaaactctaacggcgatggtattttttttggaaaaagtcgtttgtacgatgatatttgttgaaactcacacttgtcgatagcatttcttatatttgaatgcttgccaatggtatttattggattatatcttaaaataaattataggagactctatatttaaaacaaaaatattcacaaaataaaaaaattgtgaataaaataaagaaacacttttcaaagttttttttaaaaaataaataaactaaaatttcaaatttacaacagctaatgtaatttcagtaatcttgcattaacgatctttctggtttcaagcgtcgacgacaaactcagccaacaaacatccaagaaatcggccttaacaaactatgtgaacatggtggatgcatgcatgccacaaacagagcaatttttgctgcactcatgctagctgaagttgtgaactaccactgttattaaataatttatttttcacttatctcatagtactaacaaacaaaaaaacagaataccttgattttatcaaatcccgatacaaccattcctcgtattatcgagtccaacacaattatcttctacttttacgatcatcatcaagataataataattacttaaaaattaaagttatttaatagtataaacaagagatatcaagaaagaaatttgaaacagaggaagtgtaaattaaacttcatagattactgtcagtctgacagtgaacacgtccgttaataactagacatggcatctagggataaaacatgctgtcgttgatgtcgacgtaaccgaagcgatcgaggttgtccttgacgaaggcctgcagccccctcttgtggtggagcaacttgttcttgatggcggcggttccgatggccaggaggcggtccttctccttctgctcgtcggtgtgggaggagatcacagtgaagaccggctcgtaatccttctccggcaacgcccaggacaggatggtgtccatctgttcctgacccatcctgtacgtttggtacgtcttgggactccccatctcgcgctgctgctctcccccacaacctcctcctcgatcggcggcgcaaatcttcgatccttcttctcggcggcggcggcggcggcgggaggactagcgaatagcgagtatggtgggagcgatctgaagacgagtgggatcgatgtgatgcgatatataggaggaaggcctccatccgtctcctactcggactcggcccactccgactaagtttaatccccgtcccaagaccggtcgccaacccgagcgcgcgcgcgcgcgtacgccggccgccgactccgacttcgacgacgtacggccaccaccccccaacgaattaattagccacacggaaggacaagctaaggtaagggctagtcatttggtactatctatagttaatcgcggagacgtacggcatacagtgcttgctgagttgctgtgcaacggtacaagcggaacttgtcttctaacgtacgttctgcatcatgcagtgatcgatcaatccgactacgaacttagttttgcactaactgtcgcagtgttgagtggaaaaactaatacacgtttgttacaaaatataacaagttctagatttgaatatagccatagatttggatatagccatagcggagctatagcgaaataaagggtggtgccacttgtttaatttcccctatcttagatcgagtttaaactaatacgggtgcctaagtttgtattgagaggggtgcatacatggtgaaaatagataagatgtagctaaaaaaattttttgaccgggttcctgggcacccccctaatatacactagctccgcccctggatataggtattaaatactccctctattttttaatagatgacgccgttgactttttctcacatatttgaccattcgtcttattcaaaaattttatgcaaatatataagatataaatcacacttaaagtaatataagtgataaaacaactcataacaaaataaattataattacgtaaattttttaaataagacgaatggtcataagaataagtcaacggcttcatctattaaaaaacagaggtagtaagaaagtgataaaattaaaaagtgagaggttgtaattggttaaagaatgcttcctccatttcacaatgtaagactttcaagcaatgtccatatctatatttctagattcattaatatctatatatatgtgaacaatgctagaaagtcttacatcgtaaaacggagggagtatataattaaagaggttgttatatcctaagataaattttaaatactaaaaataactatagttttggacggagggagtagcaaattattgaagaagcctacgagctttggggcctcttaatgttttgatgcgagaaattttttctctatattccagttagctgttgtaactcccacattaaccatttcatgattttcgaacgtacgaatatatgttaagggtcctttgaatcaaaagattttaattaagaaggaatttcgtataattcaaatcctataggaattttttctatgtgaccattttattcaaaggattgcggttttccaaatcctatgaaattcgtttttcttacagtccaatcgaacactcattcctgtgttttttcaacgttttgcaatcctctgttttatacttgaattatattcctattagaatcccgtgtttttctgatccctctgtttttttcaatcctgcgagtcaaagaggccctaaatattatagaaatgatataaggaagataatttgatatcattatatgttgagctctaaaacattatactctagatgatatgtcatacttgcacataagtttccagatactctagaatagtaataattgctagtggatgagtatgtgacatacttacatgctttgctttatcttgttagaattgctagttggtccagtatagatagtcactggtacagaaatctctataggtgccggttgggaattggctataggtgccagttttccagccggcacctattggtcggcacctttgcctcaatcttattggtgccggttctaaaaccggcacctatactaattaaaaaaacgatggcacctacaccaccgccgccaccaccacctcgcccggcctccacaccaccacctagccgtgcccgcctccgcgccgccacatcggcctccgcgacggcggctgccacccaacaccgcgctggaggaggggggaggtcccccgggagagggggggtcggcgagatccagcgaccacgccactacctcgccgcgtcggccgcaaccccacgccgtgcaggacgagaagggaaggggggcgaggcgctccgcgccagcctctacctcacctgcgccgccgcgagcacgagcagaggagggcgagaggggcgagcctcctccagccgtcagccgctgccccggctagccttctccaccgagccgcctcctcgtccgcatcggccggccttctccaccgctgagccgccctggaggaggagagaagggggaagggcccccgggttggcgaggacctccgcgccatcctagcttctccgttggccgccgccgcaactctgtcatcgtcgggcgcaatgtgagaggaggggcaagagaaatcagagagggagagagagggatggctggcgcagtgtggtggatggataaggatgtcgatagtattggtggggtggataaggatgtgctatgggtggtaaaaagagaccggctcggtttttttcaaaggtgccgattctattaaaaaaccggcatctatattataggtgtcggttttttaagtacaaccgacacctatactgatactatatgtgttggttctactttttttatcatgtgagggtgggaaaaggggccggtttctatga

SEQ ID NO: 33725 - DNA, 11388 bp, Oryza sativa
  unsure (1)..(11388): unsure at all n locations
attataggtgtcggttttttaagtacaaccgacacctatactgatactatatgtgttggttctactttttttatcatgtgagggtgggaaaaggggccggtttctatgatggttttttagtagtgagtcaacgatagcacggaatggtgatggttgaatgcaataaaatctccgaaggaatggaagtatggaactgagactccaatagaattctgccgaaaacttcgaatgaaattctaaattaaaatatgtaatttcagccatattctattttgccagtagcagtattatacgtcggtctacatgtacgaggaaaatggagaaatggtggaggtatagaaccgtaggagtagtttgtgtacgtaaggaagaggtagaaccatgaaatttcagcatttgtttaaggaatttctcaaaatttcagatatttgaaacctttgcatatgcaacatatataaatatcatctctatacacattacaaagagatcataattaattgggaagtgtataccgatcgcaaagaatcatttgggaatgaatcagctataactgccgggagaatcttgtatatgctgatctacgtattctttaagataaatgtgatatgatctacgtctgcataatgatgcaggatcgtatatgctaatgcttgttgcttcagaaaaaggtgtgaccaagacgaaaggtgcagtacgggaatcagaatgacaaacgaagtgtggtctcaataatagaactaatgagctatgtattagtcaggaatcagcatatatactctcaatcagtatactgccttgtcctatacatatatagattcgttcctacggaaatttcggttcctaacagttgacggtacgtcaaccatgcagagtgctagacgacctaatcgattgatggatattgaagatatatatttctacaagaacgattattggcagagtgcaatttttttaaaaaaaatggttgaggtactatagctataggagcagtatcggataataattgatcacatatcgctatagcttagcgtatatacatagagtacgtgacttacatatcaagtcaagtggtcttatcttatatagaaataaggcctgtttagatcccacctcaaaatttttcaccatgtcacatcgaatatttgaacatctacataggctaaaaaataactaattacactgattgtgactaatttgcgagacgtatcttttaagcctaattgtttcatgatttgataatgtagtgctacagtaaatatttgctaatgaaggattattaggcttaataatttcgtcttgcggtttactaatggattctgtaattatttttttattagtgtccgaataccccattcgacaccctatataataccttacgtgacaagccaaaactttacacccctaaatctaaacaccccataaataacaaatatatgagagagcatataagtaacaaaatatacaaggagtgcattgatgtgtgcgcacgtgggaaacatatcctatgcacgccagctggtaaatgttatcgaaaattttagaaaatattgtacacgtagttctagtaaagtctgtattcaaattcactatatttggtcgtagaaaaagaacaaaattctgactgaattatattattaaaactgtcataattttgtatttttcaggctaaaatataataagtttaaatatgaaactttgcacataggtatagtgtaccattggaagaacatgcataattttttatatgaatttttcataacatttgctagttggtatgtacagcatgtgcgctgaaagtttgtgtttataagtctataagatacatttgccgtgctatgagtgcgtcttgagtaagtagacaaatatgaaaccaggtataaattctaacagattctaacatatctcttgtagtctttctatgcaattcagctgatatagtgtctatgcttcttgtaaacgcctagtgaagcaacctccctcgcaacaaaagaaaataaagtaaacttgtgcttcgaaacacaagattattagttttatgccgtgagctttgaatttttttagttcaacttttcttttcttgctttagtttgttcgttccttacagcattgcaagaacactcttttgcctaattgcatgcatgcctgacgatgcttcccatgcacgcctagtacgtgttttacacagcacgttcttcataatcatagctcttaaggattcagtccaaagttaaacgccgagttgatatacgtcttttaaccgaaatttaggagcgaattttaaaattgatttggagatgttagtaagatttgatccacggaacacgtatgtatatatatatatatatatatatatatatatacacggcaaatacttctactgcatgcaaattaaccaattagttaagtgagcatttgctagctagtttcaagaggaagaatgttttactagtccttgcaaatatctctacctctcgtctccaaggagaatataaggaagcttttttttttctgtttgtgtttgaacaaatactgaaccgaaagtctgataattaatctgattaacgtgcatgcacatatatacgagctgtgagccgaaagaaaatggttgattatgaagtacttccttcgtggttaagaaaaaatgttagttaattccgccaaagaaaggcaagagtgaaaccattctttttgtctctttgacggtggaccaagattccagttactatatagacaattccaatgcagtgcatgctaaggcatatgcatccttggttatggcatgtttaaacatagaggttatatatatgactttttttagctgtgattagtcaaactgtttttgaagaaatgtatgtttcgtgagtaatgccactaatatgtgctgttataaatgctattcctttgttattaattccataaaatccatgaataaaaatgtcagttgttctaatttgacgacaatacaagatatgagacaacattatatgtataattagcggaccagccaattaatatcatccttctcaaaaaaaataaagtttgcaatccaaaaataatctgcaagcaaggtataagtaacctttcaatgttgttggcccctttcaccggtttcaatgcatgtgttgtgcctgcattgagatgcacttgtgtgttaaggaaaggaggaaactagtgctgtgctggctagtcattttataagttcataggtcgtcttcaagttggggtcaatgggaggaacaatcgagaaagcgacctccaaatacttgcagtattttatgacggattattcctactaatccagctcccctgatcctggcctaaacactgtctctataaatagaacaaggccgtgcaacaacttgatcacaagttaaccaggtcatcaccaacatacaaagctaacaccactagcttagctcgcttggtctcccaaaggaagaacatatatggccactcctctcaaccttctcattgctctcctcttcatcgtcgtctccgttcaaggtaaatcttgtaacacaaagagagattatgtgttagtacaattgaagtttcttgttagtataaattaatttaagtttcttaatttcttttgatgtttcaaaattccagtgtaaaaattatttcaacttagatatatgacagatggcataacaaataatcatccatctttattgggacacttatcttcacaagtgaatgattcctctctaacccctagagctagctagttttagtcgttgtaagcacatcttatatatgcgaataattgcaagacaaattaatagtagttatttttctccagttaattatgcatgcattttccttatactaaattgttaattaacatgaattaatataataatattgagcttgatcgatcgtcatgatgatcagggacaaatggggccgatcgctgcgccgcgtcgagcagcatcgatgtgcagaccatcaacaccggcgaggccgcggccggcggcggcgacacggtgttcgaggtgcaggtgaagaacctgtgcggctgcagcgtcagggacgtccggctcgacggcggcggcttcgcgacgacggtggaggtcgacccggccgtgttccgcgccgccgacgacggcggcgactactacctggtgaacggcggcgggccgatcgccagcatggccaccgtcagcttccgctacacctgggaccacttcttccagatcactccccggagcatggaggaagatcagtgctagctatagctagctacatacacttgggtacatatgcaaagttggagggaataatattcttgcgtgagctaatacacatgtgttgcagtgttagctagtactatatatactaatgttccatgaaaagctaggtcaagtgtggaagaattattcctgcatgggtttatatatgtgtagtacagtggtctaatgtgtactgagtgagggatcgaatattacaaaaaaagtttagctcaataatgtatacggtcttttgcatctcaataaatggtttgtaattgctagttactttccatctggatatttagaaagttaaattgtatcttgtgactaaaaaggttgattacaattataagttcctagaaatttaaaagagattttgcctgtcataaactcaagattagaaatgaaacgtaaggggctatggacagggacggatccagcgtgggcgttagggtactcaagtcctctctaccccgttgtaccaccatcgagagaaggggagataggaggggaagaagagaaagaagaaaagctggaggaggaaggagataagccgcccccatctatacatttcttgtatctgcccatgcctatggggtatagctagctaggtagacacatgaacaaatctaagacaaatctgtaaagtcttgtgtagtttggaggggttaaaagggattgggggagcctctctcatagggattaaccgaacatggtctaaaacggtacacagaatcatttgattggacttgtagggacatgctattgagttcccttccttgacgtgtgtatccgggctcctgtgaatgcacggtctagcggtcccgcattgtagccagccatcagggtattgcttgtgggcgggtaatcgctttcccgatctcctcctagcgatcacccgtccctcccccctatacgctcttcctctcccccttcctcctccccttcttctcttcctactacaatacaccataatttttttttaaaaaaaaacaaagttggaaaatttatgtatagaaatactatatataaaaaatttaaattcaaattcaaatttgaaactggtatgtaaacttttaacttataaactttgggtctataaactaatatttgaattcaaattcaaatttgaatcgggtatgtaaacttttaacttataaactttgggtcaataaactttaggtatataaactttagatgtataaaaatactatatataaaaaatatttgaattcaaattcaaatttgaatcggatgtaattcaaattcaaattgaatcgggtatgtaaacttttgacttataaactttgggtctataaactttaggtgtataaactttagatgtatagaaatactatatataaaaaatatttgaattcaacttcaaatttgaatcggatatataaacttttgacttataaactttgggtctataaactttaggtgtataaactttagatgtatagtaatactatatataaaaaatatttgaattcaaatttaaatttaaattgtatatataaacttttgatttataaactttgggtctctaaactttagatgtgtaaacttgaggtgtacaaactttaggtgcataaatttactaaaataggaaagtaatgcggtgtcaaaaaagaaaaccatgtggaggagaggggggcgtgctaggggcgatcgatcgcccgttagcaatctcgcagccgtcatgcctatgtcctgattctatttgtattaattggtttgtataaattgattatagagataagacaagtgctaggctatatattgtaacattgatctctcaatcaatatcaatgcgatgaatatctcgctaacaatacccatagtgtcgaacctagtagatataatgactgctcccctattaatggttgtttctgcctttattgacttgacctcgctgatgtctttgccctctagatatatgtagggaataaaagcagagcagatttagataagtagtggttataccaaatcctataccatattttaaagcggatttagattaggtgtagatgatgtgaatatgcggatgcagagcgaataattccggatgttggaaatggtgccaagtcgattagaacttagctcggaaatagattaaaattgtcggatgttgcgtatatatgcaatcaaatacaacatcaaattgcttatcgtcatcaccacattggatctcacatcatcactaggttggaacctacactatagatgggccgggccgggcaagcatgatgggccttcgtgccttcgggtcgacccggcacggtccgagtagtattgggccatgcctgggccgtgtatgccgcccgtgggctggcacgacacggcccggtgcgtcagtcgggccgtgccggcccgacaagcctcgccccaggcacaggcacggccgggcttgggccgtgccgtgccgggtggcccatatgccatctataacctacactactacaaaatcaacttttgcataccgtcaaaaccgatttttgaaggtagctgggtcacccgcatgcactcaggtatttgcaaaaatcggatttttgcatgcggggagagcaatcgcatgcgaaaatccgatttttgcatgcttaagccgtccggttgcaaacatgaaaaatcacaaaaaataaataaataaaaactccgaaaatcgatttcctttagccccaaaaccctaaccctagaatccagaagtcgccgtcgtcaccgtcctcaccatcatcgtcgctcgaagccgtcagaagatctgggtgagtgggggggtggagagacgataggatccgcatgggaggggtaaggggcactggatccacacctttcgtcactgctaccgctaccggagcctaagctcgagctcgcaatccttgcctactgaaagtgcatctaggccccaattgttttgatgattaatgacaatacgattagagaggactaacacgtttgtttacgtgaatgtgaaggattgttagtccgtgacaatatgtagcgcaatacatatctcaatgaatgtgataattcatgagttgcggcaatgatcaaaggttatattgtacattttcaattcttcatgtcattaagagggattatgcattgacatatgaggagtgatgaatgtgctcaaaatcaatttttaaaagtgtttctcctcagtttctgtgttctggaaattttcgaagttgtctgaaacagatttttggaatttccaaaaatagacataaacaattttagcttctagaaattttcggaattgtccgaaaagtgattttttggaatttccgaaaatgaccgagcagcaaaataagtttctgtaaattttcgaacttgtccgaaactggttttcggaattttcgaaaatggcagtgaggagaaaatgtttctgtaaattttcggagttgtaggaaatcaatttccggaatttccgaaaatgtctgcgaaccaaaaatgcttctggaaatgttcggacttgtccgaagggtattttcggaatttctgaaaaatgtccagaaggttgttttggttctggatatttttggacttgtccgaaaagttttcagagtttccaaaaaatcctcagttgactttactatttctctaatctagaaattttcggatatgtccgaaattaattttcgtaatttccgaaaaatgcaattattgtgcataacgggcagatctggagctatggctataaatagcccactcgctccacttgtgagggttgctagactgattggatatttcgtgccaggcttgttcatcttaagattcacttttgagccttgctttcttgtgtcccctctctacttgtgtttgactcggatttggtttttgtgtgagagttgtggattcgagtttgtgtgagtgcttgttgttggcttcgtgaagatttgtgagcacttgcatcatctccggaagttctttgcatcatttgttactcttggaggttgaggactcctagacagctagatgtcactctcgagccaccgatctacgtgtggttggctgggagaagtttgtgaaggtcggatctcacatccgaaagggaagatataccactaatggaaggagtgttttgtggaacctcttgaggaaatggttagcgaagacccggctctttgtgagctcctcaacggagagtagaatcccctcatggatttgaactctgagaacaactcatcttgttacaactttgttgatatctcactcctctagctttgcttgtttgtgctgctataggtctagttgctgtttgtgctagtatattcttgttgtaggcagctagatctagaatttatttgaattgcgcatactctactattttcggaaataacgaaaatcattttacccgagcctgctgcccttacccatcaccaacagagcccaagccttgcccaactgataaattggactattggatggaccaactcatgttatatggaatagatagagtggttacatgagctaacaattttcaattatttggcaaagaatctattggataatcctcgtcaataggattttatggataccgcatctacacccgaatccacaccatactatctgagtccgcatttttatcctccatattttcataaacccataccatatcctgatttcagacaaatttggagtggatcagattttatctgatctgtttggacctttagatatatgctacagtcggttcaggataaaatccaattgtcccagaagcaccaaccaaggataggaaaatatattcaaggagacaaagttgtgaaactgattgagccataaaaagaaggcaacacaacctactcaagccatccatcctcgttgcgagagtgtgaattgtttttttagtttctcctaaaaaccttccatttcacccatgtgacagatgtttatccctactttatctaaatcggcttcactagtcacttttaatctttcaaacccatcttgatttagatatgtctacattgaggtggttcgcgactccaaatcaccacaaagagttaggtgccggattgtgattagtggcatgacaaaaaaaaaagttgccaacagtcctcccgtctcacctctcctggccaccgccaaatcccctcctgccatgccttccccaatcaatgccggatccactcccgccaggcctcctctaaccgccgccggatctcctcctgccaatccataggcgacccccttctctttatccggaatctaacatgataggagcaggggttaggcacttctcgagataactcgaggtggtcggtgcaggaggggccgctcctgctatggcaggggggaagcaacgacaccagcggcaggcactaggaggggagggcccgtgcggcagcgaggcatacattggagaagatattgggctgatttggtttgaagccaaaacttcccataccaaaatattggtattttgaacagtaattttggcaatgtttgatttgctaccaatacttgtcaataccacacaaatgttgccaaaatattggcattaccaatagtttggcatggttggaaaccaaacaagcccgttattcagagaggtttgctgctttgacgggctttgatgggaatattgacggtgatggtatatttttaatttacgtaagtaccagtggtgcccacactattttctgctttattagtggcattttttttccagtacagcgattttgtaatggcatgatcaaatttaccatataaacaatgagacagagtagcatgtttaattatgcataccgatctagtgcttcccaacgaccccatagatctgtcatcatgttaccttgcctgtcaaattttattatgagaaacaaactaattaactactaccactgtttttttaatatatagcgccattaactttttgacaaacgtttgatcattcattttatttaaattttttgtgcaactatacaaattttgagtcatgtttaaataacatttgacaataaatcaataaaataaataataattacacaaaactgagggagtactggtttctagcgattgcaaacagacggcatgggcgaattagaatacaaattacttaataaaatacaaagacattgcaaacaaaatggattttgacaggcccagcgcagtggtagactgatggtgcactggtattcaacctgcaacagcagaatgtataagctcgtttggacttttgagttgaggcaaagtgcataagttaccattcaaagtttagcacatatacatattgtttaaaaaataaatgcatgacctatttgaggagaatgaatgcaagtttctagattgtttatgagaacagagaaggaacacatgtcaggagtattaaacaacagctataaaaggcatacttcagacagcttggcaacattagtgagtgttgattctggaatggattgtttttgcaatttcatctagaaaactcatacatagagttcacataaagatccttctcacactgctgttgagtaaaaaaatcagctgcgctttcggcaagagtacagcttttcatgggcagcttacaactacaagtaaagaatgacagtcccagtcttgctaatcctgtatatacaaaccattgtttctcaaaataaacagaaaaaaaaatgcatacaagaaaggaaggcaacctacggtaaacactgcagtatatgagtataaaattgaggcctctgtgacagccaactcaacggcagtgccccttatttctgaaaaagcatattatgccagaaaatggttgctgaattgaaatacagtttgatttccgttcttcgcaacaacgaattatccaccctccaacaaggagtggggatggtggttccatctgccttgaccacccttcaacaatcatccctccatgatcatggaatctgcaagagaggggcagcttttgacatgctttccatcagatgtaaatgttgttgatgtcactaagttgtcctagccatgctattgaatgaacaagctagaggcatcagaaattcgcatcctattgacagaaagcacccatataaaagacaaaggcttattggaggtgacctacaagctctattaattttttcgtacaaccgcgtacaaccatctttgnnnnnnnnnnnnnnnnnnnnnnnnnnnnnnnnnnnnnnnnnnnnnnnnnnnnnnn

SEQ ID NO: 33726 - DNA, 26913 bp, Oryza sativa
ctaaacaaacagaaggacattagtttgcactatgatatgcacatgaaagatggaatcaacatgaggaaaatatgtgaaagaaactaaaggagcagaagcccaagaaaaaaaatataccactgggattggacgaagggatgatgtttgtctcgaagctgtagggatctcttgtgtaggagacataccacatcgtttcatcgtatccatcatctgaattagccttcacttgctggatatggctgatcttgttccactcaggacctgtatctcccatggctatggaactaagaagctcaaagctgcagtccacgaacaaattcctcatgcttacttgctgcaaataaccagggagtgtttcaatactatagtccttaagtgtgaggattctgagttctggcacattctccaatacttccattttggggcagaacataatgtcaagcttccgcaatttgggaaaattagatatcctctgcagatcagggttgtcatccacactgagctcaacaacacaagcgaagttatcaagagacttgaggttctggacctcacatatccatagtttcttcagagcccttgcatggaaggcaaggccaggaggaaggcacctcagtttgcaacgctcaagtaaaagctcctccaagacagccattgcttgcacttgttcctcccactcccactcctcccattccaccatccccacgaagaatagcacttgcaatcttggaaatgctttcgccgtcagggaatgatggccatgatcatggcagagcaggaattcagacccgacacgcttgatggccggtgcacgaacaatttgtagcatgaacaaatgaaggagctgagacaaaatatcaggtagttgggtgcaacaagccaagtctttaagaaacagatacctcaagctcgtaagaggcgttctggatattggtgacatcatccaatttggcagtgaacacccaaagtatccaaaaatttcaagattgtataaacagcgaggaggacagaactcattaaacacctcctcaacaagccgctgctccatctcagataaaccttcctctttgagtaacccatcatctcccaatctactagtgcagcgtaattttaagaagataagatgctccttggtgcaaagtgaagcctttgcagcataagagctggcagagacattctcaagacaatttaggtctagatccctgagctcagaaagacattctagctcttccaaactacaccaattctcttttggcgaaacaccaccagtgcccatgtgagctggaaaaccatataatttccgaatacttgacagattatggaacccctcaggtattgcatttatatgtgtgtcaccaaggcttagatacctcagctgtcttagctttaaaatgctcttaggaagttgcaccaaatttccacatgcattaatgtcaatgtacatcaagaatttcatcttgccaatgtcatctggcaatctagatatatcatctgttgccaaggacaagtaccttaggtgcttcaattggcacagagagtcaaccaaaggaagaaaatttgatgaatttatacacaagatccgtagacctgaaaagttgcccaatgaatcaccaggccttagcttgatatcacttactgatattaacattctgagtgacatttgctcttttagaagattccactctacttcatcatcagtttgaatggataatcgatagaacttctgtgaatgaagattactaatatcaatttgtctaccttgaaccaccaatgcttcatctctagccacataatgagcaaatgagcggacaacatcatgcatcgtgcagtgccattgatcaacatactctatacttggctccaaaagatttctcatgatcaactccttgtagtaatcttctcctaattcttctaatccttttgtgcattgaagtacaagtccttcactgatccacataccaataatggtatcataaccaaggacaacatttttagggataagtgagtagtgcaggaagcattgcttcaaatgaggagagagatcttcatagctcaggtgcaacacatagtttaggtcttggggcattccatcaactgaccatgtagaattactcaaaatctctgaccaaacaccatggtttctatctcttctgcacaagaggccccctagcactttgatagcgagtggtaaaccatcgcattttcctattatctccattccgacatcctttagtgcctcaatctcaggctcatctatctcactaaggataacctgtaggcaatttaagtcaacaaattcaattagtagtatgcataaatgggtctatttttctttaacatacatgagcttacaaaaactcaaattatgtaagaactagccatcaacccatgcacatgcataagcaagtttgttttttttttaaaaaaaataaggatataagttaagcactataatgttcgactgatcgcaaaaaatgtactattaactcattccgcattttattccattttctatggtatgcatttcctattgggttatgcttatttgattgtattgtatcaaataatattaatactgaaatacatttgcacgaaaattacaggtattggtaaggaatatatagtctattatgaactttagtgccactgctcacaagtcagacaaagtaacctctaccaacaaaaatgtcactgctcactgttcttatttgactaagaactgcttcttagtcttccgagctatgagagatacacaaagaaaaacatagtaagctgacagagaacgacgatcataggaatcgctagcccagtagcatcagaaataagcctgaaactataaagaggtagagcgaggaaagcaaagacaatgagagatagtcccgcgaagataacacagaacacaaagaagatggttatagtggaggtgagtgtgaggaaaaacaaaatgactcaaaataagaactggacatgaaaatgtcaggacgagtgacacccaaataacaagacctcccaaccagataatagtaacatgtgaggtcctcaggattttttttattgaaagtactattacaccttgcctagtagttatatataggaggctcactgttagcagcagaaagataaatattaagatccatgggagtttgctgatcagtaagagaagcttgattaagaagatcatgtacatactttgcttgggacaagtagaaaccctaaggtgtagaaaaacctcaatcctaagaaaatactgaagcggccctggatcagacataagaaacggcgcaaccgaagaagtttagatcctatgccatttttctctaaaaaaatagatactaaaatgccatgcaatttagatttttaaatatggtggtctggtggagtactacagatataattttaagcattatttagttggttttctaccaggtttaattaattaaaaataaatcctacctacatacggcagcagacatgcatcctgtaaggtgtaagccacaacagcacccatgcagttgattgtcacatattggctggaagtctatttgttcttctggatgcataaatatgcacatatacatctacttattcgtactctacctatcttctcctttcttttttgtacacagtaagaaaactaaaccatcgctttcaattttagatatgttggatggtcaagatgatttgtactttctttatgcattgtacaattatatacacaccttttgttgccttgacgtcgtgggaaattaatgttcaatttgaaagctcgacccaacctcccattttcaaataaataatttttccgtcgcacaaatcttggatcatgtcagatggatataatagcaagcaaacatccatcgacaatatctttgaagagaagattccaaatgtttttgaactcaacatattcatttgtttgtaggacattttctataagaaagattggcaaatagttatcttcagtaatgtttatttctcaaacaaaattagcatatatttatgtctccatttgcaggaatttctaattctgatttacaataaaatggttctcatacttttaaggaattgatatttacaaatcaatacatgacaaaagatattcatcgattaatcaaatcatgtatggaatcattatttaggaaatgatcattcttattgagtttggagatttctatatatatatatagggaaaagcatatgtgaaccaaggttcatttgcacctaaaatctgaaccattgatgtgttccaagatgtgtgctactaagtgttcattgctctgtacttgtgaagtctaactataaaggcataaaaagaaggtagtacatagtgtcactgtgactttgacatcacttcctagccttccaactttacccctgaactagattatagctctctttcatgttaaacacacaattaatattactttatttttcttagtgttgttttgagttcttcatctcatggtgtgcaactttgcatggtcccttttttttttcagaaataagcactcgtacttgttttcatacaactacattacatgcacctaataaattgatcttttactaaatgacatttgtaaatgatacctctcctgaaatccactgaaggaaggatattacaatagttaggaggagaaaaattgcatctatatcatttttaaataaaaatatgacgtaataataaaaattataagattatgccacgtgtacattactccaataaagaggtacgagacactcacatgatacttttgtggtgctttttttatacacatttcaaattcaaataaaatgtcatgcatatttgaactaatgacataaagctagatttacatttaaatggtatacctacaaatgtaatatagaaaacaatatgtgccaatttaccaaaataacattttacaaaaagaaactttgatctatatatctacatacaatgaaatttcaatatagtatatctacatttacaagaacggtatatcttcattcaccaaaaaatttgacaattacaaaatgaaatatcgatttgttatatatacgtgttggcattattttgttaaacaaattgatgtatcacaaaagattataagaactcatgtggaatcaaaatcaccagaagaaattatttgaggtgaactgccaaaaaaaaaatcaagtgctaacaatgattattaatgatataacttaatcgagtgatttctatcttctaacattaccatgtgcatgggtcaagagggaattttgagtgagtaatgagttattgtccaacagaaccaatggagtactactttaaggatattttggtcttggtttttagatcatgtaccaacccctgctctcactataagggaacaaagcttggtaggtacattttaccctagtgccaagtatgcatgctgtaagatctgcacaggcctatggatggtcaagattgctggtgcatatgcacctaggttcataaaatctgtaactacaccttttctgaaaaatcatccgcaaagaatggtagcactgttgattcttcatagcgtcagatgaaggcattttgtggtgtaaactatggaacacacatgggatgatatagtttgcattgcaagtagcaacgtgcagaataatgtcttcaagatggactccaacacaaacgaaagtcttcatgaccccgtagtttttgttcaccctaaaaaggtgctcttaaaattatgggctacaatagtgtgtgtgtgtgtgtgtgtgaattccagatctgcctatcatcattcttatcttaaccaacagagctttcataaattgcatatttttccatacaataaatccagtgggaagtccggacatgcatattgttcatcttgacctatagagcttgcaaaacttttacatcaatatttttatttattttttttggaaatgaactgaagtcaagcatattatcaactaatagaccatgtcaaacaaaatgtcaacatcaatatggtttagatatttagatgtaaaggtgaacgttggcactacatgtcaacattaacacggtttgtgtcatagttatctagcgccgatagtacttgccatgtgtatttctagaaataatatcttccagtagtccattttaccctacaaaggtaactttattttgtatcagcaaattttaacaagacagataggacagagacgggtaaataaccaaagaaagaacagttcttcaaatgaaagatggaaaaagaggaacctgtttcttgagcagggaccaagcatcgtcagatcctagtttgttgacatggtgaaggtacttggctttcacccccctggcaattctctcatctcttgtggtaacaatgactcggctacctcgaccaccatgactgaatggtatctggaggaagtcattccatgctctttcagtccacatgtcatccagcaccaaaatgaaattcttccccttgatggcattcagaaggcttagctcaagcacagatctgtcatgtgagctgcggtgatcacccccggtggcaatgatggcactcctcaggagatcaggttcattgaacttctgcgtgacactcaaccatatcttcttgtcaaacttctcctggatggcatcatcattgaagatgttcttggcaagagtagtcttgccaatgccaccaacacccactatggctaacaacaggctattgttctccgcatgaatggtctccttgtcatcagttagcaacttcaccaatgctgatgtatcctcttcgatctgatcaccaaccacacctgaccgctccaacaccggtgatgttgtacgactgatgagcggagaggcagtccttcgatcttgataggcttccagcttcatgaagctaaactcggcacctgtcttgcatatgctatcaaggctctggttgagcttcttgatacggctgccaatgtcatgcgcgaacaatggattccgtaggcagaacagcaaggggttgcaacagcccaagtcaactgaagaaccctgctccatggccttaagctggcagagctctaggatgtcagtggcgtcatacatgatgcccttcagcttcctcacccacccgtcaacatgcttgtcggtgatgcgcttcttttcagcatcagcaaggtagtccttgagaaattgaagcttttcatctagcttggtgatctcgtcggagacaccaagtagcatgcccacctcatctttggccacctgcaagagcaggtcgctgacgtaggacgcaaaagcatctaggacaacggccatttttcttgttcgcagacaagggctgtaagctatttgtgtgtagtggtgtggaagatagcaacaacgtatttatagtgctgcagaaggtagcaagctatgtgagtgccttctgctatctgacatggaaaaaaatttgatccgtttcttgagacatcagcaaagcaaaaaagacatgttgtgcaagcatcgatgttggattccataccttgcttgctttccagccagagaaaatccccattgatgtgcacttattcccctcccagtgcttttccttctggcaggggcaagaacgaaatcgagcggggcctctgcatcatggaaagaaacaaacaaatcattaccaccagctaatcgaatttgtactcgataaccagaataaaccaattacccaccgcgggacagcagctcttttgcgggtaggatcccagggccgggaatgcatcacccatggagaccgacataatcatggcatcgacgccagagtacaagccgaggcaaagcgctccagctgcgcatttcgccgaacgggtgggggggggcctccctgcagcgagggcacagccgtcgtgacgtacgagggggttcgaggcgcgcgaggaggctacgtaccataggacggcaggcggcggcgcggcgaggacgacggaggtgaggcggcggagcggcttgctggcttcttgccatggctcgccgccggctgctgctgccactggttctgcagaactcaagtgaaaagggttttgtcatgagaaaattgacattttgccattgtcaaaacggggtttcgctcgaatgccactcccaaaagtggtttcgttaaaatgccatcctcaaacaggggcaacatgttgtaatgccattttatccatttcttctcaatttaatgatttttgtagtgttttttcttgctgagatgactaaaataccctttatcctatctcatctctctcttcttcctctccgttgcatatacacagcacggctcggtggcgtggctgtggacggggacgacgccagctaagctggggacggggacggggaaggggacgacgccggcgtgggtggggaaggctgcccccaaacctagctgacgccgcctccgccatagccgccaccgtcaccccggcctcagatgtagcagccgccttgccttcagaactagccatcgtcgcgccaccgtcgtgtgtgtcatcgggatgcttcttgcgtgagggtgggatggcgacggtggagcatgtggacatacaggcggtggcgtcggtgcagctggggatggggaaggcggcgacacggctggggacggggacggggacagggatggcggcggcgccgacatggttggggcaagtggggatgttatcctacgtcgacgcggatggcgtcgccgacgccaccatcgtcccagccacgccgctgagccgagcagccttctccacccacgccggcatcatctccgtccccagccgcgccggcgccagggatccatctcctccacgcaagtcaactaaatggtcacaggggcaattttgtcacaccacggtggaaatcatttgcaaatcagctaatttggtcgaaatggcaaagtagcaatgtggcgtcgttcgaaaatggcattataacgaagccacaatccggagtggcattctggcgaaaccccatcctgacgatggctaaatgtcaattttctcttttgtcatcgggttggagaggaggcctgggggggtttcgtttaacctgacaggctgacacatttcatatggagtaaaacatccttcagtttaaaacaaaatatttttcatgaaacttggggaattttagtcaaattttacagtatattttagataaccccagcttttgggagcaagatatgtatacggttgctttgaaaaacgtatgttcggataggaatctataattgatatgttaacttataagctgtacacaagcgactgaattgatgaaaataattttagtataaaattctaaataattttaaaataaattctaaacttgttgtggctcataattcgtggagagtggcctcataatcattttactctatccctatatagtctctggatgcacagtacataaaaaaaatgatatcataagtgcctatttatttggttggagactaatttgtcataaatgtgacaaagctacacagagtatggtcaaaatggagtatgatatatgggacaaatatgctaataaagtgtggcttgattaagctcaacaaaaggcgagttgtgacacaccttaaggtttggcatgtaaaacattgactgccaaccaaacattctcaatttgagctgtccggtttttattagaaccggctacaaaacaagctcaagtgagatttgaacccagaaccacatgggatgctatgcttctgaagaaataagtaatatatttaattggttaatgaactgctttagagctttagacctatgatccaaccgattaaaccagttaaccattgaaccaagagactcaccagttcaattgtcggtccggtctcaataactataaaacaggccgataattttgtgctacctaccatgcaactagcaccaatataaaggcaggtaatttgtgaatgttaaaatctggcctgtcttgggcacgtgcgagctgcgcagggcaaaaaaaaaaaattaggggccccaaaaattgtgtttaattcaatcatgaggtgaactccacagtatatacaagagttgatgagcgtaaatctgaggccttttatttccaaaatatgtggtgcaccaacaaaaagtttgactgaattgaaatgccagtgttttatatgccttcttcacagtgacaaatcagcctcagtcagactctttcctgccaactgaatcatccctccatgatcatggaatctgcaagaggtgagcagctttaatttgatctgcttaaatttcataggtcaaattatggcataaaccagctagtggcaacagcaaccagcatcccaagttacagaaattgccaatataaaagttaaaggctaactggaactaacttacaagtcaaatcttttggtttattttgtttcatttactaacattaaactttgcagtttataccttcagaccagagcatcccatgaatagaacttgaaaaataagaccccctaagaagtataaagggctagtaccaaaggaattgccttaaataatagcacctatgaaactctgatgtgagcatctggtgtgatagattgacaaaagccaccgcttggttttctgtaagcataacgacaacctagcatttctcctatatagctgcaagttctgctctcgttcttctgtgagcatactactttgcatcctcgactctgatcggggttcacaaaaccgtacggttatcgcggttatcacgtgcggtaatcttttcagtttttgaaaccacgatataactcgcgataaccgtcaaaccgtggggtggcggtaaccccaccccaaacagtttggtaaaccctgactctgatgcagccgtttaaatattcggcggccgtttgaagtcagcagtgtagcaggtggccgaatcggattccagcacttggaggacttgatcttgatagcatcttgttcatctatgatgtgagcaacggttgtatccgtagtagccatggtcacatcatcctccccttctttacggaaaaccgtcctcggtttttccatatggtgctcgtcacatggtccatttagaataatctgtttcttctaatcaaaacaagacaaactcgagataatatgattagcaataataggtctctctagcttgcatattttattcacatctacaggaggttctaaatccaaacatatataaattttatacaccaagtatatctgtctatcattatattcgccaaagatatgaaaaataacattagtcggacatggcaaatcagttttatcaaataatttctccttcaaactatcgagctcacaaaaatcatcacattgaacatagcccaaagtatttaaaaaagatgtcaattcacgttcctctacttcattagcaatgtgaataacatgcttaaaatcagcacacaaagaaacacaagaaacaacatgttcattcacttgttgtggcatggatttaagtgaagcattatcacacaactcttctttatcataaggaacagcaagtaaatcaacttgtgacaaaggcatctcagcaattggttccactaatggttgctcttctctagacatgtttaattcattaacggcacacttaccttgattaattgcaacaccattaagattacctgtggttctctcttcggatgatgtaggtgcatcagtcttctcttcttccttcgtgagcgatgtagatgtcatctcgatcatattgctcttctcctcatggtgaatgttcttagctccctgcaaaatgtcagtaataggaggcacaagcatagattgtttcttacttgggttctttaaaatattgctctcaacactgcaagcaagcatgaacaagtggcctatatgattatatgttacgttaataagcccagcctgaatatcagaattaagccctctaaaaaatctagtcattgtgttctcattgctttcttttggaccaatataagtgatacaaattttaaagtcatgaaagtactcccgcacggttttatcaccctgttttagatgttctaatttctcaaggagagcacgtctatagtatgaaaacacaaatatttttctcatcagtattttgcattcatcccatgtttcaagcttatttccagtatgccaccaaaaagatgcagaaccggtaaacttattactagcagccttaatcatttgagcattagaaaaatcatacttatcaaattgtttttctactgctagctcccaattaatgtatgcagcggaatcatactttccatcaaaagatgtcaaaacagactctactcttgcaagattatgatcatgtaccttatttgcgtcatgttggtcacttgccatgtgatgtcccaggtgaaaatgtccacattgagcacgaacagctccaaactctttatgtaaccctgccatagttagtagcaaacaagaaacatatacaagaatatatacgttcctatcaactactaggtagtggaagctcacaaatcacacacactcaagctttatatcgagctcttacaaattcttaccaatgcaagcggaatggtgacatacaccaactcaaccaagcaccccaatggaggttggatatatcgatgccttggcaaacacctgtcgtacggctgcaatcaaatctgtggagctctgggtaggcttaagtatctagcaaaggaatagcaaatgttaaaatcagagaatgcaaagttgaataaaagttcaaactcagtactgtgctggtcctaggctagaacgtactagagacgcgagcctagacacaaacgataccacaagatagcacaataaaagcacaactctgatatatcaaaacaacctcaatgatagcaattgattttctcaccttttctttcttttttctatctttttttactttcttttcttttttttcttttcggtgcggcttttgttttctttgtttttttatgcacctttctgccttttctcactttttttatgatttttttttaccaaaaacagacttaaggacctcaatgcaagtttatagggactcaaatgtaaatacaaaatttactaggactcaaatgtaaaagtctaaacaaaaataaaaattatacaaaaatggaatgctgagtttatgtcggttccgttttcccaaacaaatctcgaaactgacaccaaacaaaaattcaccaaggtgtttaacacgactcacactttgtgatgtacgtgatttggagggagccggactgaggaaggaatgccgcatgcaaggtggtgggacttggtgagaattctaaaagaaggaaaccgataccgattccttttctgcgtggccccagatagaaaccaaaccaatctactatttctttccagatctaacttgcatactgccaaaaaaaatgatttggtaacttttcttcctcctctcgtgcacgaacacaagcacggccaaaacagaaagacaaccaactcagcaaccttatatgcaactcaacaactccaaaaccgaccgacaaaaacttctggaaactagaaaagcgaaatcccaacaacaagacaattccattttcctaggtcccgacgacaacaaagacacggcgggcggcgacgactgtggtacaaaacgtgaccagaactcgaaactctaaacgaactagacgctatgaccagcaacacgatgtgacgatgcaacacaaaattcaacaaatcaaaaactgaaaagaacaatgcaatggcacaagtatggctaggtaaaggatgcaattctttttttatggcaattttctggttatgggtagataaaaactcaccgagtaacgaaagctctgataccacctgatgaaccctgagttcctctcgacactcaaggcagttgtttggcgcgatctttcggtgagttgagataactacgatttgggagaaacgttgacgatccaactacaaccgtacgagacgttgtgttgcgccttagcgatcgatacacctctccgtgggttgttgatcttgccgatgcagatcaaccttattcctgcaagcaaatcgaagaaacaagcaagaagaagataaaagcaatttgaattgcaaataggaatgaatacacaagataagttggggtttcgaatacaagcagacggacggtctagccgacacgcgcgctgcaaggaagtagcaatggctaaactttcatctaaacaaaacccaagaaaccctgaaggggtacctaactatttaagaaggtgggaggacctctaggtcgtcctctacctggttggggcgcaccccacatgggccccacttgggccagggtcccaaacgaaattacaagcccataggcctattacaggtgacgcaacaccttcttccatcacgactgtgaaggaatttggcaatgaggttagatccgtttgaaagaggactccgagagctttccatcaagtactcacgggtcaaaaacggatgtcgtatgaatattcggcggccgtttgaagttagcagtgtagcaggtggccaaatcggattccagcacttggaggacttgatcttgatagcatcttgttcatctatgatgtgagcaacgattgtatccgtagtagtcatggtcacatcaggtattatagtctttttcttctaaccttagcacatgctaaacaacctagaatgacaagtattatgtgacggagatagttctaacaaacaagtggttgcaattctctatggattaaattggtctttttatacgcacgaatctcaaagctcaaccaatggctgatgcaccatgtgtcgtagtaacacggtactaccgtgtgaccgtgtccctaacctgtggagtgggaccccgcaacaactctcgcaccaaaccacgccgccgcccaaaccccccacctcgccggcgctaatggcggcgccgccgccggctctccgccgtctcctcctcctcctcctcttctcgctcctcctcctcgcatccgtagcagcagcggcggcagcgccggcggccgaggaggaggagttcacggaggagctgctcctgcgcccgctccccgaccgcaaggcgctggcccacttccacttccgctcctccgcgtcgccctccgccgccgccgccggacgccaccaccacctcttccccaaggccatcgcccagctggtacgtgcacccccgtgttctcccccacactgccccagtagatatagatctcgcgactggtcactggacctaggaagttagggttcgatggttagtggtcgttcgaattgggtgaattggccgtgcggagctgtagaatcaggtgatactagacggggttagagcaattggctcgttttttatgcgcagcaacggtgaggtgtagcaactcctgtagagatttttcagttgattcactgtagttgggactcgacgaggatattcactgctgtatgcataatgctgactatctcaggcacaattttgtattggatcactttatttgttttgtaaaacaatggcttcatgatattttgtgttccaatcgactcaatctgttttgccgtttggactttggttttcttgagtcgtctgtaaaacacatggtgtctaaactgcaatattgaaagtgttggtatgagtaggaaccataaattagcacaaagagaatgtgtccccagaggaccaggatagcaaagctacaaagcaaacttattctttatattaacagttttacattgttttcgataaatgttatgatggataagtaaaaaaacactatttaatgcagattttgtgatatatcagcacttcctaatatgaaaaacaagtctttgagaactatttttagaacaataaaacgatgagataatactgaatcatgaagatctgtgtagcatatgtcccctgtccatagttgcatgtagctaataatagatactactattaactaacgttctgtaatgtgctattgttcagattactaagatttccttaatgtgctcatgctctctaaataaccaacctaaatatcccttcatatggattctctatgctattggatttatatcaagtaaaaccataataattttgttccttctgtcacatcagaagaatggatcctccattccccatctgtttattaactttctaccgccttcaaagaatgtcctgggttactgttaacattatgctgtgcttcctaaaccaggtccaacaatttcatattagtgaattggagctatctttcacacaaggtcaatggaattatgagcagtggggtggatatgacccaatgtcgaccaattatgcaaagcctcctggtgttgagctgtgggcagcttttgaccttcctttggatgagattgatgccacatggaagaacctgacacacacactctcaggcctgttttgtgcatccattaactttttagaatcatccactgccttttctgctcctcgttggggattcaaattgaatgaagggaatctaagatatggtgcattgcctcgtgaagcggtgtgcactgagaatctcacaccttggttgaaacttcttccttgtcgtgacaaagctgggatagcttctttgctgtacaggccttcaatatataaaggatattaccattcccaaaaactgaaattgacatcatctcaatcttttggtattattatcgatcagacattgacagtggttctgcagccggatactttttggggtcagcaactacattctactgatggacaactgcagcccagctggtccatgaaagatctgtttaacaggaagttatcaggaaaatgccgtgtctccaaatcgagcagagtatttttagagattgagaacgatatagttgacaaatctggaactgaagcttcttggactaatgaactctttgtgctgtcaactgccccagacagggtgctcaaggaattaaataacatggatgcccaatcttcttctctatatgaatatgatgttagtaactacaacaatgataagcctttggatgttggcataacctggaaacttcccctcatatggtcttgcacccctgcaccgtatcatgcaaacagatttctcatgggtagtggaaatgaaagagggtcgattgctctgtcatttagatccactaatttgcataagcagttatttggaagctcaaatgattgctcaataaaagctgtagttttccaagttgttccatggtatgttaaggtttattatcacagcttacaaattttcattgatgggaacagtaaggctatttcagaagtagttgagaagattcatgtcactccttcagaagacaaacatttacctggtactctagagatgctactaagattaccttgcagtatggaatcagctaccctgtcgctggactttgacaaggtttgttctgctacttaaatttacttgtttcccctttgtgttttatttagtgatatatagaactaaatgttgaccttggtcttatatttacatgaatgcatatttcaggggtttctgcatatcgatgaatatcctcctgatgctaatcaaggatttgacatcccatcagctttggtaacatttcctgagttcaattctagccgaagttatcctgaaggtgatacattatttgtgtcacctttgctacaaacgttcaaggtatatcttgtgacttgactaatagtatcagaagcaaaagcaaaaagactaccatgtgaactgaaatgacatgcttcaatacttactgattgcgatattgttataacttgaaggaagatggcgtggtcaagtcatatacagaagtattgcttgttcccttgacaactcctgatttcagcatgccatacaatgtcatcaccttcacttgcaccgtcttagcactttattttggttcactacttaatgctttgagacgacgaattggtgaagaagagagggaattgaaaaaagcaggtaattttactactttgttcatttggttaccttttcacaatgccctgagttcatgacttcttgtgttctttgatctggttggtgatattgtttacttggatgttcgatctgaaatataaaattacaagttagtgctctattcgcacaacaattagtatcatgcggatggacaatggcagtattttgcttatgactggaacatagatttagtgttctactcacgtatgaaaggggtatgagttaggatgagttttttcaggtgttaagacaactcacactatgaattgcacaagcaatattcatacttatatgaagattatattttatgcaggatgtacagagaaaaaaaacatttggtttatttggtattgcctagtaataatttaatgatcttgataaatttagtgttctccaagagttcttttgttttagcatttggtgagagttcataaatttgctatggaaaagtcagcagattaatatagttatcaattgttctgtttactagctgaagtgctgaaccatattacactgcactatctttcttattttcgactagagtgcttctaggatattttatagtttgtgctagataatgacttctcagaattcatataagatagaaataaatcaatgtgatgtgctgaagaaaacaaagagaagattccttctatgcaatcgaatgttgtcttgatcccttgtccgctattgaaaaacatttgccatccttatatgccactggaattcaattttcatcccttgtgggttgccagctgtccatgtcctgtcaccatgctgttaactgaacaaggaaaatatcaaaacatgtcttcctctgccgccacctcattccccaccttgcctcctgctattgtgccggctgccgtctgagccctgttttctgcccccaatctccgccaagtagatcactgctgtcactgagatggattcttggatgcaacacggcccatcaatctctgcctgtgcattcctttgtcctttctgccactcccaaacctttcactcttactttggactgagcagacagcataagtcaacaaaaaagaaatcctcaaggcccctttctcatccacagtgtggatcatgccaaaatgacaaattatactgattgtacccaaatcagctggattctcatcattagctatgtcctgacaaggcagagattattcatgaagttcttcactcctatacatgccggtaaacatctaaagaaccacaaactctaggcttgtgcaggttcacaaaagtgctgggacatcttgacactacttccactagcatcaacctccacccgtccaccaagctgctcctctgcagccaggagcaagctggacttaagttcagcctgtcaagggcatgtcctctttatctctatagctacctgaggtaagtcaacagaagaaggcaacagtacctgttagaaaaaactaacatatcctttttaaggggttatggcaacttatgtaatggtcctacaagaagtggcatacaagagaagttctcctgcggcaaataattgattgagataacccttgatggcatagaaggaatttagtttgaagaaaacatggtttagaaatgcttgtgtttgggtgattacattattcgctgctttaacagatacatgctgttttaaacaatacatggtctggcaaatataaagttgaccatttaattttgtaataaataggaaacaattatagaattacacctttctctggtatctgttcaatcaattcttgtcttcttttgatttgatttgaaccattctctctggattctggagttacatttcaatatagccattgtggagcggagtttcattaggtgtaattttcaggttgttttttcttcagttctcttgtctcagttttcaagactatccttgtgttttgatgtagcgcaggaaaaatcagtttataatagcttgcctggccaaaaattcacaagtattggttattatgttgtggcattgagccatccatctgttgcttctggcactggatatcaagaataaaattatttttgctgcaccattggccctatcatctgatcttctgtagttcttgatcttcatacactttctacacatgaacaactttttagtacataccgtttgttacggcttgtatcactatcatcatgttgttgttttgggtgctgcattactacactactattgtggttataatcgacttctcagatttataaatttcaactcaccaatctcgatcttactacagccgcgaagcgtgggctgattcctctgttgatagccaagctaagggggaagaaggtcgacccaccaccacaaggatcttcacctacatctctgttgtcaacaaagctgctactcaaggttgtatttgtggcggtagtagctgtctcacttcattacttgtcaaacagttgaggattgatgccattgtgtacaattttgagcaatgtccaaaaccacggctgtagattgtattgatcatttcgtttatgtatcatatattatatcgactgtagcgctaggtgttgtgcttttgcatccaggccatcatgtcttagcttcatcctggactgttgaaattgacttgagatgataccatatcgtcgttgcattgtgtgcatcttttgcagcaagcaatgtaatacattttcagaaagttaagaaggaactgatataggagtgtacatcaatgcttcaaaaaaaaaggtaaccaacagtttacacagcatgtcaccctacctatacacagcatgtccctccgtccaaaaaaaacacttggatggtacatagattcgttgtactggattatgtaccatctaagtactaggttggagtatatgatagcagtcttccttctatacggcagcactaactcaattagtaaatctgatggttgcaacgggatctgcagttatttttttttttgaatgccatatggctagctctattgatgggaaaacatagttattacatctctaatcaaaggtttagaataaagccagtaggtttatcgactcgaatacaaaaacatttcctaacaaaagacgggatccgcagtattttattgtacccggtgagtacttacggtgcaggcgttgaaaggaatcatgcaagaaagattctccatttgttgaagaggcggagtttttctttttttcaatttgttggatcgtcaacatggtgatggtggtgctttctgctgttcccagtcacatgaaagttattttcttttctactattttgagcggctcatccaaatttgattacccatatctttatttgtatagccattaaaaaagattcccactcgatactcttcttcctccaatagaccatccatattacatactctatatcacatcctcctatattttaataataatatctttcaactatccatacatttgtattattttttataatgctatatttacaaacattacggaactatcaaaatagtagaagacgactaataccataatctcatttttatgctcaaacatatttatctgtacctattgaaagaagagagagtgaccgaaaaaaaagaaaaaagaaggatgataggagaagtggtagtcgaggtgacgactgggcagagccggcagagaagcggcggttggtgccagtgaccaggtggcgtaggcggcgcggcgggcggagaagtagcggtcggagtcggcacccgggcggtgggacgaggaagcagtggtcgtaggcctctagtggtcgtaggcctctcttcgccatccacatctccatctctggtaaacttctacctctccagtcttcaccttcactactccaccccacacagcatcgattcggctagatgcggaagctcggtctcgaagcaagcggttgcaatatggcgtgaggagagaggaacgccaaatttgacgtttctatctcccatgcactaaatttggaggcagcgatggtgtatctgtttggagcacgattttctcgatggaggatgggatagcgcatctgctgggaatggtcttagtggccttacctatgtggtgttcgtttataataagcatgaatgtaaagttagggcacggcaaaaaagccattagctcattattaattaagttttagttatataaatttaaaaaatatatttatttgatattttgaagcaatttctaaatagctcatattaaagttaacatatatatttgatgaattatataagattatctctattttttctcctctctccatttcttacctattcatttaatgtatttatcttaaagtatgtgaatagctagcttttacataaggaccaactgtctttattttttaaattatcttttcatataagttcatagttggcttataaccttctactatctccatcccaaattaattgtaattctagattgtttagcatatattaaggtttgagaaaaaaatgagaataccttttattaaatggtttatatgtaagagtgaagggtagttaagggtaggataaagtagggagaaattaggatgataattgattaataagatcattagtactatggctgtgtttagttcgtgtgccaaaatttttttaagtatacggacacacatttaaagtattaaatgtagactaataacaaaacaaattacagattccgcctgtaaactgcgagacgaatttattaagcctaattaatccgtcgatagcaaatgtttattacagtatcacattatcgaatcattgtgtaattaggctcaaaagatttgtctcgcgatttacatgtaaactatacaattggtttttttcgtccacatttaatgctgcatacatatgtctaaacttttgatgtgacggaaaagttggaagtttgaaaaaaagttttaatctaaacacggcctatattataacaattattttagaacaaatttaaatcctagagatacaattattatgggatagaggtagtattaaactaacaattattttggaacaaatttaaatcctagagatacaattattatgggatagaggtagtattaaactacttgttcataacggcggtatccaaatccaaagtagaatactctctcatgctatctaaatttattatagtactaggatatgtcatctgttagttgctatgttttgaaaaagaggtagtagaccgataaaacgctccacaaccgacgacaagtactggtaggataaaacgcacgggtgaaaacacggaaaatggcggagaggtcacgtgccaactcttgggggaaaggaaaccccccaccgccccacgtctacaccgacaccacggccccaccccgcagcgactaaccgaacccactcctccacctctctctctctctcttccccgcaccttcccttcccctggccacacctgccgctccagatctgcgcctccgcctcccccacgtcacgacgccgccgccgccgccgccgcacgcgcggccgtcgcgtcgctagctaacctccccttctagagccttctagacgcttctcccgatgcggaagaagccggcgagggcggtgccggagtggctcaacagcccgctctggtcggccccgccgccttcgtcttcgtcgccgtcgccgcccgtgccccccgacccctacggcgccgacctctccccgcccccgcctcctccgcccaagccgccgccgaccgtcccgcccccgtcgtacgagcaggcggtggggtcgtcgaggagggcgaggagcgaggcggggtgggaggaggaggaggaggaggatggggaggtcgggggtggggccgcgctccgggcgcacctgctcgccgacttcaagctcgcggtgggtgggtgggtggtgacgaggggagggggggttttggtttggatgaggggattggaatttcgcggtgaagtacgaattggggggtgtttggaatttccattttctgatcgtgtgttgttggggtttgcagctgtcgaagaaggtggtgaacatgggggagctgcggaggctcgcctgcctcggcgtgccggacggcggcgccgccgtccgcccgctcgtctggaaggtcccccacccgcattctcttctactctgctgctgcactactttttgttgtttctcggtacatatttgtttggggactctaccgtgagcaagcacggacaggcggacagcatagaacagtttcattaaaacgaaccatttctgcttcccggcatggtattatggaagtgattatgtttccagtgtggagacgctgaaagaaagtaatccatttccatgtctagtgtagattttgcctcaaataaacatccattattcaattttcaataatgagctttagatgggtactaattttcaagagtgaactttagaaggatactggttttttacttttaagtaccttgaactagttacctatggcatgggaacaaaaaggaattggtctgtattattggtgcgtatccctatcctgtttgccaattctcatatcatgcaatcacatgaccatctgaaattgctctatttcccaatctaatatgtatattgaataagtatgtcttgtaactataactacatcaagtttaatgcccaagtggtataggaaaatgaccactttcagcatattatttgttatttatgatctattgatggtttctaaattagcttttaacaagaaccgtgctatgtggcaacctccatagttcatacacaagaaatttattctattatatttatagtgtgcagcttctgttgggatatctgccaactgagcgtgctttttggcctcatgagctagaaaagaagcggagccagtatagtgcatataaagatgaatttctcctaaatcctgtaagttatgattgcccctctaaaatatttattaaattatcaatgaagatttattagtccaaaagactttttttattatcctttgtaaggcattttaagccttgtttggctaggccaaaaccctggtccatacctggagattttggccttgcgaaacaaggcgtcaattggttgtgtatgaatacactgatattttcttttgaccagtcagaaaaaatacggagatttgaggagtcaaagttgctaagaaagaaagaattaaatagtgacaaaattggccttctaccaagagccaaagttactaatgaagagcaccctttgagctttggtaaatctagcttgtggaatcaatacttccaggtattacttattaccatcttaaataaatctgcaaggcttgttgggaacccatggttgccagctggttccttcacgtgtcttaactcttatggtcccttcaagacctgaattgtgtttagttaatctgaaacattataatgtatttactttatgagaaattgtttggactgcttttaagttgtttggtggttggtattatgagtttgtctttgctcatgatgatcgttatatctagatatggaatcttaatttcttatcctcattctcattataatctttaattctttctagttaaattgctggtaggtacagtttcttgttattgttatttttctgatctggctgtgggatttttaatagtatttgcataacatgtggtctgtgaggtgtgtacagtccccagtatttcccaccagtctgtggtcattgttcttttcactaggttttgattttgttctgttcggtatgttggggctcatattaagttcccacattgcatttgttgtccgtcttcagaattgcgtgcctttcactggacctagttttgtgtaacacctcagcttctgagatctacattagctcatctcttccttaggagcaagccccacatatgcatagcaccccactttgacacttttctcattgttgctgtataaaatggttaatctggaggtgccatggttaaaacatttgagcttatttattgggcccaacctatctaaactcctcttgtgagactaatcctactaatacaacaccatgggccacacggccctctactaatggtcagggtattacattttgtttatgcactgttgtgaaaagctaaggacaagcactctctcgatttttatttacatgatgtttttgggctttgtcatagtccaagatgtagctttgaccttaattgtaatttttttatgttaatactaagtgtttgtaagtatttctaatagcaaatgtaatgataatttttttaatcaccattctatatattcataacatatggaggatcaattttagaaagtttagtttcatggattttgattttaggatgcaagtaaaaataaatgaagggaatatattgcaaggaaagaggaaagtgcacaactgtttagtccttctgaattctgtattgagcgatgcgaaaacatttatgttttctcgcctatgtgtttgatatgcactgaacatttatgttctgtatagtctagatgttaattattaaacatggttttctggcatggcagccacaagatttcatttgttctttttcttatattctgataaatgtaaatttacaggaatcagaaatcctggaacagatagatcgagatgtgaaaagaacacatcctgaaatgccgtttttctctgccaaggctaaccaggtttcacttcagtgccttggaattccttatttccatttaaactacaagtaattgtcatttggactaaatttttcaaacacatttcaggaatctctaaggcgtgttctcattatcttctcaaaattaaatcctaccataagatatgtgcaagggatgaatgaagttttggcacctcttttttatgtgttcaagaatgaccctgatacaagcaattcagtatgttcttttactatttgatcacatggttttaaatggaacgtttgaatgttgacaaaggaggaatttatctatcataaggatatctatctgcttttctctctcgctcattacatggaacacaaaaactttattgtggatattttgagtttctaaaatcaacactaaatgaattctttctggagaattagaatagctcatttatatgaatattaattcacaacttggtctgttttatgattggttctgaaatgtgttcattagctgaaccattcagttttggaattacaggcctcagctgaagcagacactttcttt

SEQ ID NO: 33727 - DNA, 5216 bp, Oryza sativa
  unsure (1)..(5216): unsure at all n locations
atgttcttttactatttgatcacatggttttaaatggaacgtttgaatgttgacaaagnaggaatttatctatcataaggatatctatctgcttttctctctcgctcattacatggaacacaaaaactttattgtggatattttgagtttctaaaatcaacactaaatgaattctttctggagaattagaatagctcatttatatgaatattaattcacaacttggtctgttttatgattggttctgaaatgtgttcattagctgaaccattcagttttggaattacaggcctcagctgaagcagacactttcttttgctttgttgaattgctcagtggctttaaagacaactactgtaagcatcttgacaacagccaagtgggtattcggtctacactttcaaagttgtctcagctcttgaagagacatgatgaagagctatggcgacatatggagatcactacaaaggtagggaatattcagtaatatatttcacagactgcaaaatctactgtagcatgcatgctgagaaagtgcacatggaattgcacccagaaaaacttgtcatgttatttgttcaatagctaatattggacatcttactatccgtaatgtcacctcttctcacttttccacaatttagggttaattaacctatggctatttgaagtcatgccattacaatttgccattacaatggcatagatccaattaacccttctattttattagcttgtcctaagtgaaaatgctagtattaccactggaaaggaacaggaactggtctattttctcgcattgtacagttaaagttgctcttatttccttgtcaatttaacagtatgttactgttttaggtttatcttctgaacaagatactaatattgatagcctgctatattgtttttgtgggtaaatttagtcactctggtatgtcacccaccattgttgatagtcatgcatggatattgaaaatacaggtatatccacaatactatgcatttagatggatcacactactgttgacaatggagttcagcttcaatgtgtgtattcacatttgggatgctatcttgggtgatccagaaggtcctccggtatgtaacctctggactaagcctccaaactaggtttgcagccatgttacttgtacaactgcagggggctaatgctttgcatgttcttgtgcacgacacgttgctaagaatatgctgtgccatgctcatccttgtccggaggcgcctcctagctggagacttcactgccaacatccagctgctgcagcactatccaccgactaacatcgaccaccttcttcacattgctaaccgactaagaggaagcgtagccagctagcgatacattctcattttctgcatatctgtacctcgatcttgtctttgtggtggcgttcatctgatcatattgtgaacttggcaatgtaggtagctgtgtttatcccattttggtgtgggtgtggctggcaatgtggttgtagaagagagcgttgaggccctagatgcatttcttgttgtgtttacattagaaacatctcccctatgtggaaaaagcatcagttttacatgttccgtatgaaaaatgttgtgttggatgtgttacttggtagactatacagatgagggaggacttaggactagtaggaaagagctatggttaggccacctcataaacaaatcaatagttttcagagttttagccattagttatagctgtcaatgtttggataaaattcctacttcctcagttttcttggcctctgtcgcatttgtaactgaaattcgtactgtaaacattgaaaaaaaaatcgaggtaaaatttgtaggtttggctcgagtttctttgaaattcgtgtttgtattaactctttacttgaaaggaaatgctaatatgactatgaaatactagcaaaatactctattggtccaattttatgaggcatgttgactttaatttatggtgtgatggactgattggtcgtgtgggctgttacgagatgccttgcattccttctcacattggtcgccattagatatttttttaacttttctatttttaattttaaaaataaaccctttcataatttatttccaagacaagacttcaatttccatttcaatttatattggagctagcgatcaatggcagatattttgaaaggtaaatatttccaaaatttatttgcctttcaaaatacattctcatgccttttggctaagccagtcgaactggcgtgggaaaacaacgctgttaggtcagtttgataagcgtggcaacgttatttggtcacgtcaaccttactagcgtggtagaacaaaaatatcatgcctgctaagtgttagtgttgttttgtcacgtcagaccaaacgatttagattctaaaaataagttttatgaggatttatttttaagaataaaaaaaataaaaagtacaaaaaataaaaacaaaattctacccattatggagaatctcgatgacagtgctcttttattgctgatgaaattcctttgtataaaagccttggtaggtggtagctagtactattatgaaagcctcggtagctattatggaagcttctttatataattcctttgatccccgatgaaagtttaggaggctacttttaatttgaaaataagatatattggaataaatatcctaagatgtcaaaaggggtatcatggtgaacgatattttcaaaagatgcatcatcaaccttcatcagcggttaaaggcacaatacatcatcaagattgtacaggtacaatggctactaactctatatataaaggggagcagaagatggacctgcaaagcatcacctacagtttgcacaaccatcacaacacatattcagccacacaaacattagccactccgctctgtttactatactagccatccgaccatgtactcttaaataaaaaactcgatcatacggcataagccaagacagtctaaatagagcatgaacactagtgtgaaatttctcttcttgagaagatgtcacatgggacttttatgatgttgtgaagaaaggaaaaaggaaaaaaagaaaagaatattgtctgttaattaacagactttctacagatacctgaataacctataatcattagtcaaaccgtctctaactatatatatctactgggcctacattggtcatacattctcatttcctgcatacctgtacctcaatctcattttctgcatttcggttcatacacttttatacatataacatgtgtatttgatctgaattcgtgacccggatatgtttcctacttcaactaggagttctaccaaatgttatctaaagagggttggagagtttttattcagtaatgagtacattaatacatagaacctgaacaatatctacctgacaattgtgatgttctggtaaccacgaatgcgcaagaaaaatatcaaatcgcaaagaaaacaaaaaactgcccacataccgttttcactttttttagtgttcaagtacacccctaagcaaaatcaatctggttcactgatctcccagtttaacagaatcgcctgctatttgtggccttgagtcgtcatccatctttgcggtcacccaatcttggatcttcagctaaaacttctggatgtaaattagcccccttcaaaatccccatggcgttttccacttgtaattggcccatatactcatatgatcttcttaccatgttactgtgcacctactgaattatccaagcagtagaaacagtaagcaactaaactaatggtaaaacatacatgtcaacattttgagagaaaacttccatttatttgttgactagacagattggctaagataccatagctatactttatagttataaaaactagaacaaaaaataaaaaagaaataagagaaacgacctgaaacaacagtattaacacttaacagcggcatcaacttagttacctccaacttgggatgtgctcgggctcggctcgatattcgtctcagtgctgtcggaatctcttttgtagaagacaaaccgtttgtcggtcttgtcgtcttccgcatctgtacaggcattcacttgctggatgtgtttgatcttctcccactcgggggtgcctttcccccgggagatcagggtgagaagatccaagttgcaagtgatccgcagatgacgtagttttgctggaagatctctaagacaatctgggagcctttccatctcttggtcattcaactccatgctctgcaatgctggcaaacgctgcagaatattcagctttgggcatctggaaactgtcaggctttccatttttggaagatcactgatcctctctagtttgaagttggaggagacgtggagctggacaactgaacagaaaccatcgatggagatgaggttcttgacattatcaacaaccaaaattcttagagaccttgcctgggatgcaagcccaggaggaagttgattcagtaggcaccagctgatatgcatgttctctagcttgggcatggcctccacttgatcttcccactcccattctttccatttcatcatgccatacataacaagtttcttcaactttgggaagccaattgcattgctgcttcccgtagttgttgctgcgtcttctgttgcgctctcagccacaatctctccctcctcgccagaaccaactgacccagcaccagaaagccgatgatagggcccccggttgtgggtactacctcctccaattgttgttgttgttgttgttgctgctgttgctgcagttgctgatgttgctgctgttggtgttgtcgctgcaacgtcggtttcacgaggaccaggtatagatgactggaggaggaatccatgcccgatgtgcttgacattcagagtatgctttatgtagaggtacccaaacaagggagctgccataaagtagatggaagctggttgcagcatactaagttgtctagctttaataccctcagttccgcaaggttggtaaaaatcaaccatctcgggagtcgagctccaaagaatcccttaatatttagctcctgcaatttgggtggagggcaaagctgatcaaacacctcctcgactgtctccttatcgacctcgccgttaaccgacagtctacttgtgcagcttaacctcaaagatgcaagattcttcttatcatcgattttggcaagactagccattgagccggaagcacagttct

SEQ ID NO: 33728 - DNA, 649 bp, Oryza sativa
gcactgagagatcccctcataatttccccaaaacgtaaccatgtgtgaatagattttgagtaagcagggttgcagccacgagtgagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaatccatggctcctttgccgacgctgagtagattttaggtgacgggtggtgacaatgagtccgtgtcgagcgctgattttttcggcctttagagcgagatttatacaatagaatttggcatgagattggattgtttttagtcagcctcttatagcctaaagtctttgagtgatagatgacatatcatgtaagttgctgataggtttccagttttccgctcct

SEQ ID NO: 33729 - DNA, 435 bp, Oryza sativa
taacctcaaagatgcaagattcttcttatcatcgattttggcaagactagccattgagccggaagcacagttctccagaccctctagtgcaagatgcataagttgggacatatactttaactccccaaggctgcaccaatcttttgctatgacgctttccatcatctgactggggaaaccatgcagtgacaccatattcttcagtccaccaaacccttcttctggaattgactttatttttgtctcagagatattcagatatcttaacttgtgcagttccacaatgctcttgggaagtttcaccaattttttacagccttgaaggcaaatgtactgtaaaaacttcatctcaccaatatcattgggcaaagcaagggcatctgtgtaactcaggtccaagtatctcaggtgtttcatatgatgcaaactatcgag

SEQ ID NO: 33730 - DNA, 476 bp, Oryza sativa
ccttatgatcctagcttgttgcttcgcaagaacaagagaattgctaggaaccaactggaatactcccaaatcattggctcgctgatgtacctggctagtgcaactaggcctgatatctcctttgttgtgagcaagttgagccggtttacctctaatccgggagatgatcactagcgtacgcttaagcgagtaatgcgctatctaaaaggtactatggaattggggcttcactattctgggtatcttgcggtactggagggatatagtgattctaactggatctctaatgtggatgagatcaaagccactagtggatatgtcttcacactgggtggtggtgctatttcgtggaggtcttgcaaacagatcattttgacgaggtcaaccatggaagcagagctgacggcactggatactgctactgttgaggcagaatggctgcgtgatctattaatggatctgcctattgttaaaaa

SEQ ID NO: 33731 - DNA, 1168 bp, Oryza sativa
  unsure (1)..(1168): unsure at all n locations
nnnnnnnnnnnnnnnnnnnnnnnnnnnnnnnnnnnnnnnnnnnnnnnnnnnctggtttcctctaaagtattaaactttttgaagatgtcctctcctgtccagtaacttgttagctcatttttacttattttgtgtcctccaggaaacaagctacacaacaagaacaaagattttttctcatccccttcaagatggttgtaactggattccaagggcatgtatatcttttgcaacacttcggccttctcaagagggtaggaactctcaagctctgacaatgcacactcccagtacctcttgtcctttccacacaggactgtcccgattacatctagtgcaagaggtaaacggccacatcttttcgctatttttccttccacggtttctgttccagatatgtcaggaactcctgctttgaatttgcaaagttcccatgattctttctcagttaagaagttcaccgaaatctctacttgtgcttccatgtactagcaaacttcgattttttgtgtagtgacaattactttgcattcctcgactggtatgcccatcttccagaggtcnnnnnnnnnnnnnnnnnnnnnnnnnnnnnnnnnnnnnnnnntcttgtgtaggagacataccacatcgtttcatcgtatccatcatctgaattagccttcacttgctggatatggctgatcttgttccactcaggacctgtatctcccatggctatggaactaagaagctcaaagctgcagtccacgaacaaattcctcatgcttacttgctgcaaataaccagggagtgtttcaatactatagtccttaagtgtgaggattctgagttctggcacattctccaatacttccattttggggcagaacataatgtcaagcttccgcaatttgggaaaattagatatcctctgcagatcagggttgtcatccacactgagctcaacaacacaagcgaagttatcaagagacttgaggttctggacctcacatatccatagtttcttcagagcccttgcatggaaggcaaggccaggaggaaggcacctcaatttgcaacgctcaagtaaaaagctcctccaagacaagcattgcttgcacttgttcctcccacttccacttcttccattccaccatccccacgaagaatagcacttgcaatcttggaa

SEQ ID NO: 33732 - DNA, 609 bp, Oryza sativa
  unsure (1)..(609): unsure at all n locations
nnnnnnnnnnnnnnnnnnnnnnnnnnnnnnnnnnnnnnnnnnnnnnnnnnnnnnnnnnnnnnnnnnnnnnnnnnnnnnnttgattttccaagttgccacattagattatttaaaaaattaaaaatcaaaatttttcttttgctgtgtttgtaaattaagatgccaattgtaattcctatagcagatatcaataatatgatgttaaaatattcagtaaaaaaaaaaagaactatactagaaaatatctattcaacacaaaagaggcagtaataaaaagaggagcaaggcctggtgtggcgggcgcggaggctcacgcctgtaatcccagcactttgggaggccgaggcgggcagatcacgaggtcaggagatcgagaccatcctggctaacacggtgaaaccccgtctctactaaaaatacaaaaaaattaattgggcgtggtggcgggcacctgtagtcccagctactcgggaggccgaggcaggagaatggagtgaacccgggacgtggagcttgcagtgagccgagatcgtaccactgcactccagcctaggcgacagagcgagacttcannnnnnnnnnnnnnnnnnnnnnnnnnnnnnnnnnnnn

SEQ ID NO: 33733 - DNA, 543 bp, Oryza sativa
  unsure (1)..(543): unsure at all n locations
nnnnnnnnnnnnnnnnnnnnnnnnnnnnnnnnnnnnnnnnnnnnnnnnnnnnnnnnnnnnnnnnnnnnnnnnnntatggggcataacgcaccacaaaacaaatgcaaaagctaaagaaagacagagcgcgcctagactatttgctaacaactttgatgcatgtagaacccaagttcatcttttaataataatcttgcagcaagtggcatttgagaaagctctagaacgattatgatagctagcacaaatttcaggcgccgtttccctaattccctccaaatcttggcacgttactgctttatttgtaagctttatagatcactttcaaaatcttctttcaatgtaggatctcgtgaatctatgcactataaaaaaaattcaagactacgggaacatgtcaccggatacaccgagaaatgcaaatttagtttctatcgatttgtcccaaatgcatgttcttttatcatcaagaaaagttcacatttgattcataattatagccaaggttagannnnnnnnnnnnnnnnnnnnnnnnnnnnnnnn

SEQ ID NO: 33734 - DNA, 709 bp, Oryza sativa
cttacaactacaagtaaagaatgacagtcccagtcttgctaatcctgtatatacaaaccattgtttctcaaaataaacagaaaaaaaaatgcatacaagaaaggaaggcaacctacggtaaacactgcagtatatgagtataaaattgaggcctctgtgacagccaactcaacggcagtgccccttatttctgaaaaagcatattatgccagaaaatggttgctgaattgaaatacagtttgatttccgttcttcgcaacaacgaattatccaccctccaacaaggagtggggatggtggttccatctgccttgaccacccttcaacaatcatccctccatgatcatggaatctgcaagagaggggcagcttttgacatgctttccatcagatgtaaatgttgttgatgtcactaagttgtcctagccatgctattgaatgaacaagctagaggcatcagaaattcgcatcctattgacagaaagcacccatataaaagacaaaggcttattggaggtgacctacaagctctattaattttttcgtacaaccgcgtacaaccatctttgttgctggtaggatgctttctaacatatcttgcccaattcgtgattaacaataatcaatttaacattggagctatctaacgaatcatgaaagataaatggcaaggtatgtatctctctcttttttagtcatttaccaaaga

SEQ ID NO: 33735 - DNA, 722 bp, Oryza sativa
  unsure (1)..(722): unsure at all n locations
cccattatcgagaacgatctcgacaaatgcagagtcgtcgccccgaacctaccaatgacctatctcatagcaccgcccatggctggactattcgagaaaaggtggttaacgaatacttcctcgcgaatgttgtcggcttgatcacccgacatgattgtgaacgaacatccggatatgctataaggtgggtatgtgagtcatgctgcccacatgagatgcacatgtaataacccaactctagctcttccattggtgttcgagagataattctactcgctcgctggttcccgaaccagtacgtagcaatctctcgcaccgcaacctccattggtgttcgagagataattctactcgctcgctggttcccgaaccagtacgtagcaatctctcgcaccgcagcttccattggtgttcgagagataattctactcgctcgctggttcccaaaccagtatgtagcaatctctcgcaatcgcaccttccattggtgttcgagagataattctactcgctcgctggttctcgaactagtaaaaagtagcaatctctcgcaccttaacttcagatggtcgaggtacgactacagcaatagcgtagcggtcctcgcaccatgacttcggatggttgaggaacaactacgactggtcttcgaccggcagcgtagcgnnnnnnnnnnnnnnnnnnnnnnnnnnnnnnnnnnnnnnnnnnnnnnnnnnnnnnng

SEQ ID NO: 33736 - DNA, 668 bp, Oryza sativa
  unsure (1)..(668): unsure at all n locations
tgccgggaagcagaaatggttcgttttaatgaaactgttctatgctgtccgcctgtccgtgcttgctcacggtagagtccccaaacaaatatgtaccgagaaacaacaaaaagtagtgcagcagcagagtagaagagaatgcgggtgggggaccttccagacgagcgggcggacggcggcgccgccgtccggcacgccgaggcaggcgagcctccgcagctcccccatgttcaccaccttcttcgacagctgcaaaccccaacaacacacgatcagaaaatggaaattccaaacaccccccaattcgtacttcaccgcgaaattccaatcccctcatccaaaccaaaacccccccttccctcgtcaccacccacccacccaccgtgagcttgaagtcggcgagcaggtgcgcccggagcgcgggcccacccccgaccttcccatccttcttctcctcctcctcccaccccgcttgcttctcgcccttcttgacgaccccaccgnctgctcgtacgacgggggcgggacggtcggcggcggcttgggcggaggaggcgggggcggggagaggtcagcgccgtaagggtcggggggcacgggcggcgacggcgacaaagactaaggcggcggggccgaccaagagcggcttgtgagccacttcggcaccg

SEQ ID NO: 33737 - DNA, 656 bp, Oryza sativa
  unsure (1)..(656): unsure at all n locations
nnnnnnnnnnnnnnnnnnnnnnnnnnnnnnnnnnnnnnnatcacggagtgtattcattgccgccgctctgttaggtacatcgttccagccacgtagggtggagcatctgaaacgatggggtatccattgtacaatgggttctgtgtaaggaaatacatgtcggagctgtcaatcctgaagttatgtagaactaatgcacaatgtatgatcttggtatggtcgtcactcctaaggaaataaggtatttccctcaggattctcactggcttttgataactccaaatgtcctttccactatgttacgctacgaactgtgcatttagttaaaagtatcttcctttccatggggcaaggctgctcccttattacccgcaaattcatccaagtggtaccaaacatgtgggtaaagtggtaggaatctataccggctagcatatcccgagtccacaaggaaatatttccctgcaccaacaaattagcgaagtgattatttctggaaaatggacactaacatttgcaatgtttgaacctaaaattcaaaacataccccatggtagcctttgggaaacaaaacggatagccccgtactggttttggtaagttgatcatgcacagaccctatccacccaacatcttgaaaaatgacacggtcgtcc

SEQ ID NO: 33738 - DNA, 645 bp, Oryza sativa
  unsure (1)..(645): unsure at all n locations
nnnnnnnnnnnnnnnnnnnnnnnnnnnnnnnnnnnnnnnnnnnnnnnnnnnnnnnnnnnnnnaatgattgctcaataaaagctgtagttttccaagttgttccatggtatgttaaggtttattatcacagcttacaaattttcattgatgggaacagtaaggctatttcagaagtagttgagaagattcatgtcactccttcagaagacaaacatttacctggtactctagagatgctactaagattaccttgcagtatggaatcagctaccctgtcgctggactttgacaaggtttgttctgctacttaaatttacttgtttcccctttgtgttttatttagtgatatatagaactaaatgttgaccttggtcttatatttacatgaatgcatatttcaggggtttctgcatatcgatgaatatcctcctgatgctaatcaaagatttgacatcccatcagctttggtaacattttctgagttcaattctagccgaagttatcctgaaagtgatacattatttgtgtcacctttgctacaaacgttcaaagtatatcttgtgacttgacttatagtataggaaccaaagccaaaagacttccatgtgaactgaaatgacatgcttcaatacttactgattgcga

SEQ ID NO: 33739 - DNA, 491 bp, Oryza sativa
aggcttctcttcgccatccacatctccatctctggtaactttctacctctccagttttcaccttcactactccaccccacacagcatcgattcggctagatgcggaagctcggtctcgaagcaagcggttgcaatatggcgtgaggagagaggaacgccaaatttgacgtttctatctcccatgcactaaatttggaggcagcgatggtgtatctgtttggagcacgattttctcgatggaggatgggatagcgcatctgctgggaatggtcttagtggccttacctatgtggtgttcgtttataataagcatgaatgtaaagttagggcacggcaaaaaagccattagctcattattaattaagttttagttatataaatttaaaaaatatatttatttgatattttgaagcaatttctaaatagctcatattaaagttaacatatatatttgatgaattatataagattatctctattttttctcctct

SEQ ID NO: 33740 - DNA, 1145 bp, Oryza sativa
gtggagaagaaagaatatatagaaatttagtttatttgctaaagaaggttttataaaatagctgagaaggaaaatatagtgaaagttaatcttgaattattgaaacaaagtaaaatgaaaaattaaaataagtacaacacattaatattagtttaaaactttataaatagtaaatatataattatttagtgtaatatttcataatttttgtatgaataatgatatgtcattattgtgtgactgttgaaagagtttgtaattattttataattattgtatgactgtcattattgtacgaataattatgtgtgtacgattttttttcatatcatgtagatggatcggcaatggatgtatgctgaccgtcggtccaaagagtttattgatggtgtgcattattttttgagagtggctgaagctaacaggcaaaagggttttatttgttgtccatgcaataagtgtaagaatcggaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtacgctggatttgaaggaaataaaacgggtgaggaggaaagggatgctgatggtaacaacgttgcggatgatcttggttagatgttgcaggacgccaaggaggattgtgaaagtgaaaagggggcccataaattggacaagatgttagaggaccacagaacgtcgttgtacccaggttgcgagcaggggcacaaaaagttggataccactctggagttcttgcaatggaaggcaaaaaatggtgttagtgacaaggcatttggcgatttattgaaactcgtcaagaacattcttccggaggtaaacaaattgcccgagacaacgtacgaggctaagaagatagtctgccctctaggactggaagttcagaagattcacgcatgtccgaatgattgtatcctgtatcgcggtgaggagtacgagaacctagaagcatgccccatttgcaaagcactacgatacaagattagacgagatgatccaggagaagttgacgggcagctaacgaagaaaagaattcctgt

SEQ ID NO: 33741 - DNA, 25377 bp, Oryza sativa
tggagagatgagcagcggccatagcacttggtccgttatgatgtgtatctacaacctccccccgtggctatgcatgaagaggaagtacataatgatgccgattataattcaaggccccaagcaacctggtaacgacatcgatgtgtacctaagaccactggtcgaagatcttaaactgttgtggaagaaggaaggtgtccccgtgtgggatgaggacaaacagaaggagtttaacctacgagcgctgctgttcgtaaccatcaacgattggtctcaccaactgggactaaagatccgggggtatatattcccggtgcgccctcgtcttctccaccaacacttagacgtttttcgatctcggcttctccttcgctgccaccgtgcctagggcaaccccgcgctgacaccgccgtcgtctctcgccgtcgcttggcggtcctcgccgcctccgccgcagactccgccgccgcatctcttgggtgagagccaccgctgcctctctctctctcgatctcgatctcgatatatctctctctccacggccaacgaccgacttcgacgcggccgccgccgcgacggcgccaccgccactgccactccgccgcccccgcctcgagctcgccacgccgccgcgatgccacgccgtcgccactgccactccgccaccaccgcctcgagctcgccacgccgcggccgccgcgcgccgctgccgcgcccccacgccgccgggccccgactccgtcgtcacgcccgcacgccgccgggccggcccactgcgccccgacgccaccgccgcgccgccacgctactgacgatcgcgcccaacattgccgaccgttaacgaacgtgattgaaacgtgaccgaacgcgaacgaacgttacgaaacgttaacgaacgcgaacgaacgtgcacgaaacgttaacgaatgcgaacgaacgtgaacgaaacgttaacgaacgcgaacgagcgtaacgaaacgcgaacgaacgtaacgaaacgttaatgaacgcgaacgaacatgcacgaaacgttaatgaacgcgaacgaacgtgaacgaaacgattacggaacgcgaacgaacgtgcacgaaacgcttacgaacgtgtatgcacttgtactaaaagtgtgagaacgaacgcgtttatactaatacgatttactggtaatacatatatgattatatatgtaacttggcccgtttagactaatacattttcctgataatgttgcagagaagacatcgtcgtcgtccctcaagccgaagtggtagctagccatcgaaggaattcgcgcaggcaaatgatgtaaagaagtgattgttagatatttaatataagattgttagacttagcatatatgattattacaattttaatataagattgttatcgatttaatataagtttgtaacacttagcatatatgattgttagagatttaatatattattgttagacttattatatatatgtgactattacaattttaatataagattagtagcgatttaatatgagattagtagagatttaatataagattagtagcgatttaatataagattgttatacttagcatatatatatgattattacaattttaatatgagattagtagcgatttaatataagattgttagacttagcatatatgattattacaattttaatataagattattagagatttaatataagattgttagagatttaatataagattcttagaagtagcatatatatatgattattacaattttaatataatattagtagcgatttaatatgagattagtagagatttaatataagattagtagcgatttaatataagattgttatacttagcatatatatatgattattacaattttaatatgagattagtagcgatttaatataagattgttagacttagcatatatgattattacaattttaatataagattattagagatttaatataagattgttagagatttaatataagattcttagacttagcatatatatatgattattacaattttaatataatattagtagcgatttaatatgagattagtagagatttaatataagattagcagtgatttaatataagattgttatacttagcatatatatatgattattacaattttaatatgaaattagtagcgatttaatataagattattagagatttaatataagattagtagagttttaatattacggttagcaaatacatcctatatacctaacaagtattttttgtatgcacagatggctgatcgcgatgaggaacagatactatacgatacaatcgcagagagaagcagccagtactggaacgaagaagaggggaacgaggatccaaaccagtacttgaacgaggaggggaacgtggagagggatgcggaggggagcgaggaggggaacgatgaggaggaggctagtggaagtcatccctccgctggacagaagagggcactcggacaacgaggtgccgcgaagaagatagagggtcggcacatcataactgaggtggacgaagacggccgacctagtgcctcggcagaagcagccaagaattttgtacgccacagcggttgggttgtgagggacaacgtgcctgtcagcacggtgtactggcacagaacaagggcacgcagggataatgacagctttgtcccggactcagagaaagagatgctgtggaccacaatgcttgagacgttcacgctacccgcgggtacggagaacatagtgaaacagtggactctgaagaaaatggcggaacagttccagagcttcaagggagatctctacaagaaatacatcctgaagggactaacaccgaacttcgacgtattcccaaagctaagggatcattgggatgagtttgttgcttacaagacagggcgacaagggcaagcgatgatggccagaaacaaagaaaatgccgccaagaagaagtaccatcaccacttggggtcaggcggatatagcgtcgcaatgccgaagtgggaggagatggaggcaagtttgattgagaggggtatcgaaccggccaccactaaatggccggatcgatcgaagttctggtactatgctcacggtggaacgcttaatctagttgatggctcccttgtctttagcgatcagatacacgaggccgccagtcgactaacggacgcagtggtagcctcttgtcagggcacattccgaccagacagagagaaggatgagctgttactcgccctacagactcccgagcatccaggacgaacacgagggaaatgtgtgattccctggaagattggatttaaggaggacatccacacgtacaggagtcggatgaggagcaagagagataccgaggcgaagattgcagatcttgagtacagggtatcgagctacgagctcagcatgcaagaggaggtggcaaggaaggtggatgaacgtatggccgcacatcggtcccaggatccccagccgtacattcatcctgcaatggtcagcccatcaggcaatcgtagcagctgcgtctcaacggggcaggtcggatcacagagcatggacgccatgcaaacccaggacgaaaccacctgccccgttgatgagatcacgcagcggacaccatgtgagctgcatattcccttcaagaacttatcaatcaaggtatgctcatagtttgatgatttttgacttgtacattccgcaagttgctgcttaggttgattactaatagataacctctcatcacgtgaaggtggcgtcaggaatggccatcccaacggacccttccgggacttaccactacaggccgattctagcaggatactcgagtgtcgaagttgagttggtggaagccgcgtacgaggacctcgagttggactacccaggaggagacggtgagacgcatctacgagacacaagccacgccatcatactatggcgcaagcagtacatcatccttcctgggcgacaagcggcgtctcgtgcaccatctcctccggctcctccgccacctcctgctgcaccatctcctccggctcctctagctcctccgcctccaccgtgttcgcctgcacctcccaagacaaggtctcgccaagctccactgcttgcccgcacaagggcaacaaagaaggcgaaagttgacgccaccaaagacaaggagccaccgtacgattgcagtcaagaggagcttgatgcttatgtggcaggagaggtgaagaggcaactcaagccttggagtcctgaaaagaagatacctattgacccgagcgtgaagaacttcttcaagggaatgtccacaacaaacaaggaggcgttacagatatcggactatgaccgaacacttcagagagcctatcacaagaagtccaaaccagtccctcagcttggagaacaaccaaaccaagaggtcgagccgttggtgaccggcgaagattttggcataacggaattcatttcagacaccggtctaactgtggatcagttggttggaggagcaccaatcccgaaggcggaagtggcatacaagtttgaactcggtaaaccgcttgtcaaacctaaacagctgcagtccctaccgacacagatgtacaaattccatgaatggtacatggaaatgagtgccaagggtagagagatgttcggagcgaggatcagaaaccccgacttcttgcaaggagaagatgttctctggatccatttcaaggatctcttcgatctgtaccagttggacgccctcgacgtctctcttctgagcgcatggattttgtgagtatctttgagttcgatttgtttcgttcaataattagctcctggcatatatgtaagcaataatactttcctttcatcgttgtagaatggagattcaaagggcccgacggcggagggtctacgatactgggttcatcgaccctcggaaaatcaacaccgaaatgatcgacaagtacgagaaagacacagaggacaatctcgtccatctcctaacgcagcaacatttcaagacgtacatactactgccgtacaacacagagtgagtttttattgtcgttcgaacaaattttgttcccatacatatagcatgtacatttttgatcatatatatctcttctcacgcatattccagattccactgggtcctgttattcttcgacttggacgcatgcagagtcactgtgtacgactcaatgaataaagaggagaagatttttgataaggtcttcaaactgatagacaggtaatataatgccatctattccaaagtcgcggggaatctattgctattatgttgatctcaagtaataattaattaatcatagcttgcaactgcatatgtagggcttgggatcggttccgtcaattggtccgcgggacttggaaagaaaaacttggacggaggtttgattttccagtgagtacatgcatgatccaaaattatattggattgaatctctaattacagttaatataaagagtatattaaatctctcatcgtttctcatgtagtgtgcaaagcaggaccagggaactaacttatgcggctactacgtatgcgagtatgcccactgcctatcaaaccaaatatgcacaacacgagagctcgatgtacgtatacataaaccattcaaaatttcattgcgtatcgatttgttaagttgtttattaatttcatatattcatacgtcattatttttcgaacgatagcgtattcacatgagggataatctcccacacaaggattttatcacggctgttcaagaacaactgatgggattcatcaacgaagaagtccttaatctcgacggtgaattctactacgacggatcgacaattcataacgtcggtccttcctcttctgacataacaccggcgtcaaagtcgtagctatagctaccgagcaaatgaattgtactatatatgcatgtatatatatatttatatatgtacacatttacttttgtgttaatatatattttggtaacatatatatatgcacataaaatgttaagtgctttaaattatacatatgtctgtgtaatatatgatttatacatacacacacacacacacacacacacacacacacatatatatatatatatatatatatatatatatatatatatatatatatatatatatatatatatatatatatatatatatatatatatatatatgcctatatattatgcatatatatgtattgtaacatatgtatatatatatatatgcctatatattatgcatatatatgtatatatatatataatcaaccatgcagcaaacagggccttgcaaataaaaaaaaatggtgcaccgatctttagtcctggttggtaacacaaaccgggactaaagatggtttggccggccacgtggctgatcaatctttagtcccggttggtaacacgaaccgggaataaatatcgatctttagtcccggttatttcacctgggactaaagatagttatctttagtcccggattcgtagtcccggttggacaaccgggactaaagggggttaccaaccgagactacaaacagtttctccaccagtgtagctgagacctgagaagccctgtgttgcgatggaataattatagaggaaaaaggcacatatggtgtcggagcccaaaactaataacttgaatccgactgagattaatgaatcaatccctggatcagtaaatattgatacatacaatataaccggttcttcattgcatatgttaaaaagtcttacaatactaagggttttacaataataggtactcacctaactaattaatacacaacagaagtttctatacattctgactagtgaggtataacctttagggattctctaagttatcgggatgttcgtagtaatagtcataagggtcctcctcttgacccagatctgaaaaaggggttataagagcaagggtgagtatttacaatactcagcaagttatcatgggaatatgttatgcattgacatataatagggttctttgcaaaaagcagtactagacaatctggaaaagttatagcaagaatttataaaacatataaactttagatttctaaccagggtaccatatgagtcccagtactcaactccatgagtacggctattcgaatagtttcaaagatattctactgtagcagatgtacgctttacccgcagtccatgacttgctgataatcatcggctttagtcatggtccagtattaagtcattaacaattgtggcacctgttccatgaactcatatcctcatatgctctgaatgtaatgttaacagcagcaagaggagttctggcgttcccaaggtatttaaggggaactgatcgtatgacaccacgtcatctcgatcagggtttagaaatataccatatagtttatactcgagtatcacaaaccatttacctgtacatggtaatggttaaagtttcccttcgcggctatagttgcctcctgcacgaggacttaaaaataagaaccactatacagaggtgccatattgctaattaacataataactaggtctgtccctattctagaaactgcggtcgtactcgttcgttcaacataagtatctggtaaaacttatattgattgagacagtactagccacccggaaatcagccaaatcttacgtactgtcccaatctaagtatagggtattttaaccagattgtaagcaaaataagcaatactaaattatctgggtttctatgattgatttatgcatagaaaatagaatattgaatagaaggctataagtaaataatttataaaatataggcttgaatgatcaaaaggtatatggtaacttgccttgctcgatgtcctgagattgatggatattatctattgagtcagaagaatcctcaagacctagggttagacatatgtaaaattcaaatttaaaaggaattcaaatgaaatccaaaaatatgaaaaatagagaaaataaaataaaatgcaaaaatagcaaaaaggggctcaaaagatagagaatgattttagaagaatattggtccaagtttcattggaattggatctatattttaaaagatatgagcttctaaagtttaaaaatcaaataaaagtgaaatggcactgtgtgcgggtcccacctgtcagtctctctctctctctctcttctcttcttctaccttcggccgtttccccaaatgcagccggcggtgctagggtttgggattacggcggcgatggagggggaaagtggttgcggccgaagaggggagggagctaggtatctccggcgacggcgatcggcggcggaggagctaatttggtatgtggatgggttggcgactagggcggcggtggtacggttaggctgtaatggtgatcaaggtgatatgagttagacatggctaggggagggggttctagagcatctacgaggtgtctagagggattccggcagcttgccgacctttggcaaggtgcggagaatagttgccgacgagcgcctccataggcggcggccgtgctcacatcggcagcttagaggggagcatggtagtgcaaagggattgctaaaatggaatctaggtagtatgtagatggttgaaacggaaaaactcaccgagatcggttgaaacgacggattgcggccagaaaaacttcgcggcggtgaagaacagagcagcgcgggggcggcggtgctcgggttggtgcggcgaggtaaaactcgacgcagagcttcggttagggcttactatgctagaacatggttgatataaggtgttctaagggatatttagggcggaggatggatggagaggggtggagtcgatcgcgcacaaggtgttcgaccgacgagggatggtggttgatggggtggattggcgaagcagagcttcggggttgtagggctttgattgttgatgatggatgatggacaaggaagggattggggtcctatttatagggctaggaggagcggatgagctcggacaccgtcatcgccatggatgagcttgggatttggatgaggcaaaggtggcaaaggctgagagagggcgggaaagatcgatttgagtggcgggaggccacgttcgaatacttaccgatgaagtattgacttgaccgcggttggaatcagctggcgacgtgagggcgctaatccgggcgcgacgcgcggcggcggcgagggtgaaaacggctggctcaggggtgaatggtttgaattgtgagaggagataccaccgtctatcttcaatctaaccgtgcggcaagaattggcgcgattcaccctgggtagaagcgaaatcgtactcggcggcagctttggacgggcgcgcacggcgtcgagcggcgatttcttgcggcggtcgtcgtcccggctttgtcgtcgtcaagattggtgcggcggcggtgggctgagggcgtcggacgggcgacggtgcgccaaggcggtcaggcacgcgcaagcggccctgaggccgacgcgcggcgacacggcgcgtggctaagtcggatgctcgggcggtgcgcgtgaaggggaggatgaggcaaagaaagccacggttttgagtgggttgtggtcccctaggaccaaatctagactttgcacaagattgggtaggagttgggctgctctagttgggctagacatttcatcgagcaccttgtgtgcgatgaacagtgaatttcagaatttttgaatatttcctataaaaagaatgaatttaatctatgaatttgaaagagtttcactagggtttgaagtatagcaaatcttcgatgaactaagaaaataatctatggtttgaaatttgagagaatttgctcaaattcactagggtttggaataaagggaattattagggtaaattagtagggctctaagaaataaatacttgaaccaatttaagaatcaaatagatttttaaaccaaacaaatttaatcaaaagccagcatgatgcagtcaaattttagtttaaaatttgaggatgttaaatatggttgccattaaaaatattacaccactaagttgtactccctccttttcacttataaaacactttaatttttctcattgtcaaacctttaaatttatttaagtttatagaaaattttagcaacatctaaaattctaaattagtttattaaatctaacattaaatatattttaatagtgcgcttgctttatattgaaaatattgctatgttttaaatataaatttagtagaacgtaaaaaaaagtttgactaaaatttttttaaagcgtcttctaatataaagcagagagagtaagaaccagagaaaataatattaattaatcaaacaatgcatgaccaactcttcagtctatttttttactttttttagaggaacttaccttttcagttatgtgaactcatcaatttccaccactctagaacgaggcagtccggcctagcacacctccaaacatgtaaaagcccttaccacccagcctaggctcgtgcaacccaggcagactaatagggctggctcgagtgggccggattgtagagtaggcccatccatgggcaaggcccagcacaggtctacggtgtctagcggcatgatcttgtgatatccttcatgatctcctatcctctcactacatgctctctctctctccatcctaaaatataaatagttttgaatcgatgggacacatggcagatttagatagattgtcagtctagatttatcatactaggatgtgttctatccaaccaaaacttcttatattttaggacggagggagtactacacagtggcaaacctagaacggaaattatccagggtccttaacctgtcataacacatataatactttaatttttaactaatacaatatagttaatataagctaaaacatccaagtattaaaaattacccgggtccggtaaccacagtagtacggaacaccccttatactacccccgttttttaatatatggcgtcgttgacttttttacaaacatttaaacatttatcttattcaaaatgtttgtgtaaatataaaaatatttaagttatgcttcaagaacatttgatgataaatcaaatcacaataaaataaataataattatatttttttaataagatgaatgattagacgtatcttaaaaattcaatggcgttatatattaaaaaagtaatcattgtagatattttttgtttgttcgagctatgtgaaacacggagaaattcaataattggacactttttagtttccaatttactttaactaacacgtgtgaggatgatattgttggtaacttttttgacaatttgataagcacgatcacagcacctaaagctttgcggtgatcctagagtcgccaaccacctcaatctagcaaaagctaaatcaagatgggttttgataaactaaactggctaccggagccgatctagatagaacgatagataactacccgtctcgtgggcaaaacggaaggttttcaggataaacctacaaagatgtgtcgcactctcgcagcgacggcggatgatttacagcgcaaatcaacaaagatggacaaactaaactagaattagaagcaaaagtaaaagaacgattcgattgattgatggttgattgtctttttacaatgaaccggacttgtctcttatataggggttggtcttgccctctacaggctctcctccacgtccaactcgggctaaaaaccaatggaaacccaaaatatgtctttccgagcaaggaaactcgagtcccgacaaaaacagaactggactcggattctaccggtaagactgactacacactgtcggtctgactagtctactagcagcggtctgaccggccgacatacggcggtcagaccaaccctcttagaagaaaaccggcggactttcaaactttgacaatttttcctattttatttttaggtgccaaatttagatgtaaacagatatatgggaccataagcgggctaagatatattaaataatgggagcccgacttgggaaggatcaaattattaaatatcttgtactgctgcttactagctttcttcgtgtgattcatcatgccaatcactctcccgcaaacaacgcagccaggatgaggtcttgccggctctctctctcctcctccttgcgcttgcgctgcccactcggcaggcgttttccaacaagcaaccgctccaacccacttcaatcaatacaagaaaattgcaataaccacaacatttgagtatttgagaaaccatttgtagtattagcccttgtactatactcctacatatttatatttgggttttgactaaaacgaatggtcaaccgttatatgtaaagtcaaattaaggtgagaggtagcagtactcgtcatacgtacgaacaaaacactgtcgctatttccgatggagctgtacacgtacacgatcattccaatccaatccggatcggtgtccagttcagcctgtacacagagcctatctagtcgaccatgcaatgcacaatctgtgcgaccaagaaaagacagatcagagagaaagaaaacgggaaattaacccgcagtagttgccgcccgttccttccaccaatacgtacctcgatggagatcatggaagagccgccgccggcagcgggaggcgacgacgatcgcgaggtggagctaccggaggacgtgctcgccgagatcctccgccgcttgcccccgcgaagcctcgctgcgtcgcgctgcgtctgcacggactggcgctccgccatcgactcccgccggctgctacgccctcccgctgtcgctcgccggcattttcatccacttcaacgccctcacgttcccggagttcttctctcgtccatcttcgtcaccgacaaccgtaaggggcatgctcgacttcctgccacccgaagaacaaagccccgacatcggggaccactgcaacggcctccttttgcttttctctctccttgtggtaaacccggccactcgaaggtgggcgcgcttgccaccattgccccgcaccttcgccaagctggaatctgggttctttgacaaagaattcatcgtcttcgacactaccttatcgccgcactatgaggtttttaacatccaatttgttgacgtcggatggtacaacgtaaaaacgatggatcccgtcttgaagaaatcagaatggccaccatcgccgctcgtcctccatgtcttctcatcggcgacagggcgatgggaggagagatcattctctagagaaggggatgcagccggaaccgtggctagcgctcagaggctgtgccggccggagcagtgtggtactgtctattggcgaggagcactctacgtgaactcgtattttgtcatgatgttaactttagcgttaatatttttatttagtttcaacttgtattccgttttcatatttgttaatataaattcttatgtttattttgttcttcgtagggtatcatgtctgatgggacgacctatcaagtaatcaagcatcccaaaatttacaagagcaaacaaccaccatatatttacataggaaaatcagagaaaggagtgtacctcgcatcacttcatatgctggactgttgccttttaatttggatcctcaataaatcatgtggtcagtttaagtgggtattgaagcaccaaaacaaccttaagcccatgctactacgcctgaataatagtaaacaagatcacggaccgtagatcttacaagatgttaactaccatctttatagtcaaaagtttccaggagagtgggagttatacaatgggaactatgatccctctcattttcattctccaaatgatgatgcaccggcggaaaataactttgaatggtattccgatgatgataatattgtagaaaatcaaggtaactgtgaagagcacgatgatggcgactaccttgagttgcttggatttcatccttataaagaggtcatctttctgaattctatatcaaggaaaggattggcctatcatttgaatagctcaaagcttcaacatttgggtaacttatacccaaaacactataaccacttcgcccaacatgaatacataagccaggcatttccatacacaccgtgctgggtcgatgagttgcctgaagctagtacttcactagatagtctccatcaagattagcatgcacgttgtttgcatgcggaactctcttttgtaaggcttttggtttgtaatataatctcaagcaaagcttccaagtaatgaccatatatatctgcatacgtatatcacgttgccactgctctaatatatatttgtgacatgagttagctataccacatagaccatgaatactcgattactgtggttcgtacatactctccatctcaaaatgtaagcatttttagcataatagtaagtcaaacatttttaactttgactattaataataaaaaataaaaaaaagtcaatcatgtaaaattgacgttactatatttataattaaacaaactatcataatatgcaaatcttattatttaaaacatcttatttttatagatattattgatcaaagtagcttaggacagagggagtaacaactagtaacagtgcacgtgggaggctcgttcccacacatataattgcaaatttattagagacaatccattatatgccactgagtttgtcatagctctacgatttgccactgactttgtcacgttctataatataccatcgacttttacttaacttatatgatttaccatcgccgtccagttagtctccgttagtactgtacaattttgtccaaatgaccaaaatacccctaggataaaacttccaaaatgtggacaaaaattccgaaataccatattataaacataagattgtaaacattcaaaatttgtccaaaaacttaaagtctgacatttcagaatttttatccaaaatttgaaagtttttgtctcaggggtattttggtcatttggatgaaagtgtacagtactaacggagactaaccggatggcggtggtaaatcgtagaagttaagcaaaaatcgatggcatattatagaacgtgacaaaatcagtggcaaattgtagacctatgacaaactcagtggcatacaatggattatctcaatttattatgttttcccactgtgcatattaaacagaccatataaatgtgaagtttaatatgccacatatctctccgtttacaatgtgtcatataaacggaaaacaaccaatgataccaaatatacaatttgcgatagtttgataaatgtttggcataataagaagtgtataattgcaaaaaaagaaaatccctaatgtaggttatagcttccttggtctcacctggttatgcatgtgcatatatgcctgggcaccgtggcttgttgacattcctgacaggtaagaaaaccctgaaaaacaccaaatagaacggaagaaaaagcgaaaagaattactcgtggaaagtatcggcaatccctaccagtataataaaaaatcattatttctataatgatgcatttagcataattagttactactgttttcaaggtagcacacaaatgttgcatttagcataaaagagatgaagagagcctctggtggattggtggctagtggtgcactggtgcatcagggtactgcaagcagcgaaatcgccgactccgctgagcctcgggttgattgccgatgtttgtgactccgatagtggagcgagatcgatgtcggcgactgtgacgccgatctggtgacacgcggcgtgcaacgatgctctcgaggcagaaatcgacggcggcgcgatgcgtgggcggaggggttgcgaggaggcgtcgctgtgcagttggtgtgagggtggggcagcatgattttttggatgaacgcgagagagaggatgagtccgggtctctgggagggcggagagaggaagggggtgagggaggtgggagcgtcgtcgggcgttggattgggacaatcctgaccgatcaatgagaaataaggatgtaaaaatcaattggtaaataatagggtagaattcagtttcagcaaatatagaaataatggttaaaaagcttacagtcatagggcctcatcttttcacttgtgcttttttcttatcaaccaaaatttgaattttcaattttaaatttggagctgattttgagattttttttattgatcgctaagaacacgtatataaaagttttattcacaaattactttttgttagtgaaacgatggctgcgatatttcatcaaattagaatttaatatgttttaattaaattttctcgttttttctttccgttgcaatgcacggacacttttgctagtacctaattaagaaatacgcgaaactcctgatggggatcgatcggccctagcgatcgggttgccccccatctccttcacgtggtttctttttttttttgcaccgcattactttcctattttagtaaatttatacacctgaagtttgtacacctcaagtttacacatctaaagtttacagacccaaagtttataaatcaaaagtttatatatccgattcaaatttaaatttgaattatctccacaaaaaaaattaaatttgaattcaaatattttttatataaagtatttctatacatctaaagtttatacacctaaagtttatagactcaaagtttataagtcaaaagtttacatacccgattcaaatttgaatttgaattatatccgattcaaattggagtttgaattatatccgattcaaatttgaatttaaattcaaatattttttatatatagtatttctgtacatctagtctatagacccaaagtttataagtcaaaagtttacatacccgattcaaatttgaacttaaattcaaatattagtttataggcccaaaatttataagtaaaaagtttatatacccgtttcaaatttaaatttgaattcaaatatttttccatttcaaatttgaatttgaattcaaatattttttatatatagtatttctatacataaatttttctaattttttttatttttttttaaatttatggtgtagtaggaagagaagaaggggaggaggaagggggagaggaatatataggggatggggcgagcgatcgcccatcagccacgcccagaaatacgtaaggcttcagctaaaaaattttctccgtcttcccatttttgtctttttcgccgttttcctttctttttttcttttcccttttttccgttttcttccatccgaccgtctctttttttttctttttcacccttttttcctttcctttttccttttccattttttccgttttcttccgtccatcttttttcgccggtttttcctcttttttttctgtccttctctttcgccttctttttccttttttttcctttttttcagtttttcttcatcagctgcttttttactcttttttttcgtcaccttatttttcaattaattgcaaaaatcgattccccgttactcctttatcatttttcccatttttacctttcaattctgttttaattcaccggatttagtctttatttaaaagtcaatgtttttatcccgatttttgcggattcgcttcgattttgataaaaaggaaagagcagatcgattgtataaaagccatcaaccaattttggaaaatctagaaatatttgaccggatttgatggggaggatcagttctggcattatatgaacatgagatgttttcaccattttccagaggttgaagacgacagtcagctatacgagctggagctacagctctacttgtgggttaggtcaaagagaagcagtctaagcaaaggaggtggcggtctaggctgaaactgaaaagaaaaaaaaagggaataagcttttgttcaaaaagcaaagagtaaaatgtatagggagcttttggtccaaaactaaagaatctaaaaatatttttacccatcgcaacatacaggtattttttctagtgaaaactaatatccaccgaccaaatctagattagtctaaatttataatagaaattaagcacgagtaacgcgttgcacgcatggaacgatgaaaataagcacgatgaacacgtacatgattgcacaagggttagctctgatcgaaccaccacatgcacgctctctcgccaacatgcagcttataagcatctttagtggactaaagatccggcctgacaccctctagcaaccggcgaaccgacactaaagatcatatagtcctgttgtccttaaaaaccaggactaaataatgacgtttagtcctggtttataagagaaccgagactattgtaaaatttggccgaccgatcgaagatcgtttctccagtagtgttacttagtaattttatctaattaaatagcaatacaacagcatataaattaatatacacaggtcaacactgttatcgtcgtcaacataagcaaattaatcaagctagctagccttttgccattccaagttccaaccatggccagctagtggtgcacaagggggatcaccatggtctcaccatcaccctcctcttggccgcggccttcttcttcctcatcctcctctcctcctccctcgtcaaaatcaacgagaaaccgcccaagttagaccacaggaagctagcagctgcagcaggtggcacaaatgtcgtggaggggcggatagcggtctgcctcgtcggagcggcacagcggttcgagctcaccggaccgtctattgcgtggaatgtgctagcgccgcagtacccgcacgccgatctcttcctccacaacccgctcgaccgtgactcctacaagttcggcctcctcaaggacgcgccttgagtggttgcggttaggttcttccgcccacgacatatacccgagacaattcgcgcgcatgccagactccttactcgcccatgggtgtacgggtaattttgcagctctcagtttcgttgtcttctgtttgagaaattaattaattctgttttcacaaaatcatctggaaagaaaaataaaagaataactttgtacacactactaaaaaatgattttccaaatagacaaaatcgattttcttatgcggttgtctggcccgcatgcgagaaaatgtctgcgaaaatccctattttctatgtggttagcgcatatgcatgcaaaaaggtaattttcgcatacgaaaccttaagccaactacatgcggaatattttttggcaaaaaaaaaaaaaaaactctagccatcccaccacgtgccggacgcccgctccggccgcccaccgccgtcacctcgagtccttgtcgtcatgcgctgtcgcccttcgctaccacccaccgacacacccactcgcctgctgtcgcgcgtcttttgtcgctgccactggatccgggcggaggacggccgtcgctgccgctcgtctgcctgtcgacgcgccaatccacccgccatcgtgctcctctcgcctttgccgccgctcgccatcgcgcctgctgtcacccgccccatcgcccccgcccaaggtcaagggcggtggatccgtcatcaccaaccctccgtagtgctgtcactgtcacccgcccaaccaccgcccgtccgtcgttagtagctgccgccaccggtcgtgcgggcgccaagcccaccgtcggctgccgagagagagagagagaggagaggaggaggttatagagagaggactgagaagtggtggagagggaagaggataagaagagaagtggtggagagagagagaggaccgagaagagaagataaggttgcctgtgaaaattttttgaagtggtggagagggaagaggagaagaggagaagtggtggagagagagaggaccgagaagagaagataaggctgcttgtgaaatttttttttgaagtagtggagagggaagatgagacaaatcagacttagcagacccttacgagacccgcattcaaaaatgattttcttatgcggacctcttaagggtccacatgcaaaatgagcatacggcccctaaagagacccgcatacaaaaatgaatttttgcgggcctattaaggagtcgtatgcggaaatgcctgctcgatttttacaggtgcgggttgttatggtctgtctgcaatctaacgaggatctcgttcagaaaaatcatttctgtagtggtgatattatgtgaagtattttgcccaaatgttagttttttttaatatgtgttgtcgtgcgtttcatggcaatttggtgaaaaaaatctataacttgctaaagctaactagaaaataagcttcataattgagatgtatggtgccacacgacaaaatttctcctgtcaccattgtaaaattgtcttgggaaatgaaaatgttcccatattctttgtatgcctactctgaaaaatgcttgaaaaatggaaccatagcgaatttacaattacttgatttggtgttaatccacgccaaaattaaattaagtctctgaatctacctacttttgacctccaaagatacattatgcagcagcaaggcaaactaacctggtactaaactactaactattatattgatcaattgattacataattcacgtgtcgagcaatgcttatcttccatccttgaaagctgaatatcattcgaaactagccttcgtgttcttgtttccaagatggaattaaatcttcttcaaaacgtcattacagccaaagaaaagcatgggaaatttcaatctaatgtcataggaaaacttcctctcctcctaacttctaccaacaagcatttgcgatccacaaaacaacactgattctcctcgaatccatcttgaaaatcacactaaaaaacactgattctccttgaccccattttccatgcatcttgaaattaaatcacgagacagtttagtaggatccgtggctatttaagccgcttgatatgatgactggtagctcactggatcatcagcaaagacaagaagacaagaacaaagcaagcatggagagatcagcactaacaatggcgctgcttctgcttccgctgctcgccgtgacggcgagcgcccaggtgttgtgccggtcgcagttcaacctcgccaacgaggcgtgcagcatgcgcaccttgccgggggtcatgaggccgccgctcgtgccgccgcgcccgctcaagctcaacgagacgtcggtcaccggcggcgggagccgcaggcacgggctccagtctcggggcggcggtggcggcggcggcgacgagtatgacgacgacggcgactactactacgacgccgacggcgaggagcagggaggaggcggcggcgacgaggaggggcgtgggcggcggcggcgccaccggcaccggcgcaacgtggacgacgacgacgagagcagggaggacccccacgacacggcgtgctgccggcgcctcatgtcgctggacaactcgtgcgtctgccaggcggcggcgcggctcccggcgttcatgaccgccgtccggcacgtcgtccggctcactcccgtcgacggctgccacgtcaccttcgagtgccccggctccttctagcttatatgtcgtcacagctcgcgtcgtcgtcgtcaactcagccatagataatataattcagcagaggatgattccaattactgcagaattaattattactactactgattgagatgaataatatgttacacagtttacagttgattgtaggtaaatggaagaattacctggttgatttacaattaatgtaatatgtaactcgatcatgcatggattggcatgcagagatcgatctatcgatgaagaatcgatcgatcacaacaaaagtgtacgtacgtgttggtgttgggtttgtcacgtacgtcacatgaagccgatatcgaagaggaaggagagatcgtcgctgtcgctgagcttgaagtccatgtcgttgtcatccaagaacggcagcgggaggtgcccaagatcggcgaggccgaagccgaagcggtcatcctcgtcggcggcgaggtggtcatcctcccccaggaatgtatcgacgacgaacggcggcggattcagcggcggcggcgtcgcggcagaagctgacgacgacggcggcggcgcctccttggacgacggggacgctgatgaggccgtcacttgcgataatgattccgtcgtcgtcgttgtcgtcaccgtcgccgtcgtctgcgtcttcttccggcggccagatgcacgccgcggcgccggtagttggatcttgacgcgggcaggtgacggcgcgatggcgacggcgggggaggaggcgccggcgccgccgcgggacagggaggcgcggacctgcacctcgaaggcgtcgtaggcggccctggcctcctcctcggaggggaacgtgccgagccattgccggaccttgagctggctgtcccggaagtccaccgcccaccgcccgggctggcgctggtacacgccgccgcgggaacccttcttggcggccgccgacgccgacctcgccgccgctacggcgccacgacgcatcccgtcgctcgacgacggccaatcttccgcctccaccgccttcgccgcggccgccggaatttcggaacgacgacgacgataatgacgaccggactgcgataacgatcttcccttcttcctggacagcgagatgacgatcaccttccggcgtgcggcggcgttggtcctgctgcttcggctgctgatatcgtggtcgccggcgtcggcggagtccgagtcggagtcggagtcggtggcgtccgggtcggagtaggagatccggatcctccggaaggccaccatcgatcaattcggtgacgatagagtcgactccgtcacgtcgccgtcgccaactgacgcggtccctggacgtcgtaacgtgcggtactgtgatttggtctacgaagataatatcgatctcgatcagtttttgattctgctcgatcccctaacgcagttgatgactccatgaaattagggaggaagttttacgatacgagtgaggaggaaatttcacgggactaaaattctctcgatgcatgactcgaagagcttccttaatacaaactcctaatcactacttaaaagagtgttcttcatggtggcctaaaccgattttcgctggcggtactactagccggcaatagatttttgttcatggttgcgataatagatttttgcttacgaccacttaatatgatcacccatgaaaatttaaatccacttgcgataatagaattttgcttgcagacacttaagaagatcgcctgcaaaatcaattttcgcaggagacacaactaattaagaggaccgccagcgatatccttttgggaaaaaaaaatcaacatctagagacattgttgcattttcaaattttaaatccacgtctagaaagctagattcaaatccaatccatattcaaattgacatccaagatcactacattgatttctcactgcattttaaacatgcaaacatcaacactactcattgtcatcaacgatgaccttggaggctgctgaagccgccgtggacgagctaccgccaccggcggccgcctccctatggtcagatctaggatagggataggatgggaggggagtggggaagtcaccgtcagtgccacttctactacttccaccgtcaacggtctccggtcatcctgccaccagatttgacccccatcgccaccacggacgccgttgccgagagcatgttgaggctggagggagccgctattgtcgagagcacgcacctggaggctggatatgggagaggggagtgggagggtcaccgccgccacactctttattgcgccaccgcgaccagcctcctcccataccaccatcagatctgcctcccattgccctcgtcgccatcgctgtcgctccacaggtgaagatgtatggtgagaggaggagggaggagcggcttgagagaagagaaggagtcgtgaagttgggatgtggggaaagttgagatggtgcggagctatttgatatatagggcggtttttttccatgtggtcctctttagccttcgctagcgaaaattggattaagagccgtataaatggagttatttttagaattccttgtcctatctaacacccttcataaatcagctaagtgtccatcaacacttttagacgtcacaatcacatcatctatatagattcacccaacaagccgatgagatcatgaatatataattcatagatctttgatatgtagcaccagcagtcttaacccaaaaagtcataacaacccactcgtataagccaattgctccagaacatctaaaagcagtcttcggagtatcttcttcagcctaaaaatttgattgtttcctgcattgccatccataatacttataatcttatgtacagaagctgcacctgaaatccaaggtgtagcctagaagaggggggggacagaaatttttcggcagctatcaaccgaagacagagaggtctgcccggtacttcagtggttcttttccaaaacttctggagttcttgcctcacgagacaaagtcttgattctcacggaaccccaacacttgccaacctcacagaggacacatattagcaccacaaagcaggaaatcacacgaaatacattgatttgcataagaggggagacatgggatcatatgaatcctactctccattggggacctctaacgagctgggtctcgattacccctaacctcaccgaacaaagccctaggaagaggtgccctattttcaactcaacatccctataagcttctctagatttgaagtgaccactaatatccctaacttgaacccttagagaactccgcgaatgtgaatctctgatgagcactctacagcaagcgccctgatttatccctctctttcacggtaccaatagctaccaacacaataaaaactctctgaatatttccaaacagcaacacagagctaatttatatattatacttggtaagactgataggtaaagttacagaaattgcaaatcaaaccaatccaatggatcttcctgcctgtgaacctcgagaacacgatcagataggttggctcacaggaaccaaagatcacgtccaggaaaaaaacctggctgcatcctttttctcaccttgtggtggcaacgacaaacaacaatacgatgggagcgccacccttggctcggcagcgaaagaattttttttattttatgaacctttttaatttttaattttaaaaataaacccatccaaaatttatttcccagatctgaaccggccagccaaactgggaactttttttttattttttgaacctttttatttttttaattttaaaaatagaccttcccaaaacatatttttaggatctgaaccttttggccatgccatcccgcctagcgtggccaaataactttgccacgccacgagttcatggcgtggtagtgtg

SEQ ID NO: 33742 - DNA, 34555 bp, Oryza sativa
  unsure (1)..(34555): unsure at all n locations
gccaggttcagttttgaaaatattttttggaaaggtctattttcgaatgtcaccggttggtgtgaaactatacctttgttatggccactttgtattgattactctgtcctttgataccttgggttacaatttgactagttgagctttatatattggttcagctagatatattagatataattgcttagccatgcttagaaacattagcacactattgggataactaatgtttcactactacttaatgatggacatgataatggtagctcacgatggctaatcatgattggttaattaattaatttgccaactaaaacttgataaatgtgggttgtgagcacatggttttgctggtcgtgctcatgacaattaaggactggttcacgagtttcggttgtgaaacattaaccgtgcaaaccacaagccagtatgggcaacaactttatcttttgtatagcatggttcattgcggggcaccagactgagaagtggcggagataagcccacgggggtcgctggggagtccatgccttgtgtttataagggggtgattatgatccaggaacggtgcactgctttgagttgtgttgtgcgaagggtactgtcacgatttccccctttgcagtggcgtggtggtacttcagggcatggtaacatgtgtggaatcgtgtcttgtgggtacagtggtacacctctggccagagtaaaactattcgaatagccgtgcccgcggttataggcaggtctaacaatgtctttcgtgattagtctcacacttttcatcataataaatgatgctataactggtaataatttgattagctcctggttttgaatggtttattcctggtttggagatagatctgtacagccgggtatggttgttcaggatggttgggcctgtgcagcatgggtgtgctgttcagtgttgattaatattgatgattaattactctactgttttacaattcttaaatgtttgctaaatgctgcttttgcaaatgagccctatattatgtcatcctttggtatccttgtgcacttgcatatttgctgtgtggcttgcggagtattccatgtactcaccttgtaataatcaatcaaacctcagttgaagaaaagttacgaaggagaagatgtttggcttataccctagttgagctgcctgtgggagtggagccggagcttcgctagattttattttccgctgcagttttcttcgtggtgaggactaagtgcctcttatgtaagtatttatcgttttagttaacttgatgaatctgtatattaaattgtcagtttgtgtacctcggctgatttctggatgaggatttaatgcacaaataagtttggaaattactagtgaatttctgggcgtgacatgccgctcccgctggagtgatagcgttatttggccacgccggcgtcgttggcttgacagtgttatctggccatgccgctctcgctggcgtggtaggataaaattgtcatgcccgctgcacgcggcgtgacagagttatttggccacgtgcgggccaaaaggtccagatttaaaaatattttttagaatggtctattaataaaattaaaacataaaaatatctaaaaaaatataaaaaatttcgcagggaaaaccctagacatgaactccaaagaaaaaccaacctgctccccctgtcaaccgtgatcgaccaattaaaatgttcgtaggccttcaggtcaggctcgcaggaattatttcctttattttcttggcccaacggagttaccatttaggaatatttttgcactttgatttttttttgtccaaatgtggccaataagaaatttagccaaaaaattaaattcttccgtaacgttatgttgtgacacttaaattttaattttagtatttatttgttgtttatattaatattagtttcatccgttgcaacgcacatacatgttgctagtaatttaaaatcctattaccattttaatatattttaaaaataaaatatgaaaaaaatgctattatgtgagaaaaattataacgatgagtcaccatactagtttcaaaataagttaaagaaaaaagctatttagtcggccctcgcatataaggccctgtttctttcagcttgggattattataatccagattattgggagtaagctgaaagaaacagacaacttattgaagtagcttattataatctggagcccagcttattataatatgataaactcatttaggtgagctttttctagattattgggtgaaaaattacccaccatgtcaccccactccctctttagacttgcaaacccaaataatctaggaaagaaacaactaaccggttattctactacagattataacaatctagcttatagtaatctaactcaataatctagattataataatcttaagcggaaagaaacagggtctaagtcagattctctctcatggagcgcgtgggaagagtcgatttttccttttcttttttcagttttctttcggttttgtttcagttatttcagtttttaaatatataagtatctttcggtttattttatctatacacacatctctactattataaaaattgaagatgtttttaccggtactttagtacatcatccgtgtatgagtccgtttttaagttcgcttttggaaataagttcgctttttttaatatatatatatatatatatatatatatatatatatatatatatatatatatatatatatatatatatccaggcgaatttctacaataaatttcacagcaattaaactgtatgacaataacaagattaaaataatcttcacctgttgcaacgcactagtatcttttctagtaaaatacttcctttgtttcataatacaagtcattctagcatttcacatattcatattgatgttaatgaatctaaacatattaatatgaagtgggaaatgctagaatgacttacattgtgaaacggaggaagtataaagtttgtatgtgtacgtgtatatacgtatcaatatacttatagagagagagggaaaagactagagggggaaactgatcgagctggtgcgcgaccgcccgcgcatcaaccatccccatctcccttccgctcgcatttgttcattcgcactcttgtcatcgaaatatcaagagccggacgaacatgcaggaactggagtactggacgcaccatcacccctcgaagcaatccaacatggcgcctccgctcgcacgtctcccgcccggagacctgccgtgcgatcccgattcctcccaaaatccctcctccggagccaatgccatgagccaaacacaacaacacccgggcctgcgacgcatccgatccgatcgaaatggatgcggccgaaaaaacccaaaagcagtagcagccgcagcagcagataatcaaagctgatcgaggtatgcgcccagaaaagcacagaacaaattcggttttaatttttctctccaattctccttccaaatcctgctgcgagaaagctaatttaatccgacatgttttttgtttttctctccgcaagctatgaatcatcgtcgtcgtcatcagcatcagcatcagcaggccagcagcagccgtagcaaatgtgaggaattggggaaaatcacgtttccgtgcatcgttcgatctccagtgcctcgagcggttcgtccctcccggccaatcgattttttttttttttgccgttacgattttgccttttttgcttcgcttctggggattaatcggcgttttccccttcatttttggctctattaaatgatccgagaccgagaggaaacctagggttccgttgcattctcgcccccatatcccagctccaccctttcctcctcctccgccgccgccaccaccaaatggatcgagcgcttccaccggcgtcctagcggctcaggagtcccgattccgagttgtggcagtcggttttggtctcctgttagcttagatccgctcgatccgattttctctgctcgatcccattttcgctgctcgatccgatctggggtattcgtttgatttgctcggttccttttgtgttccttgttggtttcgggtggagaactattgtggaggtctgatcgatctgctgttgctatgggtgcaaacccttgcaggttttcaaccatgcctcatttccctagcggctcaagggtgaagtgcacggtgcttgcagtgctgtgtgggaaggtaggcaagcagcgggcgccaccttgtccggtgcctgggtcccagcagcagcggccatcgtacccattcccggagttgatctcgtccgggaggttggaggtaagtatccttttgctgtttatttttgttaaggagcaagtttaattgtaggctataatccatctagtataaacctatgtggaggagagataacctggagaataaaaagtgttaagctcttgtgtataaaaagttagctatacacatgctctaagatcaggggcggatccagtgtatggttactgatgacaccaattatttttgctaattatattattaaatatgcttggaactaataaattactcttagaattggcatttgcaccatggtatgtgaagagtgacctcaatgatatttttgatagctccacccctgtctacgataaatgcattaattatataaatgagaaaaagagagagaagaaaattagagacaaccttataactaatctgttacacatgtgagccctaatgctactttttgattagcttatatctagtagttagatctactattaaacttgctcttaagtacatatattttgtttgtcagttctgaacttggaaagctgggcatgcaggtgcacacgctgattaaccctacagttgatgaatttctggaggcacaacgtgctttgcaaccccgcttcatgtacctccggggtcagcagcttgacaacgaagaagaaattggtacacttgtctggcgcgatgctgatgtatctgatccacagatacttagttcactcattcgtccgccttttcctaccattgtatgcactaaactctgctgattttctatgtactatacattttatcatgtctaacttaaactagcaaatgttagacaatacaatagccctagagtgtctgcagggctggcgcctaggaaattagcaagcatattacataaaaattagacagtacaacactaaattagatcgcacaagagcacctaaggatggctagccgtctagtacacaatgtaatgcctaatcccaggcggctaataggcgcctagcaccgatttttagagcactgatgtttggctgcttggtgcttcagctcccaatagcacctggactatgcttcttttagcgctgcagtctatatagccaatatgcttctttacatgtttggtttactgatccattttagttattagtgtttgctgatgaagtttgccaatttgtataatttgggtgctagagtgcttgctaatgtagttatcactgctcttagcatacggtattgatcttttaattgagtgatcgataatacgattaattcatgcatgcatgcagctgggattagagccaggcaacaattgcatcaatactcttatggagccataaatatgggcatttaggctatctcattgggtttcttggtttaatgcgagaaaaatacacggccgatatagttatgcagagggaatagttcataaatgcatgcatccaggctccctttgttattgaggttgattgtgttttaagggccaatttagagattaactaattggccctttaaaattacatattttggtttttgttttttttaactcttgtaaccttgtttatatattccagatatatttgtctgacttgtagctactaacaattaaatttctttttaaccttcctctctgcctattttcctgtttagtttagtgaaagttttttttttccaatttttccttagtcttcttccttgtagctactcatattaccttttaagctataatacaggtttatttggaagttccaagtggagaaaagattgctcaatctcttcaatcgaaggtagtctgttttatgatattttcaattagctgtttcttatttacgtttgagcttgtagattgcttattgctgcaaatctccttttgccacaggtgggtatctgcttgttgcgatgcgatatccaaatgtccctatttattggttaaaaaatcattttcttgtggagtattatagagattagtttccataaaacaattactactaaactgcatgtgttataacttgttttgattggcatagtgtggttctattgatggaaattttatataattacatgcttttaatgtctgcaatcactgtccatttttccacattctgattactaatttacattttttttgggtagttttactaagctttccccccccccacccaaaatacaattcctaatgtgctattatacttcggaatcttatttctaatttcagatttgcaattttcacactctttcattgctagggtatttcatatataatgtattggagatattcattatcatcgtatgcagcatctcattttcgccattccttgatgtcagttgttcagaggtatcatatccgtcttgcatttgttgaatatattgtaagccattaagttttgtttctttatccaataattgtgtattcctgtttgtagctcctgtagccatgcatgggatgcatttcaggttgcatatgctacttttcaactgtattgtgtaagaaataatgaggtgcaacgtcttatgcttgggcctcatctacttggggatgctccaaggatatatatcacccctcctggaaacgaaatagccgaggaagaagatacctcggaatattttccagacataaagatatatgatgaagatgtgaacttgaagcttcttatttgtggagcacattgcacccttgtaagtttaagcgatcatgcctatatttttcttctaaaatatggcatttttcttattccaaatcaatgattgtacttccatctcttttacaggattcatctctattgaactcactagaggatggtttgaatgctcttctcaatattgaagtatgtgtcaaatcctcttctagttaccatgtgttgctgccttttattttctatgtctaattaattagtgctgagttctaaatagagtattaccccaaagacctattttgtagaagtgctaggttattggagtaatgaagtacatgatgctaacttacaaatcagaaatactgctgcatcataagtaacatgctagtggccaccggccagtattgctaagcaccttatacaagctggtgggccggggctaggttctaaagtccatacttgtatggtgatggaatgaagctcgatgtagtttagttggagtctcactttctgagttgtaaatattcattttagactatgcagcatacccacatcgaaaaacttagtagtggtggtggtgactggtgggtgtgccttcccaccacctcctattttgtttggtaggatcttctgatttgtggatttattttttgattgatgtaggattgcaaatgtatttgttttttcatgaaatatatacaaattttaaaattggaacttgtatatttgttgatttttgcaatacaatggtattttgctagtaccattgtatgtaaattttatgtaccatgaatttaggaacaagataatatggcacatacttttcatattctctgtccatttttttctattaaattggacaagaaaaattatgcaagtagtaaaattgttggtagggccttgttaatgtttgattttcttctctccttttttcagtttcgatggtgcaaactccaggatagagtcaggtatcttccgctgctatataatacatattcaatatctcacaacctgttgtatcttaaatactattgctcatgtgtgtgttatgtttgtgcctgtgtccttgcttcagtaatcatatcataattttctatgccacagaaatatttaaagctcaaactgatgttgtctcagtgagctaacttgtattttgctgctagtataatttaaaggttaactgaggtaacatttcctatagactaaagacaaaacttaatggtaacataaattataaatgcttttattggtgtgtcttgtaaaatgtaaactaaagtgccgtagagtatttaacctgtatccttttgtaatcatattttaacttttataaagttatgcttcttattcttatttgcagttatgcatggttgcttgcacgattactataaaatttttagcttgtttctgctcacaacatttctctttgcagcgctgctcctcctcttcatgttgattcaactctgttggacgggatggttacaatatgttgtgatatcacaacatctagttcttcccatgtgtcactgcttctttctggcagtccacagacctgttttgatgataaggtattgtttttgtaattatggagcattttttagtcttcagtttgatatttgcaatgtcatatgttgtttcatggcattatgtagcttttggagaagcatattaaaaaagaacttattgagagccgccagttagttcgtgttgtctcggttagcgaggatgggccatcttcagctgagccgttgacttcaatgtccgtggcttctggagcttccacttttgaagtcttgatgaccttacctaagtgggcagcacaggttaatttttttctgaaaagtttgaatgatattgactagacagcttggtaatatgtgtgatatactgacagtttatccactactaaactaaaacataaggtgttttatacccttcttcatcactgactgaaaaatcgtttgaactgtgtaggttttgaaatatcttgctcaagaaacatcttacaaaagcctggttccacttggaattgcttctgtaaatggtactccagtttgttcgttcgatagtcaagatgtggattggcttcttttctttcgcacaatccaagatgaagctattggaactagtctatatccccatccgccaagatggtctgcatcccttgcgaagaacagagttaagggaagtatggtgtcaaaaccaggtaattcttagtgcaaaccgagttggagtggactagaaacatcttatggaaggggattaacctattattttcatatccttttcagctaggtgaaggatacaaaggcagtggcaatttgtagttgcgcaaaggtggtttctatgccagatgttgagagaatgtgcagctcacttgcacatcaacaatataccatagcaagggcaaggctctatgttgagtgaatccaaacttatactcctttgacgaacttgtcttggttttgctgtggatctcattatctggttgttggtttattaaccgcgaccaaatttgaatcttgaaagttgaatttagagatgtttttttttccattgtagtgtaagcctaggcttttaaatcgctttacatattccctttttttaatggctgcttcattcggttgatctctacatcttgtcaacggtagtctaacatattagagtcgaaatattgagcactcctgtgacctatcaatgataactactctgcctagtactacgatggcatcatcagatcgttgaaaatttcttattagttatgtccagtaggattatttaaaatgaaagtttccataaattctacgagaaattcatgtgttccaaacatagattagatcgaataggaaaaaaacatgctagttcgaatacaaaacgatctcacactgtgctgcaactagaatgagtaacgacacccgactgccctccataaggcaaacctgcaaaatttttgggactatcattgtaaactatgttttatatgcaacgctagctaaatacctgtgtgtgacagcagtaatgtccttgttaaaaaaatattagtttctacttcatccgtttcatattataagactttctaacattgccaatatttatatagatgttaatgaatctaaacatgtatatatgtctagattcattaacatatatgaatgtggacaatactagaaaatcttataatatgaaacggaggaagtacttggttgaaacaagattaatcaatcgagttacagactacataactactctacacaagtaaggaaaaaaatagctaagtactctgatatcatgacccacatgtcattggtcacctccaccactatcttttagatatagtatatatactctagaagcaaattaacaaaacacgatatgtaatcagacatcatgacccacatgtcattggtcacctccaccactatcttttagatatagtatatatactctggaagcaaattaacaaaacacgatatgtaatggtatcaacaatgtacatagtccatgaagattataaggtgtgattcatttattttgctattgtttattcaaatcacttctttcaataaagctaatgcccactaaacaccaaaagctcaacatgcaagcatagtatttattatcactcctaaaacctacatgcaagcgtgccacatcaacctattaagcacacaaagcttaacatgcaagaatataataattatgcctacaatttatttcattctaaaactaatcatacacatgttaaatcatcattctcaaatcattttataatatttcaatccaaatcattccatcatttctccaatatctaacatatatcccacagcaaagcgctggggcatcatctagtctttcacaatgcttgataccatctaggctcattgttaagtattctattgaatgatgtactatgctagaagaagggtattagttttcaattggaactacatcacgcttcataccccaagcaatacccggtccgtccctcccatagctaagtagttaaccccgagcaccgctcataccttcgaatagtgttttaacttatccaatccgtgtactatatgtgtttatcgcagcctacaatatcctcatgtactaatacattcttaattactatttttttaagattgaaattgaatgagtagagtagcatggcttcattgggtgtatgtgatgggagaagtgcaacaacagcaccgagtcttgtataaattcccccatgccccgtggaggcttggatcaagagaatacaaaacgaaagctgcagcaaccatcgaggggcattgatcaacagaagaaccgacgacggcggcggcggtggcggcggcggcgacctagaggccaacactactacatgaaatattttcctggacgctagacctgtttgtttctaggctggccataattgtcaccacatgggataatcgggggactggcaacaggctgtcgcccgcacgggaaaacacattatcccgtgcgggccactttactcaactgctcacgaaaatgccgtgcgggcctctttactcgccccgcacgcaaaaataatcctcatccccactccttaactctcccactccttctctcctcccggcctctcctctcctcacagcagcgacagcggcggtgccgggcgatagcgcgcggcggcccctccctccctctcccttcagctcccctccctccccttgcagatccggcggatgggaggcatgggggcggcggatccggcgggcgcaggcggaggcgacagcatggcgacgggcgacgacgaaggcgcgcggcccctccttcccctcgcacatctggcggagaagaggcatggggacggcagtggacgacggtggcgagcggcccctccgtccctctcccttctgttcccctccacttgcagatccggcggaggggagggatgggggcggcggatccggtggtgggcgtaatcgggcgatagcgggcgacgacggcggcgcgcggcccctccctccccttgcagatccggcggaggggaggcatgggggcggtggatccggcggcggtcgacgatggtggcgagtggcccctccctccctctccctttggctcccctccccttccctccctcccctagcagatccggcggaggggagggatgagggcggcggatccggtggtgggcgcaggcggaggcgacagcgtcagcggcgggtgacgatgacggcgtgcggccactccctcccctcccctccctccccttgcagatccagcggaggggaagggtgtattcggtcggcgacgggagcgggcggcggatctggcgtgggaagcgggcgatgacgatggcagtggcggcggcggcgacggttttttttgttttgattttttattttcccgtgtgggtggcttaagcgcccacacgtgcgggtgcctctcccgcacgaaaaaatcgtgactttcgcagacgctgggttctagacgggcggaaccaacgcacgtgaaaatcgtgattgtagtactacaatgggttgcttgtcaattccttctcaaactcaacttctacctccaccccctgtagttctagaacccttatagaacttatctctcttttcttcttcttatgttctccaccaaacaaagagctgtattcaatatgggttgctaacaggcccgtcattgattgcactgtcaatgtcaattactcttcagattggaaattactgagttgattatgaagtgaaatttgcggcatttgcttgaaatttgaggttattttgttgagggtgagcttctttgcttctcaaggatctgatgttgcacaagtgacaagacaatgttcttgggttgtacaagtagactgctaatgacgtcatgcgcatacttctgccggattcagagaccaccgccttcagaacataagagcatcctcagccgctcatctatatttggtcctccaaatgtccatatggagtatcatccaaaaaagatatcccttccaactccaacagatcattcatattacatcatccatatctcatcatcctatattttaggaatatctttccaactaactttacatttgtattttaagggtatatttccaactaacttaattttaacggtgttatttatcgcgaaaatattttgaaacgagtaaattttaacggatatatttttaatggatagttttttaattgatatatttgaattgagggaaacatttttttatatattcgtaccatcatccataaaatgaaatgaacataaaaacacagcaaaaaatattcctatttcctatttccttttaccctattcctatttcctatttcctcttctctactactactactactcttttcctttcactctattcctatttcctatttcctatttcctcttctttactaggggtgaaaacggtacggaatttttccggattccggacctattttcggaaacggaatcagccggtcggaaattttttggaatttctcggaaacggaatcgaatatgataatcgcagtttccgtcagaactcggaatcggtcggaaacattccggaaaatttctcggaatttctgaagttaaaaaggcccatccaatcaatagtccataatccctccccaagtccccagcaggcccaacccaagctgctaaccctagagaagagagtgcagagagagaagtcagacagatcgggagggaggccgggagcggcgcatcgccatccagaggcgccggcggcggagcggcgcatctagagtgcgccaccaaccaccgctggcctgtcgtcctcgcttccttggctcctcgcgacctcgcccccgccgtcttgcatctcgcgccgcccttcctcttcgctccgtcctcgcccccaccaacggcgacggcaggaggcgacgacaacgcgcgaggcaacggcggcaggcggcggccgcacggctccttctagatttggtactctccctctccatgcctacaccctcctctccacactccacggcgagcagcgcaggcggtcgacaggctggtaagaggcggcggcagcttgcggcttgcgacgacttggcatcagcaacttgcggccagcaacggcgacgacggaggcgaggtcgcgacggaagtccgaatgtgggcaggagatgtgggcattgagatatggcgtgaggagagagaatcgctatatttggccgaaatctgctcgctttggcgcatcgtccatatttggcggactggatgccgtatctgctggaggtccattttcatctcgcgtacaccatatatcggatggaggaccggatgaaggatctcctggggatgctctaaggtagtaaagagtaaatttatcagaactccagggctgtgttcgttttaggaggatggaaactaatccctcccgcaaggaaaatggagcggtccattagcgtgtgattaattaagtattagctattttttttaaaaaaatgaatcaatatggtttatttaagcaactttcgtatagaaactttttgtaaaaatgcaccgtttagcagtttgaaaagcgtgcacgtggaaaacgaaagggggagttgggaaccacttgaaacgcctgggtgcataaaacaaagtatcttgaactccgtacaaacctcatatacacaaaattgtgtgtgcgtagcaacatctgaaaatctcatggcacacaacctcgggtgaatgtagcacttttgaacgtgaaattgaattcacttgaacagaatagctacaatgcaaagcttgactcctgatatttggatatgtgcacgctgcaaaaaataccggaaattttgctactgacagaacaacagagaacccggggaaagactcgtactagaaaacttatccaaatatattgtatgcctaaaattcgaataacatatttaacacctggagagagagggagaggggagcgcaggggagggctggccaggcggcgccagaggccgcgctgggaggcggtggcggcggccggcggggactacagggcggagggaggacgaggcgacgatgcggggaaggaggatggggcagcgagcacgcctacccgcgcgttcgccacgaggcggcaacagctggggcctggggcagggggaggaggagaaggccaccggggaagggggggggggggagacggcgtatgatttatttatttgtatatcgagactacatttcaatatagtatcagttaatgatttatgttttttataatggtttttgaattttaaatgtgaatacgtgttcattattacatgggaaacttgcattgcaagtgcaatatggatggtttaattcacagtggttattacgtgcatgattactatcaatataaaacctttcactgtcccgtacgatttgttaaaaaaaaagaaactaaacacaagactagtggtacatggacacacgaacagagtatatatatacatatatacatatatatatacatatatatatatatatatatacatatatacatatatatatacatatatacatatatacatatatatatacatatatacatatatacatatatgtatatatatatacatatatacatatatacatatatacatatatacatatatgtatgtatatatatatatacatatatacatatattacatatatacatatattacacatgtgtgtgtgtgtgtatatatatatatatatatatagacacacacacggtagcgctacctagcgctactcacagccgctgcgcgccaggaagaaacgtgacgcgactcacggtgggaaaatcccaccatcgagcaaacaacccagtgtgaagttaataattaacttatgtacatttggaggtgggttatgattccgttcgcgaagagttaaatttttacttatttttagttaatgttagataagagttttacttttaaaaggatggtatggtgatggagttaatatttgacttatacacggttgtgacgtggatttggtgtataggttattgagttaaaaaataactttgttgatttgtaccctgcatgattcgatggatgtttttttaactataatataattaggggttcgctaatttgtgtgataatgcgtagccacgaatctcgggattgtacgtacgtacaagctaactaatccgctagaaaatatcttcgattactccctggattagcacggatcagatcccgtgatttctgtttgcaaggtttgcattcccttttataaacttgactatcacggcttctgcacaagtgcccaacacagacccaactcatcccatggatgagattgcccaaacatctaccgccaaagcgactaattccgaagaacatgttccagctccgtccgttaataccacgtcggagcaccgtgaggaggtatgtgaactcccccgaagagtttcgtgtgtcggagccaccaccgccttccccagacccattcctgctgtcgccctcgatggaagcagatgacacgatgttcgctgaagattttgggtacatgtcaactccacgcccatctccaccatcggacattgatgacctcaacccacctgattcggacgtcgaggatgttgtcaagatacagaaccgaacctgtacaaaaagaagtatcatgatggagaataaaaaaaattcatgacggaagtataaacctaggtttgtatgcataaaatgaataaaattgttagaaacagaagtaaaatagatgaaattaacggaatagcttaccaccaaaaatacaacacaagatgtgattgacgatgtgggcttttgtcgccaacatctgatggtatcgctcagtgcttggaacactgccttcgaccaatcgatggcagcgacccgatcgaggtcagcggcaacccatacatcactcttgggtatgtaaaagtcggttgttgggagtaggagcttggacataagaaccatgactaagaaacgaactgccgaggggttgtctttctggttcttgatcacttcaatcagcattttagctgagatccgaccattccgtgcaattcccaattcttgtgtgatcctgtcgtgcacgcttcgcacaaccttgttaggtgggattacaatatcatgtccgcctaatggggtccccatcacaagcttcacggtgcgaggggtgatctgaatcttccgttcaccatcaatggaaggacacattgtgtcggggttggtcttcttgagactttcaagtgtcatgcaagccacggcgtctagcccgatttcccccaatttctcgtggtgtgtattggacagcacacgacaagcctccgacgctaacgtggcgctgcaacatgtcaggttgggcccctttgattcgggtggctgcaaacaaaaatatagacctattgaaattaagcatgaataataaaaatccaaaaaaaatggtgctagtatatcaatgccgacactagaaataaaaataaaaggatgtgattttttatctgatatgttcactggaaagacgaggctataaatggcagtgttatgaagtgtttgcaaaaaaaagaaaaaaaagaatacacacaagatggtgtgcataacactgacatgtatgaaaataaaaattaaacggcatatgacaaacacataaatcaatttgcctattgttatgtatactgaaaaggaaaaattgtgaatatagtatattactcgcatacatgcgagacagaactgaaaacaaaagaatcgtatatttgcaaccaaaaagatggaccaatcctcattctagtcggcacgagcccgtgggtgggtcgtgggaatcaaacgaaaaccgaaatatactgcataacacattatagtaaaaaaaaaaagaagctattgatgcataaaggatatcgctaatttgactgaaaaataacaacacatacccatgcgcttgactgatcaaattaaaggtaagtcaattgcagagcgctgtagatagatacacctagggtatccgaaattgtgacacaaagaagagtaaaaagaaataacttataatcgcgtatgatggatttgtgcacgcaaactacgcacaccctgctctcccctgttgcggtatggatccccaacatgagtaaatttgtatcaattaacatatgcccaaaatagtcactggaaaaaaaggtagcaaaagattgactgagttttgtactaacctcatcgcctgatgcgtcttcatcggccgacttagcccgccgcttcctttttggcttcctatgtgttgcttcatctccagccattgatgaagaagttgcgccgctgaccatggcctgtggaacacaacttcacacgcggtttgcgaatcggcgaaccgaatcctcttcacccttcctaaagggagcgacgatacattaggaagaatccctagattgcggtcgatttgggatggggaaacgaaaccagcatccataacacaacggataaaaatcgggggatatcacatttacctgtggccgacttgtggaagaaaatcagtgggaatcaatcccggcggcgccggcgatctccggggcaaaggcggcgagagaggagggagagttcttcttggtcgacggagaagaaagaactggccgtaaaatgtggggaagacgataactccgatggtttgaaaagactagaccctgaagattcgctgctattcgcactgtagctgcaagggaaaaaaaggaatcgtaaataacaatacattgcgtgtcgagttaagaaataactcgccgtgcatccgcatcgattattaaataaacaacccatgcctaagtcgctaacagttaaaatataactgaaaactcattatgtgatctagttgcttcgatgagttaaataataactcaatgtgtgcacaccattgtaaccgaaaaaaaagaaacacacaatgcctaaatcccttccacttaaataataactgtcttgtcgtgcatgataaaaaaaagtgtttgaatccaaataataaaaaaatggaaaacatttaattaaacatttagaataaatgtcggaaaattaaaaataaataaatcaaaaacagattgttgagtttaaaaataaccccatctaatgatctgtgctacgacgcccgctagtgtgtggtttgaatgatgcctgaagaaaaaaaataaagttaaaattttgcttaattgagaatagcgacactgtaaaatatgtgatggatgttgtacaacactgagttaacttttaactatgtactattaatctggtgtgatgcgggctgcgtggtcggtggcggtatgtggggcagagtggttgtgaggttgtatcaggtgccatttaatcggtggcaccttaaggtgccctattgtagttatatatatatatatatatatatatatatatatatatatatgtgtgtgtatataagcgcacaccgcacgctggtgatcgagtttattcttttgcagaactatacaagcacacacgcatgtatatatatatatatttactagtaaaagtgtccgtgcgttgcaacaggaattgtaaagactagaaaattgagaaaaatttgagaaagatatgtattatgtaattaattgaaatataaatttccgaaaatatttggtattttttaagtaggtagatatataattaaattagtttagtgtgcgaaataaaattatatagttggatttaattttattgaagtctccatgattaattacaatatttggaattttattgaaatttctagagtttaatagctaattttgatagtacaagcattatttcagcatttatttaaataaaaaaatcaaccttggtctctaggccattttcagcccgcttttatcccttctcctcccctccgtctcaacctgtaggaaagcattcggcccaacaggaagtgtaatttggctccccctactcctcctctcattgccgtgtggcccccaaccgaaagtccaacctaagtgctttgttggaccagccggccagcgtgctgcgtagcagtgatgcggcctaaagatggaggctggcccaacacgggatcgatctgagccgttcgttttgatggacggctcagatcgattttgaatccatcaaaatcgtcgcggttaaaaaatccctaaccctaattcattttcccctccctcccctcaccgcaggccgcctctgtcccctaccagcggcgcccctcctctctccccaccaacgacgctactcctcccaccgcgagctgccccttccccaccggtggcgcctctccacgcccctcccccaccggtggtgcctctccatgccctcctttctcccgcggtgccgctccccctccctccccccctaaccattggctcctttaattcctcctcgtcggggtgctgctgccatcccactcctcgccagatccagcaagtcggtggctccccggcggcatggtggctcaggattggctcctccctctccctcccagcatcttcctggcgcagaggcgagccagcgacttcccaacgcaaccgcggctactccccggctccctagcgacacagtggcggctcggctgatccccgatgcaatgacgggacggcggaggaggaacggtggcctcccgctcgcccctccatctcctctcaacatctcttaatattttggatgattttgtgatgattccgatttagatttggatttggatttggattgagattatgtttttggttggacttggattttgattatgtgggatttggagaaaaggtgcgcgcgatgttgcgaacggacggaaaatggtagtacggactaaaaatcgatgtgatgatcgaaagctaccaaatttttaattagttaagattctctttgtctattttttttttgcttttctctcttcttttattccgccgtttttcttgctgatagtgttctggccttttttttttttccttttttgccggatattttactgacgccgtttctagatgtttttttcgccgttttcttggggacggttttttttaaatcggaatcaaaatttcttttcttttttccgtctttcttcctaacggcgttttgccgcgtgtgggggttactttttttgcggggtttttttaccgatgccgttttctagaaggccttttttttcacgctgttttcttatgaacggtgtttttttaatcagaagcggatttttttattatatggacgaaggaagcatcttatactttttaagtagtatatatatactccctccatattttaatgtatgacgccgttgactttttaaccaatgattgaccactcgacttattcaaaaattttatgcaaatataaaaatacttatgtcatccttaaagaacctttgatgataaatcaagtcacaataaaataaattataattacataatttttttaataagacgaaaggtcaaacgtttgtcaaaaagtcaacggcgtcatacattaaaatacggaggaagtaatagataatgggactgcctatacatttatcgacaaatttttccccaaaaatttgacagatgtaattatagtacaatcgtaacgtaattacactgtaacttatatccaattacactgtaacttgcatgtaactacactgtgacttgtaagtttcacataattttgaatcgttagatctatcacaagatttgttttggtgaggaagaaaacaaatcatagcacacacatatatgaaagaatttgttcccacgacctccattttaccgaaataacatgttgcggaaagatttttgaaagttacatacaagttacactatagttacagtgtaattacatgcaagttacagtgtaattacactacgattgtactgtaattacatccgtcaaatttttggggaaaaatttgtcgataaatatatagcaaaatcgatagataatagataatagataatagataatagaaatagataatagatataaataatagaatagatagatagatagatagatagatagatagataatagaatagatagataatagataatagataatagaaatagataatagataatagaaatagatatatgtcgtacgcgtcaaacgatagatcggcgtatgtcggctagctccgataagtctattacttgctgaagcactggttttccttggagtatttgatcaagcaggcggtgaacaccatccagttgaaatctctgcctttgcaccagttggtgacgacatccagcatgcaattgtagcaaccgcttgtgtcgcagttgcacgtcgtggcgccggtggcggcagtagttgccgccgccgtcatcatcatggactgccccacggacaaaaccaccagacagacgacggcaatcttagccgcggcggacgccattgattgggctggcctagctggttacaatatgtttctctagctatagtgcacaaatgatgatcgaggtagcagctggaggggtgtagatgtgttgttgctacgtactgttatttatagaggaggctgggcagatcgatcgatcgacgacaccactgtgcatgcatcagaagcgctagttaatttcttctggttcgattcactgtggctgctgtagtcggctggtgtcttctgaaactggtggctcttctcacacttgtttacacatatatatatcattagctgcttaataccacctctttcctaaatgcgaagagttttaggtttaaatatgcctataagaaagtatgtagaattaaataagagaatgttgtgaatagttgggaaaaggaaattggtggaaaattaattcgaaaggtagaaagttgtgattggttgagaaaggtatatataagtttttatattttattacaacttttaaacgctataagttattatattttgggatggaggaagcaatacttttctatggtcagaaaagaaatgtatgacaacatatacaatgtatacagttaaaacacggcaatctaatacctttgtttttaatagatgatgctattatacttttaaaataatatttagccattcatcttattagaaaaattgtgtaaatatgcttaaagtatcacacctaaatttcctttaatgttaaaacatatatatcacaacaaaataactgatatttatataaattttttaaatatgagaatagtcaaacatcatataaaaagtcaacggtgtcatcaacttagaaaacggacagggtatatagttttcatttaaagtataagttttgacaatatcagatagatatatccagttttttttcataacaaatgttaccgttgttacaccaatattgctagcttacctaggtttgttgtaaaggatttcatgttcagaattacaacttatttcactttttcttttttgagaattacatagtacaacgcaaacactctgaaaagccaaaaatggcattcttctttcaccagtgtgagttgatgcgtcatcttatcatgcggtgtggcttactaaaggttatgttcaaaataagctatctgttgatcgttcattgtcaaataaaatttgtattaaaaaggttaaaataaaatgtatgtgcacctcaaaataaattcaagcgaagtaaaataaaatgtatgtgcgcacctcaaaatacaataaaatgtacctgcacctggttcaataacttgacgtaggtgctcgcatttacatttttttttttgaaaaaggccgaattaatccctaaattattgtgaaggtacgaattatctggccccctcaattcaaaaaccagatactaaaccagatagtttagtgtaagacattcttcaccctcaaatttttataccggacgaattaccccctgatatacttcagagcagttttggtcctacgtgaaacttatgtggtagtccagtcagtaataaaaaatataaaaaaggtagggctcacatctagtgaccgagagaagaggcaaaattgacaagtgggtcacatcattttttattttttatgctgactagacttccacatgtgcgccacataagaccaaaaccgttccggagtcagtcaggagataattcgtctagtataaaaaattgagggtaaagaatgtctagtttttgaattgaggtggtaatttgttctgccatgatagttcagggataatttagatttttttccttatttttttagtggtggatgacatacttgtcaacaggaggcactcaaagatgtaccagcctaatttaattttttagaggtgctcataagaatatagtttgtatatgtgtgtttatagtagtagtgatcggcgatgtacccgtccatggcagggtacccatagtgacttcatcggtctcaaaatataccggacggtctaatttttcggatgtgctcgtaatgataggatgtgtatgtattcgtaagggtaagtgtgcatacatagtgagtgctgatgtttgtactatgtttctaaaaaggatatctctatctctactattataaaaattaaagatgtttttgccgatattttggtatgtcattcgtgtatgagtcagtttttaagtttgtttgcttttgaaaatacatatccgtatttgagtcggtttttaagatcggtttttaatacataaggaatcatataaaaaatatgttttaaaaaactcgcatgctaacttgagaagatcgaactactaattggagctcttgattttctaaaaatatatatccaagcgaaattccacattaaatttcatcttaacttaaccatataacaataataagattaaaatagacttcacccgttgcaacgcacgggcatttttctagtataaatataaatgtccctaggcagccacaatgtggccataagaagaggccataaggttttatagtgaccatatacattgtgaaacaaagtcataagtcattaaatgcaaaagaaagctttaagcttatggcttgaccacaagcaataaaataatggggtaaaatagatatgaggatgaaaaattggtacggctgataaaaaaattactagaatagtacattgtgggacccatcttaaagtttactcttgcttcaaacattgtggtaataaccctaagaatagtgggacccaccttaatgctacttatggtcataaacattggaggtgcccgagtagtagcttatttgcgccgattacctaattagaagtctgcatgcacgtgtgcatacgaacaagtcagaggccaatcaagtcacaatttgacatcttcaagaccaggtggcacatgcacgtgcatttgcctgtggtaatagaacactccgatcagtcaagaacgtcatgaatctaaataccactatagccttccaccaatcagcatgaaaactaaattactgaacccatcacatatagcttttagtaaagtaacctatatcctagtaactacatatgcatgcatgcgtgatcgccaacttgcaagtagtgtaattgaaaagaaaagaatgatgacaatgtgaaaaataaagcatctactgtatacttaccgaaaaaaatgtacaaaggcatccatagtttgtttaattgtttatcaaatagtaccaaactagtgactaactactcttggaaggaattgcatcatttcgaaagaattgggcaaactagtatatattccctccatcgatatcccaacataaatataaggtacaatctcaccctcctttttaatgttttcagcgcacatatatgcatacaattaactagcacattcctctcctctaaattcatttttaaaaatcctccacttttaaaatctctaattatattgggtatatgcgtgtttctattgaggcaattaaaaaagtgataattttttttaatctttacatttgcggtgactgtaccttacatttttatatgatggagggagtatatcgtacaacgtatttgatccgacaaaatattactccatccgtttcgaaatatttgacgccgttgactttttagcacatgtttgaccgttcgtcttattcaacaaatttaagtaattattaattctttttctatcatttgattcatagttaaatatatttttatgtaggcatataatttaacatatttcccaaaagtttttgaataagacggactgtccgacatgtgctaaaaagtcaacggtgtcaaacattttaaaacggagtgtcgaaactagatttcggcaataataaaagggggtggctatcaagctagaaaagtgtatgggtttggagacaaaggatttatacaggttcaggccttcttataaaagaagtaataccctactcctgtccggggatgaatccgccgagtgtattattgattgtatgatttgggaaaaatcagcatatgcccctagaggcgcccggaccccccttatatatgggaaggagtccggattacaaaagataatctatattcctaacggaatatgaagatagaggtaaaatacagtcgtaaccgactaagtctcagggtgtttccttgatacacaagttaagaaacaaacccgagatacagataagatattctatctacattaagtatccggtacccaatccaaataccgtcgccgtgtagatatgggatacccataatctccacagtagcccccgagtcctttgcagtcgaccatcatagccttctcaaagatagtaatccaagtgcttcaagcttttcatgccaaggcctgccgagtggactgtaaagggcgaaaagataaaaaacatggtgcatcgaatagatgcacctaattaggtgtagcccccaactatgtgattagttaacaaactaaacatatagttgaaagacaaaataataacacaattgtgcattatatgacaaaagcatacgcggcgcctaaataggcatgctagccgactgctttttagccacaataaaagaaatccgagtggtttacactctaaaaggttcacgaatgaacacacttgacaggcatccgaatataaaaactctaaagattacccatcaagcattataaagattatggtaataaataagtcgaatagcctaggcaatgactatttaccatgaaaacaggcatataacacgccaaggaaatgactataataaaaacaagtcatccctagttaacccaaacagcttttgtagcctaaaaaagcttgcaaaaacagcataacgcctttctgtcgggcacctttttaatttgcattgcaataattccaaagaattatatgaccgcataaaaaggatttcatcagcattgggcaacactgttgtgcgcataatattgccaaagcaaaatatgcctaagtccctaaggaacacaatgggccacgctgttaaaagtattgggctgaagtactgttcaggcctaggcccattagcacctccgatacccttaactgaaaaatccgatatccaagcgacgcttcgtcttccccgccggaactctcgccattttccccactccctgctacagtgcaaagctgcgccagcgaactagggttcacaactccggccaaatccacctccgaaaagtgcatcaaaatccttcccgtgatccaccacctcaattcctcacctctctcaagccatccctcgaatcaaatcagcacatttgagaaaaatcgatggcggaagagagagaaagctttgaaggccaatgggcggcgtccgatgcgacagaggagaatctgaaggagatggtggcgcatggtgttctcccagccaaagagatcatcgggtggcggccagcgtacggtgaggcatttccatctccagatacgcatgaaattgtagtcttctcgcatttcttctacggtggttttgctcttccgacctcaagatttttccgtgggatcttgaacttctatggaatcagcttacatcacctaaacccgaattccatcgtacatattgccaatttcgtccatgcttgtgaagcctttttggggatcaagcctcactttgccctattccgccggatctttttcctcaagccccaaccaaacaagaacaaaccgtgtgtagtcgggggggcaggattccaactgaggggaactctgagccaaaaatatttctccatgcccttcaagacttcgaacaaaggctggcacgcaaactggttctatgtccaaaatcctgagcctgctcttcccgggtactcttgtcttcctccagtataccaagatacctggaactcccttccaatcggagacgaagcagtccaagccttggaattgttggatcgcatgttaaagctcaaagagcaaggcttgcaaggagagcagattactcggcacttcatcaaatgccgactagcgccaatcaaggagagatctcgcacggcattcgagttcgacggcaggtatgatcctaaccgtgaagaatcagactctctggatttcagaatcatgaaggagaggatgtataaaatcttctcaaatgcaatcgtcgtcagctactcacaccagctgccagtcgtgccatataatgcgttcaatccgcctccacaggtatgtatcgaaaatcctcaaaccatgatcagaacataattttgtcttcatgctgagttgactaactatggaagcatctggttcaggaatatgcactgatgaagtcagatccaccagtcactcagcgccggtctcctcgccaacacactgctcagggaggtggagggccaacgatcagaccggatccgcaacctcagacctccaaatcaactggtcagacgggtcctcgcaagaggaaactggtgcttgatgatgatgaaggcgacgatgataaatctggggataagggctcgcctaacaaacccccaaagcgcaccatgcccaggaaaaaattggccggccgcgcaatgccaaaaattagaacatcttccaggtataagacctctcggtatgatttcactttggtaagctctctcatgaaaatgatgctaaattctgaaagaatactttgcaggaaaccatctgatatagatccatctggaaaagaccccgatcctgccatgacagagcagaatatatccaaggaccccgagctgactactgaaaaccagccgactgctgaaagccagccgactggcgcccatgcttcgggagatagggccaatccgagtgacctgccgccgactggaaaccagtcggcaacaactgaaacggcaacaactcaagagcccccgactggaaaccagtcggacgcaggccctgatcaggagatccccgaagtaggagcgcagacgacggcttcacaaggaccagaggctggtaacgactcgatagctgggtcttcaggtaaagaacaaagatcacctcacgctcagctaggtacatcttcaggttagttgtcttctcaaataatggcgatttaaataacctcagtgtatccgtctaatgtcttggaaacacatcaggaccgtcaggtgatgacggagaagaaatccctcgcataaaggcaaccgacgactctcgtcctcctattttgatcaaatggtgggacgagaactcacaagccgccggtatagtcataaaccgtcagaaagaagatgaagaagtgtgccagctgaagaaagcgcttggagaggccactcgtattgtaaatgtaagtcttccgagcgacagccttcagtaactttgttttctttttagcagaactgaaccatgatccatcatgcagagaatccatcttcgcaatgaggccaagaccacaactttggaaaagctggttcctcatttgggaactctagaagcagttagggaccagctgcatgagaccaaggagcttgccaagaagacggagaaagaattaagggaccgaattgctcagctccaagagtcaaattatgagctgagtggttcatcaaaaggtaatctctagatcagtttcatcagtttaaactggcataactatatcctcaaccatctgaatttcaaaacagcgcaagccgccaggatggaacagatggcaaagcaaattgaagccctggagagagataagacagaactggctgcgcaaagggactcagccttgaaggaagtcgaaggtaacgccagccaacaatctgagcttctctccttataatgcaacagatgctcatcataaatgtgttttgtagatcgcaagatcaaatctcaagctcagtttgacgtcctggttggtaagatcaagaggcttgaaggagcaagggatgatgtcgccaatgccgctgcaccaattatccaagccatgttcctcaataacggtggtccgagtgcactcgacgcaaccgaaatatttgacaagctgagtgttgctccggaagtatatttcaaaaatatcaagaaagctggaagtatgggagctggcatggccttggcgatgacaaaatctttgtacccgagaattgaagtcgacaccattgatggatttgcagacgggacaagtgaagaagctgcccttgatcttatcagtagtgcgcaaactgcggctgacaaaatagcgagtgatgttgtggagcaatttcgcaacaacgacctccagccgagtaatgatgactctgatgatgaaaggactgactctgactgagtttggatgtaatacatggaggctcaatttgtacaatactggtgtatttatgctgtgcttgatgattcttgcaaagtttttgatttcttaaaagtttttgctaagctttgttgagcctaaaacccaaagaagctattaaaaactttcagtcctctcaaactaagtagaaaaaccaaacaaggcaatgataaaccaagtaagcaaactgaattgataaaaaaaatcacactccattattatgataatagcccccgactgacaacggcaagaagaaaacttgatgttgacagtcaaaatagggaaatacaatgataaagttaagcgtagaaacgacgaagatgttcaatgttccaagagttgtcgacgagagtgccgtcttcgcgcttgagtcgatatgaacctggccgggtaacttcagagataataaatggcccttcccatagaggagataacttgtgccgatctcgtgtggtttgaattttccgtaaaaccaggtcgccgactagacaggcacgagatcgaacattgcgattatgataacgtcgcaacccttgcaagtaccgagctgactgaatcaaagctgcttcgcggacttcttccagtcggtgcaagtcgtccactcggtcttcttcatagcgttcttcacggaaattacggaagcgcaaagattcgaactcgacttcactcggcaacattgcttctgccccgtagacaaggaaaaaaggtgactggcctgtggcccgactgggcgtagtacgcaaagaccaaagtactgatggtaactgtgacacccatttgccggcatagggtttaagccggtcaaaaactcgagctttaatcccttgaagtatcatgccgttggccctctccacctgtccattgctcattgggtgcgctactgaggcataacaaatctttattccgaaatcttcacaaaagtctttgaaaactccgccggtgaattgtgtgccattatcagtgattatccgattgggcactccaaatctatgcacaatgttgatgaagaagtctcgagcattatctgctgtaatcgtgacaacaggcttagcttcgatccacttggaaaatttgtcgatggccacgaagaggtgcgtgtaaccgccgactgcctttttaaacgggccaaccatgtcgagcccccaaaccgcaaacggccaagacagcgggatagtttgcaactcttgagctggtaagtgaatttgtctggcgaaaaattggcaaccttcacatgtgcgcacaattttgtcggcgtcggacactgcagtaggccagaaaaaaccctgccggtaagctttgccgacaatggtgcgcgcagcagcatggtttccgcatatcccagaatgtatgtctttcagcaattgtctcccttcctctaaagatacgcagcgttgcagaattcctgaagggcttttcttgtataactcagattcatgcataacataaagtttgctccgccttgaaatccgctcggcttcatctttatcttgagggagctcttgagaagttaaaaatcgtatgaagggctctcgccagtcggcttcaaccatagcgacatcatgggtgcccgtaatttgagtggcatctttgtgaggtaccgtcggcgtataaaggtgttcgacaaaaacatcagagggcgccgcctcgcgcttggatccaaagttcgcaagtctatcggcagcttcattgttgtgtcgaagaacatggctgagctcaagtccatcgaacttatcctccagtttgcgtacctcttgtcgatatgccatcatgttgtcgtcaatgcaagaccactctttcataacttggttgacaaccagctgtgaatcacctcgaacgattagacgctttatccctagggaaattgcaatccgtagcccatgaaggagcgcctcatactcggcgacgttgtgggacgccgaaaaatgtatccaaagcacataacttaatctttctccagtcggggaaattaaaaccactccagctccagtgcctgaaagtctttttgacccgtcaaaatgcatggtccagtgctctattttctccacgggggtatcctcttggcactcggtccactcggcgacaaaatcggctaacgcttgagacttgattgaagtgcggggcttgaatgatatgtccaaagacatcaactccaaagcccacttagcaatccgcccatttgcttcgcggttgtgtagtacatcgccgagtgggaatgatgtgaccaccgttaccgagtgaccttgaaagtaatgagacagcttcctggtagtaattaaaataccatataacagcttctgaacctgagggtacctcgttttggagtcggccaggacctcgctgacgaagtagattggtcgctgaactttctggacatggccttcttcctcacgctcgacaaccaagactgtgctcacgacctgggaggtggctgatacatacagcaacaacggctcctgcggatgtggtgaggctaagaccggtggcttggtgaggagttgtttgaaatcttcgaaggccttctgtgcttcaggtccccattggaaattatctgtcttcttcagtagcttgaagaagggcatcccccgctcgccaagtcttgaaacgaatcggctgagcgccgccatgcatccagtcagcttctgaacatctttctgggtgcttggcggtttcatgttgaggatagcagtaactttctccgggttggcttggatgcccctatgagacaccatgaagccaagcagcttccctgacggtactccgaaggtgcacttttcagggtttaatttcatcctgaaagcacggatgctcgcaaaggtttcttgtagatccgagatcagatcatccttttgcttggtcttgacgactacatcatccacgtaggcttcaacgttgcggccgatctgtgttgagaagcatctctgaatcatgcgttgataagttgcccctgcgttttttagtccgaacggcatggtgacgtagcagtatgccccaaagggcgtgatgaatgaagtcttcaagcagtcggattccttcagtcggatctgatgataccccgagtagcaatccagaaaactgagaagctcgcagccggcggttgagtcaactacctggtcaatgcgaggcaacccgaagggatctttagggcaagacttgttgaggtcagtgtaatcaacgcacatgcgccattgccctgttttcttccgaaccagaaccgggtttgccagccagtcgggatgaagaacttctttgatgaagcctgctgctaacagcttggtcaattcctccttgatcgcgtccttcctgtcttgtgcaaatcggcggagtcgttgtttaataggcttggcgtcttctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttggtaggatcagaaggatctaagggaatctttttagtctgggcttcggtttccccactttttgaaatcttggcagcgggcactcctccttcgctcaccgtggttgcagccagtcggatttcctctcgggctagcgccatctcgcgagtttgggccatgtcgcaactctccttgtcgcatgtgacggcttgcttgatgtcgctccgtagggataggactcctcggggaccaggcatcttcatcatcatgtaagtgtagtgcgggacagccatgaacttggctaacgccgggcgtccgagtatggcgtggtatgctgtctcgaaatcggcaacttcaaagctgatattctctgtgcggaagttttcccgagtgccaaaagtgaccggaagagtaatctggccgagtggagttgcggataatcctggaattactccatgaaaaggcgcattgcttggttttaactcggagcgagggatctgcatatcatccaaagtcttggcgaagaggatattgagtgcactgccgccatcaatgagggttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33743 - DNA, 594 bp, Oryza sativa
tacccatgatattttgatgcaatggataggatggctgttacggaatgtagcgaattcttgatgaaatgtactttctaatattaattgatcaaatttgagtatggaggccctttgcttgtcgactaagtgacaacgtcatggctagggatgcactggtgtttttatatttggatctcaagccctcgtatctggttctccagctgaatgtgttgatgcgatgactgcagcttaccaatggatgactctgtcatcttttcgctggcttgaagaactctgcagagaagcagaagtaggatatgttgacatcaggtgcttaactgaaacccgaatagaatccatttattttgacttcaaactgatgttcagatctgacatttggtgcacaacatgcagttgggggttttgacgtttcttaagtttttttcattgaacttgatcagccaaataagctattttagacgtgattcatgacctgttagtctgaagcgaaagcagaatcagattcaagaaatgcagatgtagaactatccaatcatatcgatcgagcacaatcttgtcatgccattgccagacatccattcttgcacaaagcaa

SEQ ID NO: 33744 - DNA, 691 bp, Oryza sativa
cgagctcggtacccgcaataccaaatcattggcaaattttggtagtaacaaatgttttggcaacttatgtgtcttattggcatattttggtagcaaaccaaacactagccaaactactatttaaaataccaacaatttggtagggcatcattttagcatcaaaccaaaatggcccaccgtttctcgtgcggggaactcagccttactatgtgtgtcatccaacatctctatgataaattttggagaaaatttgcgaaggtaaacgttgcaaatatgcaggcaaccgaatcatcgcaacaactctcggcagcacatctcccctcttcttcctgagtactctgggccaatctgccgccctccgccgcacgcgccatccgatggaggaggcgcaggccgccgtgatggcgcacctggaccaggtctcgggcctcgtccaggcgctctccgccgagctccgccgcgggatcggccccgccgccgacagccttctcgccttcgtccgcgccgtcgactggacggtaactaactccccgatccccagattagcggagatcaccgatttccagccgccgcgccgtgccgcctcctttctcttttgctgatgattcgcgtgccttgtgcttgtggcactgaggctatttcaggaaccatggctgatttgcttgatggtattccatgcgactctgttgct

SEQ ID NO: 33745 - DNA, 613 bp, Oryza sativa
  unsure (1)..(613): unsure at all n locations
ataaacattgtaaatgtagttagaataacaaagtagtgcagagtagaagaaatgcagaaccagtaaaatactgggaaatgtttagtaattccaactacagaaaattacagaggaattgaatcattgcatgacagcatgttacacctatataatttattttcttaggaactgatacacaaatatgaactgttgttgccagcattttacatactacacgtgaaacaattatgtgtatgtactgtaagcataattgccttagtttcataaccgtttagcaggcaaagaattcctgaactttttcctaaacaagataaaacccagggcaccaaggaaaggccaagatgttacaaaagcaatgtaagtaagcaaccaaacagatctcccctgcgatcgaatgagctgattaatggatatctttacaggagcaatagcatcctggattttatctatgttttgttttggctgttcctgtgatcctacaggaccttgggctggcgtcacattctcttgtgacctattaccgtcacactcattctgtatttctgtggcgattnnnnnnnnnnnnnnnnnnnnnnnnnnnnnnnnnnnnnnnnnnnnnnnnnnnnnnnnnnnt

SEQ ID NO: 33746 - DNA, 722 bp, Oryza sativa
tatagggcgaattcgagctcggtacccagtgcttgccaagccaggaaacaagttgggaatccacatcctatcaagaacatcatgactacaacacgccctcttgagcttctacatatggatttattcgggcccgtggcctacataagtattggaggtaacaactatggttctgtcattattgatgatttttcccgcttcacttgggtgtattttctccatgacaagagtaaggcttaagatgtcttcaagcacttcgccaagcaagcccaaaacctctatgatctcaccatcaagagggtgcgaagcgacaatggaggagaattcaagaacactcaagtgaaggaattccttgacgaagtgggaatcaagcatgagttctccgccccatatgatcctcctcaaaatggcattgttgagaggaagaaccaaactcttattgaagccgcaagatcaatgcttgatgagtacaagacttcggatatcttttgggtggaggccgtgagtaccacatgtcatgccatcaaccgcttgtacctccacaagatcttaaagaaaacttcatatgagctcttgagtggtaagaaacctaatgtttcatattttcgtgtctttgggagcaaatgctttattttgagtaagaggcctcgctcatctaagttctcacctaaggtggatgagggattcttacttggctatgaatcaaatgcacatgcctatcgtgt

SEQ ID NO: 33747 - DNA, 2310 bp, Oryza sativa
agctcggtacccctcggtgcaccatccaagaatacatcacactgtccaaagagatcatcccgtcgacaacatacttggtgacataagaaaggaggtaactactcgttctcgtgtcgctaacttttgtcaacactatttgtttgtctcttctttggaaccaaccagggttgaagatgcacttggtgatctggattgggtgatggctatgcaagtggagttgaataacttcactcgcaaccaagtatggacattggtggagagacccgaccaaaatgtcatcggcaccaagtggatcttccgcaacaagccagatgaacatggagtggttgtaaggaacaaagcccggttagttgcgcaagggttcacccaaatcgagggtctcgattttggtgaaaccttcacacccgttgctcaccttgagtcaatccgaatccttttagcctatgccgctcaccatgatttcaggttattccaaatggatgtcaagagtgcctttctcaatggacctatctcggagttggtctatgtggagcaaccaccggggttcgaagatccaaggttgccaaaccatgtgtacaagctccacaaggcgctctacgggctcaaacaagcccctagagcttggtatgaatgtctccgagattttcttttgaaaaatggttttgaaattgggaaggcggatactactctcttcactaaaaaatctaagagtgatttattcatttgccaaatttatgtcgatgacataatatttggttctactaatgcctctttttgtgaagaatttagtagtatcatgactaaaaggttcgagatgtctatgatgggcgagttgacctttttcctcgggctacaagtgaagcaagtacaagagggcactttcatctctcaaaccaagtacgtgaaggacattctcaagaagtttgggatggaagatgccatacccatcaagactcctatgcctaccaatggccacctagacctcgacgataatggtaaatgtgtggaccaaaaggtatatcgctccatgataggatccttgctttacttatgtacatctcgtcccgatatcatgcttagtgtttgcatgtgtgctcgctttcaagcggagcctaaagagtgctatttgattgccgtcaagagaattctaagatatttagtccatactcctaatcttggcttgtggtatcctaagggttgtgactttgagcttttgggctattccgattcggattacgccgggtgtaaggttgatagaaaaagcacaaccgggacttgccaatttcttgggcgggcccttgtttcttggtcctccaagaagcaaaattctattgctttatccaccgccgaagtcgaatatgtcgccaccggttcttgttgtgtccaactcctttggatgaaacaaaccctaaaagactttggctacaacttcaccaagatcccactcctatgtgacaatgagagtgccatcaaaatagccaataatcccgttcaacattctcgaaccaaacacatagatattcgccaccactttttgagagatcatgagaccaaaggagacatttgccttacacatgtgagaaccgagagcatattggccgacattttcaccaagcctttagatgagaaaagattttgcgagcttaggagtgagctcaatatcttagattctcgcaacattaggtgatgggtggttggctaatttatagccaaacatatgtcactaaaatgtaaattaaaaaaaataaaaaaaaattaagcttttgtgtcttgagatcacttcttgtgtagaagatggtcttgataccaggaatgaagctaaaacattccccttttatccaaaaactcccttttgtgaaaatttttgcaaaatcctttgtgtgccttttattgcgaaattttggtttttatttccttcttgtgatgtattgtgaccatagttatgtaatgttgtttgttggctggtcatatacatcataagtctcttcatgtccatagttcctaatttcccttcgttaaattctcttctcctccttgtttttgggcctgactgcccttgttctgtcaggccggaagttccgggcctccctgtccggaacctccgggtgtcggggagtatatatactcagggggagttagaaatcccggtctctctcctcacttcttctccctccccgacgccagccctagccgccgctacagtaccccttgtggcgattttcaattccatccgtgaaaatttgattcctctttgtggaatcaatcacattggtggctaggaggttcttcccgtgatcgatctgcgatttc

SEQ ID NO: 33748 - DNA, 9912 bp, Oryza sativa
  unsure (1)..(9912): unsure at all n locations
ggtcgactctagaggatcccctgtttgttggctggtcatatacatcataagtctcttcatgtccatagttcctaatttcccttcgttaaattctcttctcctccttgtttttgggcctgactgcccttggtctgtcggccggaagttccgggcctccctgtccggaacctccgggtgtcggggagtatatatactcagggggagttagaaatcccggtctctctcctcacttcttctacctccccgacgccagccctagccgccgctacagtaccccttgtggcgattttcaattccattcgtgaaaatttgattcctctctgtggaatcaatcacattggtggctacgaggttcttcccgtgatcgatctgcgatttcctctctcaaggtagcacttttgatcttctcttttggttcatcatgtttttgccccaatctctaaatctgtgaacctaaggagaaaaccacttggatagtcttgtttctgctaccttgtagatcaccgatctataggatttgttcacatgcactgtctatttttgagaccactgttcttcatttttgccggccggaagttgcacctggaacctccgggcgctgtccagccagcctgccattcttgattctctcaaattttgcctaactactgcactccaatttgttgattcctgttgcagtaagcactatgcctcgtgagaagagacagaaagcctctcaggatgtgtccggtgatgagagtcctcctattcattttcctcgtggtcgtttgggaaaagaaaaagtggttgaaggtggcagtagcagtggcactcgtacctctcccaggtttaccaggcaatccagcaatcgcccagttcagattcgtgatgttgacagtggtcaaggtagtgatgctccttcttcaagaggtcgtgggagaggtggtggtcgcacttctggggctggaagggcctctcatgatttccttgttggatctcgtgtgaatcccgttcggctctacaagactattggttttgacaccactcctatgcatcacattggaagacccaagtccaactaccttcatcagcttgccaagtgcagaagggaccgtttgattgatccaaagacacagcctggggagtcacaggatcctcgtttcagaactttaactcaattggattggtacaactcagtgattatggctagagacaatccagtggttgagatgaagtggattgattggacttacatgaggaagaagaacaatgaagtgttcaaccaagcaatgcaagtttgccacaacaagaatcttggagatattcttgccttggagtatgattggaatgaggaggtcattgcacagttctatgcgacagcattctttgatactactaggaagggaacttcttatgtaaagtggatgactgagggtgttaggcacaagatttccatagcacagtttgctgagatattgggcttagaggatgaggatctcaataggcctaacatacatagtgaagcacttcttcccatgatcaagactaaattcatgtatactaggggatgctcctaggacttgtatgggaactactcatggtttgcatccaaactacaaggtgctgtactccatctttcgttggtctttgcttccaaaggttggagatgccattgctttgccttccaaacatgttcatcttctcagtcgcatgcgctacaatcagcctcctttcagtgtgatgcagttgatttggtatgagattgccaacaccattcttgagcctaagcgaggttgcatctatgctccattcattatgaagatgattgagacagtcaccggggtgttctacattaaagatgggcgccacaatcctttcctcttctccagtggcacctagatccatcccttctacctcagctggtccttcttctagtgccccaccgcaatcctcgagctcttctcccatcaagaaggcacttcaggcaatcttctgtatgtgtgctaagactgcaaagaaagtgaagaagatagaaaggcgtcagaaggaagatagaagagaggctgggaaagaagtgtcagatgattctgaagatgaggtctatgtggatccttttgaggcttatgaggcagcccgcaatgttgccggtgaaggtccatccacctatttcaatgaagagtcttcccaatcagatgatgatgatgatgaggatgacactgaggcagctgctgaggatgctcctactgatgttgacaccgctgcacagtccgatgagtctcatctcttcggcgataccgagattgttccttcagatggagatggagatgagtgatcctcttcttctcttcatggtttcttgctttttggtgccttgatgctaaagggggagaaattgtgaattgaagggggtcatttaaatcatttttgctgccttgactgctgtctggtcatttggccagaagttccgggtcctgtgatctggaagttctggccaagcagattccctccctattatctatctctctatggacatgtaatcgtattctattatggttggatgtaatgactgttagatgttttattatcctttatgtcagtaagttagactatatgaatgttgcattttgatgtgatgtagtgttcttttcatctttttgagtgtttgcaatgtcatctagttcttcttctagcatatcactcatcatttaagcactcacatctgcttcttatttgattggggatagtgtgaagttacctttgagctttccttcgtttttatgcatattgtattcttctctcatttccttatatgcatatctttagggggagcttcacacttctctcatcatttcaatttaaattctattatctttttgtgtgctttaaccatgttgtcatcaatcaccaaaaagggggagattgaagatgcacttaaaccccctagtgggttttggtgattaatgacaaggtggttaaaggggactaacgtgtttatcaagtttattcacaggagtttagtcccaaagcaagttgtgatggctaagaatgcaaggagacccccaaatttgaatgctcctaagtgcgaaaaacaccgaaggtgattagactaggtttttcactttcgaaattgagtttaggaaaaaacatactattaagaggggtttcaagtgtggttctagggtatacaaagtgctcttagtcatatccatgtgtcaaaatatttttggaatcatttttgaaaaatgatttttgtccccgggacagagagggctacccggaggttctggccggaacttccgggcgccatttcaacagcaaattttcctaagtgctgcccagaagttcctggcacttttgcccggaacctcctggcaggcttccagtttaaacttgtgagtaacggctagatgacgtcatctagccgttatatatatggatttcgtccccaggccaccctttggctattccacttcagctctttcatgttctagggttttctagccactcccaagcttcctttacttcctccactcaaatctagagcctatcttgtgagattgagagattagattagagtgtaagagtattttggagatggcttgaagattaggtttgtttgagcactttggataccttgtgggctgtcacttgggcttattactcttggagatcttctcatagacggttaggtgtcgcccgtgagcttccaaagatcttgtggatgtcccgggaaagtttgtgaaggttttcttcacctccgcaaggaaacgaggtaagtgagtaaagattcttgtgctgagttttcagaggttgtcctaggtagagcaacttacacttgtggtcttttctagaaggaattgtgagttggatcttggtggtcactcaattctagaaaatgacctagaagtgttgagttgaaggttgtggacttcttctgggatctttgcataagtgaggcaaggggttaatcgagacccggctctttgagcacctcaacggagagtaggatccgtgtgatccgaacttcaggaaaaaatcgcctttgtctctcttgtgcatgatctgtgtttgaatctgctggtatcttgtgatttacatcttgtgcaaccttgtgcctgattgtctctagctaggacctgttttgcttccccaaattttgattttctctgttgctaggaagttcctggctcaagaactccggaagttccgggctgctcatctctgccaggaagttccggtgttcttcaccaggaggttccgggccctgttaatttaactgctgtgattattgaaaaaatttcagaaaaacctattcacccccccccctctaggctacatctctgcgcgttcaatgacgtctaagacgtcatggccttcctgaagacattgtctaggaggtcatgttccttgcattcaccaccttttctttgtttggtcatcggcggtttttggttgtcttcatcaggttgggtgagggactagtggatctccttctctcttgacctcttcctctcctcaacctctctacgtgtggataactgaaagctttttgacgtctttctatattgagtcggtgtttagcagagcatttgtaacctcccggttggccaagtggtgattgatcacgcttagcggcggtcggcttggtgctattgtcctctctagggtgtgctacgaggagttgccagctcttggtggtggtgtgtttgttttcatttgtttttcttggttacgacctcgtagggttgtaatattgtaactttttcttgctatactaatatgaattttgcattgtctagcgtgaatcattaaaaagagaatctaagaaatgccattgataagcatccaatttcaagaaataccatcaacaagttcaagttccatgaaataccatcttacaagcaattttatcctagaaatgccatcatcattaggattccgtccatcccgcgccattaaatacattgtaacttgtaagtgcaagttttattattgaaagaatagcgtatgtgactacgaggagtccatggaattgtcatcaactataagagctttcataaagaatatagacagagttatccataaaataaaggggttgtttggttttcataaactccctgcctcccagcgcacgcaagcgacgtggatgcctccgcgtgcgaacatgctactcgaagcgctctcagctaggggtggaaacgagccgagcctcgtgaaagcttggtgcaagggaagcttggcttggcttgctcgctacaaacaacgagctaaaactgtagctcggctcggctcggctcggctcgttaatgggctcgagctggcttgcgagcctggcatcaagtaaatctcaagtaggtctaacagaaatcgagaaacattttaccacatagaatttataatactgtgatagttttctttaatatgtcatcacaacacataaatagataatgtggcaatcaaacttaccatttccaacaaataaatagttagaaaaggtgcaaaatttttgtatataaccctatgcactaagccaaacgagcttgcgagcggctcgtgaaccagctcgggcttgactcgtttttgaaacaagctaggaaggaggcttgggctcggctcatttggctttcgagccgagccaagccgagctataggagcccgaactttttgtccacccctactctcagctccgcaattcccagtagcttttaatataaccgattaaaacagaagagagtaagttggaacaaccattagagcatctccaacagtctctccatatctaactctcgaaatgtctatttggccaagtctccatctaatttggcaagtcaaacttatggtttactccaacagcatctccattcaccctctctattatgaatctacgacagtgggacccacatgtcagcctctacaaccctttcttcttcctcatacttccttttccccacgctctcgtctccgtgctggtggcactcctctgcgtggcggcggtgtcgccggtggaggtaggggtggcgcggttcgtgtgcaacacctgtttctcctctctctccacgccgccatccacgccggcgccctcactgctctgcatctgattcccttgcctttgttccagcggggccggggcaaccttccaacgccccacctattgcatctgcgccggcaacaccctcgacaccatcgccaggggcgtctccgctggcctcgtcccctaccaggacatcgctgcgccagcaacatctccaacccaaacaagatcgccgtcgcccaggagctctggatccctgtgcctgggtggacctccttcccgatggtgacggcgagctcgaggaaggatgcaagcaagcgacgacgcgcctccttccctatgtcggcagcaggcacgagcggaggcttcccccggtggtctcgatgcaggaaaggagttggaggcgcccaggcggggttcggcttctccaaatgctaagccactaccgccattgttgtcctcttgtcccatcgacgtggtagatcggagcagcaacgggggcgacgatgaaggccaacgatgggggcggctatagggccggcgacggagtccaagacgaagacacctcccgctccctccttccttagctcggcctaggacgaggcaacgacggacgagggcgtaggtagtggagacagtggagggcggcgatggatgccgccacagtagccggtgtccagatcatggcacgggcgatggctgctgcacgcgctcagcaatgcctcggatgaagggtgtgcatggagaaacaggcgtggctcccatggatggctagccggctttggctggccaaactagccggctttggctggctaagtttggccagcgaggaagcagtttggatggcttggccattcaaatagcaagcctgttggagtacaattttagtctaaaattgccaaattttgacttgtgggatagcaagactcttgaagatgctcttatagctctacaatttctgaataatccttgaaagctttaacaaataagcatattcacacgactgatacgaggattaagtgcatacaaaatgagaaagccttatacattattaattaagtttaattattataaattaaaaaattagattatataatattttagaagaataacttttataaagttttcatacgaaatactgtttagtggtttgaaaaatatgttaacaaaaaccaacccagaatcaggcgtgagtaatcttgagcggtttgtaacatctatataaaaggttttctcataaatcatgtgttaacaagaaaaaagagcgcatattatattagcactctctctgttaataaaaaacttaacttaaccaaggacaaatgtgacttatcttagtagtatagtaaatataaataaaaggttaccgaaatttattcgagaatgctgggaatcggtaaccggcagggggtgggggtggagcaaaatacgcgcacgtgccttcccccgggccccccacatgtctctgctcacctgccacgtgtctccaccacatactccgttgcaacaaatcacccacatattttggaaatgctctattaagggaattcgtttatttttttattccaaaaaaaatgtttcacctagtgcattcacaatgtttgcccccccccgacgcgcacatgcctcccccgggccccaccacatgtccctgcccacctgccacgtgtctctaccaataaatcacctacatattttggaaaccctctattaagggaattcgtttcattttttgttccacaagaaatgtttcacctagtacactcacaatgtttcactatatataaatctaaagttgcagtgaattgaaacattctttgcaacaaatcagccacatattatagaaaccctctattaaggaattcgtttcatttttttccacaaaaaatatttcacctagtgcacttataatattttagtatgtatggattaaatctttcactatttactgaaacattgtatttatataaggtgaaacaacgccctatttaaatgactgaaacattttcgatctacttagtgaaacaattccgatataattggtggaacaacgtgcaacatttaaaaataattcaataataaactaattttttcatcgaaatatatccatatatggtcttgttttaaatatttaattgcaacgaatttaatggtgtaatcggatcatgatttagataaataatttaagataaaaaatagtttaaagatttaattgcaacaaatttaatagtgcaatcagatctgatttagataaataatttaagataaaaaatagttcaaagtagttttggatgcatgcatgctgatgatgtcaggctgatacgtgcgtctgattttttctatctccatcgaaaatccgacgcgtagacgtctcccatttattatattatattagaatgagtcacgtttaaggtaggttgaattttgttcagagaaaagtaccagaaactcatccgtgagtagggcctacagagccacagcctacaaggcccatttataaaattctccaaccgggggcccatccatccatccatcctcgacaccaccgtctccgcttccctttccattcgcgccgccacctcgccgtcgcacccagcggcggcgccgccgtgccggaggagcggcgatgtggtgccagtcgtgcaaggaggagtacgaggaggaggacgccgggacgtgcaaggagtgctacgaggaggcgagcgagacggaggaggagctcaagcgcgagatcgacgacctccgctcccgcctccacttcctccgcctcccttccccttccctcgacgcctcctccctctcccactccgacctcctcctccacgccatccccgccgatgcgcccgcccgccccgacacccccgccgtccccgcccaccgcgtcatcctcgtgagtcattcttgcttcacttttttccaatcgattagtcccaacacgtagctttctttgttcatgccattcttgacttctcatgtgctagtgctcaattaagtttgtggactactatttgccagattgatctaggattgatgttccggtagccaactagttcatgattgattatatataaattgggggtcctgctggctacttagcggcaggtcgctgattttttgctggcttaaatcttgtaacccagagctacccctgtaaggatgaacttcgtttcattctgatgcctctggtcttcttcttctctagattgatttggattctagaatttccctagccataaccattgtttgcactgcctttgtttcgatgtagcctgatctgtgacgtacaaatttctctttccacaaagaacaaagatatgtatgcattatatactaggacatgtttaattgagatatagagtgggtaatgtgttaatgtctggcttaatattgttactttgctgtaccactgcaagtctgcaacaacatgttaaactagtctagtaactaataaaggagaagaagctgcagaactgtataagtgtgcagattcttcttcgcatgtttttagtgttttgagttccttttctttttccaatgtgttggtgctacttgctttgaatgtgtttgagttgaactcaggcatgttttgcaatgaagttttactagcagtaaaagacattatctagcaagtaaaggcttaaagctgatatccaatactccaatgtgatgaaggaggttgaatttcactattttagtgtctcaataacattgcatgttgtaaacagtatgacactgactaaaactattttgagggcatgtagtttttgaaggcatgaagcataacagagcctggacttcaactgtgatcttacacttatcactgttgatcgacagagtttaagtggnnnnnnnnnnnnnnnnnnnnnnnnnnnnnnnnnnnnnnnnnnnnnnnnnnnnnnnnn

SEQ ID NO: 33749 - DNA, 12987 bp, Oryza sativa
  unsure (1)..(12987): unsure at all n locations
nnnnnnnnnnnnnnnnnnnnnnnnnnnnnnnnnnnnnnnnnnnnnnnnnnnnnnnnnnnnnnnnnnnnnctagccataaccattgtttgcactgcctttgtttcgatgtagcctgatctgtgacgtacaaatttctctttccacaaagaacaaagatatgtatgcattatatactaggacatgtttaattgagatatagagtgggtaatgtgttaatgtctggcttaatattgttactttgctgtaccactgcaagtctgcaacaacatgttaaactagtctagtaactaataaaggagaagaagctgcagaactgtataagtgtgcagattcttcttcgcatgtttttagtgttttgagttccttttctttttccaatgtgttggtgctacttgctttgaatgtgtttgagttgaactcaggcatgttttgcaatgaagttttactagcagtaaaagacattatctagcaagtaaaggcttaaagctgatatccaatactccaatgtgatgaaggaggttgaatttcactattttagtgtctcaataacattgcatgttgtaaacagtatgacactgactaaaactattttgagggcatgtagtttttgaaggcatgaagcataacagagcctggacttcaactgtgatcttacacttatcactgttgatggacagagtttaagtggcttctaaaaatgtaagctgtagggtaaacaggaaaatatgcttctcggtacatgtgtattccaatggttattgactggatgtgacaaaatttgtataagactgatttagttcctaagaaagttaacttattatggtacaataataagctacaaactgtagcatggtcataaatctcagatacagtcactttaggctgtgttcgggaggtgaggttgggaactcacctcccgtgcacacaaaacactttaggctgtgttcgggaggtgaggttgggaactcacctcctgcgcacacaaaacggagcgacgcattttcttatgattaaataagtatttgttattttttttttgaaaaatggattaatatgatttttttaagcaacttacgtataatttttttttgcaaaaaacgcaccatttagcagtttgaaaagcatgcacgcggaaaacgagggaggtgagttgggaaagttggggaaagaactcagctggagtagtacaatgagcaagcaatggcaagatatcatgttaacatggtaaaagagtcatacttgagtctttataagttattaagacttcatttatctagtttggaatgcattcgcccatcaataccttgacaatttttgttgctcttttttttttaaaaaaaaagtccgcattaattgtataggagcatgcatttgatcaagtgaagttgcatagaacctattttcttatgatataaatcaataaataacagatacgacaatatatatttttgagagtgtctatagtacttgcataccaatttatgtatctaatgcacaaatggaattaggtactcttctgcttttatgtttccttttcactttgtctttgctcttttgatattccaaaagtaatttccatgttgttagatctggaaagataactttggcaatgatgatccatatatcattcgcctgtagtgctgttatgataactttggcaatgatgatccgcatgtaatatttgtaaccttgtaaatatttcctttttttataaaattacactgctgggcaaagccctagcagttttcctggtaaaaaaaaaagatctttgatgggagttcgaactacaggacatcacctgcctcacaggcaaacatgaatctcccgcttcttgaataggcaccccacagtagctactgctggttggacaacaaggaatattaccatgactatacaaattttggattttgctctcagtgagtggctttagagtatattcatagaggctttggaaaatatgtatttttgaactcgacgcaattccattcagattccttgatctgtcaactgtactgattcagtatttaacttttggctcatatgtaatgcatcatatctgttgtattttggcaaagatacaaatagctttattccttgttcacagactttcaattatatcatcgttcttctaatttcttagctagctattagtatgttctgtagttgatttgcttgagatatttcgcatttgtgaattagttgcatcttactgatgcacacggactagtttctgctgtagaatttattttattatccattaaactgagtttcttctctttgaaaacaggccagcagatctcctgttttcagagctatgcttgagaacgagatggaagagagccggagtggcatcatcaaaatatacgatgtgtcctacgacgtccttcgtgctttcgtccattacatgtacacagcagaagctctccttgacgagcagatggcatctgatctcctggtgttggctgagaagtacgaagtgaagaacctgaaggcctactgtgagaaattcttaacatccaaagtgagcaacgacaatgccatcacgcattatgcgtttgcgcatcgccacagcgcgaagcagctgctcgagacatccctggcagcgatcatggacaacatgtcaacgctggcagatcgggaggaatacaaggagcttgttgagaaggacccaaggcttgttgtggagatatatgaagcctatctgaacagacaagtgaacactgctgctgggaaggagacagattccagtagtaggaaggggtaattcaaaagaaaactgctatcagagatgtaattaatgttctaaccaagcttttgcatgttcatgctaggcaaagactggcacatcaaattgtcatcctgcggtgtaggcgcagaacagctatttctgtatatgcttgaattgatactgtgtgctcgctactgatagaatgagatctattgccatctttatgtaacatataggtcaactgatatgtgatgatcatcaaacacactcagtatgaacaaaaaactaagtgtaaactatttgcaacgttgaacggttaaattgattaccagggctctgtagtgatttgtgcatcgttccgagagtgcagaacattgcatgaaccggactagcttctactaaccttgatcgatttctttagtgttcattgccatccctattgctacgttcatgcacgtttcatcggcgttgagattaaaaagataaaatatgttccaactagctgaagaacatatattattcggctggttgccaaatactatgagaaagtggtcttacatttggtgaatatttgaagtctcgacatttgaaatagggccttgagctctcaaaaagccagagataagttgcatgagagagtgctaaatgacagttaaaagtggtcccactcacctacatcaattatacttttttacttgtgatgtataactcaaatagagcaaaaaacaaaactcataattaaggactattgtaattctttgcattttcctccattaaccattagattgaagttgccattgtctagcagtaacttttctgaccttcgataaatacaaaaggctaacctttttcttttctaaaagaccaaaaggctacattttctgaagagaagtactccctccattccaaattgatctacatatagtttttttgaagttattcctaaatgatctacatatttgtgttcatttattaagtctattcgttatttgtacattggagtaaatagacattgatgcatgcatccatgcatacaagtatttataacccacatgtaatatcttaatttgttattggctaggaaatagtgagaatgatgcatgcatcgagtttgttgctagagtaaatatagtatgagagatttattagtttttcttggtcttagtataccatgaaatatgtagatcaatttggaatagaggaagtagcattcaagtttctagtgaaacaagctgacaagatccttcaatcctatcatattaaccagggattgcaggtttgcacaagattgaaacaaacaattccgttgtctgcaaaggctcctttgcgtgatgagagaaggtctcatccactgaaaacatcaattacaatttaatataatgatgttgtaatgatctgggaagctgcacttatctgaaaccagagtgtgacgtgatagcctgagtaaatcgctaaagtctaccaaaagcatcaaccattaagatagccagttcaaattaagtaccaaatctggtagctccttgatcagacattcactcctatcctaatagtcagcaaacagttcagatagctgatcatctgtccattcagttacagaagccatcttatttggctgtgaatgcaacgatgcactgagagtagttgcatcactgttacttacagagctattttcttgagttggcaggacaatgcccaaagttccagtaatgaagtccttttgctgatgctcattggggtttttgattgaagcgtgctcaacaagatgtgcgacatcattcaaaccaatgtttagaatattggctaacccataggtcttaatattcgtacttgacataacattatctggcaataccgcatcaacccttttgttttttgtattaaggtgcacccgttcaaccttaagaaggcgacttagcttttcaatcaaactagctgcaatagaatttcccgttctagacatgaccgagcatccacctagagtagactgggaacatcttgtgtttgggttttcaggatcattcaaagtttgctggtgatgctcttcaccattgtggtttgatatatgcctgctgctgaggcgctgcatcaatgtttgtagttcaatcccttggtgcttacctgaactggaactagttttttggaattgctgatcggcactgtagcttggtgtattcttgtttgaaggatttatatctttttccttcatccttgtatctaggtgatttcctacaccttgagtactgccattgtccattcttaacgtactatctcgaacagcatttcctgcataattattatcagaaagtacatcagcaatcctatcatccctggtacttaagatcgtgcggcagatacctgttgtttgtccgtatgtttcaactccagttttcctgatgcggttatctccttggcatgaagaatcccgtgtttcttgacactttactgttatggaatacatgtaacatattattgttcttaagagattaatatagagaaagggatatgaactggaagttaccaggatgttgactttcagaaggacttgatgaaaacacttgcttagatgggaagcagaagtcctttggcacaagctgcaaatataaaaacattcataccgccatgtccttaaatgattatgatgttaatttaaggaacattgtaatggcagttcaaaagtaccattgtgaaagttttgtgaaatggttacatgcttctaaagaactgagacttgaaatacaagtgaatccaagtaactctgctgataatgcaaaggcttattcttgattaacacaaggtctgaagcatgaaaggcctaaatatgatggttaatctgaaggacaaacatcctcccagccagaagttttgatttatataattacatgtgcaagaatgtttggaagatctaaaatggtaaaataaagtatgattttttcatcgatgaacaatgtggctatcttgaactaatggtgtattttaacttcatgaaagttttagaagcaataaaacaaacaacaggatcatggaattgtaggatacctctctaccattttcactcaaaaaactgagaaggaaaaacagaagacaatgatgattctttacacaagtaagattcacagagtgccttcttttcatcctttactgatgctctagtatcattgtattatagctgtctacttccgtaacattatgtatcagtgcatcttatattattttcactctactgtgcagtgcacgtatagtaataatggcaattattatactagatagtaatataaagaaatgcaaatagtaccatctctagattttctttggtgacattaaaatagcaacccttgtgagatggacggaaaacagctacctgaaattaacaatgaaccaattactccatatactaagttagtttgccaacaaaagaaatcctttttcaccacaacaccttacatttttcagaacaatgcaagaccctacagatacaaccatgttatcctcctttgtaaatactttctggtgaactgaagcaccaaccgtaccacttggatcctatcaagaataactcaccattatttcccaatcagttagcattcaataaatattccgtactcagattgtaaagtaatatttatggctttcggtttaattacttatctgaatgtctcttaatgtagcccactctacatgtaagatgcaaacatgaagagatgcagataatgcaataagaggtgataagtaatcagaagaaaaccaaccagtacatcaatcaaagaccaaagtccctttttccaattttaacacgagctaattcccgcatgacgcgaacatgataactcggccaagtagggatgcaaagtgggtagtcccgctacccgcataaaaacccgcttgctaattcatttttcatatggcagtataaaatttagaagaaaaaatgaactagaagtgggataagcgggttaaaaaccccgcttgcccgctccgcttgcatccctacggccaaggaatccaactcattccacagtacacacataatcatgccatgatgctttgtgttcgctcaccttgagagaaaggaagagatcaccgagcctgttcggcgcgcacgacgtcaccacgccgaccacctgatcacaaccaaacgccccaagactaatcaagccatcagcaaagacacgcacaaaactagcgaaacaggtagagccaggagatgtccacactccgcacgcaccagacgtgctcgatacaatgcccggtcgccacggatggccgcgatctcctgccgcttccacgcgcgcgcctcgcctgcatacccacgccacgatgagcaaccgaaaacgcaaaaccaaacacggaatgtctgatccggtcaccgcctccactccaccctcaccgagggaacccagcgcgtggagccacggggcgagcgagaagtcggggtcggtggcatggccgcgggcggcggggccggacgaagccaggtggggcggggagcggaggccgcgcgccgcgccctgggagagcgaggcggccggcgcggggtcatcggggcgaggggggcggaggcgggagggagaggaggccgggccgcggcggaggaagccggagtcgtcgaagtccagcgcgtctgcccaggcggagtcctcctcctcctcctccccggcggcggcggccgcggcggcgctcgccggttgggacatggaggtttgggcctatggggaattgggggttttggggcggcagcgccggatttcggtttgaatttgttttttcttaaggagtatgggcttattgtttgataccaacttatcgtcctactaaaattttgataacttcaatagtagcaaatgccaagttgttgtatttctaacaagttgttgcatttatgcgatcacttataaaattcttgtactaaattgcacgtacatgccaaggtgttatactaaacgctcatttctcaagttcttacaccaaattgtacccacctgccaaattgatacactataggtgcaatttactctaaattttacatacaatagttcaaattcaatactaccgaaggttttggcactaccaaaattttggtatggcaaaaattggttctaaaccaaacaagccctattccatattagtattatcagaaaaacggacagacggaatccaatggggcggggggcatgagagcacgggatataaaagatgtgagcgttatcttcatattcgtttctcccatcaactcatttttctcctccaccaagcaacaacgctttgccttcctcctccctccatccactcttccatcccagtgatcatcctcctctctccctcctcgactcaagactattgtctccaacgctgacgacatccctatcctcttttcttccttcctataccggatccggagcatgtgacggagtggaggttggagagggcatgagagggagctaattatggctgtgaggtttggggattgtcgtgtctcatgtgtgagaaggaaaggtcctgggaaccgacaagaagatggatgcagccggtctcgatgtatagtgaccgtggagttgatgaaatggatgagcggtcattggttttcttcattactcatcactgttgtatacaggtacgttgcaattgatacccttggtatcaggggattattagtaccaaggtctggtaccccagatatcatgcctgatacctaggtactagggtttggtacctcgagtatcatgcctgatacccaggtacaagcctaccagggtctagtatctcgggatatcgtgcctgatacctcaggtgctaaccgatacccatagcaattaggtctgatacctgtggtatcgagtagagttaaggcgtggagaaggagagcgcgttgtcgtcgtttggctggccagtaagtcaactgttgttgtctcatcttctcttctcccttcctctcatcgacgccttcctccttcctgtattgttgctatggttggtgggggcaaggcgctaggggttgccgttgcttcaacgttggagcttgaccatggttcctctttgctatgtatagcagcttgaaggttttatttactatgtatagcagctgaatggttcctctttgctatgcacgtccaggctccttagtccatatatttggagggcagaaaccatcatcttcgtgcactccatcattcctacgaacactcaaaagcataggctcatctaaagtaatttgattatttaacacaaggttagcattcacctgagagtgaatttccttccccaattgtttggctctgctccttgtaattggacccactatattagatgcacttttattaggaggtggggaagagtggctactagggatgtcctcatcagcctccccctcttgagaaggagtcgtcctcgactcagactcaccaacaaatggacacaaatctttgacattgaatgttgcactcacattggtatattcttgagggagctcaattttgtaagcattatcatttatcttctctagaaccttgaatggatcgtcaccccgaggggataacttactcttgcgctattggggaaatcgatccttgcgtagatgcaaccacactaagtcgccggcttggaaaataacagttttcttacccttgttcgcttgccttgcatattgtgcagttttcttctcaatattcctccttgtgtcggcatgtagcttcttaatgaattcatatctcttggcagcatccaaattcacctgttcctgtaatagtgaaggcaaaaggtccatgggcgtatgtggtttaaaaccataaacaatttcaaagggacaaaatttggttgtggaatgtactgccctgttataagcaaattcaacatgtggaaggcaatcttcccacatctttcagttctttttcagcacagcccttagcattgtggatagagtatggttgacaacctcagtttgcccatcagtttgtgggtgacaagtggtggaaaataacaacttagtgccaagtttaccccctaatgtcttccaaaaataactaagaaatttggtatcatgatctgaaacgatagtctttggcactccatgtagacgaactatctccctgaaaaacaagtcagcaacatgtgatgcatcatcgctcttatgacatggaataaaatgtgccatctttgagaagcgatcgacaacaacaaaaatggaatccctccccctctgagaccgaggttacctcagaataaaatccatagatatatcttcccaaggtacatttggaatagataatggagtatatagaccatggggattaagacgggacttttcaaacaggttatgcaccgctcaacgtgtcgctggacatcacgtcgcatatgtggccaaaagaaatgatcagaaagcatgtccaaagtcttttttacaccaaaatgaccagccaaccccccagcatgtgattcctgcaaaagaacatttcgtatcgagcaagctggaatgcacagtttgttagtccaaaataagaatccatcatgcacatagaatttgtcccatccttttccagcaatacaattagagaaaggttcgttaaaatcagggtcattagcataaagttttttaattgattccaaaccaagcacttttgtatctaattgtgtaaccaaagcacattgtctagacgaagcatctgcaacaatgttatctgtgccacacttatgtttgacaacataggaaaatgtttcaatgaactcaatccatttcgcatgtcgacggctcagtttgccttggctttgcagatatttcacaaattcatgatcagaatggattacaaattctttaggtaataaataatgttgccagacttccaaaactcgaactaaggcataaaaatttgtgattagaatggattacaaattatttaggtaacaaataatgttgccagacttccaaaactcgaactaaggcataaagctctttgtcatagacagagtagtttagatgtggaccatttaacttttcagaaaagtaggcaacatgtttaccttcttgaagtagcacacctccaatgccaataccacttgcatcgcattcgatctcaaaggtcttaccaaagtttggtagttgtagcagcagtgcttcacaaagcttttgttttatctcttcaaaggcatggtcctgttcagctccccacttgaatggaacatcctcctttgtcaaattgttaaggggtgtagcgatggtgctgaaatctttaacaaatcgtcagtagaaacctgcaagtccatggaaacttcgaacttgcctcacattttcaggtgtaggccaatcctttatcgctttaatcttttcttcatcaaccttgatgccagctgcagtcaccacaaaaccaagaaaaacaacacggtctgtgcaaaaggtgcacttagcaataattccatacaatttctctgctctcaaaacagcaaggacttcacagatatgatcaagatgttcatcaattgatttactatagatcaggatatcatcaaaatatacaaccacaaattttccaatgaaagctcgtaaaacatgattcattaaacgcataaaagtggaaggagcattcgtcaaaccaaagggcatcacaagccattcatataaatcaaatttagtcttaaatgctgtctttcattcatcaccaattttcatgcgaatttggtgataaccgctatgtaaatcaatcttggtgaaaatggttgaacctatagatggccatgtgggccgcccggcacggcccgaccgacgcaccgggccgtgcagtgccagcccacgtgccgcactcacagcccaggccggcccgaaggcacgatgggccatcgtgcttttcctcagaataagtctaaattttctccctcctattgggctgtgacattgtatagctaaaaaaagtctattttacctccctcttctttgtgctgtggtatataaatagctaaaataagtctatttaaggtccctattctttagacattgacatttatatgtctatttttattccctatactttgtgtaccgggtctggcctgccagcccatcgtgccgggccggcccgaccgtgccgggccagcccagcgtgctggtggggaggcccaggcacggcccgacagtcgggccgggccggcatgggcccaacccaagtcgggccgtgccgtgcttggccgggccaaaaaggcgtgccgtgggccgggccttcgggcctcgggccttatggccaactatagttgaaccactcaattcatctaacatgtcatcaagcctaggaattgaatggcgatatctaacagttatagcattgatagcgcgataatcaacgcacatgcgccaagacccatctttcttagggaccaaaagtacaggaacatcacaagttgagagagattcacgaacatacccttagtccaaaagctcttttatctgtcgctgaatttcttttgtttcttcaggattggtgcggtaggttggacgattgggaagagaagcaccacgtaccaaataaatttggtgttcaattccgcgtatgggaggaagtctagctggaacctcattgggaaaaacatcctcaaaatcctgtaataaatcaagaacaacactaggcagcgacaatggtaaattgttagctgaaaataggacctccttgtgcaagagcacaaagaacgaggctatggtgttcctcacttctctcaaatcactctttctcacaaataaaaaatgttgtcgtggcagttttgtattttcaggaggctttatgtggctggatggtttaggagtctctcccttactatttgtgtggctctctcataattttcttttctcactctcatctcttttcatgcgagcaacatcagaagagcttatgtcttcaggagataatggaacaagaaccaccttattctctttgtgaataaatgtgtgtttgttcgactggccgaagtgcacagaatccacatcaaattgccatgggctacccaaaagtaagtggcaagcttgcataggaacaatatcacaatcaaccttatcatgatagtcaccaattgagaatgacaagcggaccatagatgaaaccttcacagtccctgaattattcaaccattgcatatggtacgggtgtggatggcgacgtgtttgcaggccaagcttctcaacaagcaaggcactaacaatataatattgttgcagctctcaccatcaattataaattnnnnnnnnnnnnnnnnnnnnnnnnnnnnnnnnnnnnnnnnnnnnnnnnnnnnnnnnn

SEQ ID NO: 33750 - DNA, 1126 bp, Oryza sativa
  unsure (1)..(1126): unsure at all n locations
aaaccttcacagtccctgaattattcaaccattgcatatggtacgggtgtggatggcgacgtgtttgcaggccaagcttctcatcaagcaaggcactaacaatataatattgttgcagctctcaccatcaattataaatttgcacacctgccgtttcactttgcatcgtgattgaaacaaattatggcgttgcccttgctcagctgcaactaattgagtagaaagaactgtcgaaccaccaatgactggtctggtgcattcaaactataagcacgcacggtggaagttgtagcagacccaaatgaactatcatgtcggggcgaaataggagcctccaaataattaatatcaacaagcaaatcatcaaaatcggcactagtgatttcctctggatttggaggaattatacgaaaaaaagatcaaatctataaataaatcatatggagaaccaaaggcacaatgctgctgccgaccagtatatactttgcaattacgtaaaagaatatatatatatactttgcaattgccgtcttttggtgctttatcttcgtaaagcttttgttccggcggtttcctaggagcgtttgttccattttttctgctacactctagtggagttatatagaattctttgtttcggcattgtgagaaaaaaaaaagtgagaggttaacggatggcactgggacaacctagcaaaatcggaagagaaacactcccataaatggcatctcatagaatttgcatttatcaacaaaacaacttaggatattcacaatataaaaataggatcggtattaagccttgtatgatctacttatatatattacggaagtggcttttataaatgtccttagtatgagctatccatatgcatatgaactatctgtatagaataaattaagtaatacatcgatctctactcccatctctctctccttctaatgctacaatggcatgatatacaatgaataatgcaatagttaaagctaatatgtgtggaccccatctatatggattatatattttgttgatgctctacatagattccatcaccaacgataaaacacatannnnnnnnnnnnnnnnnnnnnnnnnnnnnnnnnnnnnnnnnnnnnnnnnnnnnnn

SEQ ID NO: 33751 - DNA, 8544 bp, Oryza sativa
  unsure (1)..(8544): unsure at all n locations
gcnnnnnnnnnnnnnnnnnnnnnnnnnnnnnnnnnnnnnnnnnnnnnnnnnnnnnnnaagaggacctttgctccaccaaacaccataatttgtcccatccctaatattctgcataagttcattggtattaggtaaggtctcctcttgatcataaagcgggcaactgatcaacactccagcatctatctagtgaggccaaccaaacagagaaatgacaacaacgcacgtagaatttttctttcacactgaagaaacaaatatttttgttttatggaaataagaaagatggaagatcttttttttttcatttcactgtgtattctccattatccagactccagagaaacaattttttactctatttttgtttcgtggaaatggggaagatccattaggcaggaaaacatggaaaaactcgaatgcctagttgcatgcagccaagcaaaccccctacaaagaagcaaaggcagaatgcctcaaaattgcatagagccgttgtagacttgtgatataatctatagattcatatggtagcacttgggacatttaaaccagcagaacgtaaagagtggttttgtatgcatggtagacacgcgtctaaccagcggacgcccaaggtgttctactgcagtgcatgcagtagaaagtgcatagactctgctttagcccttgtttagttcctaactttttctttaaactttcaacttttccatcacatcaaaacttcactacacaaataaactttcaacttttttcttcaaactttcaattttagtcaaacttctaattttagcgtggaactaaacacatccttattccgtgctctccttcggttatcaacaagacgtctttcaggcggttgctgggctgggagctatctctgctgtgcagtgctctccatctcttctttgttcagcacggttgctggacgcccagtcgcccagcgtaccgtgcgaatgcctctggagttgggatcaccctctagatccgccaatgctatccagagctaagcagcgtccataggcgagccgagacatggatacaaatggaagcagtggggaggagaactcgatagccctcatctttaattttcacccgtgggtgttgtgttagccataataatgggttattgtacttgtgtgcattatcccattgttgcacaaataccagttacatccatcagtttttctttttccggccaagatgagacaccagcacacaacataacactatccacgccattcatgtctagttttgcaactctcaagttgaacagcccccacaacgttaagaatcagctccacaaggcctcaactgcatctatttcccttaaaaattacattataaattagctatcataaatctactatgtgaaattagctatcataaatctactatgtgtgtgcttccatacttctagtagtagagagcatggctcacctcaatccccatgttcaaccttcaatttaagggggaaaaacatctatattccagcacatgacaatgcaatacgctcttcatgggtgccatttgatgctgcacccgacactataggaacaagaagcaaatgcaagtaaatgataaagtgaagtgacatacatggtgattaaagcaacacagattctctaggaactaaaggaaacctgggttttggcacaaaaggtagctcttgtccactaagtgcacaatcaatcgcacgacttaaatccctacaaataagataccaaataagcacaggggagggtgaactggaaattttgttcaagatgttagaaaacataccttccggtaactggcacgttgttactcggtcttgaatcgtcaaactgcccatggtagaaaagctcaaatggccttcgtccatcctggcaccgggaaaccaaaatgattagatagaataatagtagattacgctcgtagtgtgcaaatttgtgaggttagtgtaattcagtacaacttgcaagatgagaaccgacataacttgggcagcatatggaccagcacaatagtccacattagctaattagagtgtttcagtcctgaataggaaacccaagtcacaaggctgcagggggtaggctaggctgctagatttcttttccagaaaaatgcttcctgattttattttcccattgaagtccctgagttgctgcatgatgtatttcaatggtgatctgctcactgtcaggagctacaaatgcagtaaacaatttgtatcataaaaacagaacaacaatcaaatgatacctcgttgtacccttgctcagttggtgtcccagtcagtgctgagacactctaattagctaacatggattgtctagccgtggttagcatgcaacttgcaagttattgcagcagttcaagtattttgcatggcgttgcattaaatttctttcaggaacaacgtgttagcatcctagacattggacatagcagcatcatgaattcatgattctaggcataagcatagatgatgttacctttttgaacaagtaaaactctggcgtgcagacggctcgaaaagctttagcaacttcttgagactgcaggttgcagtaggacaaatgagttaaatagagaaagcatggccgctgtgtctggacaaatagccatacaattgaagggaataatgtggtcaaacctcatcatatagatacgggaaagagtatttatacaattttgcttcctcagctatgtaatcaggaccatcctacaaaatcagatgaacttgtgttaaaatggaaaaatctgacaagtatcacatagatcacatggaacagaagaacataaaacaactagtttccatatccatggatcactgataggaaggaattgttgcctaatcctatactacagtaactcaagaagtatttttctcatacaccaagagaaactcatgacatcttatcggatagcctataagcttgtcagcttacatataatataaccagcagctaaatggctatctaattatctatagccattgtattttataccctgcaggacaaatcctaaaattcgatgcttctccagcatacatatctgtgttaaggtacaacttaaaacgaaaattccaccaaacaggcagagatgggaaatgttttctttgccagacttggttgggcgtgtggctaaaagcaatagttactcagacgacggttgatttcctaaaaaaattagatagggtaacaatttgaattaaatctgctatttaaaagttttaaacaatttttagtagcttctatattactatagagtatgtggtttaaatttcatgatcatctgtatctttataatttttttgtattttatttcgtttcaatataatttcaggacttccacaactgctactacattcaaataaaatattttataacaaaatccattaagctctcaacaagagaacttctggttacttaagattcataagcatgcagaagaccaaaataaaaggtatacagttcattggttgtaactcaacctgtgggtgtgtcacaattgagttcgaggatatggcaacagcagcaagccctttctgcattgtatcgagatgtcaatacaaacacacaagttaaagggaaaagctcactacccattctagagtccatacctccatgtagaatgaggtgagcttcgcaatatcttttttgagatgctttacgaatggacagtgattacatacaaacataacctgaaaggaggaaaataatcatataagatgtagataatctatgcagtggctgatcgattgctcaattgcctacatcccctcctttctcttcttaaatacagactacgagtttcccaacaaaacaaaatcaatatgtcaagagctgatagctacttcttgaagagataaagatacatgctgacataaatatcattcagcacttattaagacttgcaatttggcaaagaaattcagagggaactcaaggactaatttgacaaaatggagataataaactggtaatgttcttccatcaaagtcataagccacatcttgaatttttgatctgtttcattcataaagaggctgtaatacctacaagacctaacagtttttccacataaatgactagatagacggctcataactaatccaagcacaaagccactactattgaccaggtgtgggacaatccaaacagttgtaagtgtaagcgtatagctaatgggaaaatgagaaagcatattagcatttcaatatttcattgagtttcatggggaaatgggagtggcaaaatcgacgaaatgtagttaagcatatagcatggataaactcatttctattcagttctccagtttagagtgaaattaactgaacctggtttttttctttcctaaaaaataaataaatgcagaattgaattcaagcacgaagcaacctagaaccaatcactgaccagcagcgcggggttgccttcgaagtcatccaatgtccagagcttccccgtcagtggctccgggagctgcacgccaagaaaaaacctcgaaatcaatcaacgcccacgcccaaatcccgtccgatgaaaccttccccgagacaaacttaaaactccggcggagggaagcacctcgaactggggcgcgcggaacccgacggagacgcccgtggactccgtccttgccgcgcgcacctggaggagcggacgacgacgacgccgccttgccgcggcggcggcggcggcgagagatccatgcgggcggcggtggcgggcggcggcgacggcgagcaggggccgcgacgaggacgccgcggcggcggaggaggaggagcggacgaacggttgcgctccggcggcggcggtggcgagtgacatggcgcgggtggggctgtgtggctgagagatgcaccgtgttggctctcgttttcttttcttttcttttcttttctttttaaatatggaaaaagggatttggtttttggtttttggcggagtaaattctagaaaaatctcagttgcactgtcacgttgagaagattgctgaggtggaatatttagtaattaggagtgaggaatacctaaataaacaagatttaattggatcatgccatttttgctagttttgaaaaatatcgttgttattccttaattcgtaaccataccaatataatactctcaaatttagatccatgccatgctctacaattaacatacattttgaatcgttttaggtgtactatattttttatagactaaaatacctatgccgattctcttttaccttatgccggagtgctgagcacaacggcacgatgggccgcaacgtcggggatggttagtccagcagtgacgtgcgacccgatagcggtggagaaatcggcggtagcgatgatggggtggtatgctacgggcgcagtacaaggacagatggtccagcggcagctgcgacgctgcccatggcggtgccatctgttgcgagctcaacacgaggagatctagtggtgacggcggcaaggtctaggtgttctgtagatctagcagcggcgatgttgggtctggcgtccgctaggtctagcgggcagcaatgagctgagctgcgtcatgcggtccaacaacggcgacgttgggtctggcgtatctagaggtgggcaatgagctgagttacgacgtgcggttttggtggcgatgacaagcttagctgcgacgttgcccgtgctgatgacgaaggagacgagctggccagctcgggcggtcgtcgtggatggcaacggcaaccaccccaccaccatttctttatttttattcttcatattttacttttctaaaattgttatacttttttttcatgtgtatgtataaattttttttaccgaaatttaaccggtgcttgagttctaggaggggtacttaggtcaatacggaaatatagtacacataaaacgattaagaatgtatatcaagtgcacaacatggcatggatctaatttcaaaagtgttgcagtggcatggttgtaaataaagaagtagtaatgttatttttcaacactagcaaactgtataatttaattaacccaaaactatgaaacgttagacttgggccctgatcgagagtgagggacgaggaataatccctccggcacgaaaaacagagcaggccattagcgcgtgattaattaagtattagctaatcttttttttaaaaaaatggatcaatatgaatttttaagcaacttttatatataattttttttaaaaaatacaccgtttaacagtttgggaagcatgcgcgtgaaaaacgaggtgacaggagcggtcgcccgcgggaacgagcgcacccttaaaaaggccagcgatagctgttatgtaaaaggagataatttattattagcatattagctgctacaaacatggaaaataagtttatttgatttattatgaaacttttatatacaaatttataaagaaaacatattaatttgtagttcgggaagcatggaagatgatcaagttgccaagtggcccttaggtttgttacaattaaaatgagtttttttttttgcactggttaggttttccttgtcgttgtatgtatggcaatttgttatctatcgtacaaatgctacaccaatactccctttgttttatattataagtcgctttgttttatattataagtcgcttgatattttttcctaatcaaatttatttaagtttgattaagcttataaagatatataatagtatttttaatataaaacaaatatattatcaaaatatattcaatgttagatttaacgaaactaatttgatattttagatgttactaattttttttttaaattttgttaaacttaaccaagtttgattagttaagccacgtcattaagaaattgttagccattggattaaatcctaattatataattgtagccgtttgatcatccaattcacagcaaatcagcaatgttggaacgtacgcaagcaccaagcagtacctgggcccagcttcttcgttgagccatattgcgcagcccatcagagagagacaaggcctcaaccttatccatgaacgcggccgatagctcgctgctcgctgcccctcccacgcctccctcgcgcggacagtataggtgagcatttttttccatagctcaattttgatcgctggataggccaatggagggggaaacaaaacccaagtttttggttttttcagcatctgtctaggactcttcctatgctacagttgacaacaactccgtttttcagatggtgtgttgaatgggaattgttcgcttctgctaaacatccaattattttttacccccatttttgccattaaacttctttgtgtggctgatgccatggacgcttgttctcccttatcccagaataaaaccttctttggaatgaatggaggaattttcagtgtttgttctgtgagaatcgaactaatgtcgatgaaaatcctatgaaattttacactattttctcatgaattaattcaatctttgtaaaaaaaatcctcccgaaattcatcaaatccaaaggctgcatgtgttgctgaattattaataaaaacctgatggagatgattggctttcttcccgatattgagaccctgaccctagaaattatgttgcaagggcatgcctttggatcatgtgtattttatctgctcaagatgtgtgtacaagaataagtaggctggagttggcaataagtggtgacccggaggtaaatttgtttttcctaatatgaggtttccccaaggatgacgaaaccattctgcattttttgttcataagtttaatggtcaaattatactctagcaatttatctctaactcacatttctacttctcttaatctttcatttcggcctgaccgccatttcaacctagtctttacatattatcctcatttcaggctaagattattgattgcccatttgattgcatctgtggagaactgaagatatccagctgaattttcttgtggacataacaatcaaaagcatgagaggaatcgaacaaagattgaatttgtgtttttgagaagcctacttaggtcagccacatcactccgacggatcacattggctttccatggtatgattatgagtcctgacaatggggagccattccagaacttcctggttgaactatccagcctgatgaaattcaaggaaatttaccgcgctgagagatccgcattcagaccaaactgggagtaagcgtgatcattcagaaacagcgtgctacagatcaacaccaaaattcctaaattgcatgtccttgccaaaattgtaatagacaatgtgtaatgcttgtattatatttttctgccttctaatatattcgacaatactcttgccgctttcatataaaaaaaccaccaaaattccgaataactgaaggcatggtctatcgtgttgcatgcataccagaattattcctgaaccgctgagagcatgccgtactgtgttgcagatcgatagcagtattgcgagcgcaaaataaaggccgtaaaacttgtttaattcgtgttttacttagagagatatttttttagataataaaatagaatatcctgac

SEQ ID NO: 33752 - DNA, 15452 bp, Oryza sativa
  unsure (1)..(15452): unsure at all n locations
aaccccttactcatttattaatttaaacaaccatttagtcaaaaggtatttattttgtatttctaaattatggacacccaaactaccctgatctttgggttggcaaataatatcccatcttgtaagtctgtactttttcttatgatcatccccttgccaaaagaatgttgatctataataatcaattttttgaagaaccccttttggaatctaaaaaaagatatcataaacatagctaaactagaaagaacagaattaatcaaaaccagtctacccctaacagacatatgttttcccttccaactactaagtttcttctcaattctttgttcaataactttccaatctttgttactaagctttctaaaatgcattagaataccaagatatctaactggaaaagtacctaacttacaaccaaagatagtagaatattattcataaaagtcctttgcctggccaaaacaaaataattcacttttattaaaatttattttcaagccagacaacttttcaaacacagataaaatcaatttcagattcttggcttgttataaatgtggaattaccccattaatggtaccaacatccacacttttgtagcagtgaccaagacctaagtcagtgcgttgccctgaaaattacatgcatatatgaaacagatggtgatttatcaaaaatcatatcattcctactcaaccatagagcgcaacatataacagaagctcctatgagaataagtttcctatttttcttgtccacccccagaagccaatcatcaaaaatatgagatatgcaattaggagggtaaagaccaaaagagaactatacagctctccaaataaactttgcaaaatggcattccataaaaagatgttgaatagtttcattcttcatacagaaacaacatttcaaacttccattccagttcctccttgccaaattatctttagttaatactacccctttaagcaagtaccacacaaagatcttaatcttcagaggcatcttagacttccaaataatcttatttctctcaatataaccattgtttattaaagccagatacattgaccggacagaaaattggccattctgatgatagttccatctaaaacaatcactctgttgattcaactcaatatgtacaatagaagcccacaattcataccactttgctagattctgaccaactaaagccctcataaaagaaacatttagcggaacaggtctcgtaacattagcaactgaagaacttttccttcgaacaatagcatagagagatggatacctacctttaaacactaagttatctagccatttatcttcccagaatctaacttgttccctattattcagaatccaggaacccatgtttaagaaagtattcttaactttcataagacctaacaaaaaataagaatcaccttgtttcctatcaacttgggtaatagactgattataaagatactttgtttttaataagtcttgccaaaccccttactcatttattaatttaaacaaccatttagtcaaaaggtatttattttgtatttctaaattatggacacccaaaccaccctgatctttgggttggcaaataatatcccatcttgtaagtctgtactttttcttatgatcatccccttgccaaaagaatgttgatatataataatcaattttttgaagaaccccttttagaatctaaaaaaagatatcataaacatagctaaactagaaagaacagaattaatcaaaaccagtctacccccaatagacatatgttttcccttccaactactaagtttcttctcaattctttgttcaataactttccaatctttgttactaagctttctaaaatgcattggaataccaagatatctaactggaaaagtacctaacttacaaccaaagatagtagaatattgttcataaaagtcctttgcctggccaaaacaaaataattcacttttattaaaatttattttcaagctagacaacttttcaaacacagataaaatcaatttcagattcttggcttgttgtaaatcgtgctccgaaaagatgatggtatcatcagcatattgcaaaatagataaaccatcatccaccaaatgtggaattaccccattaatggtaccaacatctttagccctcttaattagtagagctagcatatcagccactatgttaaagagaataggagacaaaggatccccttgcttgaggcctttgtaagtttgaaaattattcccaatttgatcatttactttaatatcaacatgaccaccctgaacaaaagaaactatccattgacaccatttaggagaaaagcccttcattctcaacgtttgttgaacaaaagaccatttaaccttatcataggctttctcaaaatcaatcttaaatattaccccacttttatttttacgatgcatttcatgaatagtttcatcgagaataacaaccccttccataatatttctctcaggaataaaagcagtttgagtaggactaattactttttgagcaacgccaattattctatttgtagcaaccttggtaaaaaattttaaaactaacgttaagtaagcatataggcctatactgttcaattttcatggcctccacacgactctagagagatataccttccccttttgtttgatttggaacatcgcacaagtggttaattattcctcgacgctacattatactccctccgttatttttttttcgccggagaggccagaggaggccatccgaatatattaaaaagaataaagttacaagaaaaagcgatagaaaactatcgaggttgaaagtgcacgaccaaaaaccacatgctaaccacacaagcacaacccactgagagaggaacctagcactaaaacgacccccgctatgcatggccgatcgccactgggcatacgacaacaccacaagatgagactctgaagacgatgctgccacggaggtcacaacatcaaggacaccgccatcatccatctatgggagatatggttttcacccagagcaactcgccaagggagagaggtatcctcgacaaggccccaaggggggttacgatgccagaaggtgtagccgctgccagcccgatgaaccatcacgcaaggctttcgcctagaaccctgcaaccctgcatgaaattcgtcacccatgaactcagaaaccaccacacaggcagtggcaacatgaggcctccaccccatgtcaccggtgccccatcaccggctgacttccacacttgttgttccctgctgccaccctagaagctggcccatgcctccttcatcccaccacctgctggcctcctcgtcatttttgccaaaaggagaacccggacttgacagcgtcgcgtgggtggccaaagcttccctcgttaaccaactgccgcctcgatccaacctagaaactcccccacgaagaagggagaggagctccaagaagggcaagggtgcccatcagcaacaaggaagatgacccaccaccgccagctccctttgcactaccatcattacctgctccaggcacatttgcgccggtgtcaccaccacccttctcggcttcctggtcgccgcgccgacgcctgcgccaccttccgagcacacggccgtcgcgccaacgccggcaccactaccgccgtacccagccgttatttaatatacgacgctgttgaattttttaagatatgtttgaccattagtcttcttaaaaatatttaattaattattatttattttattgtgacttgatttatcatcaatgtttttaagcatgacttaaatatttttatatttacacaatatttttaaataaaatgaatggtcaaatatttgtcaaaaattcaaagacgtcgtatattaaaagacggaggtagtacttgtttatcgacatgatgagtcgagctatgttatttctgccttcgtttgataaccttatcaaaggtgagaaaatgcagagcatggatttagcttctcatgttcagttagtttcttgcattcttttcatcaaattttgtgagcgcttacttttaaaccttggccaaatattttttttaccgaaaatagcgggagaggcttataccgtactatatatattatataattatataaggaggatatttactatgcggatgtttacacagagattatgggtaaccaaactttggtttgccgattttcagtatgctagttaatttggtcgaaaattgagcaccccctgtatattatgctgcaccaaagaaagaatgcttactctgcacagtctatatattcctctttgcagcatatctacctactttcgaaaaaaaaaaacctaggtcagtcaacgagaagttttacagcgaatatatataggtggaacaaaactatttccaatttgattaacattgaaccttgtatgacagattaaacatatgttaatgcgtcgtcaaaagtgctgttttgataaaaaaaatcctgaattattcaatgattttctaaaccaatccagagcaagttaggttccaaaggtgagatcatgcacccaaactactcatgtgacaaagcaagaatatgataaaacaaaggataggataggaatacatgtgtaaaatagaggattgaaaacacagaaacttcatagaaattggaattcggataggtggtaggaaaatcacatgattttttttattattgcataataaccatcaaacacccaacaatcaaaatttacaatgatcgaagaactaggcttatttcgttgcttccaccgttcatgaggtgatttgcctgtgtgagccagccaaaaaatgagctttgagtggataatagctttcctgtgtttttcttctaaaatcacatggaaaggaatttcatattttgttttttagaaaattccttgtataccctaaaattttagctaatcctttctattcctttgaattttgcttgcttctttatatacccaaaatttgatttttagcccttccatacccctcccatcagttgagcgttagttgaccgtctaatttctataaatatgaccattttaccctttgaatgaacatagaaatttataaattacaccattgaaaatgtaaaagtttgtcgcatgacactattattgttatgagtttgctctttgatacattatttatgacaaaatttatttttagataatgaaataaaaatatgtatttattttattttttttaaaaagtcataaaaatgaggagcaatcatgcaaagataggacaacccacgatattttttttataaatgctcccgataaaaaaaatattttcctattaaatttcaaataaaaattttaatttattacatttgtttcattttagaaatttatgtcaaaattttctgaactatttagtctcattagttatataaaatgtacatgctgtgcactcaaacaaaattttcaatcgtttttgaagcttatattcaaacataaatcaccaaggacattaaagacatttgccaccaaacttaacagtgaccgcttggccatgccgccaaaaaatacgatctaaaatcgagaaaagagcaagtattcatccacttttcttactaaaactaactttcttttatcttaaatctaattctacttacttttttctaatctttttcaaaaaatctattcatgctttttttttgatccagttatgattatagactctaccaagagtctgacgaattttttgcttcatccaaatgtgtaaaagatcgtagtcgcacttaaaagccgagtactctaccattaatgaaggaaaatgtaacggcaggggtgtataagggatcaaattgaaatttcagggggtatagaagtgatcggataatttcagagatataaaattgattgagtgattttttaagagtatacaaggaatttactctatttttttcccatttggtcattcctacgaaccaaaggtatctactgtgaccattcctgtaggattcaaattcctaagtttttcctccattccgaagtggtcctcgaaagctaggaatttggcaagtatcttgaaccatctttccaaagacaacaaaccaaattttggctagccaatgcttagtttggttccataaatcaagcacctgtaacactacaaagtcttaataaacgcatatgactaaataaacgcataattcttcagttcttccagcacttatttgtctggtgctgcatatccacttcgaagaaaattaggtcaatcagcaccaaattacagcgcgtatagatggagcaaaaccatgtcttatattgtattaatgttgactgttattccagtgaggaacaatccataaacctttaggctgagtttgaaagggagtttggattttgctactccctcgtttatcatgagaaccttcccgaactatcaacggtatgttttttataaatacttttttaattaatatagaagtttctttaaaaaatcaaatagactaatttttaaatttataataattaatactctattaattatgtgctataataacttatcttgttttactgccactaaaaatcaaagacaaactttactttaaaactcagccttagtcttatatgaaagaaaccaatggcacatcggcctattatattgtcaaaagtgatgtattattacgtataaataagaaaggcgaaaaaaaaaattcttcgaccgatttctaaaccaacagcagtggtaaattggattccaaacgtggatcatgcatgactgaaatgcaattccatagatagatgatttgaactctcttttccagaaacaactaaaccatgcagtaagctgcagctgaaaatcttaggatgaaccacacatatgaagccatatgcatgcatgcaggacaatgattatatatatatggctagtagtgtttctctggtgccacttgcagtgatgctctaatgagcaagaactagagcctttttctacatgcagcgttgcagagctaaatctggaagccccaacttgaccaccatgcttggtactttgagcaaatagaatccatgtacttctccaaagagtctaccattgatgctagtcacaaagctagcttgcttccattgatgctagtcacaaagctttgtttcaagtggatccatcaacttgggccttacattacatcttgtctgtgtacgaatgatggagattgatcaccctgaaaagcaaaatattaatatatgagtgtctagtcttatctaatactttctgtgtatgcatatcatcgcatggttatatcctctgctcccttcattggatgactacacattatatatattacatttggggaaactatatgcacatgatatgtaacatgcttcaaagcatatgccaccctattgatgcatatttgtgcataaagagaaaaaaatgctagaaataattttttcacataggtcacgcatatgatcccggtactagctaaccaaactatagttaaatacaagttttatataagtaagattgtagttacagtgtagttacaatatagttacaatgtaggtacacttcaattatactacagttacatttgaaagtttttcataaaaagacttgcggtacgatttagatttactcatagttttccatgatgcatttctgattattttttagttgtaaaccttccgtgggacatcttccatataatggatacatccttgatttgtgtgcataggtggaacaaccaattatgcaagtgggtcatccaaattcaaagagaaagctgaataaagacgatatatgtccagttaattggcttgggagtttaatgttaggggtcctgcacttaacagtgtagtgtggattcatggaattccctagaattctatcacatcatcaccaatcaacgtctagaacagaggattcatggaaaatttcttgctgatgacaaatttggaatatatagaagctactgaaatcatcagattttcaatgatataatgcttccactcgaaatttgacactaccctaccaattctagtattgcaaaacataagcgcacttatttagtagcataagattgcattctcatatttagtttgctaccaatgtggagccaaattatgatattatagtgtagaatgttctaaattgataccaaatctactataggcaataccaatagcctttaatccaaagaattataagtatcatacaagctaaaaaaaataaatagtacggtacattttggtagcaaaccaaaatggccctaagtcaacatttagttgttaagtctagagaatttgatcaaattttcactcaattatgcatgcgaaccctaatattctcctccattcctgtatattctaaccctatatagacattttagtattttttatataaatatccatagggaccacccctattattttttgtcaaaaaaattagatgggagatcgaaggttgtcaatattttttatttaacactatgaagaagatataccagtatggtcgataagtagatcaaatatatatttatatatacatgatatgtttaagattagtatctgcatgtttaggcaacacaaattgatccaattatttattgatatgaatgtggttacgaataatatcttcataatatattttgttaatgtatacacatctagttgttcttgtactcccttcggtcataagtatttcatgttagatactactatacgtaaataatgatgtctcgagatactctcaactaaaggctctaggaatgaccacaactaacctaattttcatgataactaaataatgtaagcaaaggctaaaaagaacctatataaacaaacatttacctgaggaagagtattgatcatattgatattcataggaataagatatttttctgggtatctactgttgggatacgcgtaggctacaatagtataaatcaaaattttctatcgcgtaaaccagaaaccatgcaagtattagatcatatattgttaccactcgacgcgctgcgcagcggaaaaaggcgctaagaagtcgaaggaattctcgcgaagtagcgcgcgtcgatgtagaggaagtagttgatcgcaccggctcgaccttctcctcttcgtgtgttctcctcgctgtactcccacgccgatcagcaccgcaaaccagcggcgcctctaccagtatccacatgtacagggacagaacgccacgcgcagatgtgctagcacccacgcgtggctagagttttgctcggggagggaagtgacggctagagtttctcacgtgatgcaattactccgccggtcacacccctcacgaatatataggatccatcacttgggcctccaaggcccgtaggactcctattcggatccctattcgaattaagctcatattggatctccatccaatccccttattctggtccattaagcatgcgaccctgtaggttcatgtacactcggctgtaacccgaaaactccttttcggttcacgcgtcaacagcggcccctagcagaacgtattgacccaccgggcatacataaagatcatatcgactgaacctctactgtatacttgtaagaacccctttgcctcacgatatcgattaagctcaatgctagatatgtgtcatcctcaaatagctcaatcattcactcgaacttgttgatagattatataacttgtgattgactcctcaatcacctttggtatggccatacactttcataatctacaacatcaaggggcccagagatatctctccataggaggggcaaatcccatcttgattattcatatctcactacatgttttgattcatagcatacccgaaaactacttttataactacccaattacggagtagcgtttagcagtccctaagtaagctactacacatgttgggaaccatgataatctcaggtctaaggattcaacaccaacactaaatgagatcactgatgacacaacacatatggctcttgcagtgtcttatgttgcatgttcactaacatgtgtccacattattaatttggtatctctataccatgatccatgggacatgatcatcaattaatacatgtgctgatcatctaattatatttgttccacgtatgatatttgaacaggaatcctttagaaatagtaacaaacaacataaagagtctcatcaaaaaatcacatattcattaaccaataatgttttatctatttcgaggaacaatgtcggagaaatatataaacatagtatgtgatacaatcatctctatgattacctctagggcatatcactaacatctaccaacatcaagaaatttaatcaagcaatatatcatgatgctcatgtatatcagaagtactaaattatgttactgtaaccaagcaacgtaaaatatgttatttagttaattatgaaactttgttaatagcagtccggctattacacattactctattagcattgctactcaaatagtattatttcataatgatcaattatactgagcaactcattgaggcttagttaatttatgcgcattcagcatcatatcattataaaaacaaatgaaaacccacaaaacatatataagaagtagaacatttactaccacgaaggaatgaaccatatcttcagggctcaccacacacgtccatcatccatatgtagtgcccgatataatttttcaacaaagacaaatctaccggtcatatattagctaagttttgcaggatttaattaaatttctgcttgcaaaagcatctggatttaatgatatggttttcatttttcagttttgagtgggccggccgagtggcgtgtcgtcacttattagaatgaatttgaactccaaggattgataccagaaaagcgaaattaattaacgtggagaagcatatcatcgaacttttacagtatgaagttatcatcagatctctaatatggaaaaggaaaaggattgtacccctctgtttggtaattgtggttccaactttcgtaagaacaattatgtaatccttgattatggtacttaattaagaagatactaataggtatcatagtccatattatagaaatttactctgaggtaccacacaaacgtttaatttctagctaatgcaaatttgtgaaacctctcaatactttcttaagtatcataaaaacaccctaatttggtacattcaggtaacatactctctctattttaaatgtcgttgactttttaagatacatttgaccatttgtcttattcaatatatatatatatataattattatttattttattgtgatttgatttattatcaaatgttctttaagcatgattcaaatatttttatatttacataaaaaattaaataatacaaatgatcaaacgttgataaaaaaatcaacggtatcataaattaaaaaacggaggtaataatacttataaaagatgtggtccatctaaattattttacactaaaaagtgatgacacctatcaataccatgttcctatttgtgtgttcatttctactctacatgacttcagccggataaattagcagctatcagtgatttcggattggggtgtaattgagattttgaaaagccggtattttcagtaaaaaaaaaaagcacacctgtatgatttgacgtttaatactacattgctttagtttgtggagtacgtcctataaagaaaaccgtagaagatttcccaggaaagaaatggaatcgaagcttaggttaatttagtttagctaagcttgctcgtacaacttgatccattacttaagcaccaaacagtgatctacctctgcatatataaaccatggcagccctggcatttccagctgcagtgcagatcaacacatctctcatctcacttaattagcgagttatcttaacaactaaattaggtcaccattagcattagcaagctagacatataatccaaatattgttgctgtgtgatcgatgggcagcgtgtcgtgcggcagatcagcggcgccggcggcgctcgttgcacttgtggtggtgtcgtcggcgttgctgtcactgtcagctcgctgccagtgccacgccgcgcgatcttcccctctcgcggccgccatgtcgccgccgccgtcggccgtgacaacggcggcggcggcggcacgcggcggcggccgcgtgctgcaggaaggaggaggggaaggaggaggagatggaggtgaggcgggggtgggaggagacggcttgttgccgaccaacccaggcaacagcccggccaccgggcacgcacgcaagcctcccgcgtgatcatacgcatgatgtggaatatttgccaaagtgtgaagcaaacaaacgtacgacacgctgcgtgcgcgcgcgcgcgttaattagatagctagctagtttggacggaataatctcgatcgatgttgtgtgtgtgttgttcttgttggtttcgcagtatattttgtttgtgtttaatttgcgtctcgtggtttgtaagagttattctgacttcgtggtcgctagctagctagctatatatttatatcgttgtttgtgctcaagagcatagttatgatatgtaaaaaagatatatatatcgcatgtacatctatattgcaataaaaagacggtggttaattagtatattgtattgggaaaataccgcataggtgtctatatttttctccggtgatctttgaggtggcgggcatgggaggtggcgcgctgcaggggtgcaaccggtggtggcaggctacaactgctacaccccacctagcctattggatcccatggagaggagagaaggaagggagaagaagatgagccaccttcaagtaatcatgtccctggctacgctctttggaggctgccgcttcatcgggcatcgagccagccactcatcttctggtgaaagtggtgggtacaggtgattggccgccgctctagccgatctgtctcctaatccggctggccactaccatcgtagtagtgagcttccctttgagtatcggcatcggtaacgcctgtgggtgccacacatattcctagaggggtagtttccacgattcttcactcatacttgccatgaggtggacactcagagcgaaaaatgtcacaaccagaaaatcacatttcccaatcactactgtattaatccgcgtcctagaaaaaaatcatggtatacctcaacgaatttgatgcgaaagacacatctttattatgttgataatatttatattattataaaggccgtcagacctaacaaacaaaaataaacaacaacagaaaaacaaacctatatttccatcatcacatgcgctcaactagggtataagacaagactctacctaggacttcttctccaaagtttcacttactaaagaggaaaagattgaacaaaaatgaatataatcatcgtactcagcaagtcacaccgggagatgcatgattaatgcaaggtggtataatgaatagtattacagggttgagttttgcaacaaacaatcatttcaaatcattttaggaataaaagtcaattttagaaacatgttcctataatccaattaattatcaaggtcacgacccatgcgaacctacattaaaccacaggccaaaaacagattaaaccggccaagcagccttgtaccagattctaaatcgtcctaagccataccaggccaaccattccaagttttagttagctaactagattatccaaattttaactactaacttgagtacattactagggatgcccataatcgaggtacaactattcaaataggttttactatgattagaggtgtatatctttacccataagacacgccttcctcacatgtcaccacgtgcctcataccaccacggtacatggacggaaaaggtggcattgttctttactcatcctagccctgaacaaggggactgacacaaccccattctacagccaaggaccttgtgacaggtagaggttataattgcgtcccaaagcatcagctcacccatattgggagtgactactcgagtgatcttcctttgccacaaatataatctaggttatcgagctagctacttgagtagctttcctttgtctctaagacaatatccatcacaccagacttcgtctgcttctattcgtgtcccgatgcccaatactagactgagctacaaagtacgccttacccacactagacatgtggtagtacagtaatattttacaacagaagctcgagattaatcctcatagcggtcgaggtatggttttgggagttttgaaaggggaagagagtgtcatgtgaaggatatacctcctaagttccagagttaccataagtgatctgaaatagctcccgaaagtcacataataaaacatctacgtgttgctaattaagcatgctaagcataaacctaaaaggtctaataagcgccacatatatagttcttactaaccggttcttgttacatagggttgtcaagaaatagttaagcaataacaaccaatagggccataacaaggaataataggcctagctaagttaaacagttattcatcgaaatttaatacaacaaagtgcaataatttaaattaaaataacttctgtaaactgggattcgatatgctcaaggagagcatgacttaccttgctctaagaaaagggtcttctgaacctttaacaacaaactcaacccacactacgggatcctccagaatgacagcaactacacgaagcacacaaacaaaactaaaaccctattcaagaagcaataacaatacctagaaagcacaaacatggattctttatgttataaaaaaagttaagagaattgaactagttgattcagagatcatatgaccaagatcatctaaagtttaatgttgttatgacaatttacgaattattgtgattaattttagatctgtagaacatgtctaagacatcgacccaagaagaaaggaagagttgagttgttgacatttggaccttacatgtcaatctctagaccacagtagacaaagtgcatagaagcagtccgcggatctacggaaggggaacctatgtgtcaaccggaacaaatgaccgacaaatagatcccactagatgccacatgggctgcacatatgggcaaccacatggcgctcacatgagcatgtgcaaacactgtcatcacatgtgcacatcactgcggcacgagcgaaagctgacaccgacgcacgaccacgtcccatcgacaaacaacagtataaggaaacaccaaaatgagagaaggcctgacgaggggatgatgagctcacgaacaggactggcacagtgaggagacaacgacgatgactgacaacgaatggacgaggacgatgtagacgaggagatgactttagtgacgacctagcggcgtaggcaagacagtgctagagcatggcttgatgacgcgatgccgaannnnnnnnnnnnnnnnnnnnnnnnnnnnnnnnnnnnnnnnnnnnnnnnnnnnnnnnn

SEQ ID NO: 33753 - DNA, 801 bp, Oryza sativa
ggaaaaaacaaccggcaagagttgcattccgagataaaggagaagcgggcgataataaatgggttccggcgtgcttggggcaaaccgaggggtgccggggaaagaagatggttacgtcgggcaccactccaccaaggtagagtaagaagaatgtcgtggagatcctatgtagccagaagggaggtgccaaacaaaatgatgggaggaagagagggctctgttttataggcaaagaagggtagatccggtgatggaaagtgcggattggcagtggcaatcatgccgagcagccatcaatgccagcaaggaaaggcgcggccatttcgggcgtttcgatacacacaattattggggggaaacttagggaaaaaaataagaggaatgaaaggggggttaaaagtccccagtcaatttggaagcatgggatttaattcgggtggattttggggagcaacatgcagggtttatgttagttttatctttctagaaactctaaaaattgttctgattacataataattatttcttgtgctctgagtaacgttttagaccatggagattttagggggaaaaaaatactccaaggcacatttgaattctacttgtacgtatttcattgtttgtgatttcttttttggcttttaatacattctattattccatttcagaaattatttttaattgggataatttatcacgacatgacaaaaatcttattgtggatgtccacaatactgatggtgatatttcaaatgtcacgacctgttctgatggcatcgaaggtttcctatcggcgagttg

SEQ ID NO: 33754 - DNA, 709 bp, Oryza sativa
  unsure (1)..(709): unsure at all n locations
nnnnnnnnnnnnnnnnnnnnnnnnnnnnnnnnnnnnnnnnnnnnnnnnnnnnnnnnnnnnncccatgtttaagaaagtattcttaactttcataagacctaacaaaaaataagaatcaccttgtttcctatcaacttgggtaatagactgattataaagatactttgtttttaataagtcttgccaaaccccttactcatttattaatttaaacaaccatttagtcaaaaggtatttattttgtatttctaaattatggacacccaaactaccctgatctttgggttggcaaataatatcccatcttgtaagtctgtactttttcttatgatcatccccttgccaaaagaatgttgatctataataatcaattttttgaagaaccccttttggaatctaaaaaaagatatcatattaaacataagctaacactttgaagggaaaaaccccaagaggaaaaattttttttttaatcaaaaccagtctacccctaacagacatatgttttcccttcaactactaagtttcttctcaattctttgttcaataactttccaatctttgttactaagctttctaaaatgcattagaataccaagatatctaactggaaaagtacctaacttacaacccaaagatagtagaatattattcataaaagtcctttgcctggccaaaacaaaataattcacttttattaaaaattatt

SEQ ID NO: 33755 - DNA, 547 bp, Oryza sativa
cagagggagtggcaaaatggcattgtttgctagtagaacaaaactctgaaggcagcatttgctgtcacttctcattgctccttgcatcccctcagctctgcatgtctcacagttgcaataattcaagggcagcaaaagggtacaaggaagggaccaagctttggttcttcatcctccctaatcttttgtgcatcactgtgtgtcctccttttcggaagcacctctctgttgcaattgaaggctttttctttatcatcatccaggcccatcctctctctctctctcagcctcagaagtgagtgagctctctgttcccgctgacactggacactgctggccctgggcagcagctcagcatgctcctcctgcaaacattatcagtggtgttgggcttttacgacacctgttgctaatctgcattttgcacgagttgtgccgcttacaaggctccaattacaaaatcatgtcaattttattaggaactataatggtatccatttgattgattgagtccacatatcaatcataaaaagagggcaaaggtaca

SEQ ID NO: 33756 - DNA, 406 bp, Oryza sativa
aaaggtggctggctttagaatggtcgtagtatttttgcataaataggatgagtaaaagagattattgctggaattattggtgtaccttgcggtacatgattattgtaggctatatctactgtcgacgtaaggtcagaccaatcatgcatgttgttgttcacatagaagcagcttgctgaatgcaaacttggcctgtgcatgcgtgtcatagcttgcataggaacagcaggtctacacacatgtacagtcagggaaaagtgcatggatgctcaaaagttgatatctgtctgtccgtcatcgtgtaattttgacagagttgactttttttaaaactttgaccattggtaactttgaccctcgtataatgccgtgtttagtttgtgtgccaatttttttaaatatacgg

SEQ ID NO: 33757 - DNA, 1204 bp, Oryza sativa
  unsure (1)..(1204): unsure at all n locations
nnnnnnnnnnnnnnnnnnnnnnnnnnnnnnnnnnnnnnnnnnnnnnnnnnnnnnnnnnnnnnnnnnnnnnnnnnattttaaaatcgatgatggatcattgcaaattgtgtcatcaccattgcaatcttgttccactaatgaaacaagaagttccatcattctttgcatctctcttgactgatggagcatcatatcattggatacaaatgtctgaacaattccacctatctctatccagctacagcccggcaccttgttgccacacatgttcctcattacacttcttacctttgcaagctcattccaatctcctgcagcagcatacgtattagatataagcaggtaattgattggatcatctggctttagactaaatagcctagaggcagcccactttgctgactcaatgtttcctcgcattctgcaagcaccaaggaaagctccaatgacatcaacatttgcgtcgcaggacatattgaccaaaaattcgtaggcatctctaatcctaccagctctccctaagagatcaactagacaagcaagatgctgcggagttggatcaattttgtagtccctcgtcattagaagaaagtacttgaagccatcttcaatgagcccagcatgactgcacgcagaaagaactccaagaaatgcaatgccatcagcccgtatgccttgttggagcattctgtcaaacaggtcgattgcactcttggcaagtccaagatatgcaaaagaagaaaccattgatgaccatgtaactagatctgggttatggatcataccaaatgttcgttttgcttcttgaacaaaaccattcttaccataagccatgataagggcattgcccacttgtagaaagtcttgcaagcctcttctaacagtgtaagcatgaagctgagtagcctcattagcagccgccatgtcggcacaggaactaagtagactggcaagcgtaagctcgtcagggcaaaacccatgtctcatcatcgacacgaaaaggtcgaaggcttccttgcctctgtcatgcttaccatagcaaacaatgattgcattccaggatacggtatttctcagcaccatggcatcaaacacccggctagcctcagcaacttggccgcatttggcatacatatcaaggagcgcagtggctaccaccacatccaagtggagacccaacctgatcacaatcccatgcaccgag

SEQ ID NO: 33758 - DNA, 3180 bp, Oryza sativa
  unsure (1)..(3180): unsure at all n locations
aaatcggattgtgacctgacgaataccgtctcaattcaaaatttcaattctaagtgaaaagcctccaatttggttacgaatcttcacccgtacactgcttagtactagcttagagcatccacaatgtaggttttagagagggtatcatagtagagagagctctctggtactaatcctacaaactatatgtgttctttgacagacaataccattaactttttaaataacgcttgaccatatcattttattttaaaatcaatataaatatacttaagtataagtcatatttgaagtttctttaacgacaaaagatgccacaacataataagtgacatttttattagttttttaatacgatgaaacggtatgtcgaaaattaacggcatcatagattaaaaaataaaggattatatgttttgcataagtataatataattttcccttctgtgtacataacattactcacatgtggacatgtcttggatgctatgttttcttctttagaattagacttgtacttttcaaaatttgaaaatatacccttcaatgatttttatttaaaatagactgtttgcccaagaggtgaggtgacaagcacaaatatcactagaaatagtggcttaattaaatgcttaatagtatagttaaagtttttaaagtattatatggaaatgaatccagcatcaaaattaaacatgtatgagtcctaacgaagtaatgatttatcatgtttcgtgccctatacattatacaacacttgaatccaacaacgtatccgaaaatgcttcccatcgggtgcccaatccatgcctaaaagatcgggcgccctctcgtcttgttgcttatttctttacatggtactcttattcttattttatgccgtgtagtaatccttcatatgcatgcatgtaactattatttcttctaaactatttttccaatctacgatataattgcaccattaaattcgttgcgagtaaatatttcacaacaagatcacacgtagttatattccgttgaaaaaatatttattttttaaacggatttttaagttgcacatgatattctgaaatgttttagtaagtatttcataatgttttaatagtgacaacttaatgaaatcatagatatataaaaatgcatcaaaacattaagtatttgtgttaaatgcttcgaaaacaaatagtatttgattggttacaaatttataataactttgatctttttttcctttactgtaaataactctttttgttataaaattatattgttggccaaatgcatggcaatctttcccataaaaaaacatatatttcatatgattatttttgtgtttcacttgttcggacttaatgtttcatataagtgtttgttgatgttgcagttagccgttttaaatgttgtatttctttaaaatattttatacagtaaactgaaacaatgttctataaagagtgaaacaatggttgatttttttatcaaaatatacttgcgtgagatctgattgtagggatttagttatagggaatataacgatttagatcgtataattgttttaatagaaaaatcgtttaaaagtttgtttttacaagtgagatgagtgaaaggggatatagctactccctccgttttttttaatagatgacgccattaactttttctcacatgtttgactattcgtcttattcaaaaaatttatgtaattataatttattttgttatcagttgttttatcactcatagtactttaagtgtgatttatatcttatttatttgcataaaatttttgaataagacgaatggtcaaacatgtgagaaaaagtcaacggtgtcatctattaaaaaatagaggtagtacgttagttcacatgcatggaggttgtgcatgtaagtatgtcaggcagcacacagtagtaggggcgcccgatttgtagtgaggtcgccacatatcgcttgaaaattacagccaccggagaaaccctttatctctcctggtttgtaacccctaggtagcgaaccgggagggaaaatctgggactaaagatggccggcctcttttttaaaccgggactattgtggaaatagcctgacccagcaaaaataacttctcccgtagtgatcggttatacataggatgtcgcttctttgaataattcatagtgtatttggagatcgatctatcccatccatcatccatggtggctggttctcagggcattatttttatttgtggtaaacgcaaataatgtttaagacctcttcctaatcttaaggtctcttttatttacaggatagaaaaaaactaggaataaaaaaacataaaaattgaagtagacgattctcaaatcctaaaggaattaaaaaatatggaaaaataataggagccctttgatagtaccatgaaaaaacaaagaaaagtttaaaaaagaagttacattaattttcatgtgagctccccttctaaagtactaaagtaaagacagctatgtgtgatgaagtaagccctacgatgctcggttaagctttacaaaggttacccatagcacattaatgctaagttggaccggctaatagtatgctcgcatgatgttattatacttgccttagagatacccctcatgtgttgatgataatattatttgcaatcttctacatgtttttttcaaggagttttcccgttctttataggctagttcgatataagagcaagtttaatagtatagcccattacaagctccaattcacctataaccgatctaataaccaatttctatactaatataaaaagaaggagttgccccctccaatcctacaggtgaaatcaaccagttaaatcctaccgtccatctatcaattcaacgaatccaacggctcagcctctcctccccgttcccatcaccccctncctccccacccccccaacccccccggcgaccacagctcacccaaaaattacgccacctctcccctgccaacgcgccgagccgccgttgccccgtcatccctcccactacacctcaaccgccccctccaccgtgccggacaccccctcttcgcgcatcctttctactccgatgggtcagcggagctcgagcgtcgttcgtcgcccactgcctaccccccaccccatggtgccaccctggtagatcgccatcactcacggtgtcgcccaagaagttc

SEQ ID NO: 33759 - DNA, 4210 bp, Oryza sativa
aagtgtgattggctcaacacgatagattgcattatcgatatgacagagtacatataggcccaagccttccatatctaccgcaaccgatttatagaaacaatatcggaggggataaggaagggagggaaacaaatatacacaatcgcaatctaacacccccccgcagtcggaacgtcgacggagcagacattcagactggaccggaactccgagaagatcgtgctgggaagacctttggtgaagatgtcgccgaactaggatgtcgtgggaacatgtaacacacgaaccgaacccacggcgacacagtcacgaacaaagtgtagatcaatctccacatgtttagtgcgctgatgctgcaccgggttagtagagagataaacaacactcacattgtcgcagtagaccagtgtagaatgactcggaggggtatggagctcatgaagaagctgttgaagccaggtagtctcagccacagcgttggccaccgcccggtattccgcctcagcactggagcaggacacggtgtgctggcgcttcgaggaccatgagacaaggttgtcaccaaggaaaacagcgtaacccgaggtggattttctggtgtcgggacaacctgcccagtcagcgtcagagtaggcggtgagatcgaccggagtggaacgccgaatgtggagaccgaggtcaggagtgccgcggagatagcgcaagatgcgctttagagcggcaagatgcggctcccgcgggtcatgcatgtgaaggcacacctgctgtatggcataagaaatgttaggccaggtgaaggtcagatactgcagagtgccggcaagactacggtagtcggtaggggcagcaacaggagcaccatcaacagctgacaacttggcattggtatccacaggggtagcacacggcttgcagtcagacatgccggcacggtccaagatctcaaggcagtactgccgctgactgaggtagagaccagaagactggcgtgtgaaagaaatgcccaagaagtgatgaaggctgccaaggtccttcatggagaactccaactgtagcgaccggatcgtccactgatggagagcatcagaggaagctatgagcacaatgtcatccacatagagtagcaggtagaccatatcagcaccgtggcggtagatgaacagagaagtatctgacttagcctcaacaaaaccaagtgataggaggaaactggcaaaccggctgtaccacgctcggggggcctgcttgaggccgtagaggaatttgttgaggcggcaaaccatgccaggtctggtggagtcaacaaagccagccggttgtgtgcagtaaactgtctcctgaagagtgccatggaggaaggcgttcttgacatctagctggtgaaccggccaatcacgcgagactgccaggctaaggaccgtgcggacagtggcgggcttgacgactggactgaaggtctcgtcgtagtcaatgccgggacgctgggtgaagccgcgaagaacccaacgggccttgtacctgtccaggctaccatctgcctgaaacttgtgacgaaagatccacttgccggtgacgacgttggcgccatgtggacggggcaccagatcccaggtgtggttggcctgaagtgcggagaattcctcttccatggcggacctccagttggggtcggcaagtgcggcacgatacgtgcgcggcacaggagagagggtagccacactgagattgaggcggtggacgggctgacgaagaccggtcttgccgcgggtcatcatagagtgctcgttgacgacgggtgagagaccgagctgtgtcggtatgcggacgccaggcacacgcgcactctgggggcgtgtgggggcgccggtcggcgggggccgaaaaggtgctggtggcctggttggtgcgccgaccaaccgagcgaggggcggctgagctggtgatggtgcagtcggcggaggcccggtcggcgcgccagccgaccaggaggggctgggcaacctagccaaaggtgaaggaggcccagctgggggactgggcgaggcaagcccagtcggagaggctgacctgctggggccggtgcgcgtcggagaggccggcctgttggggtcggtgtgcggggccgtcgtggagaagcgggccgccggaccgatgtggtcagggcaggggcgtcgtccaatcggcgtcggaagtgaagctgagaaatcctaaaggaactccagatcagtagccacttcattgttagtcatctcagcaaaaggaaaaactgactcatcaaacaccacatgccgtgaggtgatcaccctgttggtggcaagatctaaacaccggtaccctttatggtggggggatagcctaggaacacacacggggtggatcgtggggctaatttgtggggagcggtggtggataggttagggtaacacttgcaaccaaacactcgtaagtgggactaggaggggtgtgcaccatggagggcaaagaaaggggtgtgatgctgaatggtttttgtgggatgacggtttatgaggtgggtggcgatgtgaagggcctcaacccaataggaagcgggaaggcatgcttgaaaaagcaaggagcgagtgatgttattgagagaacgaagcatacgctcggccttaccgttctgtgggaaggtatgtgggcaggacatccagagggagacgccgttggtgagaaataaagagcgagcggaggagttgtcaaactctctatcattgtcacactgaatgctgcgaatagtcgtggaaaattgggtcttcacaaaagcaaagaagtgagatagtgtagaaaatgtatcggatttaaaacggagtgggaaggtccacacataatgctagcaatcatcaagaatgacgagatagtatttaaatccagacacactaggtattggtgatgtccacagatcacaatgtactaaatcaaaatttgccttggcccgactagagctagtggggaagggaagacgcacatgatgacctaactgacatgcatgacaaagcgaggtggtgacttttggtggtggaatgacagacgcctgcgccaagcgagtaagagcctccgaccaagatgtccaaggcgacgatgccataggtcggtgttggtggaggtagcgacaaaggcacgtgcagaggacgccgaggagtacgcatacgccgggagaggatagaggtcaccggaactattgcacctgacgatctcgttcttggttgggtaatccttcacagagaggccaaaagggtcaagttcaacagaacccagttatcacaagaaaaacggcgagcggaaaaaacgcttttaataatctcaggcgaaaccagaacattgttaagcacaaaggaataactgggataatgtaaaaaggcacgaccaacggatgtaatgggaagaagggagccattgccaacaataatgtgagagtgagtattgtgggtggggcgttgggggatggagagggtaccagtgtcagacgtcatatgagaagtagcacctgagtccatgtaccattcagtagaaggcggagtagtcagcgtggtcgtgttgtaggcgcctgcaaggacctgtgggtcccactgagaggggccgtttcactggaacggcgtggtggcgattggcgccatgggagtcggcggcaccgtggagggggccgcgaactgggccggcccaggcgcagcaacgaaggacggcgggtaggcgtgggccggcgcgttggtgagggcagcgcctgcgaagccgggccgtggcccgagaagacctgggccagcctagcctggccacatgtgaatgctcccagtccagggattaaaggccgtgggccatccctggttgacccatgtagcagaagcctgtgaagcggtggaaccctggtttccttggccgccgccgccgtggggggtgccaccgccgctccgccgccgccgccgccggtgccgctgctactaccgttaccgcgaccgtggcgacgattgttgttgcgggagttgccgttggaggagttggtggatgacgagcagatgttggtggaggacgacgcgagaagagccgtggcagcgccggtaggctgatgtcccttggtcagctcgtcgaggaggagttgagcgcgggcttcggcaaaggtggggaacgggacttgcagtgggaggagagacttgaggttgttgaacttgtcgttcaagccgtcgatgagggtgag

SEQ ID NO: 33760 - DNA, 1833 bp, Oryza sativa
  unsure (1)..(1833): unsure at all n locations
atctaacatatattacaccttcttcattttgttcatatatgtgctctagtctattatgggtctggtcacgacttatgatgtttcttatcctgtccttcttcttgtatacaaacatcagtagagcaatcaaagggactgaggttgaagcaattcctgtgctaggagaagtcctgaaaagctgttgaagtttagactgctcgagccaatgacaggtatgttggtccctaatccatttcttttctatatgaattatatagtaatctacagatgcatgtgcaaaccagctgggtttgtacacgtactgaccacaggtgcagatgaattgtaaaattaagatattaagcaatatataaacaactaaatatgtatctgtatatataaggtttgagtatctaaaatgtttactgcactgaacttaacagaaaatttcagaaatctgactacaaacatatggaatttgcttcttccatccttcatgtgattggtggtctgccgattgcttctgatgaccgagttgctctgttggctttcgtaattaccgtcgtggccgcgcccttctgtttgttggtctcactcaccatggtggtaagcacaggcacttgatttttcttttatttttcttcatgcactaattattaactgaaactttgttgtgctatgagccaagtagtcaacgatatttcctttcttgcttaatttgattcttactttctttgccgagttcttaaattattggcaaataaatgcttggattatgatatgctgttgttggcaaatggcaatggatgcaaatgaatcagcaaggggagtttttcctatcctaggtcctaaaacttattgagcatagtgctcataaaaaataaaggagtgattaggctgcagtctgcacctccttaaggtgattgtattagattatgacctggttttttcagttctacaaaatttattatgtaaccatcagttgcaatgcaatgttacgtggattggaaatatttaccctgaaacgctgcacacatatcttgattcttaatcatgctctaatgatcagctggttgctaattgaaggtttgttgtgttcaacaagtctatgaaactcaattttttacgtgaagaatttatatggagtgctgcattaaaaaagggccacatttattattctactttttgagggttttctttagaggatgatactctcttactattctctttgtttctttttatccccaaatctgagagagagagagatagagagagtggacccagcacccttcttttgtggctttatctgattactgctcagtctttatccagtgtgttgtatgaaaatttttgcagttctgaattaatacttgtgtgttttaattacgatatgttcgcataccgaccacgcagtgtggtgtggtaagcttaaagctgacggccgagaggttgtccaagaatatatatatatatgtatatatatatatatatgtatatatgtatatatatatgtatgtatgtatgtatgtatgtatgtatgtatgtatgtatgtatgtatgtttttggttctcccaacaataatcgctagccatagttgatacaaatatgcattgctcagatgaaatgacaaacctagctagctatatctggtttcaggcttcttcctctgaactggaccgttggaatgccaggaatcttagtggcgacagtgatcaaagccaacttgaccctgtttggattgaggatctcaagctctctattcctcagcagtacggtcctcgcatgttggtaatcaactnnnnnnnnnnnnnnnnnnnnnnnnnnnnnnnnnnnnnnnnnnnnnnnnnnnnnnn

SEQ ID NO: 33761 - DNA, 2177 bp, Oryza sativa
  unsure (1)..(2177): unsure at all n locations
cgactctagaggatccccatgccaagtgagggaaagttaccttcccatccatccatgtggctctccagcctggccctccccccgcgcctcgcgagtctcagaagcagccagggggcctcggggtgccacgtcacgcccctcgggccctcgcgctgccttgccctgaggccctcgtccaactgccatgtggcggggggagcgagcggggaggagacccaggctgaaccgccatcaatgcgcgcggggccccaactgtccctcaccggatttaatacgctaagggcagacgtgcggtgccgtccgactgacccacgtcaatcggttgtgaccagactgtgaccggtctatcgacggtcacgtccgattcgacaggcggccgcgcccccacgtcggtctctgtctccggcggagtggaggcaggtatgtcccgtccatcagagtattattccagttccctccacgtgaggaggaccgcacaagtcttcactcatttatgagggaatgacagggttgtcccccgtgtcaagcggngggtggcgctgggtcccgctcaaggacagactgctgcttagcttccgggcgaaggcacggatcgtggcccggtcgaggtaaagtgggtccccctcccgtgaaagagtaggtagaaccggcgcatgtggtatccccttgaactataaaaggaggaccttgcccaccgagaaaagggacgacactcagtaggcctgagctctagaaggagaagaccaagagcgctcttcggagttgaggaacctttgtaacactcaaccataaatcccacacacaggagtagggtgttacgctccatagcggcccgaacctgtataatcttgtcgccggcacgcgatctagaaaccctgagggcggatatacgatctcgagaggcgaaccctttccctcggccgaactcacaaaaggggatctcacgatctcccgctagagaggatcactcctcgacacacccgtcatacacacattttgtcttggagtccgtgctgcagctggctacagatctgtagcccgcttctcttcttatcttttatctcattaaaatatgtttatagctggctaatagtcgtagccgctctaatgttgtctggtattttataaaaagaaactcgtcaatctagtggacgagtcaatctagcaatgaaaccaaataggaccatgggttcggatatagtctgaaaccatctgatctgcaaacatctagtccactataatagttcagttaataatttattccaaactactcgtaaataacacgtagatactctccattggttttgctttctatgaccaagaatgttaataggcatagggcagctaaggttgaagccctatgttaaccccataactctcattatatatttaaaaaaaatgttatgtaattatgaaaaaaattaaacccttattaatttagctcattgttctgtggctaggggtggaaaaaaagctcgagcttggctcgagcctggttggcttggctcggctcgtaagccaaacgagccaagtccaagcctccttttcagctcgttgcttaaatgagccgagccgagctggctcacgagctaggccatcatatgtttatatccattattttactttttatggagttattatttgtcaacttaaaatttatcattaagattttgaagaattgaatatataaacttaaattttatatgttgatgatttgttcttatttttttttaataattacaaaatatatttgaagaggtgtttcaataggaaggcatgcaagtcggctcgagtttagttcgagccaggaaacgagtcgagccgagcttaagttttagcttgttttcttaactgagctaagataagccaaatctaatttattacgacccactgcgagccggctcggctcgtttccacccctaatactcatgtggcttcgccgctgcctgagaggcggagacacggatgacacgatctcacgaggcaaaccaaacaccatttcaaaatcttttgcgccaattttgtttttttcaaaactgtgcagtacaccgggctctggcttctctttgccgcgtgcccagcgggaaaggtattccttacacttgtgtctctcaccactcgacacaacacgaggcgctgcattgcctacacttgtcacccgctcacgctcgcacgat

SEQ ID NO: 33762 - DNA, 4335 bp, Oryza sativa
accattgcgctccagctcgcagacgccctcggcctccacgcctgcgccgtctggatgcccgccgccggccggccccacgacctcgtcctggtgcatcacctcacctcccggcccgacgacgcggccgacttgctgctggaggttggtgacgcgtgcaccgtcgccgccgatgaccccgacgtggtcgacgtaatggcgagcaaggtcgccaaggtgctcgggccggactcggcgctcgccatggcgagcagcgtcggcgcggcgccggcgggggcggtggccgccattcggatccccatcctcagggtgtccatctacgacggaggagggacgccggaggtgaccgaggcgagctacgccatcctggtgctgcttcttcccccccacgacgccgccggcgggtggagcagccacgacctggagatcgtccaggtcgtcgccgaccaggccgccgtcgcgctctcccacgccgcggtgctggaggagtcgcggtcgatgcgggacaggttcgccgagcagcacagagcgctgatgcaggccaagcaccgggccgccatggcgaccagggcgttcagctccatccagagcgccatgtgccacgccatgcgaaggcccgtgcactccgtagtcgggctggtctcaatgctgcaacatccggaggcagacacaatgcggccggagcagaggctcgccgtcgacgccattgcccgaacaagcaacctcttgtcggcgctcatggacgaggtgaccgtgaaccggcagcatttgtccgtgcagaggaaacccttcagcctgcacgcgctgatcaaggaggccatcagcgtcgccggctgcctgtctcattgcgggggagctgggttcctgcaccagccggaatgcgcgctgcccgaatgggtcgtcggcgacgagaggagggtcttccacctgctgcttgacatggtgggcaccctgctgaaccgatgcaacaccgggtccggggcgtgccgcctctcgttctcggtcaggatctgcaatgtgggtgaagagaggtatagccttgactggatcccgatgcgaccgaccttctccggttgcaacgtttgcgtcaagttcaaggtcgggatcgggagatctaggagttgtgctattgagaggagtttgccgtgcgaattgcctcgtcgttctgcggccactaccagctctcagatggggcatatcttcagcggctacttcaacaagattgtgcaggtatatgggatcactcacaatacactctcatacaagtactggaagcagatctccaaatctattttgctgccttactgtactcaattatgctctgttttaaatacttcatccgtttcatattataagtcgtttgacttttttcataatcaattttcttcaagtttaactaagtttataaaaaaatatagtagcatcttcaacccaaaataagcatattatcaatatatattcaatgttatatttaatgaaactaatttaatattttagatattgctaaattttagtataaacttaatcaaactttgtagaaaaagatcaagcaacttataatatgaaacggatgaagtaatagaaatggttgacatctctctggcctctgttgataagcacatagcaagtacctacatatcccattgtttaacacagccattgtttaacacacactgactcaccgacagaaagcgttctggaaatgctagaattatcatcacttatcagtagtttgttgataaaacttctcagtttaattataggttctttaacacctgtaagagttgtgtaatccgaggaaacaaatgaatttactttatgtattacttgatcagatgatgaatggtaacatgtggtcggcgtcggactccgagggcgtcggagagagcgtcaccctgatcctgcagttcaagctgcagcagggacatgtcgaagcatccccgccgtacatccctcacttgaacggcctgagggtgctcctcgccgacgacgacgccatgaaccggggggtgaccaagaagatcctggagaggcttgggtgccaggtcatgtcggcgccgtcgggcgcccactgcctgagcctcctggcgagcgccgaggcctccttccagctcgtcgtcctcgacctcgacgatcgcgccgtgccctcggcggccatggaccggtttgaggtggccctcaggatcagggagctcaggaacagctgctggctgctgatcgtcattgccgtcgcggctggcgtcgtcgccaccgatgatggcggcgccgtgcaggagctgtgccagcgtgccgggatcaacgggctggtccagaaaccggtcacgctgccggcactgggagctcagctctgccgagtgctccaggacaactgatgatgctgcctgcaatggagtgtgtaccgaaaagagcaaggactgaaattggtagatgcatcatgcaatctactaccaggtagtagaagaaaactggaatgtacagtaccgtattgctgtctctttatcatggtgttgcatctgccggccttttgcttcgttcatttaccgaatttgctggatgattatcgaatttgtctgaacaacatcatgtaattccggccaagctggtgtctgaagccgtgctagcagtcttttagttagcacggctctagacaccagttcatctcgtgtactcgataatcatctcgtgtactcatattatcttatttgataatgcgttctatagtggttaatatgaaattgtaattctatatgatacttggatgcttatataccaaacataagataatatgcttatataccaaacataagataatatgtttcaatgtacatggaattttatagcaaactagtgggttgtaaatgcatatgataaaggctatgaggaggacttagcgaatccagattaggaggtgtcgtccatggcggtggcgtgcggatccagaagaggggagaggccgtccacagcggcggaggtggatgaggtcatgaaggggaacccttcatgcagcaacatgatcgaaccacgtcttcaactgctacgagtttcatgaatttgtgctataaattttaatattttgttctattaatttgtgttgtgaatttttattcgctttttattcggttatgcatttgaggacctatagaaattagtttcagcactactgtgaatttttgtgtagatagtcccataacgctaacatagccgctaggcggccgtccgccatctgcaaaaggtgttttttcacatgccttaaatcacaggcagtgtggcaagtcattttccggccacatgctaaaactgttttttttcccaaaaacagtaccaagactaaggccatgcaaatatacatattggtgactagttataattaaatttaggtcatcggttattccctgtgtcgagtccgatcaccaaatttagtacaagctaaaaatcgagcccgtgactagttataatttaatccggctctaaatttcagccccgccgttgatatttataggcaaacagtctcccataaaaagggctctcccagcaagccatcatcaacctccaaaacacataggggaaattctagagtcacacacaaaaaaaataaggcataagaaggcagctgcagctgctagctgctgttgttgttggtagtagttttttgggcaccaattttccatggagacgaaggtgaggatgagctgcaggttgggcactatggtggccctggtgctggtgggcgtcgtgctgcgcgggatcctgcaggaggccaccgtcgacgcggcatcgtccagcagcgactcgccggcggcgaaatcggcaccggctacctcgactacggcaacctcaaggcgaagctgcctccaccgggcgtcgccgttaccaagaggccatgcatagcaaaagagaaatgccgcggctgatcgatcgatcgatcgatcatcaccgacgtacccagacggatgaaacggatcgacgtacgtactgcttatggtgtcagcgtgttcttgttttttttttcttttcttttctttctttccgatggaattgaaacgtgtgtgttcttgtttttcttcttctcatggcatcgccttggctttctatatataatgaggtttttaatgtcactaattaattaaccacctgggatatataggccacattggtgaaaatccaactgtttgtagcgagtatagtgcgtagagtcgtgctccagcattattaatacatcatcacaccgatgattaattcttctcgttgttgttgttatttggataaattatgtgttttatcgttggtgatggaatctatgtagagcatcaacaaaatatataatccatatagatgggg

SEQ ID NO: 33763 - DNA, 435 bp, Oryza sativa
  unsure (1)..(435): unsure at all n locations
ttatagggcccttttcatttgcttcagaccttgtgttaatcaagaataagcctttgcattatcagcagagttacttggattcacttgtatttcaagtctcagttctttagaagcatgtaaccatttcacaaaactttcacaatggtacttttgaactgccattacaatgttccttaaattaacatcataatcatttaaggacatggcggtatgaatgtttttatatttgcagcttgtgccaaaggacttctgcttcccatctaagcaagtgttttcatcaagtccttctgaaagtcaacatcctggtaacttccagttcatatccctttctctatattaatctcttaagaacaataatatgttacatgtattccatnnnnnnnnnnnnnnnnnnnnnnnnnnnnnnnnnnnnnnnnnnnnnnnnnnnnnnnnnnn

SEQ ID NO: 33764 - DNA, 239 bp, Oryza sativa
cccatcaacgcgatggactccactaaacctgaaaatatgtgtcatgtggtttcaccatttcagcaagtttacctttggttttaagcatgccaaacacctgaacttttgttacaggtgttgttctgcccatcttttctgggtgttatacacttgtactgttaacatcactagctgccgtcaaaagatttaataatctcggccaaatcaattcaggaagtaagtacaagctcgcaaaggga

SEQ ID NO: 33765 - DNA, 637 bp, Oryza sativa
  unsure (1)..(637): unsure at all n locations
nnnnnnnnnnnnnnnnnnnnnnnnnnnnnnnnnnnnnnnnnnnnnnnnnntatgaattgggggcttctattgtacatattgagttgaatcaacagagtgattgttttagatggaactatcatcagaatggccaattttctgtccggtcaatgtatctggctttaataaacaatggttatattgagagaaataagattatttggaagtctaagatgcctctgaagattaagatctttgtgtggtacttgcttaaaggggtagtattaactaaagataatttggcaaggaggaactggaatggaagtttgaaatgttgtttctgtatgaagaatgaaactattcaacatctttttatggaatgccattttgcaaagtttatttggagagctgtatagttctcttttggtctttaccctcctaattgcatatctcatatttttgatgattggctctgggggtggacaagaaaaataggaaacttattctcataggagcttctgttatatgttgcgctctatggttgagtaggaatgatatgatttttgataaatcaccatctgtttcatatatgcatgttaatttccagggcacgcactgacttaagtcttggtcactgctacacaagtgtggatgttgg

SEQ ID NO: 33766 - DNA, 826 bp, Oryza sativa
agaatctagcaaagtggtatgaattgtgggctttctattgtacatattgagttgaatcacaaaagtgattgttttagatggaactatcatcagaatggccatttttctgtccggtcaatgtatctggctttaataaacaatggttatattgagagaaataagattatttggaagtctaagatgcctctgaagattaagatctttgtgtggtacttgcttaaaggggtagtattaactaaagataatttggcaaggaggaactggaatggaagtttgagatgttgtttctgtatgaagaatgaaactattcaacatctttttatggaatgtcattttgcaaagtttatttggagagctgtatagttctcttttggtctttaccctcctaattgcatatctcatattttttatgattggcttctgggggtagacaagaaaaataggaaacttattctcataggagcttctgttatatattgggctctatggttgagtaggaatgatatgatttttgacaaatcaccatctgtttcatatatgcatgtaattttcagggcaacgcactggctcaggtcttgggtactgctacaaaagtgtgatgaagagggcgagcgtttaaaagttgcatgtcgtaatcttgaggcaacggttatgcaactgtttaccaattttggatggagattcacaaacagaattcgggtaagctcgagtactccttatcttgggttggtaggtgtcttcttttttgtgtgagaaacttttcattttgtgtactactctgtaataattggctgtaacttgttgagtaaaggtcaggatattctat

SEQ ID NO: 33767 - DNA, 20152 bp, Oryza sativa
  unsure (1)..(20152): unsure at all n locations
ctggtatgtgcaaaatcgcctgcattggaatttggaattgctaaaattccttcagcatttattggttaatggtggccaagcagaataaggtaaacctactataagcagttcagcagcaaataccaatcccaaagctcatagcttaagctatgatcacccagtacttcacctctttagatagttttcattaaatatcctgatactccgaagtagagtgtgaaagagaaggaaaaaaaatgaatttctaccaagaagtacaaagcatcttgccattgatctagtccattcataccttggtcacggtatcactcctttctcacattgcccacattgctctattcatacatttggaataagggaattcttaccatttccgatgggaattgaactgattcttgtgcatttaaaaggaaccctacatgattatattatatttttcaaccattcaatgttgctgaagacaaaccgatttaagaattatctaaaacattccaaactgctacaatcataggaataagacacatttaggaaatttgactacctctctttcaatcatgcacaacagcccaatctgatgctatggagacagggactttctgatgcaagtctggtctgtatacatttaggcacttgaccgtttcaagttcagttacctgcttgtgagccaagagatctgtgcggctcaatagtgggttgttgcgctgtgggaaagtttgatgagccaaacatccagatgcaatgaggtgtgtcggccatactacacttcagtttctcatacttgtacgtaagcaccagaaaaaaatataacaaagttaaagcgatgaatatagaacattatgttttgggttcagatcgaatgaagaataactcatacgtgctcaatgtataatgattacttgagttataaggtattctccagtattacctatggtagttgccatccaatctcaaaatatagcatcttaagataacattggacataacccagtataacgaattcggaaaggcctaggttgctatattttaggaagaagggagtatatagcaataggaaacattagactaggtctcattcgtcctgctcaattatatagcaaaagtagccatgtgagagaagaggagagagaagataaaaattgttgttattttattttttggctagcctcatgtatattggtagttcatatactaaggacgaccatatggtctactcataatatataagctaaactctagaaattgatcctctctggtggctacattgtggatggcctaagaatataagatgtcaagaatattctgattaattgatgggccgcaggtctaggctcaagtttattgcttatttttcactacttgttccttccgtgagctccagtgtccaaaggagatatgaagcattcacttccttttcttgactgagacttttttttaggacaggcttaaagccatcttgactgaaactagagtgcgtgggttaggattcatcgggatgttcatccgctcgtttcccttccaacattggtaggctgtcgttttggtaggatgacgattctaatcccttgagtccccttgtagctttttggttcaaattcagtgtgcatagttatgaaaaataaaaagaaaatgacaatgtagactatattactaatatctagagtgaattgcactttgggccatgttttattgtcaaagtttcactttagaccaccctgtacacaatcttttcattttggactaggtaactttacctttcttgcgtaatggaccactctaactctttacgttagtgatgtctagcgtctcttttgacaaaggtatagcaagcatttaggtatgaaaatttgttggcatgtcgttaacaatttgcttgaaatcatcgaaaaactgaagatgtggtttggggtggttcattgtgtaacaaaggtaaagttacctagtccaaagtgaaaagattggacaaatggtagtttaaagtgaaactttggcaataaagtatggcccaaagtgaaattaactctaatatctatcactccaccaaaaatcattttcaaattctatctactccctccgtcccaaaaaaagacatcttggttttccgtgtccaacgtttgactgtccgttttatatgaaattttttataattaatattttcattgttgttagatgataaaacatgattaatactttatgcatgatttgtctttttaattttttttcataatttttttaaataagacggacggtcaaacgttggatatgggaacccagagtttgtcttttttttttttggacggagggagtacacattaagaaacgaaaaagacaaaatcagacatgaatagcaccaatactattcatatgctggatttatctttttttttatttctcaatgtgtgagttaagttttgatttgatttttgtgcagtagtttatatatatggtatgaatgttgtcaatttttaacgatttttgaatcacgtttgagtagacgaggggacattctcttaagagtttaaaacaattgttcccaagatatacacagtggtagtaaaaatattcaagtttgtactatcaatatttttgtgataaaaatattgtaaagtaaagtatatattttggggcaatttttattaaagttctatcagcatgcaaataccacacacccaaacaaattttacaaactttccgatactgatgttttggttttttctttatccaatttattcgtgtgagatgacgtcaacattgcctaagaaacgagaataaaaatagatgctttgcttgtaactcgtatttaattgtttccaacaaactacaaaatgatgcagataataaaggccaagaaattacttctccgacaaatatatacagtatatgtcccaaccaatttgagatccatgagtacatattaggtgggttcattagtgtttttttcttatgggtgataataatatgtgcaaactgccacagtttcttatgggtgagatttatggagccaagtacaatgtgccacaattaaatttcttccagactagctctatatacagtacaaaccatttccttctgctgtttctcaatcattcatgacttgagattgtgaaagtttacaggtcaaagtaagatcaccgacggacgaagacacctccaatcattcgtcatcgatacccaagtatatatataggattaggatgcatctgggaattcgtcaattggtttcaatttctctaaattccagtagcacgtagccgatatgcgcatagcactggcatttttttgaattggcatatttgcattgccatggatccaattaacccatatcatctgtagttgtgtgttctcaattgattttttcagctgcaatgtggtatcgattttctaataatcaaacgctaccaaaactcccaaacctttctttaaattcatggcgttgcattgttttggcacgtcggcattacacttcatttgtcatgcctagacacaataaataaataaacaagtaaaaaataatgaagtgatgaaagtaaaatagtgcatccaactctcggtatttgattattacgaatttcataattcagaaatcagaatgaacctaagtaccctgcaagttcgttgggggtgcaagttcgttgcatatttaccataccctatactttatgtaaggtcccattagagctttttcaatgtaaataaatccaaaaagaagtagcaaagtgccaaagtggcggcataattgacaaaattggccatgacacatccgcaaccaaaggcttgttccaatcatccttgcagacatatcctctaaaaagtcaatcataaacagtcgtgttctatcatcttcaaaattttcacattaaactcaggtctccatcggttggccatgtcttattataagccataacggcttattagcgattaaaaaatgatatgtgagtaaaatttttgtatatatgttcttagtgattgaaaagttaaagctgaaaaaaaaactatgttgaaaagcatcaaaatcaaattcaaaatcaagttttaaaatttaaatttttgccttctgacttactgttgccaattacagtaatgggagagagtggcaaagtactgaacattatatgacctagttaatcacccaactactgatgtagctcttgttgaacaccttgactgctggcaactgtataaagaaatgctagttgtacttgtatcgccaattcaagccaaaatgctcatgaattgaatgcatgagaccgtccactctaaaggcatttttgctagctcttgatttgtgtttacagagacttcctacatatatcccatgttatataggattagaatgcaacaggaaatccaaatgcctggattggtacctgccgcagaaaatggacttttgcaggcggcaagataatgccaaccgctagagaaaatgattttccagaaaaaaattaaatccccaaaatccctttctaccatctcaaccaagaagttgccaaaaaaattgaaaatgaacatgaacatcattcaagcatcaatccaaatacagagcatcacaaatatcaacattggcatcattagcataacagattaacaacaacaatctgccggctgccgttggcccaagtgaacccgctgccggctttgtcacactcgaagttgtcgtcatggccacggtggactcatggtcgtcgtggtcactgtggactcggtgtcatcatcgttggattcgagcaccaccggcgccggatccacctcttccgagcacccccgccctcccgagcaccgccaccagagccaccactgcctgcacgagccacctcactgccgccatccctcatcttcgccgctgccatcagtggggaggaaggaggaggcaccggatctgctccccgtcactccctccccccgcgccgttgatgccgaaagccaccagcaccgcttccgaggcctagtggcgctggatccgccctctcaaggcccaccgacaccagatccaccctctcgaggcccaccggcaccgtatccactcccaaggacctccccgttggtcgatgcggcgacagtggaggcaatggcagccggcggcagtggaaaagggaggccagagaagggagggagaaggagagaccgagggacaagcgagaggcgagtttggtgggcgatggattttattcacctcaaaagttttttttttttgcagcggtcctcttgtcgatgtttgagatcacgactacagtatttgaatggtatggggatcgttggtaccagggtatatgtgagatcgaggtaaaagagatggagacatggatttttatacaggttcgggccccttatctgacaggtaatagccctactcctgttgaccgaagccggtgttgcttctttattcatctgaatcacacaagtacaataattggataacccgtctagctgtcgtcgacttggcggctagataaccaacttgtagtcgacggcagggtagtcttcctccttgaacgaactcatcgagatcagagatagtgctagatctcttttgccggccttcgcaggcaccgtattgggtttgtctaggcttatctctgatgttgatatgtggcagcgtattggtttgtgttgatctatatgtcttctggcttgtctcctctcctcctagggggttgtatttatacccatagatgccccctgtcgaagtaaaactagcgagataaatatggatacgatcctagtagtcctggttgtttccatatagaactccttttgtcattccttattcggaactccttctatatatgaggtttgttttcgtataagatatggtatatggtgggtcctgccgagcttagtcgattattattgggtatgtggtatccataaccctaacacctctttacctaccgccggcgaaaacgcgattttcattggtgtacacttagaggttcgcctcgaaaaatagagttgttttttatggcggacctcttagtgcggccgttaaatcggttttcattggtgatccgtagccccctatccctcgatatgtttgtgcttgcggttttcgcgtacggccgctagcaaaaattatagggcgacatcatgaaaaatcgttttttatagtagggattcttccacaagacaaattttgcaaatatctcgcaaatgttataaaatgtgtctaaggctattcccagtgtgcaggttccacaagagtttccatctcattagatgagatgtcatatagactaaacttatgacatgtcaatgattttatgaatagagagaaaaagttgagtatcgtctagatgaaacttgatttgcgcacttacctatacctcggaaacataatgaaatcccactgaatcatttcatcctataccttggaaatgaaatgaaatccccactgtgaccaaatagtttcataataccatttaataattaaatgtcatatgtagcatatgaaaccactaaatgaaactatgcattgaaaatttttctttcattcatcaaaccaaatgtttttagattatggctgcgttcgaatcttataaagattcacaaatacgggcatgcaaaacaagaaagctattagcatatgattaattgagttttaattattacaaacttgaaaatgatatatttgatactttgaagcaactttcatatagaaagttttcgcacaaaacacgccgtttagtagtttgaaaagcatgctaatggaaaccaaggtaaaatcttcatcttcatgataaaagaacggtgcctatgtgacactcttagaaatcataatatgaaactctctatttggaatggcctgaaatgtcttgtaggttgacttttaaaataccacttgaaagtgtctttagacgaactatggaactcctgatattacggatgatttgaaaaccatctctgttaagatgtactacacggaaggtttctgttgtaaggatttgatttatcttcgttcatttttctttctgtttttctatatatccaattgtcgacctcttcttctcattcaaaatatcttattgaataaactaggattaattaagttcatccgacatctctaaactttcatgaaaatctagaaaccaaccaaaaatgcacggttcaacgcggaactgttaaaaccatagagtagttcttgacttcttggaggagggttattttctagactttccagagtaaaatggacttctctgttgaaaccttggtaggtccgagaataatttaaccttaattgcaaaaaaaaagtttaggataatatgctagcacaaataaaaatgttttaccacgcaataaattatatatgaacaaaagtagccaataaatatatgagttgttgtaaccaatagtagcaaccatgcatcgatgctatggattgtaagtagccaatcttgtaatatccttccagccgtgttcattgtttcctatgcactctaagaattccgatcgacactcctagcaacaatacttttcttcttcatcgcacttaattagggataggaagcatagggaactagaatcatacatcctccatgagataaaggatcagctccagccaactgatgcataaggttgatacatattgcgatagaagttcaattcggcagccatccgtacctgccttacctgcgacttgttcccgcaccacactgcacaagggaagaaggcaacacagacatagctagagaacaacagcgatccttcttctcgggcttctaaactatgttttcacgaagtttattcattagcatttttttagaaaacgtttcaaatcattatcaactttataatatttgtcacttttaagatgtgaaattaaagatttatcacttacagtctatgacatgtgagccctcatgtgtctacgacatgtggatccagtgacaaatctataattaccacttgtaatagtgccaaataattaaatatctcagggaagtcggttggcacatacacacaagtggagggggaacttacatcacttggatggagggtggaacgcacgtgacgggaaggggtatttttaagatggatcaaaaataaaaaaaaaagtatcgacatatctaatggttgaaatgaattaaatatcaatggttagatgtattattatttattatagagtgaagtgcacagacggtctctaaacttgtttgagtgtgtaatttaggtccttaaactctcaaatagtttttttttaggtttccgaacttgtcatgtgttcatataaatccaaacaggctctactctacttcgtgagctaatgtggcatgccactgtagcacctacgttagtgggatccacaagtcagttacatagaaaatataaaattaaaaaagagaggagaaaaaaatgttcttaatgtttttcctattggtgatagacatgtgggtttcaatgatacagacgttaccatgacataccataccagcacacaaagcgggttggagctcgattagacctaaataatacacgatgcaagtttagagatcaaaaatgcattttgagagtttagagacatagatgacacacatgcataagtttggaggctatttgtgcactttactctttcttataatatttttttctaatttattagagcgttacataacgatttaggagcgtgtacaagatgtttaacgaagtcatagtatataatagatagacaaataaataaatactactatatatcttataggtggaagacatgcatgtaaatagactttaaaaacttataccacacaaaaataggaaaaggaaaaggtacatctgagatccctcatctcgtcaccgagttacaaaatcgttcctgaactgaaaaaccagatacaacgcatcatccaactttcaaaaccagtgcaaataaggtccgtcggttgtattgtccttggttatgactgacatggcgcttatgtaacacttcaccctcggtggtattatccctttgcctaggtcttcatccacgtggcattgacacgacggttacatagcaatttggtaaaaaaaataataaaataataaaaacaatggggcctactggtcagatccccttatccttttctgtctcttcttcctctctttcttgcgtcaggcatggaggaagggcagaggaggggacgcctctccatcggctgtgggcaacctcgatggtggcgggaggtggccccggctccggtggcggtgaggccagcggcgtgtataatggtgtctcgggctcctactcactctcgttgccggcgccggattcctcatcgatgatgtagaatcctccaaatgcagtctgctcatgtctaacacagggcacgcattcgtcaatacacaaacaaaattggccatatccaaatgcagtctgcactgaacaaaatcctccaaatgtagtctgcagttctgcactaaacaagaccgattcccaagttggatattgggtaaaaaacgattttagcaccgtcaattttcctagcgcggcaggcgcatcaacaacgcaaatttaccaaaaccgaaggaacgagaccaccgacagagctaccaacgatcttcccttgttcctcgagaaggacaaaggcatcacaacccccaagccaggaggagcagcagtagcggcaaagcatcagaaccttccggagctaacccaagggcagcaacctaagaatccaaccgagatcaccttcctcttcgtcgacaggtatcgcctgcttaccttcctccccctgcgtagcggcggcgggagcatggcaggaggcggagcagcgcggcggagaggagggccggcatgacggcggcgtcactgacgcagcggggagaagggccggcgtggcgagcggtccttggatccacctgctggtggctaccactccattccctaggccctagcgacaccgcagccgaggccacctcccgccacggctgagccattagcgcataattaattaagtattaactattttaaactttaaaaatggattattatgatttttaaagcaaatttcatatagaaaacttttgaaaaaaaacatacaccgtttagtagtttgggaagcgtgcgcgtggaaaccgaaacaaacaaactcactttcacctcccctagagcagagagaggaagaaggggatctgatcagtggacccccagcatttcttattattttttctagatcaaattgtcacgtcaatgtcacatgggtcgaagacctagtcaaagcagccatgtagacgccacgtcagccaaatcagggataaaactattgaggatcttgtttatattggttttaaaagttggaggatggacgaggcacctcaaatatacttttacccccaaaatatacttaaaagatactaccttcatcttaaaatgtaactatttctagcacaataacttgtcctaaaataaagttttttctccacctacctcctctcaaccaatcacaatcattcccctttacctactttctcttttcaaccaatcacaccatttttttaatcattttttacctatatttatatttttaatagccgtgccgtcggaggaagtaaatcagtactagacctgtttaaaggacagcaatatggacaatatcaacctgcccactcacaatatgtgtgtgtgtatacagccataggattcattcgtttattcacaaacttcacttggtcctctcaaaatgaaaaaagaaaatgcatgcctacagttcagcttgattagatgcctcaaaagtaactgaaggaaaaatacttcctctcttcaacgtggcaccggcacattacacttgtattatttagaaagcaacggtccaattttaattgttacactcctccataataagattaggatgcatcaggaaaatagtatcgactttttctgcttgatttcgtcagttctttcatgctgaattcaccggtgcccaaagtagccgttgccgatgggtcgtcaggtgaagatgtttgctcatgttggtactttggacagcgcacactacgatcgatctgtcgtaggcattgccaaaagttttgctcaaaaatcaaacaagattagcattgaactgtgcgactatttgagattttttactttccccaaaatctcaactggaattgctcggtgtctacaaagtttctacgtagagggctaagtcaaaactttaaagtcgttttactctcgatttgccccaaatggtggttcaaactttacagtcgtttcacactcatcacactcaaatcaatggcaacattcaagaggtagattcaacatgaaacagtaatttcaaggcgatttaggcagtgagataatagcttggttaacttggaacgtcatggcaatgtgcagtccaataaacaaaactaaccacactagctttgtttttttcttactttgatgtcacaaggttaactgtaatgaatcaagaaggctcaaacttaacatacacacaccaaagccatccattcctcaaaataaatttaacaagcttatgcacatacaatcgaaagggctaaactacggtagacatcattcacctgatcacccctactagttattccaacaattgcaattttacaagtggtacagacagcatatactagtagtaaaaacattatcactgaccttctaccgatgatctaacgaaggaccttctccaccatacctggaaagctctagtaaggttcgggcactctgatcctttggatgcaaaacactgaaaccactcctcaaatagacactgctgctgcttgagtgggagggttagtagggcctgtcctagattttcctccaaagatcttacatccagacctttggagcatcgctgaagccagccgaaatcaagcaacatcgggctgaaccatccgtagaagaggaggctcctcagctctccacggcactgaacttttcctttgccgagtgcgatgaaaacactagcagatattcggcttagttcatacctcatcatgggtgatgcctgctcatgtatcctgatgagcctgtcttgctttgcccacagctccacaaactcttcagccatgtcaatattcacaagaatgtccaagagccagttgaggttctctgtctgctgagagattctctcaataaatggtttactgcccttgataactaatgcttgagcagtgtggtttgtagcctctgttgcttcgtcataaagatccactagtgaatttaaacaggcataacagatattatacaggctctctctgtttagccctgccatgtctttttggtagacagaacttttgcttagaaggccatttaccaaagattgcatatcttttcttgcaccactgttggtgctgctcgtgactgattggataagatgcactgtgaggtcttctgagctgctccagctgtgaggccgcaatctagccagaacatcttgggatattgcttcatcaaaagtacatcttgcaaagagattcttgagcttctcctcctcgttctcattccatggaactgcttctatgtatgacaaacacaatttaactcctctttcaaacatgattgatgaagacacctgcaattaaagcattaataaacaaattatgtacgtgattaattagttggcatttaataaactcattaccaatgcaagaaagaagcatttaataacatattattctgtaaatccccacttgagaaatatacatgctagaattgaaaagatgttacaaagatattggacagcaatggtggctgctttatttggatcactagatagcaattatgggcaacaggaatacttgcttttaattgcgggcctagatgcattcaaaccactaaatgcatttgtagctgactttcatagctgtagaatgtgatctaatggacatcaagccatagaatgtgtatggttacaagacttatagtgattgtattattatctaatccatgatttaacatattaaacaaacaataccagcatgcaaacaattcacatagaaagtgagtgatctacaacatctaatatggttataattatatacttacatatcactttgcataacttacatgaaagcaatggtttaataaaagcattagatgatattaaatcactaatatcccaggtcaaatgcttctcacacaatcatatcatattagtttcactcgaatgctagagctatcgttgtttggcatatgctgattataagccgtaacggcttatcagcgatcaaaaaatattccgttcgtaaaactttatatatgtgaactagttagcgatttaaaagccaatgctggaaacataaactacaatgaaaaaaacctcataatcaattcaaaaattaagtttccaaattaaattttggcagtggcttataagctgaaaggcaaacgctggggctctaacttgtgcgcctatcaaaaaaaaatgtgaaaatgagtattttggtaacaccacactggatatctaccaccaaaatggcttcggaaaatgaacatataaggaacacaacatcaatgtaccgtgaatgattgtttggttgcaatgcccactaaatttcctgccctgttgtgggtaacaaaatgccatccattattgcaagtagtactacttcttttgcaaccacatcatgctactagtaacacaaaatcaattaagagaagctgcttaagcttaattcgtttccctcacctcgagcacatcaatggagcgcgacacgccagcggcggcgagccaccgcagcggatcaggctggtacatgagctcgacggcggcgcggaacgcctccacattgtccaccccgtccacctcgatcctcctgccgctccctcctccgtcaccggcgggcccgcgcggcggcgccatggcggcgaagaaggcgctgctgtcgcagagcaccccggagtcgagctccatcaccacgcacgtactcccgtccctcccgcgaaggaaaagcctcagatccagcgcctcgtcgcccgccgcatccgcctccgccgacgccaccaccaacggcgccaccgccgccgacgtctccgccgggaccaccaccgtctccgccgcgggcgtcaccggcggcggcgggagcgggagcgggagcgggagcgggggcgcggagtcatcgaggtcgatgggcgagacgcggccgggggagaggatgcggcgcgggtcgatgaggccgccgaggccggcgagcctcgacgacgtcggcgagctgtggaacgacgagatcgagggggacttgggcggcagcttattcctcccggcaccaccacccggcgccggggaggaagacgccgccgtggccggcggcgcgagggagggagggaaggggcggaggtcggggctctgcgggacgccagcgaaggagcagcaccagccccggggcgttcgcgcggcggaccccgccgcacctcggcgccgccgcggtggtggcgctgagccccgccgccttccatccttgccgtcgccggcgcagatctgggtggggcgcgagagagagagagagagagagagagagagagagagagctagggttcggaggcggcggccatgagaggggaggagggagaggtgtgatgagtggaacaacacgggacgagagctctctctctctctctgctgcttctttctctcactctgtgctgtggcactcactgtgcaccgcgtgggattggtccatgggacaagactggtaggtggggtccactgtaagtggggtcctcttcctcggataccgcgggcgtggtgtacgggcatcacgagaggagctggcactgcactggcaactcaactgggcaagagagggtttgcgatcgtctgcgtccggggtatgggtatgggcgtatggctgtgccgctgccgatcacacggaaaacggtcctaaacgatactcgggaggttccaactcccccacacgaaaaatggtggtacccgttaaaacgtgattaattaactattaatctcaaaagctcgaaaactcgattattatgattttttaaaacagctttcctatagaaaacttttaaaaagaatatacttccttccgtcccataatataagatattttaagtggatgtgacacagacatgatgtgtcatatccacctaaaatccattgtattatgagacggataaagtattgtttagcagtttaaaagcgtgcgtgcgaaaaaaaagtgagttgggaaagaaggagaaagaacacaaccttactcttataaaaataactttaacttttacttccggatatagtccctccttcctaaaattatttttaacttgttccatacatatgcatatctctctactattataaaaattaaatatgtttttgactgtactttggaacatcatccgtgtatgatcggtttctaagtccttttgctttttaaaatatagatatgtatttgagtcggattttaaattcattcgtttttggaaataatgaggaatcttataagaaatctctttaaaaaaacttgcatactaacttaaaagatgatcggacttataattgcaactcatgattttctagaaaaatatatatccaagtgaattctcacaacgaaactattatatatatctctactgttataaaaattaaaattgaagatacttttgcatacgttatctttctttgagttggtttttaagttcattcgattttagaaatacagatccatgtttgagttgaattttaagattatttgcttttggaaatataaaaggagacgtataagaaacctctttaaaaaaaactcgcatactaacttgagatgaaatatagactcctaattgcagcttatgattttcaaagaaaaaaatatccaaccgaattcccacggtgaattttaccatagctaaaccttataacaataataaaattaaaatagtatttaccgttgcaacgcacgggcattttttctagtatgttataaaaattgaagatgtttttgttggtactttagtatgtcatccatgaattagtcggtttttaatttcgttcgcctctgaaaatataggagcagtattataagagatctctttaaaaaacttgcatgctaactttcagactcagctcatgattttctagaaaaaatatatatcaaagcgaattctcacagtgaatctaaaccgtataacaatatttctcacttcatttacctgtaatgcattattctctactttcacaaatagaagagcccaaaaaataacttattttgggacagatggagtaaaaaaatattagcctgtttggtagagctccaactcctaaatttagctctaggagttgggtctggaagtggagtcgtggagcaacctaaacccagctctaactctctagttcattttgtgagagagctctacccagctccgctcccattttagatggtgctgaaactatttggctgagttctagcttcaggagaggtgaaggtggagttggagcagtagctatgccaaacaggtcagactatcttcaaaacacattattaaaaaaagagtaaagtccatcaccggtccctaaacttgtaccgttgtgtcatcccggtccctaaactcgcaaatcgaccgttcaggtcctcaaacttgttcgactgtgtcatcccagtccctaaacttgcagatcactcgtttaggtcctacaacttgttcagttgtgtcaccccggtccctaaacttggatttgaatatcatctgggtcaaataagacagtctaaagactttatatttaaaaataatttataactttttcatgtaaattctaatgaagaaaaactttatatcaaacttgtagccctcgatgcgatctacaactttgtagttgaatttttttattttaagtcattttttgtcccaaaatgtaattttaaaattaaaatttcaaaatatataaacatgcaacaatattttgggacctaaacggttttaattcaaaaacttttcaactacaaagttgtaagtcgcgtcgaagactacaattttgatataaagtttatcttcattagagttcacatgaaaaagttatgaattattttttaatataaagtttttagaccgtcctgtttagggaccggggtgacacaactaaacaagttggagctaaacgagtgatctgcaagtttagggaccgggatgacacagtcaaacaagtttgaggacctgaatggtcaatttgcgagtttagggaccgagatgacacagtggtacaagtttagggaccagtgatggactttactctaaaaaaaaatgcccgaaagccaggacctaagcatagacaactggctaagagcgaggccatcctttcatgctaggcatgatttggattcaaacaggtgaattcaatgaaattagatgataatcttgcccatacagcatgtacactttatgtatctatgtacattatactctaggcatacatatgtacattatactcaggccacatgtaaccccgtgtaaaagccacggacactattagggttgtaatatacaaaagtttgcacataagaacaacaaaatatatgcgtaaaagaagaactgtttgtagacaacctaaaatgtataaaagctaagaattcactagtacaaaaactgtgataggtattttctcctatgttccggtttatttaaaaccgacacttattgatcgttcccacctctgtgggatagaaaaaataaaggaccaccaccttcgtacaactatatctgtcggttcaaaatatcccggttcaaaggcatccataacatattataggttctgttcttttaaaaaaccgacacctatgaaaaactaagccgagccattggtcatcgggtgggtattccttttaaccccactgagtcaacccgcgttcatcgtctctctctctctcatgcatcttgtcgtccctatcccctccagcttgccttcgtcgtcaacgccaccacccgtcgtcatgtccccccctcttcctcctcctcaccacatccatgcctccccccctcctactcgcttccacctctatccccgctgccacccatcctcacagccttcgctgcctctaccacccattgtcctctgcaccacattctcgcctgctcccagctgccctaatctcttattgtttaaggtttatgaatcttgttaatgatttactagtttactgatgcatataacatgtaaaaaaaagactggcaatgaaaatggtaatatctcaatgctatacgtgacaaattgaaaacatatttaattactattatattggacgtaggctaccacttagaagatccaataatcaacaatctcacctaattctagaagaaagtaatagcatacagagcagcaggggtgtactaaatttttaattggaaaaatggccatctatataagagagccatagctgtcatagtgccatagctcaagagtagcgagacaacagattcattagggattttttttttgtcattccagtgattagtattgccatatcattagcattcatatagggctgtgaggcatcagtaatacttgaaattgacttgctatgaaacacagtagtctggcaacatttctatgcagtagcacactgagcactcggttggacaagatctggagtgaacaatacctcgctcacggtgagagtccgaccacttacttttgcaaccgttgtcggagtgccgccatggatgtgagcaggcacatgagtcagcgatctggagcgaatggagccttcctgggcaacacacctgcaccgtagttgcagtcttcctgagctcatgatctgcttgacatcgacaggcaatggcagcgcgggcgctcgacggcgtgcaggggtggttggctagggcaagcaaaggcagattaggaggctgttaatctggtcatgaacttttttgattattttgcgatttgtgaagatcgagagaggaagggaaaagggaaatgcggcggcaaatccagccacatcctcttaaattggtatagatatatattgggaattttaatattgtaatttgcaaagtatacagtttcgtcgtgtttgcaaagtgctaactgcttttgcagattgtgagaacatttctcctttccattcgttcttcctatggtctgttaattcactctaccacactggtctataggccacacctctccttttaccgtcctctgccatcaccccttacctgtagataaaaccttcataggtacctgttctgagccctttgttggtgctggtttttttaaccaacatcaatataggggaactagtgaggataaccaatgggcacccaattttatttttacatgcgtgaaaaacctaaaaacatagtattactccctccgtttcacaatgtaagactttctagcattacccacgttcatatagatgctaatgaatctagacattattatatatatagattcattagcatatatataaatatggacaaaagtcttacacactgtgaaacggaggaatgacatatttcactaggcagccatggtcaagtatcgtttcccacaactcacaagattttaataccattttacctctctctccacctaaagacttcttaccatctcaccggaaaacacttattgtcttggaagcaaatactattcttttgatacttctatcattcgaaacatataatccatatttagatctacaactgaaaattttattaactacaaaattatcgatctcatttagatgatctacaactacaaattgttgacctcgaagaaaaatgtaatcaactccaaatttgtatatctcgtcgagttatacaaatttgatataaagtttatcttcatccaacttcatatgaaaaacttagataaaaacagacatatgtaagtggcgtcattataggtgccggttttaattgtcgattggcacctatgaactcatagaggctggtaataaccatacataatacccatatatgacggttcacagtaaaaaccaacacctttaacatcgtttataggtaccagtttattataataaccaacacctatgacttgagaaaactattggtgtaggtttttttatggacatgcaccaataagtaattataggtgttggttcttaattttatccgttaaaagatgaaaaacgcttcatagatatcggttttagataccggtacctatatgaccggtctatgttgtgttctgcactnnnnnnnnnnnnnnnnnnnnnnnnnnnnnnnnnnnnnnnnnnnnnnnnnnnnnnnnnnnnn

SEQ ID NO: 33768 - DNA, 2080 bp, Oryza sativa
gaatgcatgatttggaatatgcaaactcgtgacttcaaggaaattagataatgatcttgcccatatatacaacacgtatacgttatgcatatacgtacattatactctaggtcacatgtaaccgtgtgtcaaagcaatagacactatcaaaatcatagtatatataagaacgttaagttctcacataaagacaacacaatatgggtatataactgagaagaattgtgtatagacaacctaactacttatcatgtataaaagctaataatgtttgatgtgcatgaatgttattaacggcttatttgtttcctgatgcataaaatgtgtcgaaaattttgttaggcgatagaaattgtaatatctcaatgctatacgtgtcaaacagaaaacatatttaattactgtatattgggcagtggctaccagctagaaggattcaataatctagtcaactagatgattctccgtactttgctgcggaaattactaagtaacttttaatattttttaataattaagctaaaagtaaaaattatattagttattaacaacaaataaaaactggtttgtcaaactatgttaagagagaaataaatctaatagactatgtatgagattgtagatgaaatatatgatgttgcacgctttgattatatggatgaatatatggtaaatattataaaaatattgtgaaaaataatgtgaagtaagataattgtatgttaatttgtactcaatgaattatagatgatgttgcatacttacataagttttgtatgtaattattgctagtggatgataaggtgccatatttgaatgttgagctttagaattagcgggttataactttatagtaagataggatgtggaataaaagttactattatattgttaacaactcatttttctctattttctttaatttttcctcgtacttttcatacttcccctattccccctaaattcgcctcatatcccccgccttcatgtttttctttcttttttcacctcacattttcaccggcccatgtgtcacaagagtgctcatgccggtccggcatctttttaggttgtgccttgactgaggccttgcacgcggggcggcacggtacagaccgctgctgctgtcatgccacaccactgtagaatcaaggagttgatttagattttgtgatgaaaatattggtggtttgctaatgttaatttggagattttataagatggttgattttgtgaagtggatgttttcggttgaccctggcggtcagaccggccgagtgccgtcggtcagaccgcaggtgttgcggcggtcagaccggccggcccgacggtctgaccggcaagatcctgattgatgtcggtttcgggttgttttgttggatttggatattaccttcggggatttggcttctagatggtttctatgcgtatggatactgttgttatactaatgtgagttaagttgggacgaacttgggctcggaatatggtttcttggttgttgcatgtgcaggtgttgcttgagaccttgggatagtgttgccggtgatagattattggagtcaacttgggagaagttgatgtccagggatcaagagatcatgcgggatactaaaggctagaggacaatgcacgtagtgatgaagaaatccatatggtatacaagagggattgtgtacgtatggaaagaggagtcaaatttggaagggagtccgaattcgggaagtttgattgagataaggaaagagatgagttgtttacttgcaagagagggtttcctacatgggttaggagtcctaagttgtgttagattcgtgggctttgcatagcctacctcatgtataaatagagagggagggtgaggcctcccggtatcgattttagagagactagagttgagagaaagttagggttttgaatttagttcgagattttggtgagaagtgttgttggtgcactttggaaacactagttgatgcaataaagtcaaaaagtttcaatctacatcttcgagtttgtcatgaatcggtgtgtctgggtcctgacggtctaaccgcacgtgcgcgtgccgtctgaccgg

SEQ ID NO: 33769 - DNA, 2561 bp, Oryza sativa
gggtttttggttttccttaccattcacctcccctctgataggttattttggtcttgtgtgatcctacactctccttaattctaagtatactatagaatatataaagaatctatagtatatttagagcctattgtagttcagctctacatcttggtgtgtgttgaaatgaatgatgagagggccatttataggtggaggtgccttgggaggatagagtttcttccaagcatccaatgagcatcttcatcctcctagtgccgggtgtccagcttatgatggttttcaccggtgaaaacggctataaccatcattggggagcggattgttgccgaacgcaacctgggcctagggcagcagcctctgtcatggttcggctgaactctggccagcttctttggctccggttttcgcctggacactcatttcgggcccctcattatattggtatggatgtttgtcccatttgaaggtgtttaattgggtttttgggtccaaaactctataagttcggatacgagtttgattctcctcctccttcttgtatatttcttctcgacttagatagtttgtcacctgcattcgaatatacaccaacactcatagaaattgttagaaataaaccctaccactatgttggatgttttatatttatggtcttatgcaagtattgacggtgttaatttggtacttaatagccatcaacaaacccacacacttagctctttactcgtcccgagtaaatgttgaggattaatgtggaacaaaattttcaaaaatataataaaagtacacaaactattctaagccataactgtacctataaactttgcagtgtataacttaccatcttgggtaactgatgaatggaacggttgtgactcaagtccttcatgtttctcctgtcaatctcttgagttttcatatgttttcacaaagtatctatactcctcaaatgactttctctcaaatcacgcatgtggtttaatttgtggatcctcaccaaagatattttgccgaattgtcctattttaaaagggttgatatgttgagcttggtaaggatcaatcggggcatacctgcatcacatattttgcaaagccaaaaggtcggacccaaggagatagcgagttatactctctgatcaagaatgtgcatgtgtgtgatatgtgtatgggtatgtatgtgtatgtgtatagtatatttttggatggaaaaaggaaaataaaaaacaacaactcctttggtataccgcttcctccaattttctctctttggaaatttgagagagtgcatggctatctcctttttttttcatcatgccccatactttgtatgagcagattttttttctattttctctctctcatttttttttatcaatgctccatacttatatgagcaagactttatttttccttcttgtgcatagtcatgcatctctctttcttttttctttgaaagaattttggaggaagagacataaatgacatggagtatttattttgtggataatgaatataataaatgatggatgagagatgctaacttccagtgtagaagtttagcataacgtgcgtatgaggagtgtggtgtgatcttgatcatgaaagtatgaaaagtatctcacacaggtcacaataatttgacaaagctcaatgtaatgtcaagcggcctatacacatataaggttttgcaatgagaatcatatatggccttggtaggtaataatatagtcactaaggagtattgctctaaaagaatttttaattttcacaaaataaaatcccaagtatcatgaaagttggacatgaatttctttcgttcactagcacagaacctttcatctgtgatagccactaacatgcctggaattagcgggccgtcacaaggaagtcatctcaatcgggccaaaaaagcattcgattaagatatggtcgcacagacatattagatgggcataaaactcaggctcgtcatggatgacacctatccgtgacgggccgtagtttaggcccgattgagataacattccatatctcaatcgggcctcaagttggctcccatcacagatgaccatcatccgttacgggcaccaacttagggcccgattgagataacaactaggcccgccacagatgactcatccgtaatcgattgagatgacttagtatttttttctatttttcatatggaatgtttatatttgtgagtcgacctgtagcaaaataattaactgcagtataataattcattttattagtcaaaataatttttcgagtagtaaaggatttcaaatggaaaatttgtcaacaacaaagttgtataacttatcaagatttacaacttttattttggtcatttttctgtgtaaccttttttatcagtttaaatttgaatttgaaaatatgacaactttaaaacaacattttcaaatactaaaaagtcatcaacaaaaaaaaagttgttataacttatcaagatctataacttttatttttgacatttcttaatcgacaaagtgttagtaacattgttcacaaaactcacatatctctcatctg

SEQ ID NO: 33770 - DNA, 5130 bp, Oryza sativa
tttaaattcaaattcaaactgttcaaaaaatgttatatagaaaaatgaccaaaataaaagttatagatcttaatgagttatacaactttgttgttgatgactttttcagttgaaatcatttagtattctaaaatgttgtttgaagttatcatattttcgaattcaaatttaaactgttcagaaaatgttatatagaaaaataaccaaaataaaagttatagatcttgatgagttatacaactttgttattgacaattttgccatttgaaatcatttactacccgaaaaattatttgaatttcttatattttaaaattcaaattttatatagttcaatcaaacccagatggagaaatgaccaaaataaaattagtagatctcaatgagggatgctggggtgtggcatcttggcccaggacttaataggattaatagaatactcataccaacaagttaccacttcttatttctaaagaactctgaggttaagcgtgcttggcctggagcaatttagggatgagtgacttgcacaagcctggagcaagcacatgagtgaggacaaagtgtacaacaaaaaagacttgcctggcctaggagaggcgggacgttacatgggatttcttttttttttttgtggattatactcatccgtgacgtgctaatgagagtcatccgtgacgggcttttttgttggcccgattgaaatgtgtgtcatccgtgacggtcgaatgccccattgagatatttcaccacatcagtgacctttgcttgacggggcccctacccgatagagatggggcttgccgcccattacaaatgactgaacccgtgctagtggtcataaccatatcataaatatcaattacttagatgagcatggttccctatgatagatggttgttcacaagtgacaagtggtagcaaagaataaaaggtatacacgattaatcataggaagattctatttgttgagagttaatgttttcaattttcattttgagtcaaactaaattatatttaaactttcgatgcaggtttgacttacaaacaggggaggataagggaggagacgcgcaaacctgaccacacggcgaaagggtgacagagccaggctaggcaagggtcgggtgaacacttggtttggccaacccagccaggaattggttctggctgctgaattttgtgcacagccgtgggccagcgttcatcataccatcatgtcaagttgatcttgttgcgcgtcgggagttccgaaaagactcccccacatttgtcttgtaccttttctttattcaacaaaaacataaaaaacaaaatgggcttccatcgggatgaaacaccggccaaccaaactttattcaataatcctaggcgcatgaagttcctaaatttattttttttatctttatcttgataatttttttcatggcaacaatgagcatggtgggtatcttagcagggtggagatatgatgcacaaggtggttgagattcttaccggatagttcttaccaagcttagaactaaatcgaatgcaacaaagttttgcatttgttctgcttggttccatgtgcatctttgttttctcggagaccaaggagcgtggtatgagtgttgtagttattttacactgctccttagttgtctttttatttactgcaaaaggttagtggacaacaaatacccgagggattacaaagaattggaaagattttatcataccctcaagatcagttgttcacatccatgctaaaaaggaattgaattcaaaacttcagaagtgtggatctcacaaatttgccataattttattttgtcatcatttttttcgagagacactttattttattcttgaaaacaaatatatatatttttcatttttttattgttcaccaaattttcatttaagcaaaactcttgcagggctgaggtaaatttgcctgaacaaggtaaaggagcattcaacaatatacgcactgtgcaccttgagaggtgatctatttctcttttgcatgttagcaattgctttattcctggccctgtcctacctctagtgtgactcgtgcatgagaactcacctcggttgacggaactcgtcatgaaaagcttgtagacctccccccacacacacacttggacttttgtgtcataagacgtcaaaaaccaagtgtgagatgttggggtctcttgtgttgcatcgccaaggatcaccaacgtgctcggttgatgtagctcttgcattcttaggcatcgtatgaccctcgttcttaatctcaacctgtgattgttagtgaccaagaataccggaatgtgcatactattctaaaactggtccttgccttcattgaaaaaaaaacttgccatgataatccggggtaactcctggcagtgctttgtttatggtcacaagctcagccatagagacatcttgctgcaaagttagtgccacaaacacatacgagatttgcaatagttatgataaatataagcatccacaaccacacttctaatcatgttagaaatgatggccaaaaggcggttgtggtcctcgcacaagaaagcgatactaaactaataggaccctggggattccttatgtgagcatgaatcttggggaattttgaaagagaagctttcatgctcaaagtgccgttctcatcctccagagttgatgtctcaagcttatccataacccaaaggttctccttctcaagagatgcatcgtgcaagaacgaggttgtttcttgacaactgtcaagaacaacatattgagggccagagagataaggttttggctcgattggaggtcatgatggtggttttatggaatgtaattcaaagatctcaaccgactcttctttttcttggataaaatccagagcgtcttgtttagaagatgatttgagcagctaaaatggaagaacaaccattatgtcctccccgatatcttcttcaggaagggtatcagtcaaggcttttcttgactgcgagaatggaacaaagaaattgaccctcctaaagagaatttgaggctacctaatcgaggagtattgatgagaagtttctcgattggatgtcttattagaacatcaaaatcttggatttcaaaaacatgaataatccaagattgcctccttgccatcatgaatgacaggcacgtcttgtacaatacctaattcttcaataagactcccgttagggtgctcgaagaatttgtttgtcggtgtaattgccttgtcactcagaatagtgaatacaaaggattttgagacaatattggcacagactgatggactgtaaaggataccaacattattcccttctaagtgatagggaatggttcgaggagcgatatttattagaattacttcggaagaaagctctgcctcctttagccattcgtcactcatgattgatgtcagctcccgaactgtttcctttagatatccatattctattggatcgagagttggctagagaataggtggccgtaatattcgagaagatcgtccctgaatttgggagcacatcccggatcatgaatttcttcaatatctggagatagttcccgggaggattcctcagttagatctgatgatgttgacggttcaggttcctccgtacctgacacagatgcctctggagggggttcaaatcactgcccgaaggtatttttggatattctatcgagaatttcctttccttcgacgggggttttgtgcatgaatgacctccagcagttatgttgaggtaaagtgcagactccttatccaaacccgtatggaaatgttgcagtaatgcaaaatcgggtatggcaaggttgggactagactgtaccagagtaacaaatctggcccaagctgcacctattgatttcttattattctaccgaaagctgaggacttcgatccggaggaaagtaatacgactaacaggaaagaatgtgaggcacaaaatctgtctcgcaattcattccagctaccactcacactcccaacggtgtaaatgtaccattgttttgctctctcttgaagagagaacggaaacaatttccatttaatagtctcccgtggcatgccttggatcaagaggcacgaacacagatgctcaaactctcgcaggtgatgataggagatttcctggtctagactagagaaagatttctccctaaccgtaatgatgaattcgggacgaatttcatagccaggtgttaaataggctccgatgaaggaggtggctcgtaaaatttgccccgtggagcagatagttgaaagatatattgtggctccatgggcgagaagagttttacaagaacatttctctgggtagcaggggtgaaggtagaagaaagaaaagtaaaaaggatatgaggatgaacaaggtgcagagataaacaacaaccgttctccggcaacggctctagaaatgcttgttggtatttcttaacgtcgcagatagaatttgcaagcgcacggaagataccgatgtagcacttgacccgagagtattccaaggtatcgatttctgcagggaacgtgtgtgttaactctttaccaggttcatctaaggacacgaagcaaagataggcaaagggtagagaggatttactagtgggagacaatgtctatggaaagcttaatttaatcctaacgcgatacttcgggcactggccagcccgctgctcccagatatggctctaccgcgtactcggacagggaggacttcagtgtaattgagggttgtcaccaactctacacccacctcaaacctactatgggatatgaagcaatcactggaaattaactacctagacaccgcgtctatgatattaataactattctagtgccggccaaacactaatgcaatcattataaattaatggactatagtgaacaatgatcctgcatgctaattaggaactaaccaataattaattctcacaaagtaaatcttaattactcagaatgatatttctattaaaccagagtaattaactgtcggtgacatgggatcaggagtatcatgactagaggtttgaggcagacacaatcgcacacgtggcctggtacccccgagggacgtcgggcccgagggtgatgcgttcgccctcctcttagtccccccgagggg

SEQ ID NO: 33771 - DNA, 2242 bp, Oryza sativa
  unsure (1)..(2242): unsure at all n locations
nnnnnnnnnnnnnnnnnnnnnnnnnnnnnnnnnnnnnnnnnnnnnnnnnnnnnnnnnnnnncgacccctcgtgggtttttgctccgcgtgtatgggttaggtgagcacagtggggctcacctaaccacatttattgcggtttggctgagcgtgtcacgccgcatgtaacgcagtgcagtgcacttgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctagtcagatatatgccaggcttcatcctaaaccattacaggcaagatgttgtgtgaagaagggcgagcatgtagattgctaagctgacacgtggtggacaagaatgaccgacgtgactggtctgataccggtcatgtcgtcagcagacagccacgattccacgttgcacctgctcccggcgaaagtggaggtagttgtgggccgtctcatcagaaggtgactcggacggcaactatacaaacctccgtccatttatgaaaggggggggggtaagtccccacaaaaaagagagaaattgtgcatgtggtatccccttaagatataaaaggaggaccttgcccactgagaggggggactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcatctggcgcgccaggtagggggctctgcgagggattttctgagctctcgcactctttcgtgtgcgccaagtttttcctgttcagcccaatggccgagccagcaaaggcgcacgacctctccccgagtatgagcggtgacgacggggagccaaacccacgccgtcgagctcgtactccaccgccccctccacgccaaagtcctaggcgggagaaggcgctcgagagggccgaaggatccgcgacttcgacacccacaggaggtggagaagggcggcgagatggggagcgtcgcctcctcgtctacggcgacggcagcacgccctagggcgcgctccaagctgcgggcgcgctcctacatcacccgcccgtcgcccatgacccggagtctccagcccaacgttggctggacgatgtggccaaattggtcatgactgcacggcagcgcctagatgctggtgggcggtcctccgccaccaaggcctctggtgctgctaccaccggctccgcatcgtcaagacggagggcgcggcgagcggcagccgctgttcgccattcggccgccactccttcgtcaacgcctccgacccgggaagatctgcgtggggaaccggatgctcgcatcagtatcgagcgccggcgtaatggccgacgtgctccccacgcaacggagggcgcctcctcgtccggagtgtcacctcaccacggacgcggggatcagccctccgtgcccccggttggtggtgtcggctgtagagcctttgtgacgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaagcgcggggttggctaatgaacttgccacccgcgtctgttcactcttgggaggatttgtgccaacagttcaccatgaacttccaaggcacatatccgcgtccaggtgaggaagcggacttgcacgcagtacagcgaagggatgatgagtcacttcgctcgtacattcagcggttctgtcaagtccgcaacaccataccatgcatccctgcgcacgtggtgatttacgcgttcagggggggtgtgcggcacaaccgcatgcttgaaaagatcgcctccaaggagccccagactaccgcggagctttttcagctcgcggaccgagtggctcgtaaggag

SEQ ID NO: 33772 - DNA, 1771 bp, Oryza sativa
  unsure (1)..(1771): unsure at all n locations
cgagctcggtacccgacgacgagggtcatgtcctcgccgtcgagggcgcttcgcgggccacccgaaaggggaggcctgcgggaggcaaaaagaacgaggccggcgctcccaacagggagcgcccaaccggcaagtggtgcaccgtccacaacacttcccttcacgacctcgcggactgccgtgcagtcaaaagtttggctgagcggacgaggaagtgggaggaggagaggaggcaggagcgccgagagggcaaatccccggcggttccttccggtaatcggcgaagtgaggccaagcagaaggcccccgccgaggacatcgatgacggcgatgatgacctaggtttccaagagcctggggccaccattgccactgtcgatgggggagcgtgtgctcacgtttctcgccggagcttcaaggccatgaagcgagagcttctggccgcggcccctactcatgaggcgacgtgtcgggcgcggtggtcggaggttgccctcaccctagaagcttgcccgcaggtacaccgaccacccaccgtgcgttgcccggggagggcagattgcgatggtggtttctcccaccgtttgcaacgtgaagttggggcgtgtcctcattgatgggggagcagccctcaacatcctttcccctgcggcctttgacgccatcaaggccccggggatggtgctccggccgtcccagccaattatcggtgtgacgccggggcacacgtggccgttaggtcacatcgacctaccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctacagatgaagatgccgggccacggtggccccatctaccgtccatggcgacctcaaagtcgcgctcgcttgtctggagcagcgcgcggaccacctcgccgctgcatccaagcccgagggtggcgacgagaggcttggcgcttccgccctcgccaccccgagccaacggatgatcacaggcgacgaggtcccggtcaaggaggttgccctgggcgacggcccgtccaagaccacacggatcggtggtcttctggacggcaaataggaagacgcgctcgtctccttcctgcgggcaaacgctgacgtcttcgcatggagaccggcggatatgcccggggtccccagggaggtgattgagcaccgtctcgccgtgcggccgggcgcaaggccggtctggcagaaagtgcggcggcaggccccggaacgtcaagccttcatccgcgaggaggtggcacgacttctggaagccggattcatccgtgaggtcatccatccggagtggctggcgaacccggtggtcgttcccaaggcgaacggcaagcttcggatgtgcatcgactacaccgaccttaacaaggcatgtcctaaggatccttacccccttcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacgacatgccctttgggttaaagaatgcaggtcctacttttcaacgtactactcgcatttctttgnnnnnnnnnnnnnnnnnnnnnnnnnnnnnnnnnnnnnnnnnnnnnnnnnnnnnnnnnnnnnnnn

SEQ ID NO: 33773 - DNA, 1499 bp, Oryza sativa
tgtgttttctagatgcatactctggtacccatcagattcgcatggctagggaggatgaggaaaaaactgcgttcattacccccataggaacctattgttatacgacaatgccctttgggttaaagaatgcaggtcctacttttcaacgtactactcgaatttctttgggtaaccaattaggacgtaatgttgaggcttatgtcgatgacttggttgtaaagacgcgcaaccaggaaatgttactctcagatctagcggaaacttttgagagtctccgctccgcccgcataaaactaaaccccgataagtgtgtgttcggtgtacctgcgggcaagcttctagggttcttggtctctgcccgaggcattgaggccaaccctgagaagatacgggctatagagcggatgcgccccccagcaaacttagggatgtgcaatgcgtcaccggttgcatggccgccctaagtcggttcatatcgaggctgggagagaaggcgttacccttatttaagcttctcaaacgctccggaccgtttacctggacggaggaagccgaaaatgccctcacccagttgaaggcgtatctaagctctcccccagttctggtcgccccggagccagacgagcccttgttactctacttagcggcgaccccgcaagtagttagtgcggcattggttgtggagcgcgatgagaacaattctcatttcacgcttccccaccctgtgccgacttggcccgggagagagcagggaggagaggctcccgagccgaacggtggcccaaggcccccgacgaccggagttggccctctgcccgcttgtcagacggtgctaggagcccccgaccctagaggatcccctgaggccactgtgggaaggccgcacctatcgcccttcgaccccgaggctaaccctgtgctgacccgacccgggaaagagcagggagaagaggtccccgagccgaacggaggcctaaggcccctgacgaccggagttggccctttgcccgcttttccgacgacgccaggagcccccgacccccaggacggccccgaagccactgtgggaaggccgcccctgttatcctccgaccccgaggtcatcagcacagaagataagtgcgcctcgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgctattattttcaggcgcatcgggtcacagtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccgg

SEQ ID NO: 33774 - DNA, 2052 bp, Oryza sativa
tacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctcttaatgatgcggtcgacctggtccggcgatgtagagcgtgtcaattccacgccaagcaaatccatcagccggcccaggccctgcagaccatactactttcgtggccatttgctgtctggggactcgatatcctgggaccgtttaggcgggccccgggcgggtttgagtatctgtatgtcgcgatcgacaggttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccagggaaacgcctttcttcctcgtctacggcgcggaagcggttctcccatccgagctcaccctgaggtctcctcgggctaccatgtattgcgaggctgatcaaaatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaatgcgtgctggattgagcaagctttcaccaatgtgggagggtccgtatcgagtggtcggcgtcccccggccgggctccatacggctggccacgggcgacggcactgagctgcctaacccgtggaacatcgaacaccttcgtcgcttctacccctgagggggggggtcgggtgtcaggtttcgggctcgggccaaccccgcacccccctcgggcgtgcagggttggccgggggctacaacatatgcatattcttatttctcttatatctgaatttctataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccgaggcgtggtgaactccgggggggaatcggcaaaaacccacaatcgggtcacccataaccctcggtcaccacgttcccggcctggccagtctcgacatgtggatctccccaggcactagccccgacccgcgccttttgaggaccagaacctgggcacaagcccttattcaagctaagacacaaaaggaccacgacacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgccggcctcgacgtcactgtcgtctgcaccaccggcattgccctcctcgtcggagttgggggcgaacgcaagccgaggggccgagccctcgaagctgtcgacgatatggtcggcggcatcctggacctgcgcgcgcgcgcggtccttggtcccaggagggaactcatccagcgccatccatggagagaaattggggtctctggcct

SEQ ID NO: 33775 - DNA, 3148 bp, Oryza sativa
ttgcttcccggatggtgacggcggcctcgcggtccgccagatccctctccacgacgcaggcgcgctcttccagcgccatggcgcgcgcctcaagggcctcttcgcgccgccgggacgccgcttcggtctccaccgcccgctgttctcgggcagcggcagcgtcaagcaccccctgggcggcgtcgagcttcttccctagctccgcctcccagctcccgtattgaaggcggagggtgtcctgcgcctcgttcatcacggtggtggcaatgagggcagccccccgctcctcctccacttccttggcgatctccgccagcaccttcttacgagtttcaagctccgagacgtgccggcggtgagccttacggcccacctccaccatggcctccaccgagcgtcgccctcttcgacacgcgcccacgcggcgtcgagctccgcccgctctgcctgcaggacctccacctgggcacttaacccatccaacaccgtggtgtttgcggcggccaaggcctgcagaaggggctctgcgttcagtagggcgatagaaggcgtggggaagagccgccttggagaggatgccacgcggctcgggccgccgatggaagtgccggactcggggatgtcccccggacccggttggtcctgagcgtcgcccgagggagtaggcccaagcgacgcgcccgcggcctcgtcgccagctgccccggaagttgtcgcctgagtgtcgcctgagggagtgggcccaagcgacgcgcccgcggcctcgtcgcgagctgcctcggaagtcgccatcgtctcgtcctggcgaaatccggcctcctcccgagcggcttccccggcctggcgggcccgggcggcctcctcccaagcggcttccccggcctggcgggcccgggcggcctcctcccgagcggtttcctcggcctggtgagcccgggcggcctcctcggcttcccgtaggagatccgcggcctctcgccggtcagattcccgcctgagggcctctgcggccgccggatcctcggcctcagactggccggacttggaatggcgggagggacgcgacgggatctcgctgaaacgaaagaaaaaaccagaagacgaacaagatgggtgagtgaaaactcgcgttgagagaatgaatacagccacgatgggagagagacgaacctgcgagggggtcggttaaacgaccactttggaggggaaatgaggtttccccgagatggttctgtctcccccatcttacggggccgcttcttcttgcgctccccctcgggctgcgatgttggcgcagccccctccgggcgcctgttactggcacgcgccgccgcgccccctcggggaggagatgggggaggtgttcctccctgcttcctcttcccccgggcgtcggcagggcggctgctccccgggcccctgtcgcgggacccagaagcacgaccccctctcggggtagattgttcccccctgcggctcccgcctgcgccgtcgtggccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcggacccggtgtactcccaggcgccccgagcgcgtcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcaccgggggctggctcggaagtcggaggcgcgcttcgtcggcgaggggagtgtagaaccagtcactcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggtggaaccagccttgccattgcaaaggggagaaagaagacggaccgccccgggtagtctggcgccgggcgtccctcgcccagcgtgactatctcctggccggtggcagattccggcatgaagcggcgcgacagcctagcctgcctctcgctcacgatccgggaaggcggcagcacgctaccatcgagcagagcggaaccccgtgccatggcgccggaggaagagaagattaagagcgagcgcgtgtggcgaaggtagggcacaggaaagaaggagttagggcgcaagcggcgaagacaaggggaataatggcgaaaggaaggaaacagatcccttcctcagtgcctttatactcttgccaacgctgtgcccggctcctcgcttctcgcgcccactatttcgccccctcgtttctcgcgcccacgcttccactaatcccattcgcccgcttgcggcgcatgaggtgggtatgcggttgtggcagtcgagatagatcatatcgtgcgcgcattaattacgctcgccgaccgaagcgacgttaccatatctttagacgaaacgaatcgccatgtccagattcgtgtgctactcaagtaatgtggcagtcttgaagagaccgctcattgttgacagcagagttaccattgccgatgtgcgtggtttgtgaccgttggttttctgcccaattgtggagaccggtcccacctgtcaccaggtcttaggagtggcgtcacgcccgaccgtttcccttaaagagggcgatcgccctggcataacgccgggggctactgtcggtgacatgggatcaggagtatcatgactagaggtttgaggcagacacaatcgcacacgtggcctggtacccccgagggacgttgggcccgagggtgatgcgttcgcccctctctttaatccccccaggggg

SEQ ID NO: 33776 - DNA, 9541 bp, Oryza sativa
taagctgacacgtggtgaacaaaaatgaccgacgtgactggtctgataccggtcatgtcgtcagcagacagccacgattccacgttgcacctgctcccggcgaaagtggaggtagttgtgggccgtctcatcagaaggtgactcggacggcaactatacaaatctccgtccatttatgaaagggggggtaagtccccacaaaaaagagagaaatggtgcatgtggtatccccttaagatataaaaggaggaccttgcccactgagaggggggactggacttttccagattagaaacccataacaagggagaggttggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccaaaccggcaaaggggggcctgcgcggtctcccggtgaggagccccacgctccgtcattaacgaagtacaaaaataaggaaaggattaccgataactccggaattcctccgacttctattttactctctccctaattctaagtatataccatataacatataaagatcctaaagtatacttagggcctattgtagttcagctctacatcttgttgtgtgttaaaatgaacgatgagaggagtatttataggtggaggtgccttgggaggatagagtttcttccaagcatccaatgagcatcttcatcctcctagtgccaagtgtccagcttatgactattttcaccggtgaaaacggccataaccgtcaacggggagcgatttgctaccaaacgcaacctgggtcgaggcagcggcctctgtcatggttcggccgaactccggctcagttggccccggttttcagcctggacatttattttggaccccttattctattggtatggatgtttggcccatttagaggtgtttaatttggttttgggtctaaaactccataagttcggatacgagtttgattctcctcttccttcatgtatatttcttctcaacttaggtagtttgtcacttgtatatgaatatacaccaatactcatgaaaattgttagaaataaacattaccactatgttgtatgttttatatttatagtcttatgtaggtattgacagcgttaatttggtacttaacggccatcacaaataatcacctatataaatttactaactaaaaggggcatctatataagatagccatagctcgcgagacaactcattcatcataacgttatatcaagtgatccaccaccacttagaacaaagctttattattttcctctcagtactcatgcatgctttctgtcgttccatcaattaatatagccatataattatcactcaagcataggattgcgaggcatgagtaatgcctgaaattgggcgctgttgagatagtgtcttctactgaaattgggcgcctgtgagatagtgtctgctaggaacattttcgtgcagattcatccaattacatctaaaatatgttatgtggcttcattgtaggccaaggatgcatgtagcaaactgagaatgaagccagaaccaagcttagagattttggctaagtggctaacagcaaggccatcttttatgctaggcatcctttggaagcaaactaagggctcattcgaaatgtagggttgaaaaaaatataaaacataggatttgaaaatacaagaatttcggacatctttgaaatgcaagattgagaaaacataggaataagaaaaacataagaatataatgttatgattattgaattcttatgggattataaaacacagaaaagtctctaaactatcgtttgattagcacatagaaaaaacgcaggaattttagacacatgaaaaggaaaacatggggtgaggcctcatacttattttcctccaaaattgctgtagcataggaatttcaaaggaattggtagaaaacaattatttgttttaaaggactctataggattatttctcataggataaaatcctctaaaattcatgtggtttttcctttgaaacaaagggggccttcataggaatggatgtctagatgaaccatgggaaaaacacgggaaacaacggtacgtgaaaagtttattagagagttaactatagtcttatccctaaaaaagcattaaataataaaaaggagaagcctgatgatgcttaagccttgcgtacgttagtgtggcatcagggcttcatttgcctcgatcctccgcaatgagaaagaaaacaaagaggtcagactggacatttttcccctgcagttttcctacaaaattagcaccataagaaagtttccaccatttttccaaagggataatcctccattccgaatggacaaacagtaccatttcctattggaattagaatcctctgtttttcttccatgaatccccgatccaaacaagccctaaacatcatgatgtataaaagctaagggcccctttaaatcatagaaataaaaaaacgaaggaataggaaaaacatatgattatgagagaaatacaagtataaaacagatgattgcaaaacacaggaaaaaatcataagaatgattgtttgattgagccgcatgaaaaacacaggaatttgaggagagataaagactcaaaggattcttaacatgaggcaaaacctcatgttaaatttcctccaaaacttacatgggaagagacattccgtaagaatttcatagctaggattccataggatttattcctttgattcaaagggctatataaaaaaaattcctataggaatgaaaccctttaaaatttctatgaatttcctttgaatcgaagggggccaagaatgttaacagcttattagtttcctgatgcatataatttgtcaaaaaatattggcggacgatagaaatcgcaatatctcaatgctatgcatgacataatgaaaacatatttcattatattggacatagcaactactagagcgatttaataatccagatcaaatgtggaaagctcctattatgttgttcatcagtagagcttctccttttccactgttacaaatggattttcttaagcttcccctcattacaattgcctgcttagtgctaagtagttacaacatataggatatgcaacttggtatttaaccaatagaaataacgtgagatgaacacaaacactttattataaaccttgtaaccatcatcattttatctgtctcatggatatatactggggaaaaactcatgcgcttatgtgtgaagcatgatttaatactattacatggatatccaaaatgaatgtaggactgttgaatagatgtagtacaaatgagcacatcaaaagttagaaattaaattgcagggaaaatgaaagcatgcacggaaatatagcatggtgcatgatgtactttgttttcaaccataaataaacagctgccatagctattgatatcatatcagcacatacatttttttgatcttttgcgattgagaacagaaactttgaatcaatgaacgcaaaattttgaaggaaaaattaagtaaatgtgacggaagctttttctttttttctttttacccaaacacagcatggagagcctcctactgtaattttccattataaagagaaagttatgtacaacaggcaaaaaataatttttgagggaaaaataattacaaggagaatgaagaatgtacaacattggttatgctaaaagtcctagctatgatgtctaagtggttttttttcttttttttttttttgctctgaacacatgcacacgcaaagcaaaatcctctttgaaatgggaaaaagctttgatgtggcaatgccatgccacaggatagcaacatacaatgtggcacctcttaccacataaatagtgttgtaatgaagctttgcggtggtaatgtcaaagaatattggcatggtcaaaaggttcaggttaaaaaaaaagtttgacattgttcgttgttaaaaaaaatgcttttttaaaaaaattaaataacaaaagattcagctctaattcacctatggggcgatacagtacatacactgcaacccgtgcaactatgcaatatatttattccctatgtttatctcttggctttgcaggacggaacacgttcttctgggtttaagccatgaactggtcttgccttttatttttaatccgcattgaatttatcttgttagagatgacacaccagagccatggcctagtccctgtggcctccaccctgactagccacttgtcaacagtaggttttaccaaacttgcaatacctcacattacatttaaggaatattggcattattaatacacaacaatttaattttttgtccatcaaacatcatttttttttaccagagagagtaaccaagtattcaaatcgcattagatgccttctcttctgcgaattcagaaacagctatctcatcttataagttcagatttcagaatgaactccaggataattgagccaccagcgaatcctcggcccctccaagcaacaatcgcccagcttcattccccctgctccagctttggggagcaggggagacagggcgggacactggaacagaaaatgaaattgcattagtccatgctgagcaaaagatgaacaaggaacgtcctcttggtgtcctagaacccctggcagggccatgaatgctcacatggaagaatcgcccatttttcgcttgcgattgcgtggcagaataactcacggtctctgaatgcacaaggtgaaaatggttccatgtgtttctggtatcccagtaggccagtatacttctgatcaatgctttgtgtggagatctctggtttctataaaccccaggatgatgatggctcttgtgagttgtgaccaccaatttgtccaatggttgtccttgctcccagctgcacatgaagagcatgagaaagtagtcaattagttgagaacccagtactgtagtactacgaataattgagctctgtgcgatacttccaagttccagcatgtattttaccagtatttatggttcaaggggcaataattatattattattactattgaatgaaaatatcgacaacaataggactgcttatttcagttgggaatatcaaaatcaactggaacactgagcattcactttactagcagataaggtgtaagttgcaaatactcctactagatagtaaagagaaggaccagttatgcgatcgatttcctcacaatagtttgtccactgatacaacatcgggtattcttaaagtagtaaaagttttgtacgggaagcataatagatggcatcaaattgcatgtcagataaatgtgatgcagataaggcttccacagaggagaatctaatgtatgcaaaaaatgcaaataaataatattcttttggaccaaactagactccaagttatgctgtagtacctaggtttttgatatgcctaaacctatgatttccttgtgtttcagtaatgtgatgctatcgacctggagatctttaaaatcataaaaaaaaaagtactagatatgtgaaatcatccaactcaggagtcaggaagcacaaaattaccgttggcacgaatttgaaggactgattagttttaatcctcggacagcagcctgaaagcaaattaaaataacttatcatgagtcatgattggagtgacaaaggtaaaaaggaaagaagggctggagagtcagaatgacctggtgatcaaaacttcgatgatcttcctgaatgatggaaaacagaaaagttacaatataagccaatcagatcttctagtctctataaactaaagcaacaatatcttgagattagccttgaaaaaagaagtcctgaactgatgtttcaaaatttgttcacacccttccttacaaaagttcaaagaatgcaaaagcatgtcacagtcttacagaatgtgaattaaaatgtcaggaaagcctcatcggacaacatgaagattcaaaattagatcggttagacttctactagtacttcataaattaattggtcacttagtcatctcttagcattaggtgtcctttttgttaaagaataaccttgacactgtaaacattagggtaataaaaaggtaaagataggaaaaatgatgaaatggagcacacggcattaaacgaattttacaggaaaaagttcaattccctaaatcagggaaattcctgagaaatagagtccagagtgtccatcagctttctatgtcatattatcttcatctattttgtgattttccatatcaatatcatctctttgggtaatgctgcttaacctcagacataaataaacaacaaatattctctttgctaatgacaactttcagtagcatatataaaaaattcaatcaatttatcactccaatgttgtcttatattcacatggaaattattataagattttgcacttaacattcgtgtccctgctctttttttattctccacaacaaatatctcctaaatgtattacagaagagaatcactactgtaaatccaggtaatttgttgtcttaatttaattcaatcataaatagtgttcaagtcgacaatgagtactcaagcataaaatttgctgaataatccagccaaaactaaagataaatttccacagtgaaaatatgagaaatcagacaacacaaagtacccatatatcattaagaaaaaatgtatgttcctatagctctaatgacccaggagacagtcagacagtatgtctgtactgaggaagaagcggaacacaccacaatcaaatgtgaagttcatcctggtatgagttgtcactgtaaaactacatcttgacatgagcacagcaacttctgcctgcaatgcaaattctcagtggaggttttgtttcttgaaaaagaaatttcttctttaaatggatggtagttcactattaattttacattcatgcttgtaacaaaataagagcagaaaaattttaccttgtaaacaagcttggtgaaaaaaaatttaccatatcataaattcataatagatggaagaggattgaacatatacgactattgatctagatgaaggtcacagactggcagctatgtaatcagcatggtccagaactataaactgccagtagggcatttattaactggttgttgctgtcatgatgacatgtggtgtaaaggccaatgcaccttgaaatagccaggcaatagatggaacatgattcagcgattttgaaccgtatagcgccaacaagagaataacaaaaactcaaattttaacaaaataaatcgaagtggctaatggatttctatcaagtatccctgcagtcccattctaaggatccccagctgcaagttgcttgcagctatgttcctcagccaaagtcaagattgctagaagctaaaattgaagtaagatcagaaaactatgtaaaggcctaaaaccagttgcacttaccagtgtactaatattgaaaagtgttcttctttcaaataagatgtttgagaataatgtacaacacataaaactgggaaagaaatttctatacttactatttgtaacaaatatgccatgctagtcaaagaaacagataagtcgtgtgctcccaatttgtgatttcagtagtttgaagacaggatctcaatatgattcaccagattaatcaaaatgcaatgggttggggtgatcacccaaaaagaccgtatggagcacttctgctgctagctaaagcagcttcctcaaatatgcattgatagtaaagaagactcaactgcccagagaataagtgacgtctacttatatctgagatagtacgcagctatttgctcctggtgagtggtgacagaaccagagcttggttcatgccaattgcagcaaaactctctgccttctatttaccaaaagtgatgctctccagtttgatccagaaagaagattattagcaaacctgatacagttgtagaacaataggaagatcccctttacccatgttactgcagattattcacaacacctgatgaactgaattagactttttcagttacacttggaaaacggctgtaaaagagcactccagcgattaacttctcccataatcacagtgaagcaatgtcagcaaaaactagctgtatcttacacagttgttgccctatcaagcattgaatagccccagtacctagccacaaaaaggtcctgccacaaggactcaaggacataaggtcctagggtcccaactctcaacctttacacatgagctgcacaagacagacaagcaggcaagatcttcaatagttaagcggtgtgcaatttctttaagcaatcaaagggggtgtcctctatgattcatgcattcaatcaaatcatcaactgctgatctctctctctctctctctctctctctctctctctgctatacaacttaccagtccatcctgttcaaatggtaatctagtatttattttgcacatgtaggacgagcaacactcaactaagcacttctgatgctgcagtgttctacattatctttacccaatggtgcttgctctgtatgtctcatgagggccattaaaccgtcaactgtttcatatatctctttcctcctcttatgccttgtatctttagccaaaaactcatgaacctcactgcctacctggattgagctacttccaggcactttctcaattccccaattacgcatgcttgtgcgtgcatcgatcacaccatcccaccttccttccaaagcactacaattagaaaccaggacttgataactagaattaaatggttctagttcagttatcttcttactgacatattctataagctctgcattaccatgtgcaacacaagaacaaagcaacgtgacccatatgacaacactaggttcaagaggcatgctttcaataaataaaatcgcctcctgtaagttacctgctcgaccaagtaaatccaccatgcacccatagtgctccattcttggttgaatgttatatcgctcaaccatttcattaaatatactccaaccttcttgcaacaaacctccatgagcgcaagcagcgagtgcagcaataaaaactgtgtcatccagttgaactccttctctgcacatattattgtagaccaaaagagcgtctctacaaagaccattaaaagcaaagccagaaatcattgttgtccatgtaatgatacatcttgtttccattttataaaaaattgactctgcccttcctacatccccacactttgcaaacatgtctatgagagcatttcctagtgcaacagtgagatggatgttgcttttaccaatgaaagaactgatccagttgcagtattcaacactgcccaattgagcacatgccgagacaacactcactaatgtcgcctcatcaggtctgaaccgtccttcaagcatcatcagctgaaatgtgcgcaatgcctcatcgtatcgcgagttgtgattgtatccagttatcattgcattccatgaaac

SEQ ID NO: 33777 - DNA, 243 bp, Oryza sativa
aattcgagctcggtaccctgtcgtgcggcagatcagcggcgccggcggcgctcgttgcacttgtggtggtgtcgtcggcgttgctgtcactgtcagctcgctgccagtgccacgccgcgcgatcttcccctctcgcggccgccatgtcgccgccgccgtcggccggacaacggcggcggcggcggcacgcggcggcggccgcgtgctgcaggaaggaggaggggaaggaggaggagatggagg

SEQ ID NO: 33778 - DNA, 1024 bp, Oryza sativa
  unsure (1)..(1024): unsure at all n locations
tggtccatatgtcctgcgacgcaaatgttgatgtcattgaagctttccttggggctcgcagaatgcgaggaaacattgagtcagcaaagtgggctgcctctaggctatttagtctaaagccagatgatccaatcaattacctgcttatatctaatacgtatgctgctgcaggagattggaatgagcttgcaaaggtaagaagtgtaatgaggaacatgtgtggcaacaaggtgccgggctgtagctggatagagataggtggaattgttcagacatttgtatccaatgatatgatgctccatcagtcaagagagatgcaaagaatgatggaacttcttgtttcattagtggaacaagattgcaatggtgatgacacaatttgcaatgatccatcatcgattttaaaatggcaagatttttatctggcatttgattaattcagctgtttgggataatttcacaatggaatactgtcagagcttcctaatgtgactattctcaggtcattccgagatgtatctattttactgtttttttatcctttgattatatacacaaacataatatgcttactagaattaccttgtgcaggttttcacttaccatagacatgagataatgtacacccaggaaggaaggaagtctaccgtttcttctaggtaatccatgtaaatatcaaaatatggtagaacagccacatactgatttttgtatgtaagcaaccatatttgttttgggcaatcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33779 - DNA, 528 bp, Oryza sativa
  unsure (1)..(528): unsure at all n locations
nnnnnnnnnnnnnnnnnnnnnnnnnnnnnnnnnnnnnnnnnnnnnnnnaattgggtgtatctacgtccccaatcttggcataggcagaaaccatagcagtccacgaaaccacatccttttggtccatccgatcaaacacggaacgtgcagcctccacatcaccactcatcgcataacccgaaatcatcaaattccaagaaacggcattcctagaaggcatcctgtcaaacacagcccgcgctgtcaccatgtcacccatccttgcaaacccggcaacaacagtgttccaggagacaacattcctctcaggcatcgactcgaagaaccccattgctcccgtagcgtccccactcgacatgtacaccccaacaatggagttccacgagaccacatccctgtcaaccatttcgtcgaacacctgccgagcggtcccaacaccgtcaccgtcaccgacaccgtacctgtggtacacatccatgagcgcgttctggacaaaaacgtcgctcccgaacccgcacctgacgatct

SEQ ID NO: 33780 - DNA, 189 bp, Oryza sativa
  unsure (1)..(189): unsure at all n locations
annnnnnnnnnnnnnnnnnnnnnnnnnnnnnnnnnnnnnnnnnnnnnnnnnnnnnnnntacttgccggcggagagccttactgtccacctttatcatggtctccacccagcgtcaacctcttttacacgcgcccacgcacgacttatcttctgacgctgtggatgcatgacctacacatgatcactgaa

SEQ ID NO: 33781 - DNA, 953 bp, Oryza sativa
tgccttcaaatattaaataaatcaaattttcaagtatgtaataattaaaaatcaattaatcacgctctaatgactttctcattttgcatgcccatacttaatcttcattggatgctatgttgaatggggcataagggagcataaaagtgtaagtacgatgatatgtgaatatggggtcgctcaatatgtagatcggataaatgcggatttggaggttggggtgttacaagtggtatcgaagagtttaagtgatgtacacaaatatggtacttagatgaaatatataatggggcttatttcttttaccactagagaccacggtaaaaaaattgtcctatgttggatcggatacatcatcagttcatcactgaagttcttaccaatgctgtgtttgtgagtcagcttataaatgttggcttgtacgtgacttgagaagcccaaaactaccatgaactctttttcccccaaatttgcttcagtctactgtctaggcccaatgcaaatttctggatagcatatgcacagtacaaaactgtctgttgtatttggatttggatgcatcgggaaaacagagatgactagaagcagaaactacccacgttcagtacctactggatctagtcgtatatctcaaccatggaaacacatgcatctttggcctaacagttcaattttgttgttgaatcttcatcaagctttttgttgtgccttcgtcaagcaacaaaaatccatgaactgcaaaaaaaaaaaaaagtacgctgaagaattacctaacatctaatacgtactctggcgtgcgtctatttgcgtgtaccttcattagtatcttaccctatcctcaaagggattcctaattataatgtggtctttaactttattagggttataagaacatcaaccgttggatcaacagccaatggatggtgtaaataaacttagattattctaaaaag

SEQ ID NO: 33782 - DNA, 3520 bp, Oryza sativa
  unsure (1)..(3520): unsure at all n locations
gaggaatttgggccgagcccgaaagggaggaagggaaagttatatttgttttctttttatttaattgattaaatgcactttgtgatgttaaaattacttcttgagctccaaaaattcacgaaaaaaatctggagagtaaattagggaacagagaatattaaaaaatatttccggctaatgatttttaaaggaaaattttaatttcctctataatttcacttgattaaattgattaaatttttatttaatttctgggaaatacattattaaatgatttttaatcccgaatgaaaatcggggcgttacagtgcgaggccatcaggcagcagcacgagcaactccggtgaggcgacccgctcgccgatgtagccaaggaggagatgcagcggcggtcgcgaggggacttcaaatttttgttaatgtgtcaattttgtgatgcttgaatgctaacgtgaatggaaattttttactataaattgttgatataaatttctgtggaattttgaataaatgcttgggtaaatttctgtgaaatttttgaatggtggagcgttgacggagacggacggagcggtcgtctgtcgttttttttaaacttggccagtattaacactggtggctagcacagtgaaacccaccagcgataatttattttcgctggcggcgtcttaaggcaaccgccaacgaaaatagatttttgctggcggctgccagcaaaaatgaattaccgctagcggttattgcggtcaataaccgctagcaaagatattgatctttactggcatttactttgtggcggctgcaatttccgccaacgaaaagctaaaatagccgccacgaaagatgatttccgtagtagtgattcctgttcagattcattgtactagaaaatatctcatccggttataggttcttatattttaggacggagggagtatatcaaattgttaatctgctgatggatttctcgtttgacgtgttaacttaatctttacttttatcttcatcagtactagtatgacccagcagaaaaactaatatataaattttcaggcgagaggcatgcatgcgtggcatatgtatactgacagttcagtaacatcagctagcttggtatattttacatagtaatatagtactccagtatattcaggcatggatgcgttatatgtacatgcgtatatacacgtgtggcattggattagagtggacacgtcacacgtagtacagtccactagtccagccacatagacacgtacgtattccctccataaaaacaaaaaaaaactcttagaagaaaaagaggtgactcctccaaatacaacgaatctggataaaacgttgtccagattcaatgtactaatctcctccttgtttactctttttggacggcggggtacgtcgagatcgatcggacatcatcatcatcccatttgctcccctagctttcgtctctcaatgtcagtatcggcccagcagagtgctttcgccgttggtgttctttctgatctcaatgcatttcaccgctccaccggaaattctcctctgcccctacgcgtagctccaagcttggtagtgctccactcgccttgtccatggtatgagccctaggacttagacggcggaccttgaaaagccactctacagannnnnnnnnnnnnnnnnnnnnnnnnnnnnnnnnnnnnnnnnnnnnnnnnnnnnnnnnnnnnnnnnnnnnnnnnnnnnnnatccctcacatacacgtattgtttcttctccgaaaaaagaagtggacgacccctgggcagatctattcaatgccggaattcgggcttgctattaatgtgggtatttccgttttcagagtaggatccgcggctcaaattaaagccatgaaacaagtagctggcaaatcaaaattggaattagctcaattcgcagagttacaagcctttacataattcgcctctgctctcgataaaacaagtcagaatcaattggcaaggggccgacgattacgagaattgcttaaacaattccaagcaaatcatatatatatatatatatatatatatatatatatatatatatatatatatatatatatatatatatatatatatatatacacatacacatacatatacatatcgcctggtcactatcatcgtgtttggagtgcttctcatttctacaatttcttacataatttgtcagaagttcttccaaacagtttaggttgtcatctgaattttgaaaatttatagttatatatagaatttagaaaataaattagaaaccagaacttaagaaaccttttttatatattctcactaactgacttctcacttgttgcttcttaagctcctctaaatatatatacatactccctctgtcccaaaaaacaaatatagaactgtattgacatattctattataacgaatttagacagatttctatcaagattcgttgtactagtatatgtcatatctagtacattttttttagatagatagagtacctactttcgtttcaaaaatatattactaaccttttagctatgtatctggacatagctcaaaattgttgtatctttagcaaagctccaagacttgaataataatggcgacggcgacgcatggccaggcaggttactggtttcatcttcgtctcgctccttccgtccggccagacaccaccgttttgacgacgacgttgcaactcatccatgtctgttcttctatagtcaattctaaggtagacgcatgtgtgtgtgtgctggtagctacacgtacgcacatcgcccggaatctcccatctagctacgtgtgtgcacaaacccaggcatacagcctaactagttgatcatttgatggatctgtaaactagcttaattactttggtgattaattaattaattccttgtctccgacagctcccgtcaccggatccatcatcactgatcgccgtctttaaattaaccacaagcgccaatttatccttgctaccaatgccagccaaccaccctcctccatccacggccatgtcactgctgatatgatagcggtcgactgtatttattacatactagtggactactattttttcacggtgatccctctaagtatgattgcccccgccccattcaaacccggggccttataccttaactctcatacttcaactggagttagaggaggagttggggttgctggagtatgaatcgaaaagcaaattcgttgaatgtgatgtagcaattccgttaatttattgctcatttcgaacgtaaattttttataggttttccctaagagtatcctccatatattccaaaggagtcgtaagggttttagaggaatttcgctgggattaaattatttcttgcaaaattcccacaaaatcaaagtatttcaaacaggacttcagcaaaattttatgttggtctttggccctgcatttagttataattataagttttgaaacgaactaaactatagaaaatatggtcagattgttcaactcgtgtgtactcgcaaatag

SEQ ID NO: 33783 - DNA, 5556 bp, Oryza sativa
tatagggcgaattcgagctcggtacccatttccaagggacatgggtatgcatgtatgacacttggcaccaagttggcaagtagcagggttttagaattccagcggaaaccgatctcgacttttcggactcggctaaaaatacaaatcacttgatctttaagttaagttaaaaaatggaaccgaattcaaagttattaaaaaaaattcattcgagttatcaagttttgttagactatcgacggattccgcgaaattcaatgataccgctagtgaacagagatttaatttgatctggtatcgagtgagattgtgaaccctcacaagtagttgatctgttattttggcttgtagttttatttttctccatgagtaggtacttgccagagattatacaaatgctgcatgcatgcctgcctcaaatcgaaatcatgaaatcatgaacatgcatatggttagctgcacgagtccctaggtataatattcaggagcgagatgatgaatgatgataatgaatggtataaataccactccctccatcttaaaaaacccaacctataaaagcaggtacaatagcaagctataagccagctataaccacataccgagaagaaaagagaagagagagaataaagcaggctacagattgtagccggctgcaacacggactccaagacgttatgtgtgtatgagagatggatcgggtattaatggtgtagtatatttttatagttaattatctatctaactattactccctccgtcccataatgttacaacctaggatgggatgagacccatcctaggactacgaatctagacatgcctcaagctgccacgtggcgttctaataaattagagaaaatcctagaaattttaagaaaaaaacaaaacatccaccccttgattttcacttaaattggtgtgtccaatattatacaccgttagataaaattgatcttaaaacaaaccaaataatatgggtcccacctcttctatttctcgcgcgtgcataggtgtaggtcacgtgggcctgtagtacgtacgcctccctccatttttctccttttttttcttcttttttccatttatacaatttgatatatatttgtttaaataatcataattttttaaaaaggaaaataccatcgtataactctttataaacacaggtaactaaattagctatacagactttgaaaataaaatttacaccatattatatgtaaattagctctaaaatcaataatgtaagataatttactttgtactattattttcatataatgcaatatattaaaataaagcttacacaatattatattgtgtaactatcaaataaacaatttaagatctatattaactaatatatatgtgtaattaaacagatagacccattatttaaatcatcggatctatttttttaattactttggactattattctcgaataatttagtgttttaaaataaaatctacaccatcaccattatgttgtgtacccattaaattaacaatttaaaacatatatattaactaatttatatttacactaaaaccggtggacccattatttaaatcatcggatctattgttaataatgtctaaagttctctttttggcacactgcacaatgcacgtctgcacctttgcctttcacacatatgataaagtgtcgtgtttgagacatcttgggtgatcacaaccactgcagcgctaccgctgttgttaatagcatgaaaagaaaattaaagatttgatgcagcgagagaagaattaagtaccgtggaacacttaactctgtttaagctgaaatcgagagttgattaaataataattataatgtattgtgttatgttgtatttggattttgtattatttgttcgtatggttgaaagaaattattatgttataattgtgagcacaatattaacgaatatcaatagaactcttgataggataagagtgttataagggagtttaaggccctatttttccctgattccatcttttgaattttcgtttgcacgctccacgctttccatgttactaaatggtgcttttcttaaacaactttttaactttttagaagtcaattcattcgtttataatctcaaatagctatcacataaattagataattcatcaatttcagttgtcctaacccctaaagtacatattttttcgtgcgagtcatggtgataagtaaattggtgatcaacgcataatcaaagtcgtaagatgaatctgtaagaactactatgaccaattgtaaataggtatcaaaattaattgctattaattaaacatctaatggcttgctagcaacatatttaatttttctctacgtgtatataaacatggacgaaactagaacgaatattaacatacatcccatacatatatattacatcttaatattctaattatatgtggtaagcccattaaaatttcttaaaatgccctcaagatgccacatggtgctctaataaattagagaaaatattagaaattctaaaaaaaagcaaagtatctattacttgattttcacttgaatcgttgggtccaatattataaaccattagattaaattgatcttagaacaaactaaatactacaaggtcccacctctccacctttagtacgcacctacgtacgtgggtacctacgcttcccctccttttttttatttttccctttattctttttctccatgaatatgctcccctccctttcttactatatcatgcacctttatgagacgatttaatctatttactcagaaaaaaacatgattcaaaagtcgtaagtacttaatccatctcccactctgaatggatttttaagataccttaacaaaaaatagaacccttaaattattacaaaataacagtatgcgaactttagtttgcccttaatctatgagataattttttttaacaaacaataaaaatcttacctttcaataatataagtgctcgcgcatacgcgcgggccaccttcctacttgtatgaatgggctattagattagctatagttgttttggagctaacagttggctatactattaaacttgctctaagggaatgcgatccttttgtccagatttgtattaggagaaatcacatctcctcctatattaatttttttttctgacgaaggagtacagtccaagcagcaatagctggactcatgcagtcagcacatgtggcatgcgaactgggggatgtagcacagggccgacggatcgtcaggcgcagcaaagaaattaattaagtacagtttaattgagatgcatggaatacttggatatttatttatattctagacctttatttcctccgaaatctccgtggaattttgtgataatattttgggtggatgtgatattgttcgtcttagttctatgcagaatgttagagtttagtcggatatgcttacataatcggttacaaattaattaaaacttaaagtttgtaatatgtattaggaatttaggatagtagtagagttgaatttagccatggctctcacttaaatagagccacaccggccgagggtcgttatacccggatattcatgtaatatgctggatcggaaaaatatattcgtaattagtgtcctatagatataggttttggctaaattttattaataaatattgtggctcggtatcgtcattatatttgcaacttctatagtcttttttcgtgctcggttatcaacgttgatttcggtgctagttttataacatgttgatcttatctgttgaggcaattttagttttctctatcggtagtgcaatcagtctaccgttttcgtcttttaattatcctaccacctcaattttatatataatacaatagtacaatttaattacaaggttttttcccaggggtaataggacccgtaagtaagtagtctaaatcgtttttattactgataatttgcaatggtataaaacgatattactagtcgtgataaacgtaaaagtactaatctgttaatactatttttgattcagacaccagtacctacctggcatcaaacggtatcaactccaacacatgcgattttcacgaatatgcttctacctggcatcaaacggtatcgatcagctccatcatataatgcatgcatgtctgcatataatgacattaggcgatgtgacattgtgcctaactgcctaccctctctcttttttaatctttggtatatttacctcttttctattttacttactccctccatcctagaatataagtattctttttgactttgacacggtctttaagatgctactttgaccaacaatatctataaaaataaaatgttttaaataacaagaatataagtattttttttattttcttgctattaaggggaaagtttaaaagagtcgacctgcaggcatgcaagatgcttatattatgggatgtggggagtacgttcagaatcccgtactgaaattaacttttcagtttcaaagttaagttcgtgccttaatttggtttgtgaggataaaaacagcacaaactttacataacttttaacttcacaaattaatgtcccataacctaccggaaaaaaacacactgatcagcttaatgcgtctaaaaccagtaaagcaagcataatcaattgctagtataaaattaaatcatcaatctcatgctcgcattattaaattacataaagcgcgacagtgaaattttgtatggatgtatgatgtatagctatatcacatgcttcctcggttttaaaatataaggaattttggatggacgtgacatataccagtacaatgaatctggacacgtcaccctagtacgatgaatctggacacatgtccatatttattttattgtgacgtgtccagatttattatactgggatgtgtcatatccacataaaattccttatattttgggttagagtgagtattgttctgtcttagaaatatattagtctattcggttgcattgcggtgctgccggcgcagacccgactaggcgtaaatataaagaaaagagaaaatatcatttggtgaaatggtgacgagttccagataataatgaactgattcatcttaggccttgtttagttcgtgaaaataaaatttttaggtgtcacatcgaatatttgactgaatgtcggaaggggttttcggacacgaatgaaaaaactaatttcataactcacctagaaaccgcgagactaatcttttgagcctaattaagtcgtcattagcacatgtgggttactgtagtacttatggataatcatggactaattaggctcaaaagactcgtctcgagatttctatacaaactgtgcaattagtttttgtttttatctatgtttaatgcggggatcctatagagtcgacatgcaggcgatgtgatgttttttgagctaaaccaggccttactactgcttctactggaaatgggccatgcaccttaaggagggcaagttaaatctgacaaagaggataaatttctgaattattggggtacaggccacctaaggtgtgggcccaacagatcacatgctag

SEQ ID NO: 33784 - DNA, 6208 bp, Oryza sativa
  unsure (1)..(6208): unsure at all n locations
agacacatgctggctggagtagtgtaaatatacacacacacacactctctctctcatagtaacagggctcaagggccaacaagattagcactcactggttcttcttccttgtttatttggtatgttcattagttctttgctttgcatgaaaaaaagctagctgttatgttgctatttctgcacttaccttgagcaaaactgttgaggtgttttgctgtgaatgtgtgttctgggtgttttggtttgttccaagataatttaacaaggctgctagatctgtttcaagttcagttcttgagctcagagatggtttcgttgtgcttcttgaatctttagcaatcctagagctgtggtctgtggtatgcaggaacatgaagcttctcttctccatttcttccagagtttatgggaatcgttgtggttcacatgttcttggtgttagaacatgcaagtgcatgtgcattgacttcttaatttgttgttcctgcaagtgcatgtgttttctgttatttgctcacacagtgtgttggatcatgttgacttgaattatttatagaagagattgttttggagagcatagatctttggaaagtaatgtccatggattatgctctgcatctttctgcgtcttctttctgatgatgctgaaaatgcttcttgtaatgtttccactccaatccaaagctgttcttagcttcactcttcagtgttccttccttctgtgagttcacttatatggtacagctgaacagagactgatagaagcttggttcctggattgaattttaagttattttagccttttgttgtagaggaatctgatctgtatatgttgtcggaaagttcaggtgaacaattcttctttgttactacctctgctgtttcctgaacagttcttgagctgcaaccatgtagctgaagctgtatacttgtatttcgctttcagagatcacatatttccatcgcacacctctcttacatcttccagagttcagtctatgttttttttttgttctcatgttcttggtttcaatgcaatacacaaaatcctaatgaatctttcccactgagagtttggattgaatcttgttctttccagttcatagctttacacagtgatctgttgctcactgactttgcagagtaacaccgtttaccaagtctgacagagtttcatggagcaggtaattactctgtccctgattcttctccggctccggcgagatcatgtatcttgtgaaggatatcggcggcgccattgcgctgatgggcgtgtcactggtgctcctgggcacatggccggtggtcctcgccgtgctggagcgccgcggccgcctcccgcagcacacctacctggactactccatcaccaacttcctcgccgccctcctcgtcgccttcaccttcggccagatcggcgccgacacgccggagacgcctaatttcctcacacagctcacccaggttagtgcccatggttattcttgtctgaatttagacatgttagtctgaaggaagtgatgctcatttcagacattcagtatgttggtctagtacagttttcagacttttcagacatggggtacaaccttttctgaaaaactgtggtttgtcactaggaagtgaattttgttggttttttacattcatgttggatgtagaggccgggttccaatccattgtctaaaaaaaaagggaagtgaaccttgtttcctgtcggaagaggccaaagatgtaaactgttttcattatctaaaaaaaggaagtgaacccagtgtatcaggcttgtgttaatagaaaactctgaaaatttcagttgatcaatgctggataaccttttttttttcaaataaagatgcaggacaactggccttcaatcttgttcgcgatgtcgggtggcatctttaacggcctagggacactggccacgcagtacgggtgggcgttcgtcgggctttcggtcaccgaggtcatggcgtcaagcctgaaggttgtcataggtacaaaaaaattcagagtgatatgctctcctgataataagaatgatgcctgatgcttgtatagcatttactgttcagaatctgaaaatgacaatatggtgtgactgagaaacttctcttccagggacaacactgaactattttctcgatggccggatcaacaaggcggagattcttttccccggtgtcggatgctttctgattgcagcctgccttggatctcttgttcactcttccaatgctgctgacaaccaggagaagctgtctagtgccatggtgaaccacagcaacaccaatgggtataaactctcttcttccgtttttcactcatgtggtgaatccgtttcatcagttctgcctaaattctacttctgaaatactgaaaattttgaaaaataacacgtatataaggtaatttgcttttacttgaattttatttggttgttgctaattgcgaccaatgtatcatttgtgcatcagtacattattccaatgcagtaaattcatctgaacaaacaatgtaattaacttgaactctcaacagggacactgaaaatgaagaactcaccaagcacctccttgagataggtactaatcagatttagtctgaaaataatagtatatcatagagctatgtgtactaatctttcaattgacagaacaacccaaggattgtgaagaacaagagcctgaagtggcaccggctgcccaggctgtggaaaaactagaggcaggaacagctgatttcctggttgaccttgaggggaagagatctattaaagtacgtacttataatactaaccgtaccaatatattagttaaaatgtcatgactaaactgcagaaattcaggtggagcaattgcaaagcagagttgctagcaaaatttccacaaatgaaaatccatgtatctctaaggaactttttttaaaaatctgacacaaccttccatgtatttccaacatactccctccgtttcatattataagtcgtttgactttttccccagttatacttcattaagtttgatcaagtttatagaaaagtataatagtattttcaataaaaggcaaatgtattatcaaaatatattcaatattagatttaataatctaattcgatattttatatgttactaagttttcctatatatttagtcaaacttaacaaagtttgactgaaaaaaatcgaactgacttatgatataaaacgggggggaagcagtaaaattcacactttcacaacagaaacaccaactcaacaacattaatttgtttcttctccatgacacaaaagaccttctgaaaaaaaaaaaacttcacattcaggtgctcggatcgaacaccttcctgggcctcggcatcgtcaccttcgccggcgtgagctactccctcttctcgccggcgttcaacctcgccaccaacgaccagtggcacacgctcggggagggcgtcccccacatggtggtgtacacggcattcttctacttctccctcgcctgcttcgccatcggcatcgccctcaacatctggttcctctaccaccccatggtcggcgtgccgcggtcgtcgctcacggcctacctgaaggattggaaggggagggatcttgctctcgtcgcaggcatggtgtgtggccttggcaatgcgttccagttcatggctgggcaggctgctgggtatgctgctgctgacgctgtccaggtacaccatctttcttcaatccaggccgtctgcagtactgctgtcgaaactaaatttctgctattctaaaagggtagcaaacaagctagaaaagtagatgggttatgagacggatgatttatataggttcacgtcttataggtatatggtatccataatctccacaactgtagaggatctttctcagctcaatttgcatttcttgggagatattctctctcgttataaatatttgatgattaggataagatttcattaaaattttgggatttgacattcagtaacttctcaatttggctgtatatatccacttgtagatatatagaccggatttctacccattatcttttttaaaaagtattttttaaaaaattattggtttaaaaattagtgtgtgcagattaggataaacttgttctgaaataaaattaatggccaaagttttgatttgaccaaatcttatcctaaacgttaaatatttacgacctggagagaggagtacatgacttgaacattttatcaggcaagcattannnnnnnnnnnnnnnnnnnnnnnnnnnnnnnnnnnnaattatgatctgatcatggttttggaatttgacagtatgagaagaagacgatatgggttttctgaaactctgaacatgaatgggccggggcgtgtgtctgaacttttctgaacattatttctgctgcaggcgttgccgctggtgagcacggtgtgggggatcgtgctgttcggcgagtaccggagatcgtcgcggcggacttacactctcctggggagcatgctgttcatgttcgtcgtcgccatggtcatcctcatggcgtcgtcggcgcaccggaggccgctctgatggcggccggccggcggctgccgtcgacctcctcctctcctcatggacatgaccgagaaacatcagaagaagaagaagaagctgcatatgtacagctccattgatctgaccacatcagtgtgtagttcctgaccttctcgacgtaggatctatgcatattgcctcccggtgcttgcgcatcggcgaggctacacatcaattaatttcttctgcaatgagcaaccatgggatgggggagtgaatttggagatgtgattggactagtatatagtgtaatgttgtaatatatgtctcagcttctttgtgtgaagcttctgtgaagggaaccaaaataattttcaaatgtataaattttgatcaatgttatgaggagctacttcctccgtttcacaatgtaagtcattacattcatattaatgctaatgattctagatagatatatatgtctagattcattagcatcaatacgaatgtggaaaatgctagaatgacttacattgtgaaatggagggagtagctattaaggctagctctagtaaaaccagattaataacctttttgtaatcctcaaagtagaaatgttacaactttgacaatgaaagaatcaataatggcattatgacgtcatgagggcttttttcctgaaatcaggttcatattttcttttctatacgtgcagtctaaatattggtcctagaacagtttttccccccctgaattttgcaacgacattaagttgattatcagtgctaaaatgactccaacaaaaatactaaaatgtgtctcccggtgaaaaataattgtgtttttctttgacagataagaatatatactcacataggcatctccttaaagttttgagtaaattttacaaagggtggtgacttggcaagtgatgtcatcagcacataggtgaccggtcccacatcaatcgctgattagtcccttgcatggtccatactccatccataccagttcttgtcatggttgaaaacagagttggggcacacctacaggctactctagatctagtctgtgttggatagtaaaggttgggaaaacttttcccgcacacagaaaacgtgataactcattaatatatgattaattaattatgaatatgattttttttaattaatatttttataaaaaatataaaaacacgatgtttaataattagggaagcatgcgtctgagaaacgaaagagtagagaggcctcggtcccgggccatctacataggtgagatggcatttcaactaaaactctggtttgtctagatcagactaagactaacacgagttattttaactagaggttcgtttgcatgctacagtaagtggcgcgattaaaatatttgcagtgtttgaatcatccaaggatgttgaacacactatatatattttaatttgtagatgcaatgaatgagtgaagatcatttcttattgattttgatttatatgactgagctgatggtgatccagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33785 - DNA, 1788 bp, Oryza sativa
tagtcaaagtgcaatttacctcactaaagatcagatgttccatgagagaactaagcacatagatatcaagtatcattttgtgcgtgatgtgattgaagaaggtaagctgaaggtatgcaagattagtactcatgataatcctgctgatatgatgacaaagcctattcctgttgctaagtttgagttgtgctcaagcttagttggtttaattgaatagtccaagagactattgttggcaccagtggttttctatctttgttgttcaagatgattggttgatttatgatacaagaagaatttgtctcaaggtggagtttgttggagttgttccaaattcacttcaagatattggccgggcttctgacgaagcggagcggaggcccaagccggaggcttgggcctgctagggtttcgtggagacttgattctcttgtaagccgccataggcgtgtaacccaaaactcttgagatagtgagattgttgctggctggtgcccgtggttttttcccctttcgcattaaaggggttttccacgttaaatcgtgtgtctccgctgtgattgtttttcgtttactttgtatttctatacgtcgttcataacaatttgtacttaccggtggggtgcgaaattaccgaaattttgaaccgaagttttaaaccctgccggtgaatatagaaaggatagagttatcaagatctggtctgctagtcacaaagaaagacctgccactatttttctgcacctcgtgcagtgatgagctaactgatgacgggtgtccttcctcaattgaactactccattgtttctgcaacacagatggacagattaatgatgggatcagttctgtgttgaactactccctccgtcctaaaatataaccacttttaaactttgatatagtctccaagatgttactttgaccaataatagctataaaagtaagatgttttaaataaaagagttatacattatgatagtttgtttaatgataaatctagtaacatcaattttacatgagtgatcctttttatttttttttataaatagtgaagtttgaaaatgtttgacttatcactatgttaaaaatacttatattttgggacgaagggagtacaaaggattgcatcatccgatgtgaaaggccacacggtcagatgagatcatgcatgagagggtattcgaggtacaaattaaattaccagcaaatttggtgttagtctataatctgaagggccattactacgctggagatggaccatcgcctgaaatttgaaatactaatatagaagtacagaatacatccgtgcaacttaaccttgatttggtttctgaaaaatccttacaagtggatatcaatcatcacttgtacctggcattgtgttttatagggagccctaagtggatcaccactcaagtcttggtttatacttttatattgttggacgcactaccaatgtcgtgtgtatgagtcaacttataaatatttggcttgtaaacttgagaaggtcaagcaacacaaaacacgtaccagattccctatttctactatatatatatacatatatatacacacatatatgtatatacatatatatatatacatatatatatatatatatagagagagagagagagagacacacacacacatacactcatgttgttacttaaatttgcttcagtgctctgtctggatgcatgctaattgctacagagcatacacgcagtagaaaattggttgtaaacctgcattttggatttggaggtgttgggaaagtatagatgg

SEQ ID NO: 33786 - DNA, 2719 bp, Oryza sativa
tcccatccattgcattagagttatcagggctggaacgcttcgaaatacatcttcatatcaaatatcaagaaaccagacccagttattgatgcaccatctggccttgcttccatgagccagataacagtaccgttctaaataactacctaattctaatactctgctggtattaatttgtgtaatcttgtttgtgaaagttacgtatcttctcatgcaaattatgcagagcaagtcagcaagagtagtgttaccgacacagtggttttgatgtgcagggaagttgtgtactataagtggtgtaaaaaatggaataaaaattcacatagcaacaatcctacctctttggctcataaattaaaatgacagatatttttgaagcttcactcaagtaccaactcaacttaaacttctgacagaacaacttccttccaagtacattcagaggcagtggtatgagataatattagattatataaaaaaagcccctcttgtcctatcataaaagtgactcacctttttttgctggaataaccgaaggaggtcattcattgtaattaagattggaacaaaatgttacaagaaaagttttacatcgacagctggactgtcgaggaaggaaatgcgtgtctcaccttccaaccacaacctttttccatatatattcaagacatattgagctataggtcactcagatgatattatacgcaagttggataacgcatataacagaatgagaaggagaagaccgagagtaacataagcacatcgttgcttgagatgaatacacacaattgatctagagtacatgtatgttctgcgcattggaattggaggtatccagaaaatggagatagcgagtggaatccactagcagtatgttcatcatgatctgtccgcgtttgtttttagtgtggcaacaactgtttcctatgaatgtgagaaatcacagttgtttatattttgtaaatcttgcgatatttgtggtatgattactgctgcaatcgtcagtgcgagaatggagaaacaactcacatgattatttatggagtacaaaaatacatgctccaatatggttattggttcatgaccagtcatggatatggtaagatttgcttgatctactggaattttaggattcgaccttgcacctgccaccatagtcaagaatactcaccagaaaatagtttctcagcattaataaaaaactggaggttgggtctatacatgcattgtaattggaatgtaggagatcacaatcaaatacttcacattttatttctttagataaaatgttttacatctccaccttctgtcataagacacatatccataagtctattaaaagaaaacgaaaaaagataaaaagaaatgaaaataagacaagaggtgatgggaaaaaaaacctcaactcctcttattattggcaagcgtttaagcacatagattttttagccaacaattgtaatggaactacaccacccatagaataagacatccttggatacagattccaaaagtatagcactattgtgcatatagtatcctgctctcttgtggtagcatggtatattaaaagttgactcaataggaatacatgatgataacctgcatatggttagacaattgtttacgattaaaaactttgtcattacaacaccgtcaaattgactaacataaaacgctagctccaactagaattttctttatggacccagttatccctctaagccaattaccaaacatatttttggcattatggggtggtgggatattaaatgcaaaaaccacacatctacaaacaaaccacaaaacatgacacccaaaaacatgtttgtctccccctattttccattagtcaggttatctttgttaggattactttcatatgaagaaaccacaaaaaaaccttgatagtagaacctttaggtcccatagattcctcttatggatcataatattagatttcatggacacggtatacttagagttaactggaaattggctattttatgaagcaaccatacaaagtaattcttttcatttgataaagttatattagctagcatgaggatcaaatcattccacccgattagcttttggtaagctgtggctctcctaaaagaaacattcaacaatgttgtgctcaaaacctctgccacggtagactacttctttcgagccacattatataaagtagggtattgatctttgagagcattctcaatcacatgtctttccaaaatcttattttggtcccattagcacatttaaaggatccatacctaagaaaatggttgtttactttgttaaatcagcctagaattgacaaatacttgtattactggacatatcagagagaggcttaccctttaaattataggaacaaacacaaataaccaaacttaccagaggggagatgaatagtagattatgtcaggggaagtcaaataatcaaattttaatagatcaaagcacaccccaatctcaaaatccaatgtaacacatgtccaacacgatctatccaatctactagggtcggtctgactgaggctaggctggtctgaccgcatgataatgtacacggaacattgatgaatacaatgctttgcccaaatctaaatatattttttttctaatgattagaataagatgtatgcatgtctccataggatagaacactattgccggaattgaaggtattgggaaattagagttggaa

SEQ ID NO: 33787 - DNA, 6707 bp, Oryza sativa
  unsure (1)..(6707): unsure at all n locations
ttgtctagatgcatgctaattatttctagtgatcagcatgcacagtaaaaaattatgtgtaaccctgcatcttggatttggaggcgtccggaaagtgaacatggcaagaagatacacaccatcgtcctgacttgcttgatattccagaaaaggtccattccagaaacgctttgaaacacatgatggagatgaagaaaacaacccagttattgatgcttcaattcgtaaagcttgctagtgtgtataattaatccctgaactatagatcagtcatgtgctaaaaaatttcctaacttacaatatttcagtgcccccctacttttgtgtacctttatttccttatttctagttaatttacttgtgcacactctcttgggttttcatactattaattcggctatcttcttccaaatatgacataataggtgtcctattaatctataaacatcattgtcaaaaaaatatgatgttaatctctctcttttaagaaataaatcagtgcaaacaacaagaggttaatatgataacccatgttctcacagtctgaggactagcaagtgcaacattccagcctgtttgaagtagttatagagttgaggcccatgtggcttagaagtggttgcagtgggtgttgtagctagtaccaccttagaagtttaagttggtaaagatcggcttataagccttggtactctaaccgtgttacttcaggttaaaccctttatacaatgtcagagaaaaaaaatacatgtaaggtactatgtgaatgtagacacaattgtacctctagcaaatacagtgaaaacagcttatttgattctgttgcacagatatttcatttttggtcccttggaaaataatttggatttggaattatttctaatattaattaagtagcaggtatccaagtaatctaaagttcctcatcaaaacatgaagtcaacagttgtgtttatgaggtaaaaaaaatcaaatcaaaattctaagagcaataatgcctgtttgctaccttatctacttatatatttgtagcacccttaatttcatttgcatttatttaaaatcttggcatttaaaattttggagttaatttggatcttgttgatttttgtgccaaagagatctcaaatcctctcctagaaattcccttcaaattctgtgaaaccctagacaaaattaaaattataatccttctcaaaattcaactcaaatcccaaagaaaattgcgaaaagccactgttcatttgggcccttattcctttttcttctcctcgggcccaactccctttcactcttctctcaagaattttgttcgattttagattttttttaatattgacagaaataatctatcggccaaaaaaattgcataaatagaccctgccaccccaatggtgggcggcaagctgacgtggcagacggtgggtcgaccacgccgtctgccgccgtcggccaaaattgcgattaggccctaattgtaattttggccgcccataaagagcttgcggccgtaatttttgcatctgggtcccttgagggcagcaagggacccagatgtaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtactttattcgacgttttagtactcggataattaatatagacctatcgcagtctcggtcgtagaaacattatatggacttaaacaaggagaattatgtaacatgaagaaatagtaggacaatttgaacatgatacaactatttccattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatctctctcctctctcaaactgcgctttagtaaccctgtattgctctggtagttcaagctgcacaacacggctaggtggagttagaacccttctggtgtctatccattctctgtattgacatctccttggtggtttctgggaggaaagaatagatgtaaagcgagcaaagttagtaaatgttgtgagaaaataaggattcatgtaatcaaaatattcttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagaacccgccagtcgctctgttgttcatgacattgtcgttcataagccgcttttctctataagtattgctcagtactttcggatgcgaaataccagctaccttcttgtaaacaagtggttaggtcaagaacgggattttctgtatcgacccactcgatgtatgcgcaagccgtagtgcgggtctgccgaatagagtagtgttacgaagaataaagcgattgcccatacggaacgaataagcatatgcagataataaaatacctcacggtcatagttagggcacctaaaaaagcgctttcctcgaatatcaggattcctcgaagccattagttggcatcgatcaccgcataggcagataggacgctggcaccaaggtggtagtaggtatacacaaggatcgctacgccagtttggatcctcaacaccccggcatctagccattgacgaaagccggtaggatttgtaatgaagcaagtgggcaagagagtacggaatgtgactgagttctgaaagattgtgaggcctcactcgttaagacgacttatataggtgcaaaaaattgagtgatacccctgacatgtgaacgtggtggggtatggtgggtacgcctgattggcgccgaaagttacatgcctgatcggcgccgaaagttacattggtcgtacacgccaaatggtgggcaaatactcgtattgcacgcgaataaaggagnctgcatcggtgtggcagaaagtagtcgtgcatgcgccgaaaggtatcgtgcacatataataacaacgtagtcattacacaagcatacagtactggaaagtgaagcaaaaaaacaaagagcagactgctctactggccctgccccgcgccgcgaccacgcttggtcctccgggcctgtgctcgcacgtggtcctgggagtaggtgaaacgatccggtggcacagcacgggtagcacgagtgtctggcggaggagtggcctgcgcctggtcctgcgtctgcaccggcggtgcgcctcccagctgtgaggggccgatgacgtcctctgtcgagcctgaagcgaagtcgaagtcagtgatgtcgaagagcaaggtggaaggcagcaagcggtccgacgaggtcccagcatggtccagtggtggaccctgactcgacgtgccggctgcctgtgacgaagtcccggtgtattgccagaactgcgctgagtgcgaggtcgacgcagctgcctgagacgctgatcctgcagcttgggagaagtgggaggcctgcgtcatagcgaactgggcgaaacctacacatcgacaacggggcccttgtaagctaagacataaaatgcatgtaaattgattgtcaaagtaatgttgtttttttaagtacccgtggggggcacaacagaaggcctagccgaggaaggcggggtgctgaacggtgcacgaaaccctgaagcaatcggcaagtgaaacgactcacatatatgtgcgaggcatgtacagaaaaatccttaaaaatacttacctccgtgcggagggggagtcgccctaagaacgtgcgcagctggacggggaccagtcggtacgggtggccgctgtacaactgcgtctgcccgagcaacgtcgtctgcacgacaggtgagcactcgcagaatcgagcgcatcgactccaccatccgcgtgtacgtcgtcaggtgctcctctacgggtaccggaatccccgcgcctaaacgttggatcgtcgttgaaccgtcaacgacgacccggttaatgtcgtcgatctgcatggttaatttgttcgtacatatttgtaaaatttgacgaagagaaagacatgaaacataaaggaatggtgtgatgcagggtactcacagcacgagcgaagtcctggtcgcggtgcctggcgtagaggtctctagtgctcgcaatgtggggctgctgctccaagggagcgaaggtgaccctagtacgggtgtgtggctggtaccagcgtaggtaggcctggtacgcctcctcagtgtgtggctctccctcatggtccatgacctcctcggttgcgagcaaccagtcctcaacaaaagtcgccaacttggcgggccagtcgccagctgacttctgacccttgcgcgagtacctgtgaattaatgtgtaatattagtgtgaatcgacagatgttacaaattattgtgaacaggtagattttaatgcaacaacggaaagcatagtgaaagattttactggtgaacagcagctgggatggtggtcggaaatggtactggaaagggctgacggaagccgaactgccgcatcacgcggaaaggggcgtgaggctcaatgcagatgtcgaagaccatcggaaccgtagtcatccagtacgcctggtccctggtgcagagtgtggacagacccaacggcgcacgagcctgggtagccacggtactgtagggctcccacacgatgtcagtcggcagaaggcggtcgaactccatactcccaaactgcaactcttctatcgctcgcagaatgccagcgtgcctatcttgtatcaggcacacatttggcctcataccaacaacttttgttttaaccaatatcaggaaccagtacagctgtcagtattctcactctcaacaaaagcaaatgccaagggcaatacctgattgttcccatctacccctattgctgttagtatctagccccgatactttcctgtcaagaatgtcccatcaatgcagagaacaggacgatagttcacgaatgccatcttgcatgcatgtagagctaagaacgccctttgcagcacactcttgccaggatgttcaattgaggggaatttcttcactttgtaagagctcccagggtttctttcctcgataacaccaagcaggcgtggcaaattgtcatacgaggcttcgtaagttctaaatctcatctctattattttctgtttggccctccaggccttggcatagctaatagtatacttgtatgtctcctcgatgtgttggattattgaccttggttcatatgtgagattatcgatgacatgcgcatacatctcagatgcaacaaatgcacatgtaatgttcctatggtatttatgaacaccaggtagaaaacatgtatgcttggtaacgactgacactgtccaataatccttccatttccccttatacgcgtgcactctccagggacaaccatctttttccttaacacaccgaactttatattgcgaccggttggacttggcaacccaaaactctctatgaagtgacactgcaaaatgttttactgcctccttcatatcttctgctctactataaatcgctccctgaataacctcattttttttactcccatctcacactatcctcttcagagacgatcagcccagaaaaatcctcactagcccattatgctggattaatatccgtctcatcatttgacgaatcatcttcctctacacgctcgttgtcagaatcctccctctccatttcatccacaatggcaccgacagtctccccctcgtcggccactccacctggttgaatgcccattggagctactacgcccccgtcctctcgtgcgttgacctcctccacagaagtctcatttacttcagcacttggtccctcgccatcatccatgttcatttgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactcttaagcccctcattaaccatccttttatagaaagtacactcctctcagccggtctatcaattcccctttctgatacaataaattctgacagatctaccccagttggcccgtaacggacgtttcctggtccatggtaaacttggaatatttgtttgttcgacatatctgtcaatgaattaactagatcatattactctttcatgcaataaacatctataatgtaatatcttcttgtgtaagccaatgcaacggtaatgtattgattccaaactagcagatctacgtagttaccgatatatacaatacacacttctagattagtacaactaaaaccctaaaaatataatgcatttattcaaacaaatttttaaaaaatacacactatttaactcaatagtcacatataggatctatgaatattacctgaaatcggtgtctgaatccggcagggcttcgccccttcttctcttctcctcccctctcttctttttttttcactggatttgagggggggaggaatgagggctg

SEQ ID NO: 33788 - DNA, 7235 bp, Oryza sativa
cgcctgtaaaatggccggccccgactggcttttttgcattcgggccccttgccgccccaccagagggcggcaagggttttcctgcaaaaaaccctccctctgtcaccgcccgttcctcccccgtttgccacgtcagcttgccgccccagaggtgggcggcagggtctatttttgtaattttttaggccgatagattatttctgtaaatattttttaaaaaaaatctaaaaaggaaaaaaaattccttctctcaacccctcctctgttctcctccctgagcaggccggcccagcccagcccaactcctattcatcatcttcctcttcaggccagccagccacgtgcacacaaggtgttcggcgaaatgtctcgcccggacgccgcaccatcccgcatcgtgtccgagccacattgcatcgagccgaggccgcgctgcgccaaaaccgcgtcgcgccaagccgccctcgccccggtttccctctgggaaacatggagaagtcccgtcgccgtccatccatcaaatcgccatcccgtcgcctgtcgcgtcgacactaacggataacggccaccacctcacccttcgtcacctctaaccctaggtcgagtcatcctcggtttacacttatccattcgcccttgctttgtgacaaaggagcttagccgctaagccacgtctctctctcgctcgccaccgcgtcgccgcctataaaaggggaagcagcccgagctccttctccccacaccatcacaatcccaacccatctctctctcctctcccattctccagtttttgctctctgtgccaccaaccagcgcccccgggcctcgcctcccagtgccgccgtcgccggcggagctccgccgggcctcgcctcccaacgccgctgctgccgctgcacacagcaagagagggagagcgagagagaagtggagaagtggagaaagggagagagagaaccaggcttctgaagaataacctatgtaccaagccaatgaaaagctaaagaaataacccgtaaggaagaagagctttttcttttgtcaaaacaccatatcgttcatgcgaagccataacaaccaataaatagtgcccgcccctaataggataagcgactttaagtatttcctaattccccgtagccaattaccgaatatatgtgatacaccatgaggtaggaagagccatgtagccacttgaatataccacacacgacgggcaaattggcacacacagaacaaatgtaatttttcctcatctttgtgacaacaacaacatttcttacttccatgccaatttcgcttggcatggttatcccttcacataacccttaggatgcaaatatcataataagaagatcctgtctttaaaggtaattttaacttccaaagtactttttttatattgggcatatctaaatgtaccaaggcaagataatgcaactttaatgaaaactctccattctgggttcatgaattatcattgatgtgctatgctttggttggtgcacctgcctccgtagttaagattcctttacaaacaatactttttctttattaattgagcaatgtaggttagaatctaatgcgtatgtagataatgttactacttattatagttgtgtgtgcgatgtgattccttcttctatcaacactacttctgacagtacgagttaaactagaagtcccacttgttaattatttgaatgtacaagtccacgtctgacattgatttaatggataattttaccatccttataaatgtactacaaggtaacacatttttttaacgtaaaattagtgctacctcatggtaccaaaatttttaatgtaaatttaggtatcttgaggtacttttttaagaactataatttttttcttaatttaatactatacacttttatgtagctagcgtgagctgttactgtcagatgaatattcttgaagggtatttgagctcactagtcattaatatacgtctcacaaattgtgaagtttcaaatttggagatcagctcaaatatcttttggtttgctttttatttttgcaatatataggaactgaagtttaagaagacgtctcttatttctcaacactgaacaggtcacaaacttgcgcaatgcggcagcaggatataactattgtgtcaatccatcttgggcagaaagagattcacccaaagaactctgtgctttctttctttagtcacatctctcacaaagtatatatatgtggagacatgtgactaaagaaagaaaacatggagctcttgaggtctgaatcacagttaagatatgtgtaagacaaattgcaaataaattcagttccctcccaaaatatgtgtaataattatacatttctacatttggatggaattatattgaatagtcatgtaattgacttggttctagagcacaacacaatggccataaactgtctctaatacctggttttgtataggggctaagagcaagtttaatagtatatcccactactagctccaattcatctatagccaatctaatagccaactcatacaatagttgcttactatattattaatatatggtcccacctatcctatacatactacgtcttggagtccgtgctgcagctggctacagatctgtagcccgcttcttttctctttcatcttttatctcattaaaatatgtttatagttggctaatagtctgctaatgtacctgctctaatgagtggattaggatggttccaggggtaaaatatacttcatttgaagactatatatatacacatatatatagtcaatgctgtagtatttgccacattgccaatgctgcatgtattgacgaggaattttaccgtacatgagaaagtatcttgaggtacttaaattttaaattaattttttttactagaaaatataataccactaggtaactttttaaggattctaataaaattaccctatattggtatgcgagtgttataaaagggccatttggccaacaaagattcagaaatgcaatttcaatgtatgtagctgccattcctgttgttccccaaatttgcttcagttaggtctagcttctcaacaaagtgcacttgttgtttgcttgcttggggtgtaaaagattgtgtgtaggccagcagcatgctggattgggaggtgccgagaaagtcgagacagcaaccatctgcagttttcggagtatgattgaataccatacagtgatttatcctgctttaaagcacagtttcttctgaacaggacgatagacctagatgtatggttattcatgaaggatcatgcatgctacgttgggattgcaaggctctaaggacaggaagtcatttgtgttaattaggtgcaattaatgactgcagaagtggctaatttgacagtcctaaattcatccttgttgcactgctgaagttcacatctctaatccaagatgtcctatgttcgtgttccacttggatatattgcagagtttatcgtctagtccctgttaatctgttatttaggcgtgtaattttcatgcaaaagaaaagggattatactcagaggtacatcctcttttgtcacaaaattgtccatataccaaccaaagtatgtgagttgctatacaacaatgaacaaattgatttttaccagtgtgtcagttgattcctaacaatttgtgccccaacatcctttccacccacctttctcattctggactttcaaaccaggaaaaataatatagtgtaaaccatatatgtagtaaaaacctaaaaattactattgaatcgatggatgtatgagattcgtccatgtccatttttcaatgatgatgtggacgaatcttagacatccatttttcgatccaatgatagtattcaggttttcactacatttgtattagtttctaccatgtattttccctacataccatgcatgcaacctattgattgcaacagcagtaaatagatactccctccgtcctaaaatattacaacttttagccctcaacatttgtctcaaaatatagcaacttctccaccaacattctctttacaaccaatcacaaccctccaccattcatttttctcacctacctccactaattaaccaatcacacaattctccatcatgcacttctacctactttcttaattaacatgtccaactctaaaaaagcttatattctgggacggaggtagggcagtgttttactgttttggcacattaacaatgttgcgtgtgaagtgtacgtatatatatgctagcttgtgagcttactggtattcttgttccttccaaagtttcccacatgaactctacaagcaatagaaaaaaataaatatgcttcaggcgctcctattaattaatttgcttctccacgatgtgtaattgctctatagggatatgagtattaatttgtttgtaatggaagaatgtattactttgattattggatttggaggtattgggaaaatggagatggcagcgattcctcactctgctatatatgcttaagtaacaggagcaagcttttgcatttgattgagcacagaacatctgggatcaaccagcttttatatatttgttttgacttgagtaatcttccgaagatgaaaatgttatacatgaaggttggttatgcatcaccagtggcctggttgtgcaatcccaaatttttagttttctataataagtagatatgtaagcacagctgccattgttgcatgctaattaatggccgcaggatttagcaacctagatcgatgcattattaagcacttttagtgcaaaacccaaatgattgcaatttgtttttaggaattctccaagaaacaactcaaactacattattatatatgacaactttagcatatattcacatcagtaggcttgaaaagtttggcacacatagctcccgtacctactatctcccttctcagtcttcacattgtacttgcaaaaaatcacaatgcaatgcaatctccaccaaacaggcgcttgtgctagggtttaaattcctcgatgcattgctgagtggctcggtggttgcgtgcattggttgagctgatcgagttggggcgcttgagataggcccctcagtggttggccaagagcatcgcatggcaacatcaagtcatgcgaagtactagtcagcaaagaactacgaggccaggatatttctagttcttcgtgacgtctaacgcaaggaaaaaaatgaaggcctcccctgctctcccccactgaaatgcatgtgtagcacagatatggtggtgaaacttaattagcaatagtttcaacaagtgattgaaattaagctcgttgtagtaatatatggtgatatggcctacactatgctcagttataggtatgataattgagaagcagtgagattaggtgccactaacaagaaccaaccctgaattgctgacctgcatgccaatagagacatactccctccgtcccatataaaatgaatctaggattggatgtaacatatcctagtactaattcgtagtccgagaatttttcacatccgatactatgttggttttttatggaatggagagagtatgactaaatttcactgacctgcagcaacaaggcaccgatcattgagttgttcctggatcagggtatgaaccatattctagatgccccagcactgggcctggtggcctaccctaccatatgaagccctctgcctctgggtgcacctatatatatgttggatatgagttgtgaataagagttgacaagggttaatccagttcctttcaaggttttcccatcactctaaaattattgatccctgtccataggtaattaattaccaacttgttgctcgctaataatccgcttgaatatagttgagcactagttattttgcttcagttcaccttctaactaggatgttcgatgctgcagagagtatatatacatgtcgtgattgggttggaacaactatgtttgcgtgagtacttttgcttatcggaattggaggcactaggaaaatggagatggaatggaggtccttctccatccaatgatcacgagccttcggtactacagtgctatcagatattgtgcactatggataacctcatagtcgcagattcacctcccgggtaacacgggcagctgcctaggcttcattgcaaagttcgctggcacataacactaattcttcgctgcgatggattaattctggggcaagatttgcatgtgagagttgaatacggaaaacatgcaggatttgtatatagtgttaagtttagcatgtgggccttggtcctcggctgcctatggcctctgcctgcctcattgtaaaaagaaaaatatattagtgtggtatatgttttcactcaaattaagcaacgtactcgatgttttatcttttctttcgtccataaatatttacatgcatttttaaccatgttttgtataaagcttttttattgacaactttgattacaatatattaaaatatgtatgaacatgttttagtatagtagttaagttaggccagcccagccttcatagagctcttggttcttccactccctcacattgggtgtttgcgtaggaattgcataaatcaacaagttagaggcagtcatggaagcaacttagaagtaccaaggaggacaaatgttgtccctgtagcagtgtagccacacccattgccaactttgaactggaagaagaaaataccatagatccataaacgattgtttttcctttaaatttttgcctttcctctgttttcaacagactgcaaaaagatagcaattggagatcactggtggataaatgctttttactcctggttggtaacccctatagtcccggttttccaaccgggagtaagaatccgggagtcccggttcaaatacaatctttagtcccctaaagtttttttttctttttttttgctattttgtatatctcacgcccattatctcaaatcaatcacaggaatatagttcatcccaaatcattcacaccaacatagttcattctcaaaatcgttcacacaacaaacacagatcgaatcacacaacaacacagatcgaatcaacaaagatcgaatcacacattaaggaaaaaagaaaaaaaaaatcccggcaggcacaccggcctccattgcctgccgccgcaccggcctccgcgccggccgccgccgggtgtggccctccgtgcaaggccatagccgctgccgcccggccgcttcccctctcggatctggcgg

SEQ ID NO: 33789 - DNA, 2652 bp, Oryza sativa
  unsure (1)..(2652): unsure at all n locations
atgggtaagtgaggagagaagagaagaaagagataagggtgagggaggaggagatagaacttatcccgtgcgcctcctcctttcgcctcgatctcgcgcgcatgtttcgttctcaccaacgggactttttctagtccaccaactgggagtaaagataatagaggggtctgacacagcctgccgtttttttaaacgggactaaaaataatctttagtcctggactaaagatcaaaaaacagctttaaccttttgaaccgggactaaagattatctttagtcccggtttttattgcaaccgggactatcgtttgaatttggtcgaccgaccaaagatggtttctccagtactaaatactgcattgtacatcatgatgctcaaatgagataaatagagcatgaccagagaaactttttttttgtttgttcttggccagaaaggttaaaacacttcgctattttcagttgctacacattagtattgcaagaaaaaaaaggatggccataactacaccactgatgtctgacacgattgtgctgtgacacgaaatttaatcaaatcacacatcttggttttgctgaaatctatctatggaattgcaaattctgccaataaaattaaaatgttcatacgagcacacacagtagaggggaaaaaaaacatctatcatgcccttaattttgcagacctaaggaatcctccattggttgttgttgtatgcagaacattttagccattatctccatttctcaacctttagatctacagcttctgactgtcatgcggcaagacgaacaagctaaaatccgagcactatatttggcttccaccatcatgctcaatgcatacataaataacaaattcgaagctacacacgaggagatgtcattgacttcgtgtgcacttcgaatttgtgtttcaaaattactcagtccgtcccttcatatggatcaatggctgctgcagcatttgggctcaaagaattcaacctggagaatgagatcatgatgcatctgggtgtggaggtggtgcagctagagtacgttttcccgatgccactcatgcatatattctaagcccggctgcaacttatattaccgtgtgctgctctctaggctatagcatatgtgtatgtgcatttgccatatgttacagtcttgtagagttggttggctgcaccctctcacatatatatatcctctcttctagttaattttatgatttctggaattgaatctggtgctccttttctttatagtacagaattggtccaattggacaagcaacttctttggcgaagtactgtatttgtactcgctcaggcccaatatgtatttggaccaccatctaatctgtttcgtactaattaatgtgtatcgatctcagtagataaatgcaaggactccacatgcgatggccaatggtacagaaatattgattttttttttaatttttcggtggtctttgttctgtcggcgatttctgacggtgcacttacaggaatttattttttctgacagtaaaattaatttttctgacggtaaagccaaattttctgatggttttgctcctagagggttgattaagtctggtagtgagaacatggtctggactccatccaaacgtgagataccaagcgtcgggcgacaaggggcagcacacccacaattatagtgcctaaacacggtgttacataaccctgatttgatttctgaaaaaaaatcttaaaagtcgatattcactgaagttctttggttagatgtccccactacccacattaatattaccaatgttatgtgtgtagagtaagcttatatatcttgtgacatgagaaaggcaaggaacacaatacatatcagtttcgtcccatttggaaacactagctactcttgttttttccttaaatttccttcagtcctttgtctggatgcatactgattgctattgaacatagacacagtagaaaaactgtatgtatcccagtagaaaaacaaagatgacatgaagatagcgagaaacatagacagaagagaactgtgtatagctctgtatgttggatttggaggcatcggtaaaatgaagatggtaacaagctgcagttacccatcgatgtgagttactgatcttgcatccactaccagaatgggagtctctcccgagtgggagtaaaaggttacggtgtgcttgatctggcactgagtaaaaacggagtgtttcctagagacactaggtaaccaatcttgttatgtagtgttcattctaaacactatatatgtaatgttaggagattacagagtgcctatcaattacgcccaggaatttgggcccgatgtccatcagtcgaacaattttttttggcgtgaaagggaatgcatttagacgcccacatattgatgcatggtggcgcgaatgctatttagtcgttcgttactgtgtgttttggtgtacacacccggtaagtataagagaaaatccctttatacccctgggattttagctaatttctttcatgcccctgaattttgcttacttccttgtaccccaaaatttgattatgatcccttcaatatacctcccatcagttgaccaacgaannnnnnnnnnnnnnnnnnnnnnnnnnnnnnnnnnnnnnnnnnnnnnnnnnnnnnnnntt

SEQ ID NO: 33790 - DNA, 5592 bp, Oryza sativa
  unsure (1)..(5592): unsure at all n locations
atatatgtaatgttaggagattacagagtgcctatcaattacgcccaggaatttgggcccgatgtccatcagtcgaacaattttttttggcgtgaaagggaatgcatttagacgcccacatattgatgcatggtggcgcgaatgctatttagtcgttcattactgtgtgttttggtgtacacacccggtaagtataagagaaaatccctttatacccctgggattttagctaatttctttcatgcccatgaattttgcttacttccttgtaccccaaaatttgattatgatcccttccatatacctcccatcagttgaccaacgaattgctataaaaatgatcattttacattttggatgaacatataaatttatgaattatattattgaaaatgctaaagtttgtcacacgagactactatagttatgagtttgttgtgcgatgcattatttacgacaaaatttatttttagataatgagataaaaatatgtatttattgctgtgcgatacactctggtgcccccttctcgtcctccactcatccccggcaatctgttactctgccatttttgcacgcagttgcttcaagagttgcccccgatctattcctggcggcggctgtgcgtgaccgataaatgacaattatatatatcactcggaaaatatttaatacccccatatttcaactactattaaatgtattaaatgaggtggtagaagaaataaatctggactctaaacccattcaaatgaaatctcacctgttcaaaatgctttttgtactaccagtagagagcaccaaagtaggatttccgtaaatatattgccatttgtgtgttataaaaagggaaacaaagatgcaaaatgcaatttcaatctacgtaattgctactctcctgtggtgttccatgaatttgttcagcttgaatatattggcatgcgtgtgcactagtagcttgcttgtttgggaatgtaaaacattttgtgcatgcctagatgttggaatggaaggtgtcaagatagtcgagatagcaaccatcgggagttctccagcatccagaatatgatgcactacaagcgagctatctgctgctttaaaacaaaatgcttgttgcactttgctagagacctaaatgattgttgcagatgctagatcgtgcatatgctaggctggttcttcattgggcaagttctatgtgtgtacaggaagttattctcgtgttaggtgtaaatgacagcagaagtggctctaatcttacctttcatcctttgttgcactgtggaagttctcatcactgatccaagaagtgttgtgcatgtgctttacttgttccagttggatattatagagatatttaaagggttaatgtgcaatttaggtggttagagcaacaaaggggttatatccaattggtacatcctctttgttttgtcagaaaaatgtccaccataccaatcacagtgtgtgattttctacaattaacacaataattggtaaaatgtgttagttgttataattcttgttactttgttataacacatcgcaatatcactaatcttgaatcagctcatgtattcttaaccatttgttccccaacatcctctccacccacctgttgattgtaataataccaggaaatagttacaatatatggctcgttaacaatgttgtgtatgtcaaatgcactttgatcaatagatctgcataactagcataactgcagatcaaaccatactaatgcctattcttgttctttcaaaagttcccacatgaagtctacaagattgatccgtaaagtcattggctttcttcctgccaagcaatagaaaaaatatgcatatttgcatgtaatggaagaatttatatatttgcttataggaatcggaggtattcggaaaatggagatggcaaattgttgtgaggaatttatagctttgctatgcctgaggaataggtgcattgttatgcattccatcaaatagaacatctgggaccaaccagcttttatttgttttgaaattgaccaatcttctgaagatgaaaatattatggagtttggttttgcatcaccatgactttttggacagtgcagtagcccacttgtgcaatccctcaggataatatgaaaaaccgtcagagacaaacatctagttgagtgctaatgactgaaatgttcagtttctgtaaatagaatagatatgtattcgtgtctgcctggttgcgtcacatagatctgatgtatggtaatgaccaaattttttttatatattttctcgttgtatgcatgactccacgattaaactagcaacctggatcaactgttttttcatggcagtcttatagaagcacttttagcgtacataaaaccccaatcattacagtaatttgttttagggaactcttaagaaacccatgtgtatgtaacatactcaattttagcatgtaacctcctgtacctactcatctcccactctcactcttagcactgtacatgcaaaaatgcagtgcaaactgcagtaagtacattggtacaactgataaccgacgctagtaaaaattgtgactgatgtgtacatgtctcaatatctatcgcataataaaatggatcaatgggtttaaattttcccaaaagaatataagaggtggttaagggtaggattgggtgaaaattaaatgagcggtggttgcatgtgacttctccaacccgacatgctactcacttaatggatggtgtcattgtatttttccttcctaaaatctcttatatatatttgggacagaggtagtatatgtcccaaaagggcaatacataggccagctacttgtgttgttacccaaatttgcttcagtgtcctctatctggatgcaggctaatcgccttctatcaggagagcatagacaatagagaactgcgtgtagcactgcatattggattcggaggcgtcggtaaaaacgagatggtaacaacctgcagttacccatcgatgcaagtaccttgatcttgcatccgagttcactgctgaaatactttgaagcacatccggaacagaagattagattgctgtttatgatgctttgatgcttcatcaagtacggcatctctctctttctgttaccgacataagatgtcactttcaaactgctaaactgctaaacaaaagatgttacagacacttattacagtgacaaatattaaagggtagtggttgtaaaattatgtcgtcactcactttcttttgccgacaaaagacaatgaatttagacatattctcttgaaaatttgaatttcagttctttttttcaacttcacaagatgtgtttgagaaaagaaaaacatggaaagtctgataaccgtgtgattacctttgcatttgtcaaccttgctgaggactagtaagggtgtccatctctttatataggtaacgcgttcgctcctatacttttttttttttgtaaaatcacctatctcatttgtaaattatgaaaggtcaaaatttacaaaagagtagatagattgatgtgcacagcaatattatgccactattgacagaaaagtcgattcaaattttcagatagtaataatgtatattgatatgcatgaagcttcaacttgaacttatgaggaaacaacttctttccaagaacaaatacacaatcaggggcacaaagccctgctgttctgtcataaaaatttcaactctcaagcactacttctaaatttccataaaaaattcacctctcaagcacaacttctaaatttccagatatattgaagaggcttgtttcatattgaggacgtattgcctcagaagtacaggagttgtacacaatcagaacgggagaaatgatactaacttaatcacatcatctttgtttcagacattgctctagggacaagcttccaatcatcaatagctagatatgagtagacaagtatacttgattttgataggatgagtgaataagtattggaattggaggtattgggaaaatagagatagcgaatggccacttgatgactcggtgagtttttcaagtggaagcttcacaattctctcttctaacctttcctaatacatatacaagcatatggggagatggaccttgtggggtttaacacacatgttggtgatcatgatcatcactagttgattcattaagattaataaataaacaactcaattttgtcatctctacatgaaatgggacggattccctaaaagcaacatccatactgacaaatgttcatcattctgaacaaatggccagatgaattgcctgtaagtgcactttacagttcgaggatctagttttccaacacaggatttattatctctaacaaaaaaagtacgactaaacacttttggtagaatgataaattcattcttcccaaataaaatatggtgtcttcatcccaaggattcttgaatgtgtgtgattgaatacacaatcaaactagaatgaaactgtacctaaatacctttttctagttagaaaataataaatcgataaggaatttagttaatgccgcaaaatatacttctctctttgaagactatacatatagcaccacacacacaaacacatcgcacacacacatcaacatatgtgttatcctttaacacacactcaatagacagatgcaaatgataaatctccgacattagtaatttctactgaatgcgtgtccgatgtgcaaaaattgtgcccaatgtcgacataactagtagataaagtcatacatcacaactccagcacagcaccaaaggtgcttcctcgagcaagcttgtaatccgtttataattgcctgggtgttaaaaatgataacgaagattcagaaagtgcgatttaaaactgcatacttgccactcttttttgttccaacttgttccccaaatttggttcggttctctggattctttaagaagagaaagtaccatctagggttcagtcagcgatggcgtgattggatctccctcattcttagcgcctcctcttcccgggtgctgatcaatggggtgccgggtccgcgcttccatcaccggaggggtcttcggcaaggagaccctctttctcctatgcttttcattctagtcatggaagtgctcaatgcgatgcttcgtaaagcctctgattcaggcgggttccttccgcttaatgatcgcgctttgcgacaccgcgcctccctctacattgatgacttggtcctcttcctctccccggttcagcaggatctcgagttcatccaggttattctctcggtctttggtgcggcatccgggttgcgcaccaattttgccaaatgctcgattacactcctatccgctactcggatgaggacttggagctggttcactcttgcttcccctgctcaatttctgattttccttgcacctacctcggcattccgctgtccattcgcaagttgccgaaggcgactcttcagccgctggtggacagggtcgctcatcgcctaccaccttggaaggggcgtctcaccactcttgctagccgctccgtgctggtnnnnnnnnnnnnnnnnnnnnnnnnnnnnnnnnnnnnnnnnnnnnnnnnnnnnnnnnnnnnnnn

SEQ ID NO: 33791 - DNA, 4142 bp, Oryza sativa
tcttgcttcccctgctcaatttctgattttccttgcacctacctcggcattccgctgtccattcgcaagttgccgaaggcgactcttcagccgctggtggacagggtcgctcatcgcctaccaccttggaaggggcgtctcaccactcttgctagccgctccgtgctggtccagtctattctctcctccattccagtccatgtgtctatggcaatcggccttcctgcttgcgttgttaaggccattgacaagaagcaacgcgccttcttgtgggcgggtacggatttggttcatggggggcagtgccgggtgtcctggacgaatgtctgtcgtcctaaggccttcagtgggttaggaattcctaacctcaggttggcagggttcgccctgcgcgttcgctggctttggcttcagcgttccgggcatccctatttgggatgtcttgaaggcctcggtcgagcgatctgtctccaacatgttcgaggcgtccaccttcttcgtgccgggggatggtgagcctatgctcttctagaccgaccattggattgatggaggctgctcagtggcctccttggctcctgacctcctcttcgctgtgccacagcgcctccattcgcgcacggttacttctggcctggcgaacaactcctaggtttcggacatccgcggggccctcactgtccctgtcatctcccagtttcttcttatctgggatgctgcgcttcgaattcagctctcgccgggtgtcagagaccgtcttgtttagcgttggacgagcgaccagcgctactctgcgcgttcagtgtaccaggccttcttttttggccagcactcctttgcctatgctgatcttctctggcacgcgaagggtcctgctaaatgcatgttcttcctctggtttgcatttcagcggtgctgctggacggccgacctcctcctaaagcgcggcttggatagtcattcggcctgccccttctgcggtcaagagcttgagacagcgaaccacatcctcctcgattgcgtgttcgctcggcaagtttggctccgtgtgctgtcgcctcttggttggactgccctctctcctccccggggtagctgggtttgcttggtgaccttcttctagggtttgcttgccggggcatctccgagccagtttcgattctatggtcctcctggtctcttggcaactatggaaagagtggaactctagagttttcgactctgcgttgtcattggtctcggaggtccttgagtccatcctctctgagggccacctttggtctttagctggtatcactaattttggggttcttctgggaaggtagtggctctgccccctcccagctatttggagttgtgtgtagccgtcacagtagtctttcgtctcttctttattttagtcttttttccccttttcttggcataagtcggactgactgtttgcgtcgtgtaacaaacattctattcttctaatatattgacatgcaatccttttgcgcgttcgagaaaaaatacacacctgttttcttgggggtggcaaatcgttggatttggaggtgtcaagaaaatggggatcgtaaaatttagctagctagtatcaagaatatagcgtgcagtacaattttgccaaaagaatcttcaaagcatacattattgtcatcgagttcagatcgactcaaaagattgttgatgctatatcgagcttaatagttagggagtgaaacaacagggtgagctatttatcacaaagagttacgtgcgctagctatgtgcaaatgacttaaagtgtactttaattttccattgatattgttttgctgcacagagaggatgagtgcttttttacttgtcccacttggaatctaaaatttatctagtggttcttctttaaccatgtaatttactatgtgttctaagcaggtattacgtccaaggtcctctttgcctgtcataaaaacacacatatacaaatcgtaatgaatgatctgctataattaacacatttattggtaccaatgtgatcagttgttacgttatagatacagttactttgttgcaatgccttttattgatgaaatatttatggattggtaaaaatatctggtcactgcatgaactggaaaatacaaacaaaatagaagaaaacaaaggtgaaaaaagtatcatgttgatgattttaatttgcaacaatttggtctttaatttgcagacaatttataaacgatgacaaagtaacagtctccagaacaatcattatcgtttacatgccgatatcatcgcctcatccataccaaccagttttgttcgtctggttatcggaattggaagcaccaggaaaatggagatggaatatggagccacttctatagttctatatattccattgacttttgatactataatattggatgtttcagtacgaaatgtggaaataaatactttgaaagtagtcacggcagcatgttagaagtgctaagcaagatcaaaattattctttgatccgcatcgatcgatccattccaagaaatatgatgaatcggaaagaaaatagaagaagaaaataactaaagtcgatctattacaaacatgctactggaaggattgttcttattatttctggttaagctgtctcttttttaacggactgctgatagtaataagctatttcaggtactatgcagtacatcatgaacatgaaatgttgagttaaaaccctttctgatttttgctattataatttacaaaccataactctagtcttagaaatgaaaaaaaaaagatgtttccatctccgagaaactacacagcagtcagataacaaaaacattcaccaccctgaattttgggaacctaatgcatgatccaccatcgattgatgtgtatatgctgtaaattttagccaccacctgtttgaattgtgtagctcccttagtttttgtcaatctttctatttcctcctgagatcgagtcacgcaaaagttgggccgatgatcaacagagaaatcatagaaagcagactaatacctatacataacaaaatgaacaagctgaacattacttggctcaatacatattacgatgcatatactttccacacttgtgtcctcttttacgctgctgctgtccttcttgtgctgctgcagtaggaggtgggaggaatctgaacaggggaagaatgcagaaagacggatcagtaggttggtttctcctattacgagttggtcccgattgaggtaattgatctcttttaatagttttgccagccctgatgacgcggtcgtgttgaatctaagaatcacggtactctgttttaattctgaaaagttcagttcagtttagatctattttttcatggtcttagaggctgtttatatatggagaaatgctccatacaaaagttgtagaaatttctttcaagtgtatgtttgattgtaaaaatatcccaggataggatttaaccattcaaattttcagtgtatttgattgattagcaagggtgaatgacggctgatacagcgaatattccattaagatgttgggtaagctcatccgtgaaaattgctggataatactatcgactgtagttaatcttgatcattactaataattaattagtgacagttgaatcatttcgttgttaatcagtaattaacactggtggagaagtagtttttactcccggttcgtaaccccctttagtcccggactacaaatccgggactaaagatagagccaaccaggactaaagatagagccaggctgatccccggctgctcttttattctattcttttcttcattgtttttaatatattgatttcactccatccccatccccaaaatcccaaatcaattatcacctccaaatcctcaaatcgatcatctccaaatatatcacaaaatattaaataaaaattacatcacaacttctacaaaattcatcacaaatacatcacatattcatatcacacacaaatcaaatacatcgatcacaaattctcaaaaaaaaaacaaaaaacaaaacaagccgccatcttccgcctgccgcccagccgccgccttccgccttccgccggccagcgccgcgcgccggccgccgcacgaggccggtgccgcacctgcagatcggggatgagtgggggg

SEQ ID NO: 33792 - DNA, 6055 bp, Oryza sativa
caccaaccgggactaaagatattagaggggtttgacatcacctaccgggactaaagatcaaaaagtagctctaaccttttcaaccggggctaaagataatctttagtcccggtttttattgcaaccgggactattgtggaatttggtcgaccgaccaaagatggtttctccaccagtgtaattagtcaagatttgtattgattagacataattattttatttcattgttatttagtgttgattagacacaattaacatattttattactaattattctttttattttcattctatccaaacttatccatccaaccaaacaaaaaactgcgatcatctcatccacacaaccaatggaaagaacgggacaaccatattttcaaaaaaatagatatatccaaccttgatgatgaaccaacaaaccttaaactttccaacagacccaatactggcaccgcaggttgccattgccgtctctcgtttcgtcctggttcttctcattcccaacctctctcctatgatcggttgtattgtttcctaggagagcatggcatccatgatagcttatgttaactattctcaccttgtgtttggttgtccgattgacatggctttttattggtagtgaactcagatatgtataggtgagtgagtagagaagtaaactatagtgtggagcaagtgggtgtgaaagctataagtgtcccatcccccatggtgtgattttggtgggtttttcccatataaagtttggattggggaccactatagaacccatttatttcctaaccatagtttcattggtaacctgcagtttgtatgaagagagaatgcaaatgtaagttgttacgcatgaacaggtccagtggcagacacaactttaaaaaaagatggggcggagatgctaacttcataagaagaactgaacgcaacatatatcatatttatatttcaatcgtataaaaatatagtataattaataaatcaaggcaaacaagaacattcaagataataccttttatttaaaataaagcaataatctttgctccatatataatttcatcatacaccaaaagaaaagtaaacccgtcaatttgcaaatagaagtcaattcataaaacatagatgagagatatcatttaaaattgattaatatatgagaaacatattgctatcaaatcactaagcctttctagggactgtagggacttaggcaaatctattcttcaatcacccatggcttaaaatatctgcataaccttttcaaaatcaagtcctctaaaaatctcattcttaatgtagcacaatattgaaccattcattggacaccctattgcataaatatgtattatattcatcgcccaaaagactcatttaaccgttgccattgccatatataggcagaagcagtgctaagtcaataaagatgatagaccaatgaaaaagcaatatgcatttgcgtttcaactatctttaaggccaaactaccaagatcatgacacgtagtggaaatatcaatacgttgcacgtgtagaataaatgtttcaagtcaaaatgtgagaaatcttggtcatagatctccatcaatcatgcgattttatcgacattaaactttagaggactctcttagatcaagagaagacaagggaacaagcaacacagatgatatatacctcattgaatcgatgatccatcttcatgataatagaatgtagaccctattgcagaagacctgaagtaatgcagattttacaagacaacgtgcattacatgtgtatatatggcatgcattttagaatcgtatcctattggtttggctttctaaaaataatagaatgtagaccctattgcagaagacctgaagtaatgcagattttacaagacaacgtgcattacatgtgtatatatggcatgcattttagaatcgtatcctattggtttggctttctaaaaaaagccaggtagtaaaacatctgttgtcgtaatcttgagataatagtcatatgcagctttttgtcaacttcgaaaggaggttcaaaaataggatccaataattgtgtactctttatcttgtattggtgtttattagtttgtgtttgcttcatgtttgggagtgtttctataagttttctttgagctgcgcacgacttaagtgaattggtgtaataattggttgtaactcgttgagcaaaggccgagatggtattctattccattatctaaaaaaatatatgttgtctaaaaaaatatattttagaattcgtggggctttatgtgtaatacttttgggctcctaggtatgtctgtactcggcatatggcattatattgcatatttatttgttccctgcctttgcactctgtttagtgttaggttattagttccctaatttttgcactcttcttagtggtagccatgcctagtaggtggagataatttcatttacggcgttgatcatgatctagaattcattccttttcatacttatcggagattgttgagcactactcaagtcccattgaatctcttgtttcttattttgtaataggattaggagacatgggaaatttggtaacttgcttatgattgagaggcgaggaaaagaaaagattgagaattttgccaaatttcacagaattaacgagctgaatgcctcggtaagagagtttttgtggtgcgatgtactcatcaacatttctcgttgggttccctagaggaaattgtaaattttgagactggtaatgtcaataaagagatgcatgaactgcaactttggggaaatttcaacataagattgttgttcttttggatactttacttatctgctacttggactttgcaattaaatttcaaccaagatataattgagttttgctaaaatttcagtaatggataccactctgggggaaccattcaatcagtacaccatgtactaatgacacaaaaattttagtggacttaacatgaataacggtgaggtttaaactctatgtttctctaaaaggtaaagtgtgttcaaaactggttattcccctgaaatttgaaaaaatatggttatatttccagttggccatcaaaatgtttcaacagtccaatagggccaatttgtgggataagtacaaaaatttttttttgttaggttcaaaatgctgcaaaagtgacttataaatcctcctcattcacctttctcatctgggacttataaatcatgcatatatttgtgcaacaccaaatcctcttgaaaaatttgtttcaatctgaatatcttccctaacggttacctgctaatccactttaatatacacttcagcccctatagatttgcatcagtttgtctggtgacctaatccttctctacgatgtcaaattactgtagacattgtatgcatctctgcttaggatggaacaacattgcccatgtgtacctcttatgtaatgattgttatgaaaatagatgcataacggatacacaaatttaacatggaaaagcgacgggcaccaaccggtaatgatcaatatagacgagttggatacaaactcaggggatacattggcctatcacaacctccccatatggtttgcaagagatatataaataagaaatccatgagtcctaacaggtaaagacacaaagtcctaataggaaaactaatcctataatacaaagtactttatgttcttcttgttatttatttgtataggggcttggatttggtattcaatactttacatttattttttaatcagttttcagtttaaactccttcatgttaccaaagtttcacgttggccctctctgtgtaatgtctatgtaaaaactttctttaatattttttataaataagcttggttgcaccatcttagtcttgttgagagtttatgtgtcattctatatatatggtagtcatgtgttggggggatgataagggtattattgtctttttcaatttttaggcttcgccatgtattctataagattcaattatatatcaggatgataagggtattattgtgttggggggaaaatgaattcaatctccatttatctcttctccaaattaatcagtctcactattttttgttcaaaaaatatcacgcgcatatccatctagcaccattcctcttgaacattttgttttgttgtaggaactgtatatttcggataccggatgatgcctaatgttgaagctacgctgttttgaagcatcaactatgttgtgcatcaagttcatccattggtggatcgcacttaaaaattaagtggatcagacatggtgaggtgatagggggtggtggtggcgcttgcgctacggtgaaattcctcgatgcattggtgagtgtctcagtggttgtgtgcatttgttgagctgctcgagttggggcgcttgaggtaggcacctcagtggttggccgacagcgaggcacggatatttctaatttttcatgacaactaacgaaaggaaaaaactaagccctcccccgctctccgctactgaaatgcatgtgtagcacatatgtgatggtgaaacttaaatagcaatagttctatcaagtgattgaaattaagcccgttggaataatatatggtgaaattcgccttgactttgcttaattataggtcaaattaattgagaaggagtaagattaggtgccactgacaggaaccaaccctgaatgactgacctgcatgccaatagagacatactccctttgtcctataaaaagagaatctttgatcagatatgacatattctagtactaatttgtagttctagaatatgttacatccgaactaggtcggttttttattgtacagagaaagtatgcctaaatttcactgacctgcagcaacaaggcaccgatcattgagttgttcgcggatcatggtacgaaccatattcaagatgccctagcgctgggccaggtggcctaccctaccatacggagccctccatacagttggattggaacaactatgtatgtgtgtacttctgcttatcggaattggaggcaccaggcaaatggagatggaatggaggtccttctaaatcccataatcacgaacatttcgtactacaacgctataagatattgtgcattgtggatagcctcacagtcgcgcattcacctcccgggtagcacgggcagctgcttgggcttcaatgcaaagttctctggcacatagcactaatccttcactgtgatggattaattcccgggaaagatttgcatgtgagagttagaaacggaaattagtatggagagttaagttagcaaagcatgcaggcatttgggcctgggtcctcagctgcctatggcctctgcctgcctcattgtaaaaagaaaaatgtattagtgcggtatatgttttcactcaaattaagcttcaacgtacttgttgttttatcctttcttttctccataaatatttacatgcattttggatccactggtggagaaaccgtttgtagtcccggttggtaaccccctacgaatccgggactaaagatagctatctttagtcccggatgaaataaccgggacgaaagatcggtgcaccattttttttatttgcatagccctgtttgttgcatggttgattatatatatatatatatatatatatatatatatatatatatatatacacacacacacacacacacacacacacacacacatatgttacaatacatatatatgcataatatataagcatatatatatatgtatatatgcatatgtgtatatgtataaatcatatattacacacatatgtataatttaaagcacttaacattttatgtgcatatatgttaccaaaatatatattaacactaaagtaaatttgtacatatataaatatatatatacatgcatatatagtacaattcatttgctcggtagctatagctacgacttcgacgccggcgttatgacagaagaggaaggaccgacgttatgaattgttgatccgtcgtagtagaattcaccatcgggattaagaacttcttcgttgatgaatcccatcagttgttcttgaacagccgtgataaa

SEQ ID NO: 33793 - DNA, 5241 bp, Oryza sativa
atgggctgaccattgcaggaggaatgtacggctggggatcctgggaccgatgtgcggccatacgttcaatcaccttccttgccacctcctcttgcatgctgagctcgtagctcgataccctgtactcaaaatctgcaatcttcgcctcggtatctctcttgctcctcatccaactcctatacgtgtggatgtcctccttgaacccaatcttccaaggaatcactcctttccctcgtgttcgtcctggatgctctggagtctgcagggcgagtaacagctcgtccttctctctgtccggtcggaacgtgccctgagaagaggcttccactacgtctgttagtcaacgcgcagcctcgcgtatctgatcgccgaacatcagggagccatcagctgggttgagcgttccaccgtgagcatagtaccagaacttcgattattctggccatttagcggtggccggttcgatacccctctcaagcaagctagcctctatctcctcccacttcggcatcgtgacgctatagccgcctgaccccaagtggtgatggtacttcttcttggcggcattttctttatttctttccatcatcgcttgcccttgttgccctgtcttataagccacgaacttgtcccaatgatcccttagctttgggaatgtgtcgaagttcggtgttagacccttcaggatgtatttcttgtagagatcccccttgaagctctggaactgttctgccattttcttcagagtccactgtttcactatgttctccgtacccgcgagtagcgtgaacgtctcgagcattatggtccacagcatctctttctctgagtccgggacaaagctgtcattatccccgcgtgcccttgttctgcgccagtacaccgtgctgacaggcacgttgtccctcacaacacaaccgcagtggcgtacaaaattcttggctacttctgccggggcactaggtcggccatcttcgtccacatcagttatgatgtgccgaccctctatcttcttcgcggcacctcgttgtccgtgtgccctcttctgtccagcggagggatgacttccactagcttcctcctcatcgttcccctcctcgttcccctccgcatccctctccacgttcccctcctcgttcaagtactggtttggatcctcgttcccctcttcttcgttccagtactggctgcttccctctgcgattgtatcatacagtatctgttcctcatcgcgatcagccatctgtgcatacaaaaaatatttgttaggtctataggtcatatttgctaaccgtaatattaaaactctactaatcttatattaaatatctaataatcttatattaaaattgtaataatcatatatatatgctaagtctaacaatcttatattaaatctctaataatcttatgttaaaattgtaataatcatatatgctaagtctaacaatcttatattaaatcgctactaatctcatattaaaattgtaataatcatatatatatgctaagtataacaatcttatattaaatcgctactaattttatattaaatctctactaatctcatattaaatcatactaatcttatattaaaattgtaataatcatgtatatatgctaagcctaacaatcttatattaaatctctaacaatcttatattaaatcgctactgatcttatattaaaaatgtaataatcaaatatgctaagtctaacaaacttatattaaatcgctacaaatcttatattaaaattgtaataatcatatatgctaagtctaacaatcttatattaaatctctaacaatcacttctttacatcacttgcctgcgcgaattcctttgatggctagctaccacttcggcttgagggacgacggcgacgtcttctctgcaacattaccaggaaatcttggtaatatatatatatatatatatatatatatatatatatatatatatatatatatatataaaatcttgtatgtattaccaggaaaatgtattagtctaaacgcgttcgttctcacacttttagtacaagcgcattcacgttcgtaagcgtttcgttcacgttcgttcacgctcgttcgcgttcgttaacgtttcgttcacgttcgtaagcatttcgttcacgttcgttcgcattcgttaacgtttcgttcacgttcattcgcgttcgttcacgttcgttaagcgttcgttcacggtcgtccacgtatcattcacgttcgttcgcgttcgtccacgttcgttcacgttcgttcgcgttcggtcacgtttcaatcacgttcgttcacgttcggcgatgttgggcgcgcgcggcagtggcgtggcggcggcgtctcgcggcggcgtcggggcgccgttggccggtccggcgacgtgcgggcgcggcggcggcttgggggcccggcggcgtagggcatgcatgcatgatattaaattgttaaaaactctaattaacatatgtaaatagcacatgcatgatttaaaattaataaaaattctaataatcatatataattagcatatcatgatattaaattgttgaaaattctaattaacatatgtaaataccacatgcatgatttaaaattaataaaaattctaataatcatatataattagcatatcatgatgttaaattgttgaaatatctaattaacatatgtaaataccacatgcatgatttaaaattaataaaaaatctaataatcatatataattagcatatcatgataataaattgttgaaaattctaattaacatatgtaaataccacgtgcatgatttaaaacttttaaacattctaataatcatatataactagcatatggatgatttcaatttgataaaaattgtaataatcatacataattaacttatgccatacaacaattgatttgtacggatattcaatacatccaaaatagtttacatcgtgtacacaacaattacgacaatacatcggcggtgacgattgaccgcacgtactttctcctcacaattgttccttccttgtgatcgctacgtgagtaaggggtgtcttcatttgataggaggatgctagggtcaatcgtcaccgtgaaagggggttgcccatcaaactaatcgtaatcctcgtcagtcttgtcctctactccgatgatttttctttttcctaggagaaccacatggcgctttggctcgtcaggccctttggccttttttcctttgctggacatgtccttgacgtaaaaaacttccgttacatcattggcaaggacaaaaggttcgtccaagtatccaaccttgttaagatcaaccgttgtcatctcactgtcattaatcgttacgcctccaccagtcaatttaaaccagtggcaccggaacagagggaccttgagagatccatagtcaagttcccatatgtcctcgatggcaccgtaatacgtgctagttgtaccatcgtgtcctatggcatcgatacgaacatcactgttctggttcgtgctcttcatgtcttgggccctcgtgtagaatgtgtacccattgatttcatatccctggaatgtcgcgatcgagccagatggtcccctcgccaggaaggccagttgttggttaatcgtctcgttacccatgagatgttgtcgcagccacgcggagaaagtatcaatgtgatgccgtgtaatccatgcatcggacttaccgatgtttctggcgcgaactagagccaagtgctcctcgatgtagggagccaccaatgaagattgttgcagaaccgtgaaatgggcttttgtcacagcctgattttcgtttaaggatttataaatcatttaataaattattaatagaatttatattaaatgttcattaatttacaagtgaagttaaatatgggaaataaaatttcctaaatataaagcatggttggatttaatttttattaaattctccatgattaattatactctctggaattttctcagatttttcagagctcaattcatagttttaataatacaaagaatatttcagtaattatttaattaataaattaatcattaaatggtctggttttaatattgttaaatactttgagtgtccaagtatgttcaagatttttcttggaattatttgagcaatgaaagtatttttaacaattgaaagatcatctcattggttaatttatttggaaaagtaataaaaatcctcctcctcagcctgggccgaattcagcccattctctcccttcctcccagcccagacaaagtctgatttacctccctggcgctacagtactccatcttcctcctccagacagagccgagccagccgtgctcgtgcacagtgccgcctcctcatccgacctccccgttgctcctctttccaaattagttgcgggaatggaatcctctcaatctcctcttccttttccccaagaaatccccaaaattttctatggaaattctttacaatttcgcggatcaaatccttcctttttccggcgagaaccctagactttcccgattttttttctcgtcgatttgggcccggacccgagctcccgtgcctatataaaggaccccctagtcgtcctctccctatcccctcaagtcccgtccgccgccgtcgccggaaacgctctccccgcgctctccttctctctccaagcgccggcgccgctccagccgtccctagccgccgcctcatctgcctccttcctgcgccgccacctccatcggctccgcaaggtcgagctccaccccggccgccgttccccttgcgccgaaacttcgccggaagccgtcctcgccatgaaccagtgggttgccgtcatgttccgatctccagccgcagctagcagccgccttagccgccgcttttggtcgccgctgctgccgttgggttcgcaagaaggagagggagcccggcagccatctccccgaagccgaaatccaccggagctccatcgtcgccgtcaacccgaagctcgctgtcgcattttgatttccggcgaagccctgctgctcctcccgtcatcgccaagcttcgccgctgcctccattggattcgcagctgcgaagtgaagcccggccacccctccgttgtcgccgcacatcgccggaaagtcgtcgcctccgtggacagtacctcgccgcccttcgaagctcgttgccggccatcttccgttgccgttcgtcgtcgcttaagtggtggtaagggtcactttgatcccctctcgctcccggtgccc

SEQ ID NO: 33794 - DNA, 7369 bp, Oryza sativa
acagtcgtgttgctgctgctgttcgtaaccgcttgccgctagctgctgtctggccgctgtgctatgccgggccattgctgctataccgggtcgcagctgtgcgtcgcttaaacctagccgtcgctttaacccgttgctcggtagttgagttgtctaggtgtaggtgcatccctaaattcctgtcggcctatcgtttgccgtaccggggctttaccgtgaattgtgtctagctcaccggtttagttgcagccgttgctgagtcgttcgctcgttcgttcgaacgaggtgttccccgtgcttcgttcgttcgtccgtgttgactcctcctttagttcagagctaccggttccgttcgccggtttcggttgatcatttgggtgatcccgtgtcacgtagagttgactcgttgagtcggtatctcgtgaggctcgcttgccagatcaatctaagccatccgatcttggtcgactctttgagtcggttgatctcagccgcccaaaatcaatataaatcctttccactctttccaatggcatattaattctttttatcatatgtcatctaccaaatataatctaatctttttccgaaggttgttttaatctttcatctccgttataaatcatttgtaaatggtttaattaatgtggaatagtctttttctttaataggtttaattgtaattaaatcttgtaaaaatcataattaattcatacgaaatcggaatgagaccgttcaagtctctaaatttatctaaaatcaagatctacatgtttgtttacttttatgtactgtttatttggtttttattagtctttttcctcgttttgcgtgttagcttgtcgtttccgtcgtttcgaaggattcgtgaggcgttggaagtattcaagaagactaactgaagaccgaatattgcaaggcaagtcacacagatcccaaacacaattcctttgagcatgttgatcctatatttaaatttcctatttatttcaactgtgcatttattttcgaatgtcaccgggtggtgagcctttcccatttaattatggccaaagatgactttattttcctatgggttataatttgattagctagaaccttatatattggtttggttcagctagatgcttataatagatgcttagccatgcttagaaacaatagctcactaatgggataaatcatgcttcactatcacttatggatatttaatggaagctcacgatggttgatcgtgattggttaattaattaatttgccaactaaaacttgataatggtgggttgtgagcatatggttttgatggtcgtgctcatgataattaaggaccgattcacgagtttcggttgtgaaacattaaccatgccaaccacaagccagcgtgggcaacggctttaccttttgtatagcatggttcattgcggagcaccagactgagaagtggcagagataagcccacgagggtcgctggggagtccatgccttgtttataagggggtgattatgatccaggaacggtgcgctgtggtggattgtgttgtgcgaggggtactgtcacagctcctttctgaggtactgtggtggtattgaggcgcatggtgacatgttgtggggctgtgtcttgtgggtacagtggtacacctctggccagagtaaaactattcgaatagccgtgcccgcggttatgggcgggtctaacaatgtctttcgtgattagtctcacacttctcaccataataaatgatgctataattggtaataatttgattagctcctggtttggaatggtatattcctggtttggagatagatctgtacagccgggtatggttgttcaggatggttgggcctgagcagcatgggtatgctgtttagtgttgattaaaattgatgattaattactctactgttttataattctcaaatgtttgctaaatgctgcttttgcaaatgagccctatattatgccattctttggtatccttgtgcacttgcatatttgctgtgtggcttgttgagtatgtcatatgctcaccttgcaataatcaatcaaacctcagttgaagacaagttgtggaggagaaaacgtttggcttataccccagttgagctgcctgtgggagtggagccggagcttcgctagaccgtaattccgctgctgtttttcttttcttttgtaagtatttacgttattattatgatgaatctatatattaaattgtcagtttgtgtacctcggctgattactggacgaggatttaatgcacaaataagttcggaaattactagtgaatttctgggcgtgacagctttacggaataaattgttgtctaccgtcattattgctttccttcgagagtcccctttccccgtagtctccgtccatggtgtgattcaggtaccccgattgggcgaaggtcttcgataaattctacgcagaattcaatgacctcctctgttccataccccttggcgatgcttgcctctggacgagcacggttaagaacatacttcttcagaacgcccatgtacctctcgaaaggaaacatgttgtataggtacacaggaccgagaataccgatctctttgacaaggtgacaaagcagatgcgtcattatattgaaaaatgaaggtggaaatatgaactcaaagctgacaagacattgcaccacatcattctgcagggcttctaatctatccggatcgatgaccttctgcgaaattgcgttcatgaaagcacatagctttgttattgttgcccggacattgtctgggaggataccccttattacaactggtagcagctgtgtcatcaacacgtgacagtcatgagactttaggtttgtgaacttcttctccttcgtgcttattattcgctttatattcatggagtatccagacggtaccttgatgctctccaagcattcaaacatactttccttctctgccttgctaagagtgtaattggctagactcaagtaatggcttcctttctcctttggttctgggtcaaggtcgccgcgttgttccatatgcttcagattattacgtacttccagtgtatctttcgacttttcatatacacctaggaagccaagaagatttacgcaaaggttcttagtgaggtgcatcatgtcgattgcatggcagacgtccaagaattcccaatagggtaactctcaaaatatagagttctttttccacatcgccgcgtgaacatcttcgctttctataggctggctgccaggcccctttccaaacactactttaagatctttagccatagcaaacattgttttcctgctgcgatgtttaggcttcgtacggtggtccgccttatgttcaaagtgcttgcctttcttctgtaccgggtggtttgctgcatggaatcgacgatgacccatgtaaacaaccttcatccatacagtgagtgcaagccttgtaccccttgttggactgcccggataggttgctaagtgcaggccaattgttgatggttacgaacagcagcgctcgtaggttaaactcctcctgtttgtcctcatcccacacggggacaccttccttcttccacaacagtttaagatcttcgaccagtggtcttaggtacacatcgatgtcgttaccaggttgcttggggccttgaataataatcggcatcattatgtacttcctctttatgcatagccaaggggggaggttgtagatacacatcgtaacgggccaagtgctatggccgctgctcatctctctaaaaggattcatgccatccatacttaaaccaaaccgtgtgtttcgtgcgtcctttccaaagtctttaaattttctatcgatgtttcgccactgcgaaccatcggcggggtgtctcagcatcccgtcctgttgacgctcttcagcgtgccaccgcatcattctagcatttcccttgttcctgaacaaacgccttagctgtggtattatagggaaataccacatcaccatagcaggaattctcttcttcgttagctgcccgtcaacttctcctggatcatctcgtctaatcttgtatcgtagtgctttgcaaacagggcatgcttctaggttctcgtactcctcaccgcgatataggatacaatcattcagacatgcgtgaatcttttgaacttccagtcctagagggcagactatcttcttagcctcgtacgttgtctcgggcaatttgtttccctccggaagaatgttcttgacgagtttcaataaatcgtcaaatgccttgtcactaacactattttttgccttccactgcaagaactccagagtggtatccaactttttgtgcccctactcgcaacctgggtacaacgacgttgtgtggtcctctaacatcttgtccaatttatgggcccccttttcactttcgcattcctccttggcgtcctgcaacatctgaccaagatcatccgcaacgtcgttaccatgagcatctctttcctcctcgcccgtttgatttccttcaaatccagcgtatagagcaaagtccggaatattgtcgtcttccacttcatattcttccatttcaacaccttgctctccgtgtgatgtccaacaattatagcttggcatgaaccccgactcaaacaagtggaaatgaatagtcctggatgcagaatactccttctgattcttacacttattgcatggacaacaaataaaacccttttgcctgttagcttcggccactctcaaaaaataatgcacgccgtcaataaactctgtggaccgccggtcagcgtacatccattgtcgatccatctacatgaaatgaaaaaaaattgtacacaaataattattcgtacaataatgacagtcatataataattataaaataattacaaactctttcaacagtcatacaataatgacatatcattattcatacaaaaattatgaaatattacaccaaataattattatttactatttctaaagttttaaactaatattaatgtgttgtacttcttttaattttcattttagtttgttttctattatttaagattaactttcactatattttccttctcaactattttataaaaccttctttagcaaataaactaaatttctatatattctttcttccccacacaaattttctctatcatcaacttacaacaaaattttggagacaaaaaagtgtgcaaaacatagctccaaatgtaatatgacaaaaaaacattggaggatgaagttactaaccttttaggcacctccgatttgtatataatcaccataataaatttactagaaattttggcatgacctcccctcttttttgaagaaattttgaagcttgctcgggctggagaaggaagaagacatatatataggggttggactttagtcccggttggtgttatgaaccgggactaaagatccaggggggcctgacaagccctgacagcatttgaaccgggactaaagattaccaaccgggactaaagatcaaatatgcccgttaccctttttaaccgggactaaagatcatctttagtcccggtttttgttgcaaccgggactattgtgcaattaggccaaccgacgaaagatggtttctccaccagtgatcatattttatataaaacttctttttattaattatgatgacgatatacggaaatataaacatggtttatagtatagtagtttaagttaggctcacccaggcttcacggaaatcctcgctctgccactagcctcacattgggtgcttgagtaataattgaagaaagaatcttgctatacgtacgaccaagccgtacgatttgtgtccgaccgagtcatgcaaccaatcactgaacttatttactactatgtgggctcagacaaacagcatatatgcttatacttacactagtcagatggatgggtcggacgtataggtcggacgtatagcaatttcgttgaagaaatcaatagactcataaacgattgttttctgtttaaatttttgcagaaatcaatagactcataattgcagaaatcaatatgttcgtggtagtcgtggaagcaactttcaagtactaaggaagacgaaagttgttcctgtagcagtgtagctacacccatttcaatcaatgtgcagacttcaaaaggaactggaagaagaaaatattatagactcataaacgattgttttctgtttaaattttcgcctttcctctgtttttaacagaccgcaaaaagttagtaattggagatactgccctgtacatcatgatgctcaaatgagatcaatatagcatgaccagggaaggtttttttttttttttggccagaaaggttaaaacacttcgctattttcagttgctacacattagtattacaaggaaaaaaaaggatggccataactacaccactgatgtctgcatgattgtgatgtgacacaaaatataatcaaatcacacttcttggttttgctgaaatctatctatggaattgcaaattctgcctacaaattaaaatgttcatgcgagcacatacagtacagggaaaaaaacatccatcatgcatatgccctgaattttgcagacgtataaggaatcctccattggttgttgtatgcagaacattttagccaccatctccatttcagcgtttctcaacctttagatctccagcttctgactgtcatgcggcaagatgaaaaagctaaaatctgagcattatatttggcttccaccatgcatcatgctcaatgcatacataaataacaatttcgaagctacacacaaggagatgtctttgatttcgtgtacatttcgaatttgtgttacaaattactcagtccatcccttcgtatcgatcaatggctgctgcaggatttgggctctataaaatcaagtagttgacttagattttgtgtgatgaaaacattggtagttggcgatatttcaagtgtgaaagattggtttcttgtgataattggttttgtgaagtgatgttgctattgacccctggcggtcagaccggctggatgccacctacatgtgttttatgatcccgacggtctaaccgctggcaaggcggcagtctgactggcgggagtgtggcggtctaaccacaggtgtataggtggtctgtgtaggatcgaacatgagtaaccaagcctaccagagggggtgaatggtagggaaaatcaaaaacccaaaaacttttagcggaaataaaagttaccctcaaatcgaagaagatcttgacgttgtccaatcgccgctggtcacaccgctcctaagccgccggtctgaccgccgtagcctgcccggtcagactgctgagttgtctttggttagaccgttgtactcccaccggttagtctgccgccttactg

SEQ ID NO: 33795 - DNA, 11842 bp, Oryza sativa
  unsure (1)..(11842): unsure at all n locations
tgaaagtatatcaacttttttgtatcaatatgtgcttccaaagtacatctaaagcactcctttctgaactcacaaactaggattgaaaccacataaaccctaacttttctctcataaaagtcgatatatttctgcctcaacccctcgtctatttatacatcaaaaaacccctactcaaattaggtgtagaacttctattcacaataggactcaattccatgctaccaaaatcatacgagccagaatcctatccccatccatgtcggactctgcgcttgatctccagcccacgtgggccctgtctccagcttggtctccagccacctactaccgagccgctctctgccgaaatgcctaatcggcgactagtcgcgcgcctgctcccccgcgcggcgcggccacgtggcgcgcgcggagggggggtggggtggaccgggcagcaggaggacgcgagaggactgatgcgtgtctagttttttttggttgttcttcggttttcctctggttctgtcggttttttagtttttcttcagtttccctctggttcttctggtttttcaggtttttaatatatatacaaactttgtatacacgtatataaagtttgtattcgtacctatacaaactttatatatgtgatttttttgttttttttgattttttaatatgtgcgcatacaaagtttgtacatatcataatataaagtttgtacatgttgtatacaaagtttgtacatatcataatataaagtttgtacatgtcgtatacaaagtttgtacacgtcgtatataaaatttgtatatatgtatgtttttttatacatcaaaaatatatacatacagtagagtagtagtattagtagtagtagagtagagtagtactagtagtactactgtagacagtagtagtagtataggaggaggaggcggcggcggcggcagcagcagttaggagtagtactagacaagtactccagtactaggactagaggccacaaaatagttaaatggatagaatcgactaagcagagacatccataatcttctttacatcaagtaaatcctttggctcctatacgcctttttctttaagttatttattgtttctctcgagccatagggaaagtctatgataaataaaaaaacatctcactctttctctatggcccacatttcatgataaataggggaagatgttttcttcaaattctttgttcaattctgaacaaaaaaaagaaaggaaagaaaggaatttttcaggctgtggtatcctatatttcctaatgtatattgtaggaataatcaaactattccttacagcagtctggaacacttacgtcttcgcaaagcaaataatgatcattgtaatcgtaattgtagaatacgactacaattgaaatgcatacatttggttcatacgctattgggaagagtaggtttattttacagaccgggaactctctaagtcttaaagtaaaggaaagggccgcgatcgaagtaccaaccgcaaactgtgagtaaccttctctatttcattaactaagagggaattagaatctttctcgaatggctacccttgacaaagggtagctgtatggtatcataatttacatgtagtgggtatagttaagtggtaaaagtgtgattcgttctattattaataattgaatttgaaatgatatacttaaggcgtccttatgttttttatattccgatgaaaactttagttcttagaaaggatttactcctttttctctcaatagcatattgaggaagaatatgcattttcgcgatttgtacccaaagactaattgaaattgcatgcaaaaaacaaattggatttggattacgagtacagagtcacgaagcatggattccaatttttaaaatatgagtaaaggatctatggatgaagatacaaaaaaatttatttccaatcataactaaatcttcttttgttaaaaaaaggaaatggaagccaaatagctaaaaaacggtagttttggtttacaagaaccatcagcaaaanggctcagnnnggnggnnncccnnnnnnnnnnnnnnngnnnnanaaattttattatttaaatttatatttttatttttttaatccgcccccccccccccccccctcccnnnggccnnnngncnnnnngngnnccncggnccccntcaggcaaaaagagctganttagatgttaagtggtgagaatacccataaaggagcngaatgaaattaaaatttcatgttnggttttgaattagagaggttaataataatcaaccaangnngannataacttctagctttccaagctatcgactcgagttcattctcaccacccgctccattctgtataaaataactattctatttgtctagacatgatagaggcctgtattcaacctttttcgtccaccggtttccagcgctccagagcagagtagagcagtttggtatagctcacaaggctcataaccttgaggtcacgggttcgattccagtctccacacttagcagtctgtataaaaggactattctatttgtctagatatggtagagggctgggtggttgggcggtatccaaccctttttattcattagttccggaccctataaggccaaatttagcaggttgcgaagtaacttgctaccacaagaggaactctcaaggccccctaccttgcagaaaagaaaaaaatagatgaaagaaaggcacagtctatctcccttccctttaaaagttgtttgctggttgtttgtttcgatgaatccccagtttagggagccctgttgccgagttcgattctcgccgcagtagtgctctttttttgagtggggtgcaaagggggctaagatagtaaaggggtacggtactagactaacacctattacattaataaaagtagactaaattttttatcatggtacgtaccttactaaattaagctggcgagcggcgggaatcgaacccatatcttcttcttggcaaggagatgttttaccattgaactacgctcgttacgtcctatattttatagggtatatccacttgggtcgactgtctatgtatgggtagacagtttcattttctatttgagttttaattttattaatttaattgtctgtcaatcaattcggggcgcaaattacatttaagaaatgagagaatttagaatagctaccagaaagaccagtcctatccataatgatgtatcgaaaaatacaacgtttttattgtttgaacaaccatcaagagaagcaaatacaaggggtacactaaggactaagactgaggaagtcacaattaatgcaaaaacagctaattggaaagcaatagtcatatttctaatccttcaagttaccatcaaataaagttaactacgtattatatttgatccctcacttaatcaaaattgtaataaaatacaagtaggaggggtttaaaagggctaccacgagttaaaagagcttcctattcaattccaaaataaactaataaactaatacgccccacgcgagcagtcgcccattaggggccccgctctctgctgcctgggcctcgactcggcttgccacccagccgaagcctgcagcccaaacaactagctgcacgcctgcacctgcacgcagtacgcatacacatccatgtactgcatgctacacaagcatacacaccacgatacagtatacacacatatatgcatgctacattacctcaccgtactgtaacgctatctactccaatccaatttcttccaatatccttcgcgaacactgacccttgtacacacacttcgtgaagcccattgcaaagatctctaccacacgctgtccatccaccatatgccatctcgtatccaacttcgtcacccggtatccttgatcgtctggacatcaactcctccctaagtcttgccccgatcccaaccgttgaccaaagatgactcccaaaaatcctgactctagtcaccttctcacatggtatcccgatcgcagtagacctctgctcctccttgaacatagtcccggtcctcaccattgaccaaggctgacctcaagttacctgcacacaatcagacaaaacaactatttctgggtacagatatcacaacctgacccacattagtcacacgcactcacaccaacatccacacataattccaaaccaattcactaaataaatcattttgcaaagccaattgttcatcacaaatattaatcatgacaatgatttcatggtctgaccggcggagctatggcggtctgaccagtggcaggtggacggttcgaccggcggcaacaggacttcgtcatctgtctcgttcgaggtaaatcttttattccgcaaaaaattttgggtttttggttttttctgccattcaccccctctctgatagatttgtttggtcttgatcgatcatacatgctcttcgaattcaacatcaagaatgagatcccgatgcatctgggtgtggaggtggtgcggctagtgtacgttttcctgacgccactcatgcacatggtctaagccaggctgcaacttatattaccgtgtgctgctctataggctagcatgtgtatgtgcattttgccatacgttacagatatgttacagtcttgtagagctggttggctgcaccctcttgcatatatatcctctagttaattttatgatttctggaattgaatctggtggtccttttatttatagtatagaactaattggacaattggttggttccttgtggtggaaccaacccacctgggttcaagttttagacttgatatgggtgcttgcatttacagttaattattcttcggacgcgatggccgatcaacggaaatattgatcccagaagatggtgggcaaaatttgctacaagacataaaaaatatgtaattagccagggggcaccgtaagaacatgtatttgttgcagggcattgaaaaaaactggtaattagctgctggacactcgcaccattaatttattatttttggaagaataggatagagaaacaaccattaaggacaagtttgcccttggctcgaatgaatccaacgtgggccccacatgtaagcccctccacatctttctttcagatgagaggacggagcagcgagaccaggccccttcggccggcaggaggtaggcggtggtggtggcacaaccatccgtggtgagcgcgacggagggcgtggccgggacagtgtgctcggtgacgagccgctatggcgagaccagctaccgtggtggcgtccgcactgctgctggtactgctcctcatcttctcccctacatgtcctcgccaccgtgtttgcgcctcgtcgacgccgaatcaagcaaggcaaggaggaggagatccttggatccagctccctaccacccctcgccgcccaaggaagtggatctagagactagcaaaatgaccaagagatggcagagatgagggatctcaatggtgttggcgatggtgactaccgcgtgctcctcgatgcaagtggggccaagctgttcgcagacagcatgcacactgcgtgatcctctgcgctgccgtgcgactgcttggtcggttgggccatgtggtccaacgaatagtggtggagactagaccggaggggtaagggccggcgccacctcgtcttctcacccgccaccatggccaccgcctcgctagcgctcgtcgctacccctctatgtgaccacgcacgttggccctccccgttgatggctccgccacgccgtatgtactggcgtccccagagcatgctagccatccttcgtgtggtcaacgggaagataaaggaagaaaaggaagaaagaaagaagaggaaagaaaatagagcgcctaaggtagaaccgtacttacatagccgtttctctctccaattcttccggatataataaaataatcctgcgagtgtctagcagctaattaccagttttttgcaatgccttacagcaaatacgtgttcttattgtgccccgtaactaattacatattttttggatgtcctgtagtaaattttaccaagatagtatagactccatccacaagggacatcccaagcgccatggtgacaaggggcagcacacccacaattagtgtctaaacagggtgttattaaccttgatttggtttctgaaaaattcttacaagtcgatatccacttaagttatttggttatagagcaattttagcgtactatctttggtacttaaggtaccataaatttttgatacctccagatactttctagtgtaaaatttggtatatcgagatattaaaaatttgtgtgtaaaatgtggtacctcgagataccaaatgttggatggtaaaattgttgttggttacctgttcccagtatcccatattaccaatgttatgtgtgtagagttatatatcttgcgacctgagaagggcagggaacatatgtaatacatatcagattcttcccatttggaaacaccagctactcttgttttttccttaaatttccttcagtcctttgcctgaatgcatgctcattgctattgaacatacacagtaagaaaaattgtatgtatcccagcatcttggatttgggggaatcaagtaaagaaagatgacaagagaacatagacagtagaactgtgtatagctctgcatgttggatttggaggcgtcggtaaaatggagatggtatcaagctgcagtaacccatcgatgtttgcccctgatcttgcatacgagctcagcactgaaacagtttgaacaacatcctgagcggaagattgcggatgattctttgatgttcatcaagcatgatatctttcactttctataactgataaaagatgtcactcactttacagtgacaaaaaaaaaacagatttacaggatagtggttgtaaaaacatgatgtcactcactttctgttactgacaaattaaatgacaatgaaatttagacaatttttcttgaaaattggaattccagattttctttaaacttcataagctgtgtttgataaaagcaaaacatggtaagtccgataaccacgtggtgacctttgcatttgtcaaccttgccaaggagttacgtttgtttttagtcaatgccttatgtcctaagacaatttccttttctttctgtaaaattgcatatctcacatgcaaattattgcaaggtcaaaatttatgaaagagtagtttgatgtgcagagcgctactatatatgtacccctattgacatataaaagttgaaggaaattccagatagtaataaggtatacgatatgcatggagcttcactcacctgccacatcaacttaaacttatgataggaaacaactagtggtgagggaaaactttagaaaagggaggaagagtaactgaacaaagtgaaattgtaaaaatgagttgcagttggtgttgttttcttctttagttccacctcaggactcacctcttcataggcttgcgggcatacccaggggaaaaatcacaggtccgccactgtatacacaagttggataatgtgtaaaatagaatcagaagggaagaaatggaagtaacttaatcacatgcatcatcgttggatgtttttcctcttgcttcggctactgttgtttattgcgacaatgttagcgccatctatatgactgctagtgcagttcatcatcgtcgaacgaagcatattaagattgacattcattttgttcgagagaaggttgctttgggacaagttcgtgttttacacgttgcgtcctctcatcagtttgctgatatcatgaccaaaggcttgccagttcagttattcactgagtttaggtccagtctttgcgttcgtgatacatactcccgcttcgagtgtgggcgggtattagagttagactagatttatagcctatatatctactgtatctgtatatatctcttatttaagagtttgttataatcactattgttttggctatataaatacaatcgccccccacgttcggttgtgtggcgtccaattattctctatatctaaggagaaaatctgccaattgtaaaaatctagagatgagtagacacatagtacaaacattcattggcagcaaggtacaattatgtgataatcccatcttgagcatgctatacccagttatcaattaaaatgaataagtagatcaaaacatgcatttgataaaagaaacgaatggagttccctggatagcaaatcacagctaagatttgaataagacaggttgctaaattcagtggtctcccaaaaagtgcataagacttctttttttggagaggaagagttaattagttaattgtataacatgaattctctcaggaattattaatgagtccactaattgactagattttaaagaaaaaagagcaacatagtatggcacaacacaatgaaactatatatggctaactacctttttttaatttagggacaaataagtggattaggaatttggtttagcaaaatatacttctccatttgaagactatacatttatacaggttgggctagagtgttcagggtatctccgatgccatgccatagctatcccataatttttgttttacacataaaagatgcacacgcacctgaacaaccacacaagcaacgcacgcacccactgacgtatgcgtcatcctttaacgcacactcaataaacagatgtcaattattaatccctaacattactaatttataataaaaagcattcatggtgtacaaaattgtgggtacaagctaggatttaaaccatggaggatagagtcattcatccactactaggatttaaacctcgagcaagctgcagtcgtatatatattagcgtgtttgtttaaaaaagggcaaggatccagaagtgtgatttcaaattatgaacactcattttttttccaacttgttccccaaaaatgcttcagttatcaggcttctataggaagaccaagtatcatctttgaagttctggtgtacacactttgtttgcttaggacagcgaaatattaattaattgttggatttggaggtgttgagaaaacggggatcgcagtttgctaggcatcaaggatattatgtactagtacaatttcaccctaatgtgttcttccaagcatacattgttgtcgtcaatttcagactcaaaaggttgttggtgctacatcaagagcgtgttagctagtgagtgagacaatagggtgagctatttatcataaaagaaagaagttacattttctagctaggtgcagatgactgaaaacgtgattcaattctccactgatattttttgctgcactgatcgatgaaggtcattaagaaaacagaaaaaatagtatttcctcacctattgcttgctaactccttgctgttgaataacttttagagagagcttgggacaaccgtgcgcctacatttgaaaaattactggagaataaaattcttgagcctgaggctggtctatataaagggaatggagtgcttgaggatttttcatgcttgcatcctttttggacgatggacatgtaaatgtttatatgttcatttctccgtggaaacttgagtaaaaagtaattccgtggtacgcttacggtggctttgtgaggcattgggaatggggaaaccacacacttggttgtagccacttatagcactcagtttgcatgtgttaaatccatgactcgaggagcaactaggtgttctagctatactggagatgatggggaaagttgcctactatggtgattgtgtttacctaatcgtactaaaattctagctaattgattgtgggtagaaagaaagagtaggtgatgatctgtttgaattgggttccacttaaagttttctaaggtggatctaggaacatcagtggtaataaaaagaaaaggtgtttccaataaaatcgtgtaaagcacatgtcgccaaattgaacagttctatggataggtcacttctttctatctaacctgtcatttcgagttcgtctcgtgcaaacacagggtgtatattggtggctaggccagggtaaagcaactaatttggttctttagcatcattgcatacatggttgattatccaaggacaaagaaccatagactatatataaatatctaatattttacctactaactggatgacaacaacatgacctgcacagatagaaggactaggtctcatccaacataattacaattttcttcacttccttcttgcaagtttcggactggccgagaaatgcatagggatatgctggctagctccacaaggtggtgggctagacggcctgagttcgaaggcccgccccttctatttattgatattaggttctaccctaatattcacgtttctaagtttctgactggccgacagagtcaaaagaaagcatgttttatagtcaagagtaagaggctacgcgtgcacaaagaaatagagaggagaggccatatatatggtttacctctgcttataggaattggaggcactagggaaatggacatggaaatgagctcattctacttgcactatcaatagtagtgtcaagttagctacttgagttggccatgcaaaaatctaagagtttagaggcagtcaagaaagcatcttagaagggctacataagatcgccggtatttgtggagccacgtgcattccaatcatatggcgatttgggaaggaaacatgagaaaagtatctgaagaacctataataagcatcgcactgccgaaaagattgtttttggtttaattttctggttttaacttctctgttttgaatagactgatgatagttagctattgtagctactgcactgtacatcaggaagctcaaatgttgacttgaatggacaaagcagtactccaaacaaataatagaacaaggctggggaaggttttttttttttggcaagaaaggttaagagactttccgactttatgctcttataattttttaacaacaacttgctagtaactacactctaatagctcacttctcacatgaaaaaaaaatgatatctccatcagtatatcacttatgtgtccaaatcagaacatcattaattgtgctgatacccaaaattcagtttaaatacacaacttgggagtgctgatcaaatctatgcatggaaccgtaaatcctcccaaaacgttaaaattttcatccaagaacacacaacaatcagagaacgaaaatttatcaagcatgaattctgcgaacctaatgtgtagttgtgtacaccattgattgctgacactggacattttagccaccacctgtttgagttgtgtagctccgcacctcagcgtttgccaatctattattgttctccatatcttctgagaattacccaaacgtttggccgatgatcaacatagaaatcataaaagccagactaaaaacctacataacatgatgaacactacttggcttcaaccatcatgctctcaacacatattacaacgcatatgtaacaattccatcaaaggaatatcgacacacgagcaaatgctatcgtcatatatattttgcacctgtgtttcggaattattctcatcccattactctgtcaagtccaaacagcggcttcagaagtatagagccggtggtcagggatttctgaattgaacaaatagaactagataagcattcatgtgctcgaggaagtcatataactgcagcatgtgttcctgatgccgctcatgcacatgttctaagcctgctctttgccatctgctgctctccagactatgtaccatacaagcatactccctccgtccgaaaaaacctcaaatcatggctttaaagnnnnnnnnnnnnnnnnnnnnnnnnnnnnnnnnnnnnnn

SEQ ID NO: 33796 - DNA, 1817 bp, Oryza sativa
  unsure (1)..(1817): unsure at all n locations
nnnnnnnnnnnnnnnnnnnnnnnnnnnnnnnnnnnnnnnnnnnnnnntacataacatgatgaagactacttggcttcaaccatcatgctctcaacacatattacaacgcatatgtaacaattccatcaaaggaatatcgacacacgagcaaatgctatcgtcatatatattttgcacctgtgtttcggaattattctcatcccattactctgtcaagtccaaacagcggcttcagaagtatagagccggtggtcagggatttctgaattgaacaaatagaactagataagcattcatgtgctcgaggaagtcatataactgcagcatgtgttcctgatgccgctcatgcacatgttctaagcctgctctttgccatctgctgctctccagactatgtaccatacaagcatactccctccgtccgaaaaaacctcaaatcatggctttaaagctggacgaattaatgcttgtccaggttcttagtcaggatttgagtattttttgggacggagggcgtatatgttaccgcaccaactggctgcctgttctgaatcaaagcaaggtgaaacaagaactgacagaaatgagcttgtcagtacatgttcaaacttctaactgagtacaagtagttgtttaccagttgacacttgagagcccctagaaacttcattatttcttattgtagttgtaaataggattttcaggaaagcaaatcaatgatgatataatgccatccaaatagtatagattggagagtataaatgagagtgatgaaaggataatgagaataatggtgtgtgcaggaggtaggtgaaatggaagatagttataattgtgatcaaattacttttctctgttgtatgtactgctatacctactataatgagaagattgaaaagtatgattgatacagtacaatgcagttacagctaggtcgctgtggtaaaggacctgggctgtcaaccccttgtcactggctttcattcacatccatctgttagtttttcaaggacacacaaattaaattgtaggcaccatttgtacgattccaattcaaattaaattataatcaccatagtatatcagtttgagtttttcttttctcttcatcttgagtggctgatatgcaatgctgacatgttcatcaccgtcaccaaggtcaaacacattttagataaagataataactacatacgtgagggagagttaattagcttgcgatttgatggtgcagttatttgtgtggattcactgatactagtatagcacaaagcttcatactagtgctcaacccatgattcactgataagtgtttctagtatagcgcacaaagcttcagtgtagatataccagccactactagaaaaaaaaattttcatggcgttggtctatgatttttgctggcagaaaaatgccaaaaccgctagcaaagtcataacaagggggtggggggcaccgaccgccagcgaaaatggatctttgctggcggccacgctataccggccgccagcgaagatatgttcattttcgctagcggtcacttagatgcaccgccagaaaagatggataattttcgctagcggttgggttatatagtccggtagggaagatacaattatttttactggcagcccacttaagcaaccaaaaattgatttttgctggcagtagaacaacctccatcttttatcaccacgtacccatgtgttcttatccacccacctctccacaataaaaatatcttcctctcctctcagcaccaaatccagatccaaatcctctcctctcctcctcacctcaacaaatccactcctccc

SEQ ID NO: 33797 - DNA, 7164 bp, Oryza sativa
agatcagggcttgctacagcatgaagagctcgggtatgggggctcgcacaccggtgctgtttggtgggcaacggagacgacggcctccttcctttcttctgtagaggctgtttttctttttccttttttcatgttcaaaatgcttgtatgctgtgttcacttccatgcatgttaattgaatctagtgaactctgaataagcatttgaatcgatgctcgaaaatttggatgtggatttgaatctgtacatgctgtgaaaatctgattttggggatatttttggtgtaatttttatcgcaggcggctagctatggttgcggttccattttgattatttttcttcgaaattattttcgctggcgggtgtcattacctaccgccagtgaaaccaaatttttgctggcggccgcccaccgccagcgaaaacgaggaatcgctagcgaaaatatgttttcgctggcggtccacataaggcagccgccagcgattcgctggcggctgccttatatggaccgctagcgaaaattgaaattctctagtggtttttcgccaccagcacagatgattcattttcactggcttttgctttgtggcggctccaaataccaccagcaaaaacctaaaatggccgccacgaaagatagatttcgtagtagtgagcatcactagaatgctaggttcatagaacgaagtttgggatcataaaattagcggcacaggctgcaattgtcatctcttgtttcctcctgatgcttctcattctcaacctctcctacaatcagttctatctttctcctagtagtcaatgggatttgtgatagcttatttcagttgttgttgcctgagttggctctcttactgacgtagttttttattggtagagatctgaggtatgggtcagtgaacatggaagtaactatacgtagggtgtgtttagttcacgtcaaaattagaagtacggttaaaattagaataatatacgtgtcgaatataatagtcctatttggttacggttagacttggagttggaatagatgtaggatagagttagaattgaactctctcataggctctctcttaaatagagaagggggcaccacaatgtaaccatggcgactataatatagcgtagacatgcagggagagatggcggcgtggccatgaacttgtagtggctaggagctatattggttggggaggagcgcccataatcagagccccggggatgtaggcttcggctgaacatcgttaacaaatattgtgtgttcctgtgccgtcatctggcatgtcttcggtgatcaatgactgaagcgatcgggaaggttagtcgtcgttccactatatcgactaagttttataacacgatgtaacggaaaagttagaagtttatgtgtgtaggaaagttttgatgtgatgtaaaagttagaagtttgaagaaaaagttaggaactaaacaaggccgtagtacatttggattaaatggttgtatagctataggcgtgtcccatggtttggttggtggcattgagggtcaatatataaaccacatgttttctagacatagttatatgcagcaaaaatgcaaatgcaaaagttgttatgcataaacaggccctcttccaaaaaaaaaggtacatgtcatgtattttagaagccaaattaagcttcacatatatgtatgttatatgaagataaaacagaatgcacgtgcatgttatacttttgggcccctagcatatactctactagggtattatattgcaaatttattggttccttatcttatggctatgattaggctgcgtttgtttgcaggggttccaaactcctccctctcattttccgcggctacgctttttaaactactaaacggtatttttttgcaaaaattttcaatagacaagttgctttaaaaaaatcatattaatccatgtttcaagttagttttagctaataattaattaataatatactaatgtgtttctctgttttctgtgctggaaaagaaggttccaaaccagcacaaacgaatatagcattagttacttattggttgcactctgcttactggtagcagtgcttggaatagtccgagagatgatgatttagagttcaatccatttcatacctttctaatgcaattcaattgaattcggttcaaagtttgggcatcttcagaccttgagatggtaggactggatgttgttggtgtgccacgccttttaccgttaatttatagtaggagtatacggtacaaaaagttgctcctggttcattgtgaatctgtgccatgcaattggaatgtcgctatgtatagaggaacactttcagaaactgatgagaatcaagttccttgatctttacttcctactccctcagtttcacaatgtaagtcattctagtatttcttacattcatattaatattaattaatctagataatatatatgtctagattcattaacatcaatatgaatgtgggaaatgctaaaatgacttatattgtgaaacggaggaagtaataggttaggagacatgggaaatctggtaacttgcttatgaattaatgagcagaatgttttagagagagaccttgctggggtgttcacatctgcatttctcgcacactgggttgcttcgaggaaattgcagatttggagaaatgtaatgtcaataagaagatgcatcaaccgcgattcggtagaatttcaattgaagatctgctgcgcattttgttattttacttatctactttgaccattccctaaaatttcaaccaagaagtatttgagttatgctaaaattttcaataaaggaactacactaggggatccatatattcatgtagtggtacatcatgtgttaaatgatgttttatgaagagctcacagtaaatgtgggaatccgtgagaggattttatgggagttaaaactaccattaaatatcaatcttttaagtttttatgtagttccttcacagaaaagtaatcgctgctaaagataacttggctaaaagaaattggaggggagacaagcaatgttgttttttaatatgtaagagactattcaacatctatttttttattgccacgttgcatgttttgctttgcaatgagtcttttttactttcaacatccccttccttgtaatgctaaaaatatttttggtaattggctaaacggagtgtcaaaatcaattaaaaaactggcaagtgttttacgctggtcattctggtgttgccgaaatgatatagtttttcttaaaaaaaaagtctaatacaatgcaggttattgcagaacaccctgaacagttcacgaatgctataacagatcacagccattacacggttgtattgtgcttatgattagcgcaatgctacacttctaaaaaaccatcataaggatcggcactataggtgctggttcatttaaaatcggcacatactgtcttttccctcctctatgggctaaaaacaaataaaacaaatacctttaaataactataggtaccggttctataggaaaacagacacctacaccttaggtgcctttttttaaaaggaccgacacctataatttattaccggtatcgattaattaaaaccgatacctataataaactattggtgtcggcgcctatagcaaactgagccgagcggagctctcacgctggccttatccattccagatggcctttatctctctctcggatgcgcttctctcgaactctctcttgcctcggcagatcggggcgggtgagtgcctccactagcagatcggggagggggagggctgcagccggcggatccgggcgggggagggctgccgccggtggatcgggggaggggggagggcacgcaacagccggaggatccgagcggggagggccgccgccatcagattagggcaggggagtgctgaccccggcagattggggcgggggagggcggcagcgggcagatctgagcaggggagggccgatgccgtcgcccatgccagcccccgccgtggccctctgccgccggagtccgcgttgcgggcggcagcgcccactcctaacgccttttcgtcggccgcgcccgctgcccggtacctcccgccctgccctagcccttgcatgccgccgccgccgccagagtcagcgttgtgggccgctcctggcgcgtcctcgtcggccgcactgcccaccgtccgctgcccagcgcctcccgctcgggcagagaaagacagagaggagaggaagagaaagagatggagaggagagaatgagagagagatagaggtgaaggaagagaggggggggggaattattagacgggagagagagagaggagaggataagaagtgaaaaattttgaagtggtgaggagggaaaaaactgtaataaagaaaagatatttttgcatgcggaccctcaagagatccgcatgcaaaaatatattttcgcacacggatctttaggaggtccgcatgtgaaaataggctcatttttaaatgcggccccttaagaggccatatgcgaacatagagggcaaattttgtagacgccgccagttacactccatctacaatctaaaggggtcctcgtatagaaagttcatttttttatagtgaaataaaaattaataagacaaatgatcattttttcctgtcaaataacttttagaggagtttgttgggacaaccatgtgcctatgtttgaaaagttactgaaggataaaatatattctcttcagcctgatgctggtcaatttaaagggaacgaagcggctgaggttttcatggttgcatccttggaatggacatgtaactaaactgttacatgttcatatgtctctgaggacagttgaacaaagtaattcgttcacaactcggtgctatgcgcttaccagggcttgagaggcattaggaatggtgaaaccacattggcgagtggaaggacgtacgcaccctgttgtacgtgaaatccctgagcggaggagcaaccagatccgacgcccccctccgtcgcaccgaaggtccccgccggaacagcaccgcctcagccttcctcgcagccgctcggcacgacggcggtctgctcgggtgtcagcaagaaaatggagtgaggagacgagaagccgagtgacgacacgagaagtccgcggcgttccacggttaataaccttctgactttgaattgtttgattgtgaatacacgttaactgggctgtagtcgaattcggccttctttacactggtggagaaaccatctttggtcggtcggccgaaatctacaataatctcagttccactaaaaacccgtctttagttccggttcaaaaggttaaagctactttttgatggcaggtggtgtcagacccctcctttatctttagtcacggttggtgacaccaaccgggactaaagatctatttttagtcccggttggtgttaccaaccgggaaaaaagatcgacatgcgcggtgcgagatcgagaggactgaggcgcatgagaggatcagttaataagttatgaccttttatctcctcatcccctcactcaccccatgtcttcctcttcctcctcccatgtcttcctcttcctcctcaggatccgcctccttccctctcctccccactccgccccctcccgtctcctccccacttctcaggcggcggcggtggccaggcagccgcgaaggcggcctcgcgtggccgggaagcgcggaggcgccctcacgcagcggccgggcggcgacggaggtggcctcgcgcgccctcgcgcggcggccgggcggcgacggagttggcctcgggcgccctcacgcggtggctgagcggcgaggaatagcgcgcggcgggcagtggggcagcacgcagcgtgggcggcgaggccgcgcacggagcggcagcgcgtcggctcttctttcttttttttttataatttgtgattgagagatgtgtaatttcttttttagaatttgtgattcattgcatggatctgagatgtataatcgatttgtgatgcatttgatttgtgtgtaatttttctaagatttgtgatgtatttgatttgtgtgtaagtaacttagtatttgtatttgtgatgtgaatgatttgtgatgttactttgaatttggggatttggagtttgatttaggtatatgcatgacactcgatttggggatttgttgtttgttctgggtttatacatcccacttgatttgagacaaaataaaaagaaaatggaccaaccagaactgcccctatcctctctttaatcccggttggtagcattaaccaggactaaagatcgatctttcctcccggttatttcacccaggactaaagatagcgatctttagttccagattcgtagtcccggttggaaaactgggactacagggggttataaaccgggagtaaagatggtttctccaccagtgttagttccaaagtttttcttcaaacttttaacttttccattatatcgaaacttttctacacacataaacttccaatttttccatcacatcgttccaattttaaccaaacttccaattttgacatgaactaaacacaccttttaaaaaaatttcgtacaaaagtcaattaatgggacaaagaatcggcgtcatatagaaaataaatgaagaacaaagaatatcttacagttaacacttttacagcatggtatctatctattttatactaaaagtccatcaaacttcctacaaacgctctcaagccgccacgtgagactcctataaacgcttttaagtcgccacatggctctctaataattcaaataaaattataataaaaagaaaaacatctaactgtaagtttttatttaaagtggtggacccaataatattaatcgttggatcaaaactaaatatcttctcaccctttctctccggacccacaagtacgtacgtacgaacttatgcttctattagctcgatgccatcaactctggattctccctctctttttttttactaattacaaaatacatgtgcatcataatttgtgatcattttcatggagactgatctgcctcggtgagctcgattgatgccatccagatcctaattctcctttttttttccaaattacatgatacatgtacaccataatttattatcataaattattagttcggtttttttcatagagag

SEQ ID NO: 33798 - DNA, 893 bp, Oryza sativa
  unsure (1)..(893): unsure at all n locations
nnnnnnnnnnnnnnnnnnnnnnnnnnnnnnnnnnnnnnnnnnnnnnnnnnnnnnnnntccggtgtttgcatagtatggggatcgttggtactaggatatatgcgagattgtagtaaaagagatggagacgcagatttttatacaggttcgggcccttgaattgtcaggtaataatcctacatcctgttggccgaagccggtattgctcttattcaccataatcacaccagtacaatatttggggtagcctatctaactgttgtcgacttggcggtctgaagttctgactcgtagtcgacaacagggtattcttccttctcgagttcgtacccagcgagatcagagacagcgctagatccctacggctggcctctgtaggtaccagatagggtcgatctaggcatatctctgatgtcgatgtccggcggcttgtcttggcgtatgttggcttgtatatcgatcttatgtcttgatctattgttcgtgtcccctctcatcctagggggccttgtatttatacccatagatgtccccttatccaagtagaactaaggaaaccaatatggatacaatccgagcagtccatgtcgtttctatgcagaactctattcatccttccttatgcggaactcctcctatatggtgggtcctgtcaagatttagtcaactactattattaggtatgtggtatctataaccctgacacaagtgactttgcgtaatctcatcattcatttttatttaaattggcaggcatgttatattgaggacattagatcaaatgaacatctacggacttaattgtatgcaaaaaaaaccataagtagtgtaggtatgattcagacaaaagtttgagcttacaaagtagggtaccgagctcgaattcgcctata

SEQ ID NO: 33799 - DNA, 1566 bp, Oryza sativa
aaatagttaactgcatgttcagaaaccgatagcgatgacagttttgaattagcaatcaaagtgtttcatgtggtcactgctggcatatgtgcgagtcgactctaatgccaaatatgctagggaaggggtcaaaattaaacacctggtaacactagcacatggtttttttttccctctcatcatcaacttacaggtggactactccattattcagtcagagtgtaatagcatataatatgttgcatataacataatactcggtaagttactttcccgttacagtcatgaacaatacgacattctaactagaggttccctggctataattgaggtgcacatggtaatctctctgacttccggtctgttaatattgtttacgcaatgtttccataaaacactcgtcaagttacctgatgccaagagaagcactcagtaaccttttgttagaccctgggagagcatcccgttctgctagcgaactctggtcttctctaacgcctcccattctcaacctgtatggctcaggctgtgttgggacgcccatttttccaccctatctccctcgttttccgcgtgcacgcttttcaaacagctgaacggtgtgttttttacaaaaagtttctatacgaaagttgcttaaaaacatcaaattaatctatttttgaaaaaaaaagctaatacttaattaatcatgaactaatataccgctccgttttccgtgctactgttccaagttgggaacaacccatggcaaacacagccattatgactttctcctatcttcttcctggatgcattcatccatatgctagccagcttatgttatcttcatctcgtgctttgttctctggcataatttgggtagagcgaacttatatatacacacatgtacacatacttacttacttttacttgtctatttcaattttgaactaaaattacaaccaaaaagtaaaatttttgaagtacctaccaactaaaagggagccaacaggaaagtggtacaccatgcgctaattaatgaaagaagaaagttaatattcaaacgaaaatgtataaatagacacatgtggaccttcgtatgaattgtagtagagtttgaaatgttggaagagctcagcatataaaattttcagctactagctagatattgattggcattacatacaccgcgactgtagaagttatcagaggcaaaaagttttcttatgacgacatgattagacttgggatgcatctggaatataaaaagaacagtgccatagtggataacttgatcgtttgtgctccctggcattgatgtaatatcccaattaattcattgacgaaggtaatgacgcaaattaatccctggttttcgtgataccctatgaattgctgttgtgcaatatgatatataattgggaaatattttgactctgagtaagactttgtacagatgataatgatgcagaaagagaggagtgaattaaacatatatgttctgaaaatagcattcaggacagacaccagcaacattaattagctcgtcatcagttcatacttatgaaattagggcagcgtgag

SEQ ID NO: 33800 - DNA, 440 bp, Oryza sativa
  unsure (1)..(440): unsure at all n locations
cgatgacttcgatgggaagcgggggcgcggcgatggcgatatggacgggacgagaacagtgatagagggcgcagcaagctcctcctcctcctccccctcccacgttctcgctggtgagcccggcttcctagatcagggcttgctacagcagaagagctcggcgacggggctcgcacagcggtgctgcttggtcggcgacggcgacgacggcctccttcctttcttctgttgatgctgtttttctttttccttttttcatgttcaaaatgcttgtatgctgtgttcacttccatgcatgttaattgaatctagtgaactctgaatgaggatttgaatcgatgctcgaaaatttggatgtggatttgaatctgtacatgatnnnnnnnnnnnnnnnnnnnnnnnnnnnnnnnnnnnnnnnnnnnnnnnnnnnnnnnnnnnnn

SEQ ID NO: 33801 - DNA, 284 bp, Oryza sativa
gctcggattcgagccagctctctttttttttttggctcgagcaatggttaaggtgccggttctattttcattataggtgtcggttgctgttattggtgccgaccaattggtgtcggatgaaaaactggcatctatgggcctttaggaaccggcacctttggcctttttttgtagtactgattccatgcattgaatctccagctgaaatgcatgtatgactttccaattcagcatatctatcaattggaattggcttggattccggaaaaggggaaaatatgttg

SEQ ID NO: 33802 - DNA, 512 bp, Oryza sativa
cgttacatcattggcaaggacaaaaggttcgtccaagtatccaaccttgttaagatcaaccgttgtcatctcactgcattaatcgttacgcctccaccagtcaatttaaaccagtggcaccggaacagagggaccttgagagatccatagtcaagttcccatatgtcctcgatggcaccgtaatacgtgctagttgtaccatcgtgtcctatggcatcgatacgaacatcactgttctggttcgtgctcttcatgtcttgggccctcgtgtagaatgtgtacccattgatttcatatccctggaatgtcgcgatagacccagatggtcccctcgccaggaaggcaagttgttggttaatcgtctcgttacccatgagatgttgtcgcagccacgcggggaaagtatcaatgtgatgccgtgtaatccatgcatcggacttaccgatgtttctggcgcgaactagcgccaagtgctcctcgatgtaaggagctaccaatgaagattgttgcag

SEQ ID NO: 33803 - DNA, 1962 bp, Oryza sativa
agctaccactccatctataagaggcaccatccacctatacttgaaatacaattttctcttaaactattcatctgatctaagatccgattacaccgttgtgttcgtaacaattaaatctttacaacaagatctcacatgattatattttgataaaaaatcacaaattacttttatgatatgtctaaattacttttaggtttcactaagttacttcttagacatataaaagtaaattcagtaaagcctaaaagtaatttacatatattatagaagtaacttagaacgaatcgaaggtaactttgacatgccatttgaagtaaatctgtcgtagagataaaaacatgactcaatctagaaattaaattaatcagcacaaattatggaattaacttaaaaaataataaaagtaatcacctcagagcattatgaatgtataggaagtattttaatccaatctaaaagcaacttatatatatatatatatatatatatatatatatatatatatatataagataattttttcaatgaaaaaaggcattaattaaagatactttcctttttattataagttacttctataatatatgttacttacttttaggctttactgaattacttttatatgtctaagaagtaacttagtgaaatctaaaagtaatttgtgatttttcatcaaaatatactcatgtgagatcttgttgtaaagatttaattattacaaacacaacggtgcaatcgaattgtaaatcggatgagtaatttaagagaaaattttatttgaagcatagatgataggaatatttcccctacttgctcaatgaattaatatcaaccaaaactcctgaagtactagcacgtgggtgtctctggatatgactaattggagaggcgcctccaattagatttaccaatatacaaaattttaattcacggtcttatgagatagagggagtagaagtaaatagaagaatgtctttacttagatggaacaataatattaacaatttccattctacaatcaaccatgaaaaccattttcattccacaatcaacatgagtacggtaactatccgtggccattggctagccccctgaatcaccattgatcatagatccattctcactcagttacccttttcttttcctcactaattaattaaccttatcggctcaaccaaattgatattggaaagaaacacatatgtgggggaaagactatttagaaagaacttatgtaataaccatctgatagccctcaaaatttggcgctttatcacactactacaaaaaagcccataaagatcggcactataggtgctggaacagttaaaacatgcacctatagtgattttaccgcgtccattggttgaaaacacataaaaccggcacctttaagcaactataggtgtgtcggttctaaagaaaaaccgacacgtagagtataggtgccggttttttataaaaaaccgacatctatccaaaccgagccgagccgacacctagccaaactggcgacgcattagccttgtcgatccccctatatgagtgagctggccttatcccctctcctatctctctcgtctgtctctctcttgcctccctctctcccggctctctcacatctcagcgcgcggtggcggctggaggggaggcgatgggcaactggtggcggtggcgccctctcctccaccggatccagcgggaggggaggcgcagcaggcggcggcgggcggcgacgggtggcggcgggcaatgggcggcagcggcggtctcccctcctccggatccagcgggaggggaggcgcagcagtcggcggcgggcggcgacgggtggcgacgggcaatgggcggcagcggcggtctcccctccgccggaggcgcggcagccgctggtgcatcgtggcgcgcgacgagtgacggcctcccctccgcccggatctggcgggaggggagatgggc

SEQ ID NO: 33804 - DNA, 1564 bp, Oryza sativa
  unsure (1)..(1564): unsure at all n locations
cttcaggatgaaggtccaatgaacgtagcatattttcttcatggcgatgatgtgttccagggaacgatggatggattagtcgttcctcgatcctaggttgaccccaaatttttaaatttaatttctggttaacttatcgctgtttataacagactgcccatatttagctatgggagctactgcactgtacatcattgagttggctgggggggatagctacaaagatcaaaaacctttctgattaatgccactccatttcatattatatgttattttgacattggtcaacgtcaaaactaagtttgtagaaaaaatgtaataacattttcaacccaaaccaaatataacataaaactatattcaaatatcgatttaatgaaattaatttggtgttataaatattactatatttatctacaaacttaaataacttatagtctgaaacgggggagtacaacttactacactccagccttacaagaaaataaaaggatggccattagctagtacatcactgatgtgtcaaaattagaacatcattgttgtgatgacacaaaattaagtcaaagtgcagtgacagctgaaatctatctatgaacatcatcgcagcatcagttgagatggctacaaaatgtcagatggaatcatacatgagaaggtactcaaaggaggagagatagcagtaaattaagtgttaatgtgtaatcttaattggtgttaggatggagtttcaggacatgacttcctaaaatatgatacttatataactggttagctgtatagtggtgtccttgttgaccatctgctggcaagaggcggatgttatgtttgttgtgcatgtgcagataactaggatatggccagttacatcagcatggtggcataatcctaggatcgttctagacaatttcttgatgcctcttaatcctacaagggtccattcatgtatgcataattgaatgttgtctttaaagaaaggctaatttccttagtttacagttcttgttttgtctgggcagctcatgttctcgccttcattcacctgcaggtaaaaaattgaatatgattggacatatacagcctgtggttctttgttcttggataatcaagtggagatcaggaaaaaatgtcgagaaatcaacaaccatgcattcaatgatgttaaggaaataaatgcatatggaaagatgcctgcttttaacttttggaaaaagtacgaattacacccctgaactattacgatcgatcgaattaccctcctaaactcaaatactagatgttttacatcctgaattattcaaaccggataattaaccctctggctcaatccggagtggttttaatcctacgtggcagtctagtcacctgtaagactctcctccctctatctactctatctcttcctccctcttgtgcaatcccatccccctttctctcctccctccccttctagcagcgagtggcggcggtcgacaaagtcggagctcacgctcggcgaaggtggtggcannnnnnnnnnnnnnnnnnnnnnnnnnnnnnnnnnnnnnnnnnnnnnnnnnnnnnn

SEQ ID NO: 33805 - DNA, 4569 bp, Oryza sativa
  unsure (1)..(4569): unsure at all n locations
nnnnnnnnnnnnnnnnnnnnnnnnnnnnnnnnnnnnnnnnnnnnnnnnnnnnnnnnnnnnncaccacctctcttcccggccttctacgtcatccccacaagcgtcagcggggcggcacataggtacgtctccatgggcgacaacaatgacgacgctgacatccccgtgcctccctgagctcgccgccaaatctgcaaggactgtgccacttcctccgccgcctctgcgtccactgctggaggtggatctagagccgccgctccaagccccttctcggcttctcctgccatatgtgcagactagagagagagatagagcaaggggagggagggatggcttgacgggagagatgacatgtggacccatgaatttttttatatattttctttgctgactagattaccacgttgacgccacatgtgcaagctcagatcaaaaccacctaaaacagtgctgatggggttaatcatccggtttgaataattcaaggtgtaaaacgtctggtatttgagtttaggaggataattcgatcgatcttaatagttaaggggtgtaattcatacgtttctcttaacttcttacgcgtgttgttttttataaaaaaaaaacctaattttcgaacaagtccccttttactttattggcagttaataaggaaatccacctctgccaaatgacccgggtcaacagtgttgttttaagtcaccggctctaaaaattgatttttagagcacattgttttaatcgagatctgctagtttagaatagcctcattttccagagacggttggcttaagcgtccgcctcaagaaatagcctctccggaaatagcttcactcaaactcgactttgttttacacataatgtcgtcttgtccctgattttaacggactgcagatcgtgaagctattgagttgaatacgctatatctgaagacaaatagagtcaattagaagctttttctgtccacaaaggttaaaatccttacggatatatgctattgtgatttataatatacaacttgcaatttgctacactctagtcagacaagaaaaagaaaaataaaaagaaaaaggatgatgatctctgatgtgtacaaaaatacggttaaagcaccacctgttcatatggaatttgtagccaacaaatgaaaatgttgatcatatgagaacacacaaccaatcagagaacaagaaacatccatcacgcccatcttgttgcgaacataaggtatcctccattttgttaatttgcttacacaagaggtatatatcctccattgatcgctgtacagatctgtacattgtatagctgccgtctgttttagtggtgtagctcctcgctgcaaattttctctccctttcgatcttcagcttctcacagtagtcatgcaagcactaggccaatgcattaacagatactacctccatattttaatgtatgacgctgttaactttttatccaacgtttgaccattcgtctcattcaaaaaatttatgtaattattatttattttattgtgatttgattcatcatcaaatgttctttaagcatgatataaatattttcatatttgcacaaaatttttgaataaaacgaattgtcaaacgttggtcgaaaagtcaacggcgtcatatattaaaatacggagggagtaaatcttaaagaacagactagctaatacccacacataacaatatgaacaagctgagcaatatcaacacaagagcaaatgctatcgacctatactattcaaatccgtgtttccaaatcacttagtcccaatcactgtctctacaatgatcgcggctacatgacttggaatctaggattgaatgaggattaatggtgaatcatgttttcctgataccgctcattcaatatatacatgttggatgccgggctcttttgccgtctgctatcatcgatgctagcatgtgtgcaagcaggtagaaataataagaaccgacagaactgagcttgtcgatcagttcgtgtgctaaccattaatattaaccaagtactccctccggggttttttaatagatggtattttattcaaatgttaatttgaccattcgtattatttataaaaaatatgaatatgtaataaaaaatgtaagtaacgctcaaaagacctttaatgataaattaagctactagctaaaaaaacaaatgataattacttcaattattaatttttaataagacgaataatcaaatgtatataaaaaatatttcaacttttaattgttcacataccaatggaataggcagtcacagaatagaatttcaaggaaagcaagttggatataatgccattcaaatagtataaaaggcgagtttaattaaattatatgagctgagcaagctatgatgaaagaagaataatgccatccaagtagaataatgacgtgtggctgtagcttcgttgaagtgaaggtcgggatttattccattatgaaaaaaatagaataatggcatgtgtgggaggcaggtgaaatggaaggtggttaatcgtaaagaaattacttattactctgttgtgcatactactatagtagaacctactatagtgagaagattaaaaactttgatcaatgcactgcatagttacagttaggtagaagtggtaaacaaccaggactttcagctctcgtctctggcctttacctatacctattcgtttttcaaggttgcaaatttgagtgattatgcatcgtttgaagggcacacaattaaactggactaaccatttgcatagtttcaattcaagaaaattggtagcaatttgagatcttttaatcttcaattcttgatttgcaatcagtgagttcgacgatatttacaaacactgatatacaactagataatgaacacgtggaaggaggagtttaaaaggctagaacattgtttcctgcccggagatgatatgatcctgacatgcatgtgtttggaggtattgttcaaggcctgattctgtctcattgcccatgatttaatgttgataccatggaaggttcacaaaaagaagcttggtgttagagaactagcaatgcaggctgcgactgccatctctcgtctcctcctggtgcttctcattctcaacctcttgtatgatgtgttctatgttcttggtagagcatagcatggatgatagcttatagtatctgttctcaccttgtgattttgctctttgactgatgtgggtttttattggtagcgagctgaggtatgggcaggtgaggatgtaaagaagtaaactacagtgtggatgtaaagaagccacttccatgagcactcgatgacctaccataatatttgaccaaattcataaatatttgaaaaaaaaatccaaaaagttcggtggagatttgtgttggagttgttccaaattcacttcaagatattggccgggcttctgacgaagcggagcggtatatatgccctttgctagggtttcgtggagacttgattctcttgtaagccgccataggcgtgtaacccaaaactcttgagatagtgagattgttgctggctggtgcccgtggttttttcccctttcgcattaaaggggttttccacgttaaatcgtgtgtctccgctgtgattgtttttcgtttactttgtatttctatacgtcgttcataacaagtggtatcagagctttggttgctgttagggttcatgacgacgtcgatgaagttcgatcttccgctgctgaactacgacacgcggttctcgctaaggcaagtcaagatgcgggggattctggcgcagactcatgactatgatgaggcactggataacttcggcaagaggagggccgagtggactgctgaggagatccgcaaggatcagaaggcgctcgccctaattcagttgcatcttcataatgatattttgcaggagtgtttgatagagaaaacttctgcagaactatggctgaagctggaatcgatctgtatgtccaaggatctaaccagtaagatgcagatgaagatgaagctgttcactctgaagatgaaggaggaggattcggtgatcacccacatggctgaattcaagaagatcgtggccgacctagtgtcgatggaggtgaagtatgatgatgaggacttaggtcttctactgttatgttctttgccaaattcatatgcaaatttccgtgacaccatacttttgagccgtgatgaactaaccctaaaggaagtttatgatgctctccaaaacaaggagaagatgaaaattatggtgcagaatgacgggtcgtcgtcctcaaagggcgaagctttgcatgtgagaggcagaactgaaaacagaacctcaaatgaaaagaactacgataggagaggccgttcaaagtccaagccgcctggtaataaaaagttctgtgtttattgcaagctgaaaaatcataatattgatgagtgcaagaaggtccaggctaaggaaaggaaaaacaaaaaggatggtaaggtctctgttgcttctgctgctgcttctgatgatnnnnnnnnnnnnnnnnnnnnnnnnnnnnnnnnnnnnnnnnnnnnnnnnnnnnnnnnn

SEQ ID NO: 33806 - DNA, 1516 bp, Oryza sativa
attgtctggtagtatttgctggttgtgttgctggtcatgatgaatggattcttgattccgcatgttcgtttcatatttgcactaaaagaaattggtttagttcttacaagcctgtgcagaaaggggatgttgtgcggatgggagatgataacccatgtgctatcgtggggattggatcagttcagatcaagactgatgatggcatgacacgcacgctgaaaaatgtgaggtatataccagggatgtccagaaatcttatttcattgagcacgcttgatgcagaaggttacaaatattccggttcagatggcgttctaaaggtatcaaaaggttctcttgtttgtttgaaaggtgatcttaattctgcaaagttatatgtccttagagggtgtactttaactggttctgattccgctgctgctgctgttactaatgatgaacctagtaagactaacctttggcacatgcgtttgggacatatgagtcaccttggtatgacagaattgatgaagagaaacctgctgaagggctgcacttcgagtaagatcaagttttgtgagcattgtattttcggcaagcataaaagggtacagttcaacacttctgttcacaccaccaaaggtactcttgattatgttcatgctgatttatggggtccttctaagaagccctcacttggtggtgctcgttatatgcttacagttattgatgattactctagaaaggtttggccttattttttgaaacataaagatgatacctttactgcttttaagaactggaaagtaatgattgaaaggcaaactgaaaggaaggtaaaattgcttcgtactgataatggtggagaattttgttcgcatgcctttaatgattattgcagacaggaaggcattgttaggcatcacaccataccccatactccacaacagaatggtgtggccgaacgtatgaacaggaccattatatccagggcccgttgtatgctgtctcatgcaaggatgaacaagcgtttctgggctgaagctgcaagtactgcctgttatttgataaacaggtctccttctattccactaaataagaaaactcctattgaggtatggtctggtatgcctgctgattattcacagttaaaagtttttggatgcactgcttatgctcatgttgacaatggaaaattagagcctagagctgttaagtgtcttttccttggttatggttcgggagtcaaaggctataaattgtggaatcctgaaactgggaagacttttatgagcaggagtgttgtattcaatgaatctgtgatgtttactaacagtttgccctcagaacatgttccagaaaaagagttgcagcgtatgcacatgcaggtggagcatgttgatgatgatacaggtgttcaggtggagcctgttcatgagcaggatgaccataataatgatgttggtgatgatgatgctcatgatgatgttcagcaaactcctcctattttgcagctagaggaggaattacctattgc

SEQ ID NO: 33807 - DNA, 1278 bp, Oryza sativa
ttgaagagtgtaatttgttttactatgctttgagttgtgctgaacaggtggagaatgttcatgagccagcaacctataaagaagctgtttgttgtggtgatagtgagaattggatttgtgctatgcatgaggagatgcagtctcttgagaagaacagtacatgggaggttgtacccttgcttaagaaaaagaagaccatcagttgcaagtggatcttcaagagaaaggagggtttatattcaagcgagcctccaaagtataaggcaaggttagttgctagaggttacagtcaaattccgggtgttgactataatgatgtgttctctccagtggtaaaacacagttcaattcgtactttccttagtattgttgcttcacatgatcttgagcttgagcagttagatgtgaagactgcgtttttgcatggagagcttgaggaggacatatacatggaccaaccggaagggttcatagtgcctggcaaggaaaaatatgtgtgcaagttgaagcgatccttgtatggtttgaaacagtcccctcgtcagtggaacaagaggtttgattcatttatgttgtcacacagttttaaaagatctaaatatgatagctgtgtttacatcaagcatgttaatggatcacctatatatttgctgttatatgttgatgatatgctgattgctgccaagagtaagattgaaatcactaagttaaagaagctgttgagtagtgagtttgatatgaaagatcttggtagtgctaagaaaattcttggtatggaaattagtagagacagaaaatctggtttgctatttcttagtcaacataattatatcaagaaagttcttcagcgtttcaacatgcaaaatgctaaggctgttagtacccctattgcaccccactttaagttgtcagctgctcagtgtcctagtatagatgcagagattgagtacatgtcaagggttccttattctagtgctgttgggtctttgatgtatgccatggtttgctctcgtccagatttgtcatatgctatgagtcttgttagtagatatatgtctaatcctggcaaagaacattggagggcagttcagtggattttcaggtacctcagaggcacaacatattcatgtttgaagtttggaagaactgataagggccttattggatatgtggattctgattatgctgctgatctggacagcgaagatcacttactggttatgtgtctactattggcacttgtgctgagagttggagggctactttacagtgtgttgt

SEQ ID NO: 33808 - DNA, 1270 bp, Oryza sativa
  unsure (1)..(1270): unsure at all n locations
aannnnnnnnnnnnnnnnnnnnnnnnnnnnnnnnnnnnnnnnnnnnnnnnnnnnnnnnnttttcttctatatcctgtggtggaacctaactaaattgaatcaaaacatactatctaataccttgaatatggccatgcaagcatacataatggtctccgtaggatttctataaatagataaacaatctcttaaatgggtgtaactttcaagtatatatttcaatttattacctatttgcacttgtatttttaattaaatcaatagattgaaaatcaaatagactaaatttccaatgctacaactgttgaacccacatttatcccgagacctctactaaatacaatcaaagcatcccactttattttttttacttatggactgttagacatctaataactttgtaaaaacttaactaatttttgtcaacatatatctacacaaattgatcttaatgttttaatagataaacattttatatgatcatagcacctagcttatagatatgatctatgaagtcactaataaattagataaaagtatttaaatgatacaattattttgttatggacacatttatccatgctaagttagggcggaggtcgaaaacattacaggatgcttgatagtatggtgtaacaccctgaaaattcgaccgacaaaaatcaaaactctaaaaatgcggattttcaaaaactttttaaataaattgcatcatgccgattttattcgattattttattggagtttgggttcagagtttataaatcgcgaataatggataattggttaggaataaaccctaaaaagtaaatggacaaagtaaataattaaagtgcaatttaaaataagatttggtgaggatagaaataagtaaaatattattacgaccatatttatatccatcaaatttaaaagcaatggaatgagaattaactctaataagttcaagtaaattacaataataatatataaaacatggaataaattaatctagaatgaatccatggattggaatggcgcaaatattgagtatacttcatttatgcaaaatttgggaattaaagaatcaaatttaaataataaataggccaaaatcgggttaattagaaaatggcactgttcattgcacctaaagtgttcgacgaggtcccctagccctagcccctcctttgccgcgttgccctcgcaccccgcgtgccgcgcgccgctccgcctcccctgtgccgacgcctttgccatcaccgcgcctagccgcccctaaccccgcgcc

SEQ ID NO: 33809 - DNA, 1895 bp, Oryza sativa
  unsure (1)..(1895): unsure at all n locations
nnnnnnnnnnnnnnnnnnnnnnnnnnnnnnnnnnnnnntacgcgttcgacttccgtttggatttatttggatttttatttgaattctaaccgaattcaaatcaattttcgtacgtaactatagagcccgagggagttgcggatccaagtgaaggccaagacccgcaagactttgagcaaggcaagtcatcactattcttgaacatattgatcccaattgcgaaattgttttgtttacaaataaaattgcatgcaatgaggaacatcctacttgcgattatgccatgccttgattattgtttaccccttattcctttgtaaccatgtttacgtatgagtccctagtcaactatgacaaatgcttagaaatgctattctagaatcatgcatactcatatttgtcaaatgctatatgcttggacaattacctttgggaaggtaattgagatgcggcatgtggagacatgagcgccacattgccatgatattgaggacatgatttgtgaaaggagaaataaactaaataactgttttcgactggggcggacggaggatttgggtggtatctggaaaaggctagtaccgtctccggtcaattaaggaccgagccatgaaattaagcatgaaacgaccctcgtacaactgcacttctcgtatgggtatagacctagcggagtagatagccgagcggaggcagtatccctgcatagatggttcacccctgagtgaggcaggtgcgttacggtgggacagccgttgaggtagggccaagaggcgtgccctacatcggtgtcgccattggtaggactgccatgagtgtgtgtgagagagaacttaacttgaaccataatttaatatgtgtgtgagacttctctttcccgggagcgccagaactcctctcactactagaaacatggacgcctagagtgcatgaggatttaagttcatggagcgggtactgccaatgcgaggttatcaaaaggctttgccgtggcgcgtctcatgtgttgggacgaggctcatgtgttgggcagtcgcggagtgcgggtaaagtgtacatccactatagtgtgagtaaaaccaaatctattcgaatagccgtgctcgcggttattgagcaccgggacatgtattacacttggctagactctaaattctttaacttgtgtgggatgggatattgcatgatgatttttatgctgatggagccacttcctgagaggcgggaatgtggacgtcctcagaaaaccataacgactcaatggcgggaagctatccttgggatcacaatggatggtggacagaaccgtcattgtttaatatgaacacaggtattaaaacttgatcagtctatgctaggtcttaggcttgtgaaaagaattacaaaacttgctttgtgcaaaagaaccatagacatcctttgaattcctctgtcatgtgcatcattgctgtggtggcttgctgagtacggttggtactcacccttgcaaatataaaattaatcagaagcgggagatgaagcttcggaggatccctatgcctactaccaggagggagatgaagacgatggcactcagtaggtcttagttacggtcgttacttgtggcaatggcgtgccgctgccttaactccgctgccttacctacttctgtttttggaatgtattccggaccgctcggtccgatgatttaagactgtgcctgcgggcttatgatgtaataatttgtactagactctcgtatatgtgcacttgatatttcagctataagttcgtgtgtaccagactacttgatccaggaaaatggtactgtttacacgattcattcctgttataaaaannnnnnnnnnnnnnnnnnnnnnnnnnnnnnnnnnnnnnnnnnnnnnnnnnnnnnnnnn

SEQ ID NO: 33810 - DNA, 692 bp, Oryza sativa
cggttatctggtggagaaaatgtatgttaggctttttctatttagttgttgataactgaaattatcctaacgatctttgttattcatacctttacggatactactactcctcgctttgccgaatcaatctgattaccatttgatgtttgcattgaggagatccttccaagaccatggactgtgcctccaacatagacacaaattggtgttcccacctgaaatgcaattaccacaatcaatgatgagcagtaatatatgtgacctattgcaatagcgccagatttgtaaacttttataggtttggatagatgccaagattttccatcaagtttatttctaaggtgtagcatgccacactttttgtgaagctcaatttggatgcaataacaaggtaccatatttttgcactgtcattgaccgtgataagtaggccaagactaaaagccaatgaaccaaactgctgacatgtaaagtttaattgtgctaactcaaactgtggcgaaatgcctatgcatcagtatctaggataattatcattttaacagaattcactcaaaataataaggctaaaaaaagtaccttgacgacaccttccaagacttcaacatcacaaagaaatggattcttcttaccgtatacacggtttggcagaatctttagggtgcatgggaacactgcattggctgcacact

SEQ ID NO: 33811 - DNA, 9502 bp, Oryza sativa
aaaatcaaggtaaaatatatatcttaatcagaaattaataaacacccaccaaaatcacaccatggacacccactggtggagaaaccatctttcgtcggtaggcctaattccacaataatcccggttgcaacaaagaccgggattaaagatgatctttagtcccggttaaaaagggtaacgggcatatttgatctttagtcccgattggtaacctttagtcccggttatttcacccgggatgctatctttagtcccggattcgtagtcccggttgaacaaccgggactaaaggggttactaaccgggactacaaacggtttctccaccagtgacccctacatcaatataaatttacttccttgcttatgcacctacccataccccagctctccacccataaaaaaccaagtcagtcgaagagccaaacacaggtgtcaacagctaacatcaggatgaaatgagagacggcgatcgaatgcagtactatgaagaaaaatataggtcttgtttagttctaaagttttttttctaaacttccaactttccatcacatcaaacttttcatatacacacaacttttctatcacatcgtactaatttcaatcaaactttcaaacttcagtgtgaactaaacacagccatagaaccaattgtaggataggatgagaatgaatgagaagcatcaggatgaaacgagagacggcgatcaacgaccacgtggataattctgtgatcccaagcttctttctacgaacctcgggttctaacgccgtggacgtatctacagtgaatcactgagtacttacaattttttaccatgtcactattttttaattcaaacttaatttgtgcccccgttaaaaatttgcatattcgcacacaagtctagagctcaaggtaggccaatctgtgctcgaggactcagggtaggtcgatctgtgtccaaaggagagatgggtgatctggatcatttgcttctacagtactcctatagattatttaggctgttggatttgtctgatgatgatgattaaaatgagttagtgaaatatacatatagatgatgagtaaaaaaagttggtgaatgaaatataggatagttgatgatgagtaaatatcatttcagcctttcttcagcaaatcataaagcgattgaaattcctcctcctcgatctgggccaaatccagcccaactctggcgtgcatctttccgcgggcccaacatagccgcgagccagcccaacccagcccagcaatcccgcctcctcgttctttcccgctgacatgtcggacccacctgaccccacatgtcagatgcttcccctaccttcaagctcgcacgacgccgccttctccgaccgcaactccgtggcatctccacttttccgacacctcaaaatccctgagacaggaggcacacacacaaaaaaaaaatctactttgtgtgctcactagccaatatatataggttcgttcacatttctttgatgatgaaaatttcaagcattattacccatttagattagaaatttttttaggagtaatatgatttcaatgtaaaatcgcaaaaatatggatcggccagataaaatcataagtttagcactgtgtcgaacaatggttgttcgataggggttgtgcagtagaacctgtcgaacatgggatgttggacatgcccttgtatgcatgcactttttattatttttttcatggccccatgggtgctaaacttgcgattttatctggctggcctatatttttacgattttttattaaaattgtattgtttctataaaaatctttagattacgcattaacaccaaacttactgctactctcgaccttaagtgccttctcgtatgtgatcccatctgattttgggttctttcatctgattctgctgctctttgattagcccattatgtaattttctctatagttaatgaagagagcagagagaactgaacccatcgttaattatgtactccagctaattaatctatccatccttgcaaacaagtagacctactaacaaggaacacatatcctcaactagttcattttatattgcatcatttcatgaagtggagaaaaataagggcagctctgacttgtaaaccagatctcaagaactttgtgctttctttattcagtcacaggttatatatttgcaatgagatgctctggtgctttttactgtagtataatacaactgttaatcagtaatttactaataatataatgattaggagtaactttattatttatttttttcccggctacatcgatcattcattgtactagcatcactcatatttcatcgaaaacactaaaacaagaaaaaaaaggtttagtcactgataaataactattatacccctttgtattttttttataataataccccttcatattctactcccgctaactaaggtgatagtataaataaatttaaactctttaatcaaataagatatagggttcatattgatttctactaagagtagagagcgccgtagcgggctcatcatgaccacatccttgattatctctttacctttttcaggccaaaacatgaactagatgaggacaacatgccagggaaatgggggttagagtgagactagttcacatggacatgagcaattcgtccaattgagacttgagatgaaagatctagcctgaaatcctccccggagatcacaccccaggctctccgttccgcttcccggcgtcgacatgttcgtcgtcgaggaccggggcggcgccgtcgccttgatggtggcctccctcctcttcctgggcacctggcctgctctcctgactctcctggagcgtagaggacggctgcctcagcacacatacctggactactctgtcacaaatctccttgctgctgctgtgattgccatcacatttgggcaggttggagagaccaggcctagcatgccaagcttcttcactcagctcactcaggtcagtgctttttttaaggtttcttggttcagttggttgttcttgtgtcatgcaatctaggactagaatatcttagccatcaagaatgcagtggtgatttcataagaagctgtgtgagttagtacctgttaatgagagtaatttggaagtgaatagctgaatttgataactggaaattcagaattgcttcaagttgacagtgtgactttggaatttggatggtatctgtggacgcaaaacaagcatgagagacttgtcccaactgtatgttggttgcatcgtgtcactgtcgttagagtgttcagcttttatgtggataatcaacttcagtgaattcttccatgatttgcagccattgatcaatgcaggataactggccttcagtcctatttgcgatggccggtggcattgctctcagcatcggacatttgatctcgcagtatgcgtgggcatttgtcggtctgtctgtgacaaacatcatctgctcaagtctggctgtagttctaggtacacccaaacatgcaaaaaactgaatctttggtgaatctgcagctatttatcttgcacttcgctaatgcggatgaccatgatctattgaaggaacaaccatgaactacttcctcgatggccgaataaatagggcagaaatccttttcccgggtgtagcatgcttcctcgtcgctatcttcctcggctctgctgtccactcttccaatgccaaggatgaggaggagaagctaagcatgtcaggattcagaaatgcatttgagcactaccaatctgaattttcttcgagagaccttcctttgatgtcaagaagtacaattcgtttgtttgcaggagtagaggcatagagctcagcagtgatgttgctgaccaaggtggtactatctatcttctaaccacctgaaaaagggtgagattatgcaatgcagaagctaacaaagttgctactttgctaccatttttttttcagtgaagttgctgccaaatcaagaagaactggagaatggcgaagacgacgatttcgataccggcaccgcagagttcatcgttcaggttgagaagaggcgatccatcaaggtcacatcacccactgcctctgaagattggtgaagcttataaaggagtaatataggccctgaaattcagaaacctgaataccggtttgtgggtttcaggtgtttggctccagcaggtggctaggactgggaatggtgctcctcgccggagtctgcttctccctcttctcgccggcgatcaacctggccaccaacgaccagtggcgcaccctgagagacagcgtcccccacctgacggtctacaccgccttcttctacttctccgtctcgtgtttcgccgtcggtatcggcctcaacgcccggctcctctaccgcccggtggccggtgtaccgccgtcgaccatcggagcttatgccggagactggaacggcaggcactgggcgctcctggcagggctgctctgtgggtttggcaatgggttccagttcatgggtgggcaggctgctggatatgcagctgctgatgctgtccaggtgatcctctccttaggttcatatcagctctgcaatgtttgctgcattttacctgcatttcagctgtaatacaactaaaactcatggtgttcatgatatggtgtgatcaggcactgcctcttgtcagtacattctggggagtcatcctctttggcgagtaccggagatcatcgaggaagacttacctgttgctcggttgcatgttgtcgatgttcatcgttgcagtggtacttctcatggcttcagcagcacataggaagacagggtagtccaacacagaaggatttcactccaggaagatatcacagatgcaacattcaccattaacgacaatattcgccattacaaacatctatagattcatccattattcacaaagtaacaaaacggtttgacaaatgatgacaaagtatgactggagtttctggacacaacacagaccagaaaatgatgaacgtgatctaaattgccgacacgagaagacgacagaagtattccaatccttcaggctatatcgagtagtttctttagcctgcggataagctgccaattctcatcattcatttcatcctgcagcaaggtgaattcacaaaaattagatgcacgtgttaagggctctgcaagataaatggaaatggctgtggttatgtatcttactcgatagtactctttgaggacatcaatggatctccttgagatttggctgatcagctcattgctctcatcaaaatggcgtccatacaaccaggtcttctccttggggctctccccggttatctggtggagaaaatgtatgttaggctttttctatttagttgttgataactgaaattatcctaacgatctttgttattcatacctttacggatactactactcctcgctttgccgaatcaatctgattaccatttgatgtttgcattgaggagatccttccaagaccatggactgtgcctccaacatagacacaaattggtgttcccacctgaaatgcaattaccacaatcaatgatgagcagtaatatatgtgacctattgcaatagcgccagatttgtaaacttttataggtttggatagatgccaagattttccatcaagtttatttctaaggtgtagcatgccacactttttgtgaagctcaatttggatgcaataacaaggtaccatatttttgcactgtcattgaccgtgataagtaggccaagactaaaagccaatgaaccaaactgctgacatgtaaagtttaattgtgctaactcaaactgtggcgaaatgcctatgcatcagtatctaggataattatcattttaacagaattcactcaaaataataaggctaaaagaagtaccttgacgacaccttccaagacttcaacatcacaaagaaatggatccttcttacggtatacacggtttggcagaatcttcagggtgcatgggaacactgcattggctgcacactgcattttcttcaactcctttgatcttttaatgtgttcattaaagctgtcaacaagcttgtacactgtgtcagctgtaacaatcttcactcctgattctgatgcaaggacatctgcctcaggcatcaccctgacattaaatgctaagatggctgcatactcttctttccgcttcagcatagcacttgccttcatgacatctttcttctcaattgggcctaagttgcaaccactgacaggaacattcacaccagggctgttcaaatgctcaatgattgcttccaagattccaaaagtagaagcttgcacatagacaccttccttgcaagttttgagcctacttatttcttgtattacatttccctcttcattctcattcctctggcttttggcttcagattgtcccagatcatcccctggcttcactacaacgagagaagtgcctggaattgcatatttcagtccctgaaaagataaagttaagcaacaattagttcgagattggatcttttttttaaggcatgacaactgaaataaactcacccgtgccacaatctttaccccctgtgcagctttaagctccttgtgatgcttatatatgccctgcagaatagaagtggacaaattaaataaacacccaacaaatactgtcaaataatcttgccacatattaaaattaaattcatatatactgtacatgcttaggtggcccatttttgctcaaaaccccacataataattaaggctgtgttcttccccccattttcccaacccacctctctcgttttccgcaggcaagctttcaaactgctaaacggtgtgatttatgcaaaaactttctatatgaaagttgttttaaaatatcatattaatccatttttcaaaaaaatagttaataattaatcatgcaataatacgagcttcgttttgcacgctagggaggaggggttctcctcctcccgaacacagcctaagggtccatttgaacctccatattggaggagcatattaacaggacgcaaaacgggggcacctcattagcgcatgattaatagagtattgattattataaacatgaaaatatatttatttgaacttttttaggaaacttctatatagatttttttttacacaaaacacaccatttagtaatttgggaagcgtgctaacggaaaacgagaaagttgtattatggagatgtggaaaagaacgcagcctaagtgatgataacattcagtatttctcttatcatataaactgcatgttttaacaagatgaactgtttcactctcatgggcatatacatttattaccttctggggatttgctagatttgcatatgttgtttctttcttttaaaaacttatgtacagaaactataactgtcaaaagagagtgcaatcattaactcaccttaactctcagttctttcaatggatgaggggtcaacaaatctctaatagttgttgtgacaggcccctgaagatgaaaaatgtttaagattatgagatcaaaccgttgtggaaaaattcaaggggtatgaaatctcaaatttaagaagttattatacctgtttagtgcaaacattcacttgatcacctttgtgcagcacaccattaatcagcactacatcaatagtagttcctaaatctttgtcatcattgacttctaggacagtacactgatcaaacaaacatgaagtcaatctcacattcaacatcttgataaatggtgcatatccaaactagtaagtaactcgatattaaacagagtaatggagattaacatagtaatggatagtggacaaacctccactgtattgacaaaggttagcttctccatcattgtcgcttgggaccttaacaccagcattagtagaaggtctggaatgccttcaccgctggaggatggaatagcatatgttaggaaaaggtaaacctcaaatcacatataacaactgaaaatgaaacctaataaacaagaaaagtcaaagcatatagcagacataccttatggcactggttgggactatgtcaaacactttccgaaacttttgattgtcatagtatagtgcagtgttaaagccattttccttcagttgtgtcacaacctgtttagatagatgagtcaaattgtcaaataaaatcaaagaaaatatttgcattgaaacatattggatcaatgaatgtaatggcattgccagtaccttagtcaacctccacccaaattcccttttgacatcaccagattggttctcgagtgccttctttatcggtgcatctggacaatgtttccacccacaaagccggtctaccttgttcaagacaacaatgaacctcacattgcggtctttcagaagagcaagggtctcaacagtctgcttctcaagcccatgcataatgtcaacaaccaccacagcaatgtcgcacaaactcattcccctcgagcgcatgttactgaacgactcgtggccaggggtgtcaatcacaagcaacccaggaactttgattacgacacacctttatggggtttggccctctccttgacgtattcaacaggtacgtaggtagcgccaatctgctgcgtgatgcctccagcatcccctttctgcacattggtgtgcctgatgcaatcaaggagctttgtcttaccagcatccacatggccaaggatgcaacatatcgtctcacggagcaccctgtcaccctcgattgcacacgcatcttgagaatcaaggatcccatcttcctcaacctcaccagccacatcgatatcgactggattaacaacctgggaagcagaagtcgcaagtttgtcctctgtttccccctctgcaacacagggagaattcccatcagattggacatcaaaaccatccaagctcttgtcctcacaagaatcatcaccaccatcactaacagtgccatcctcttctgatgatccagttttccttcccactcccaattctactgcgtctgcggcagcagcaacctcgatagataatgcattgatctgctcgtcctccaattgcggcttcgagctcagcaattctgccgtatcagcttcagactgggcatccccatgaggcttggcctgcaatttagtcttcctggagtcgtacacaggccgacgacgatcgccatcaccgcctccgccgggagaatcagcgacgacggtgatgccgagccgccgccgttgctcctccctccgccgcgcctactccctcaccttctcctatttcctcctccgacgcctctcctcctccctccggctactctactactgcgcccgggccctcccctcctactcctaccgcctcgcccgctcctccgcggggggcctatccgacttcgaccttctttccttctacggccgcctatactactccttcgcccggcgatcgatccccctccggagcctcttcagcggtacccggcttggcccactacccaccttttttcgtccctgcggcgggcgccgccgccgcgggggccccgcgtctttcttgac

SEQ ID NO: 33812 - DNA, 4065 bp, Oryza sativa
  unsure (1)..(4065): unsure at all n locations
aannnnnnnnnnnnnnnnnnnnnnnnnnnnnnnnnnnnnnnnnnnnnnnnnnnnnnnnntttcctcctccgccgcctctcctcctccctccgcctcctctcctcctccgcccgcgccctcccctcctcctcctcccgcctcgcccgctcctccgcggcggccctctccgcctccgccctcctctcctcctccgcccgcctgtcctcctcctccgcccgccgctcgatcccctcccggagcctctccagcgtcacccggctcggcccactacccaccttcttcgtccctgcggcggccgccgccgccgcgggggcccgcggtcttcctcgacgacgacatcggggcggtggtggtggtggtgacggtccaggttggcgacgatggggcgactgctcatacagcggcggccggcgacgaaaccctaggcgcgaagcggcggcaacggtggcggcgaatcgacggcgagtcggcgacggcggcgaggggaatacgcgtcgagtcgaagtgtacgcgtacggattcgcgtgtaggaataaatagtgtggtgcgtgtggggcccacgtggcagagactgggacgagcacggcggggggtaaccaggtggtggggtcggtgccggtctccgtgacacggacgggtatggggaatggtggatgacaggtggggcccaggaaggtgcgggtcggtgactcggtggggacacgggctctgggccgtgttgctcggctgtcacgatctgtcgtgtgggcccaaggttcggcccggtaaggtttcctcgaggaagggaaatcagcttttgtaaaggcccggcccacatacaaccgttctgcccaaacaaagaccataatatatggcgccacgaacaggaatgtactccactactctttaattccctgacctgctgctcttaatttgggtcaattacactgttcttttccgatgattaacatgtagattttacaatggtttttgttagcacactttttaaattattaaacgatacattgctttaaaatatcaaatactccctccgtcctaaaatataagaacctaagaccagatgggatatttaccactagaaaaacgatttttcatggtgttagcctatcattttcgctggcggaaaaatatgaaaaccgtcagcaaactcgtaacaagggggtgaggggcaccaatcgcgagcgaaaataaattttcactggccgcccgtctaatgcggccgccagcgaaaatatgtctatttttgctggcggtcaattaagtgcgccgccagcaaaaaaaaagataattttcgctggcggtcgaatttttcctagcgaccaataaataaaaccgctagagtaaacccaaccacaaatatcatgtcacattaaaacacccacctacctcttcctcttcctcttcttcacaataaaacaccacacatcctctcatcttcttatccactcctcttctctcctcctccctcccggcctccccaccggcgacggcggtggcagctctggtggcgacgaccgcggcgtgctcgggcgcgggtaacaaggagggcggcggcgctcgggcgtgggcagggaggccggatccactgccgccaggccgcgcggaggccggatccgccgctgtcgcgccgaggggaggccggatctgctgctgccacgggggacaagcccaacgacgccagtggagctagtccttggcctggtctaccgcctcatcacctcccaaggtcagcacccatccattcttgcgcttcaattcaccatttttgttgacgcagcaatctgaaatccgcgtgtggtggtggtggtggatgcacagaggtgacgaaggcgctgcgggcgaggaagaacgagaagatgcggcggtgcgtgtcacacccagaaatttagcccaaatttccatactattttgtgtattaaatccctatccaagaccagccatggtacacaaaacgacaagtaatatacatttccaaacgaaaataaaagcgtaagatacttacagaggaggcacttagtcctcacaccgaaacgaaagcagcagcagcggaaaaaggcaaccctagcggagcttcagctccactccacaggcaaaactcaactggtgtctgagccttggtcctctaactccgtcttcagctcagaagcactacacttctgaaaagagaaaatcatagcaaggttgagtacaaccaccgtactcagcaagccacaccaatgatgcagacgtgcaaggggataaaaggatggcttgtggctaattgcataaaggcagttgtaaagtattttattgagcaaaacaataaaatagttgattaattaaggtaatattagatctccattgtacaacgctacaccacgttgaacaggtccaaccaaaccacctgaactacaccagttcattaaccaattattcaggatgggactaatcacggtgaatctggtcgatcgcccataactgcgagcacggctattcgaatagttttgctctaaccagaggtacacaactgtacccacaagacacaatccaccggcatgtcaccgtgtcatcatgtgctcatgatgaacacgtcaccacgtcgagtgattatgacaaaacccttcatataactctcccctaaccatccacaccacgctaaggtttcacccccaccccctaccccggaggtgggcagtcccctcgtgcgccgcggtgaatccgacagctggacaaccggacaccccagccgacccaactccatcatgctcacccttgcctgggaacatcagccagaggaaagctatacttcaagtcaggcagttacccattcccgcttgtggcaagcgttgtatgtcttccagtgcatggggcgaaccggtccttaattgccatgggtgcgactagcaaaaccatgcacccacagcccaccattcagtcgcattttagttggataattacgatcagtgcaacatggtcgggtgtctcgagcacgcagctcgtcatgatactaataggtctaaaactgtaattatcccatcaactgagctagtggtaattaagcatggctaagcaaatagttctagctaggtcaacatagtaacacaagctagtcgatttattatccaaggttgacaaagaaaagatatcaagtaaatatggcacaagcaagcagataggtaaaccctgatcccatgtaattagcaaaacatgcatatttaatttgcaaacgtatgacttgccttgcttcttcaaacgatcttccaaactcttttcctcgcgaccggggacttccgaaacgacggattctatacgctggcacgcataacgaggaaaaactctaataaaaaccaagaaaatagtacatgaaaagaacaaacatgtagaactcaattttagatgaattttgcaagttgaatggcccaaattggagttcgcatgaattagatatgaattttagaagttttgagccattttaaatgaatttcaatttatgacgcgattaatgataattttctcaaaggataagggaagcgccgacatcagcaagggagaccggcgccgacaggcgggccccacaagtcagcgacacaaggggttggcgcagtggacacggtccaccgcggccggggcgacaccgtggacccggaccacggcggtccacgggcggcggcacaggatggcaaaggggcggcggcggttcacggccggacgcggccaccggcgacgacaccagcgcaatggcgggcacgggaggcggccggtgcaagggaaaaaggaggggagatgggggctcaccgggtggcacggcggaaggaggcgaccggcggcgggctcctcggggtggcacagcaacggcggtccggcggtgttccgcgagcgggaatcggtggacggctgccggaaggacctggggaacaaggaggaaaggttagggtagggaagggagttgctgcgcgacgagaaacgccggccggagtggacaatggcgacgaaactcaccgggatgcacggggagacgagttaagcggctcacggcggcggggaaacggtggcagaggggcggtggagcgcggcgatgcttttggc

SEQ ID NO: 33813 - DNA, 865 bp, Oryza sativa
  unsure (1)..(865): unsure at all n locations
caaggcctggatccgcctacagttgatttatatataatttgatgatatttgctccaatcaattaaaaagtatctcgaggtaccagtacctgatcacgataccaaatcgttttcgatcgttggattatcctgccgagctagatcaacgatcgaaaacgttttggtactgtgagaaaccagtacatcgagatactttttgttggaccggagcaaaatctcatataattttgcagctgttggacaccacatgcgcaggtttactatctgtcagaggaaagaaccactctttacacgatattattcgtcgcttccttttacattctgttagtcgatcatgatctctgacaaaatttcaagtgtagcaaagtaaacacccattcttcatttaattcttaatcttatgtccaccgtattaataactagtagttctactaaacaaactttcaaagaaagcaagcaatcatctcagaaggcattggacttgtgactggatttgcagcttatgtatacaagtgcttttgaagacgacacgcatatcgaaaaggaatgcactttcaaaacacattgtatatatagaatcaagtttgaaattggctgggttaatataaccaaatcccccaagaacacacggcctcaagcatagcggaatggtgggaatctcttaattatgctccctctcaccaaatgccgcaagaacaaggatcctaggatccttactgacgagtggaatgtttagctagaaagcaatctacgaattttccagcaatctagcttctttgtaaaacaagagttaagtatctttcatagttaannnnnnnnnnnnnnnnnnnnnnnnnnnnnnnnnnnnnnnnnnnnnnnnnnnnnnn

SEQ ID NO: 33814 - DNA, 1371 bp, Oryza sativa
atataacttgaaagttacaaccatttaaaagattgtttatctatttataaaacctactaccgagtccattatgtatgcttgcatggccataaaaaaggaattagatagtatgttttaacttaactaacttaactaccaccataggagagagaagaaaaggaaatcaacaggagggatggctagctacctgcatgctgaacagcaggtttcggaattcttttctttagaagatagatctaactatttcttttcagaaaatagagcgtatgtctcgtgacagcccaggaacatttgtagtagtgtcacatgtatgacggcttaagagcgtttttaggacgtctaatgaatttttagtatacaatagattttgagatcaaagagccatcgtgccagacagaaacaattaatcatcttgaatcgaattaattagctcatgccctatagttgcagctctatcatcatatatgtcatgaatatatattatctcaagcttcacgaaatacaatgaactaagagaacacagcttggaagacaccttaagccggaggaaataattgctgatgctcaaccgatgaagacgctcgcgatctctattttcctaacgactcttattcctacacagaggtcacatgcacgcctgaagacacaattaatatggaaatttaaataatgtatgtgtctagccatcgatccaaagctatatattgataattggcagcttcgatctccctagtgcaacatctgcagcaaaatgatgtgcttaagttactcccacttctctcctttttctgctttacacacattgtccaacttccatataaagctgtggtttggaaggtgaatatatattttatgacagaacaaaaagggtcttgtatatatatattggtagagtttgcttcgtcagatgtttaagcttagttgttggctagttgagtgaagcttatgcatatctgtaattccgatttatgacctgaaaaggtcagcaagggataccctctggggtggaacaatatcaagaacgtcaaacactatctttgagaaaacaaacattttgggtcaaattaacgcattgagtattataaaagaggggatatttttactgtattcccaaaattgttttgggccatccatttattgtagatccaacggttgatattcctttatctccgatgaggtaagagatcttaaaaaaggaaatagatcattgatagtacacttgatgttgttgataagcatgaatgcatattaaaacaataccagtagtgtgatggtgaagtcgtgatcaggcccatatactggccggtgcaacatgtgcacgtgttcagggcccgcaaatccgcacttagtaactaattatcaggcccaatg

SEQ ID NO: 33815 - DNA, 3274 bp, Oryza sativa
caaattgacttttgcagtccctagacttagcataaacggtaccctgtaatgtttgcggtcggcaatgttaaacatgtaatatgcatatgtgatgtacatgggcatggttagatggacagatgcgaatagatagagcttgttgtaatagaatagtatcatatctatccatccacctgcaccccttatcttgtaacccacggcgatggttattatcgccatgtatatcaacaaagatgcggcccgagtgagttgaatctgaacctatgatgtttgacaagcaacccttggatgagaactcacactgatttaaccagttccaagattatcatctccgcaagctagatacgttcttgaggatgataaacttaaattaattcataggcatctccactttcccgatgcctcgaaatccaatattcagggctatcacaaaattttcttctttgtgtgtgctcactagcaatcagtatgcataatgcattcagaaagaggattgatgcaaagtggggaacaaaaagagtagtagctggtgtttggggaaatctgatatgtgttttgttccttaccctgctcactcagtagccaatgcaatatatataggctagctcacacttctttgttgatccacttcaaggctgggtacaactgtacaagtgatgaatcaaggttaaatgatccaatgtttaatatatttaagaaaccaattaaatcaaggttaaaggatgccatgctaatacccgtttagattataccctctcaaccttaaatatatatacattctcgtatatgatccaatctgactctgtgttcttttcatctgattgtgccgtcctccgattgcccattaattatgtagtagcaattaatctctccatcctcttgcaaacgagtacacctcaactagcactgctacaaaacacatccttaattccttacagttagccaaaatagcttttcacatgcggatggagcgcctgcctagaacaaaaggtatgtgaaaatcaattttcccatacaggtacgtgaagacgactaactgcgaaaatgatttttggtgaaaaaaatgcaaagagaaaagttttttcaaccccagctccgtagaaaaactttccacagaattcacatcaaggggccctaattccccagcaatttttttcccaagaattcacaacatccaacaacacaaaagttcatcacggcagtgatggggttgccactagtagaaaaaactttttttccagctgggccaaaagtagttttttatgcagaactccaacaggtatgcccgaaaaggtatgcaaaaattgctctttttccatgcgggcgacgcacccgcacgcgaaatgggtgcttatgtcaccctcatgcaaaaataaaattctgtaaaaaaaatcacaagagaacccctagctctgctgctagatccgaacgacacccgtcgcccaccgctggatccaggccgcaatgcttcgttgttgccggccgccacccgacagatccacgcgagggagccgccgtcgcctccttcgaagcgcaggggagcctgcgccgccatgctccatcgcagccgtttgccacccgccgtcgaccgcgccgcccgccgcccgttatgaggccggcggaggcgggtccgcccgccgcctgaagacccgttctggttgcaaccacggtggttgaggacaaggaggccgttccaggaagcaaaaaggtgggatgcgccgaacagcccgtcttcccactactacttcccagcttagtagcattgtcgtgcaggtggaagaagctcggcccactgccatcgatttgtaatgcagcttggggaggagatgctcgtggaggtgcggctgggagaaagagccatgtgggggtcctctccaatgctccctgcccgccttgtggcctggatacctccgattgcactgctaccctcgctatctttgttttcttgatacctccaattccaatgcacagagcttatacctgcactcctgatgtcacactagccatgtccagatcaattatgtgtctagtcatctctagctattgataattggcagcaacatctcaaccattgatgtgcttaagttactctcctgtttatgttctgcacgttatatatctaattcaaatataaactgatttgagtgatctatggtcaatatgaaacctagctgccacttgaatatttatcttaggaaatgaacataaacccggcctcgacttgaatatatctggaaaagagctgtggtcggattgtcacttatttaattatgatagaacaggggaaggcttctatgtaatcttatactttctaattaagaccactggccctgaatgtacttggaaggaagttgttttgtcagaagtttaagctaagtaagttgatagctgagtgaagcttcgtgcctatttgcatttttaatataaacctatgagctgaaaaggtagcatcgttgctctgaattttgatttgctctttatcacttacgatacaattgctctgcacatcgaactattgtttcggaaaacattgctcatgcagtacttgcaaggacctcttaaactaactaaataaatagattgatcctcagacttgagtgggttgagtcataaagagattatccatattaacccgatttcttgcacatgtgatatttgttaaatgaaggtgactaacattgattttagattaattagacactttggaagcaaacaactggggtagaatgttaatatatacaaggtgtaagatcaacgtgtgttttgattcttattctgtgatgaacaattggcatctgtgattattggttttgatattttgagattatcattgaagtggttttggagataatcaattttggagataatcaattttcaggtgatgatcggattcactgttattttatgtgtccggtccgaccgggcggaggttgccggtcagaccggtgctatgtgtgcggtcagaccggccaggtccgcggtctgaccggccgacgctgagttggtttcggtttcgggttgtttctttggatatccgtgattgtttcatggttatggcttctagatggatactatacgtatgtaatactgttgtttgctaacaatgagtcaagttggagatagcttggtctcggaatatggtttctttgtttgtttcatgtgtaggtgactcgatgcctcgagagagtatttgcggtgatggaccaggagtcggcttggtggtaagacgatgtccgtggtggtcagatatcatgcgggatactaaggctagagt

SEQ ID NO: 33816 - DNA, 581 bp, Oryza sativa
gcatctattaatgtatacaaaaaatttgtctatattttttattcatatctactcggcttcaaatattttcccagtatattgagatcgtgttcctttgctggaggagttgggaacacatctggcagatgatggcgtactgtacaaaacaagaagacaatggtgagtaacattctgattactaatttactatcttgtggattatgttttcaaattaattttgatcttgcgaacctacctttgctcaccagtcaagaacgtctttatagatgatattcttggtgctcttccctgcagggtcaacttctttctcaggcttagccaaaatccttgttgtttgtcacgacacactgttgacaaccaaatttggtaaattataaaccaggttcgacattgggatcgaagcggattcgataacgagattgattcgaagaacagagtatgcatcggctgcgaaggcatcggctggagtctgcgtcagctgagatggatcggacagaggacagctgatacagccggtagaggtggtgcagccgattccgatgatgatgatttcgaagatgcttctagaatcgatcaaggtg

SEQ ID NO: 33817 - DNA, 214 bp, Oryza sativa
aatgatgactccactgaactcggcaaaaccgggtgaccttgtttctggttctcctttcgctggtatcaagtatacgaacccgcttctccacatatgttaggtcctcctggatatcaatgtgttccgaatcagcctgttcttcaggtacccttaaccacttctttagttgggacacgtggaacacgctcatggatgcccatcatgttggatggaa

SEQ ID NO: 33818 - DNA, 1374 bp, Oryza sativa
agcttgatgattcataggggccatggtgtcaaaaccgggttacctaactagggaaaaactgttcctaagctcttccaaagcgtggcaagctggacagcttttatcgaagcggaccccccgcccatagcaaatgtttgttgtcatatttcaatctagggggctgcggcataacctgggtgtggagacatgaatgagtcgaaccctattcatcatgacgtaatgtcaaagaagtggctcagcgaggggctttatgctgattcaaggccgaaggacaaagctcttcctcttcgtgcttgtcctaaataatgatattcactgaggtgtgctggctctgcttcaatctgttttcttgctccatgccaatcgaagatgaaccattcaccgagccgagtatgtgcaagacaagacacgactagataagtcaaatagaagatattgcttttacacgagcaactcttaccttcatgtaggtacagcccacttttcctttgatgaaatgcgaacacaaacttcaggcatcgaagaaagaagtcaagatcgaaatcaaagcattgtcattgggttgaagatcaattcatatcgacaagactttccattcatctttttgttgatatttggattccgttttcaaataaagtcatcttctagttttaaatcacctttagaatcatcagcctctgtccctacactgactcacttatccgggatcgatcctcactacggtcctttatttcgaaacgaggatagggcttgtgaagattatggataccccatatctacacggcgattatatttagactggatataggataccgaatatagatagaatatctttatttgtatctcgggtttgtttcttaacttgtacgtcaaggaaataccctgagacttagtcggttacgattgtattttatctgtactctcatattctgataaggatatgagttataccttgtaatacggactccttcccctatataaggaggggtccgagtccttcctgggacatcaactttcttggagattatacatccaataatacactcggcggattcatccccagacaggagtagggtattacttcttgaataagaaggcctgaacctgtataaatcctttgtctccaaacccatacacttttccagcttgatagccacccccttttagtattgccgaaatcttgtttcgacagttggcgcgccaggtaggggttgcgtcaagcttttcaccgatcagtgcaatgggttccgtctccggcatcgaccacctcatcttcccacccgggcaggcgtttcggttcggcagcctctacttcgtcaccaataacttcagcaagatctctctcctcgactcggaatcggaccactcgagaga

SEQ ID NO: 33819 - DNA, 528 bp, Oryza sativa
aatcatggcttaccgtctacgatctcgcaatccgcgcagcatgaggagatagcaaggccatggcgaactatttaccagtggctttagcagattccgcccggtcctggctccatggattgccccgtggtacaatcggatcttgggccgaattacgcgaccacttcatcgccaacttccaaggcaccttcgagcgccccggcacacaattcgatctctacaacgttatacagaagtccggagaatctctttgagattacatccggcgattttctaaacaacgcaataagatctccgacatcaccgacgatgttaccatcgccgcattcaccaaaggaattcgccacgaagaattggtcggcaagttcgggcgtaagcctcccaaaacagtcaaacttatgtttaaaaaagccaacgagtacgccaaggctgaagatgccgtcatcgcatcaaagcagtcgggctccagttggaagccaaaaaaggatacgccggctacgggagggggtggaagtaacaatcataaggacc

SEQ ID NO: 33820 - DNA, 723 bp, Oryza sativa
gaatgttcatcgacccccgacttcatccatctccaatccgtgtacttttgtttataaccagactgagccacaaactaagccttacccactagacatgtggaagtacggtagtgctttgcaacaaaggcccgagcttaatccttatagtggccggggtgctacttcccacaactggcatgcacccaaaccccaccgaaaacaggttttaggggctttgaaagaggaagagaggggtatgtccaattccaccataagccaaacattccatagtatccaaatgatatgagaattcccaaagtctaaagttataaaaccacctaatgttgcctaattaatcagcgaagcatctacctaaattcatactagtggaaccatgaatagagtacccactagttggggttttatttattctagggtgaacaaggtaataataacaatagcaataataatatggtcataacaaaggtaaataggcatggctaaataaaacagtgataacgcgggaatttaaataaagcgataatgcaataatttaaatcaacataattttacaaactgggatccaatatgttcaaggatgatgtgacttgccttgctcgctttcccaaacgtcggcttctacttccacgaagagcggatcttccgaagctgcagcgtctacacgaccaacggaaaaaaaaaagcttttactctaataaactccatataacacgcaggaacaaa

SEQ ID NO: 33821 - DNA, 650 bp, Oryza sativa
catcactagatgtttcgactgagaacacacacagtcatggcctttttatacatatttatataggtacgtcagggatttgatgctggcgcaagcttcaacattgatgtggcaaggatacctcatgagcaagccaggattgtatgggaccacccacctattgtccaacactgcacctctaatttttacacgccacccatcatctctcctcctgtatgaaggatacaagtccttcccttgttgtgttgcttgacagaacggtcgaagaaagctgaagcgacactctctgtccaccatgcaggcgcactttttgtttagctcacctcacgggatgtgcaacatatgctttatgaccagatgatgtagcacagggtatttttccttatctggtatctctgcacagataactttatcataaccatctgggtttgttaacttactgcatggattcatggttaacaggatatgttcatgtaggaggccccgcttctgaaactcaataacatgagcatatgcctgaacctcactgaaatacttttcttggtgaacaagtctaacatgtatcgtagcttggccctaaatacccttgccacaaggtcccgcccatcttgcggctgttggctacaataaaaattttctgttatctccttcca

SEQ ID NO: 33822 - DNA, 2181 bp, Oryza sativa
ctttctccactacacctggtaacgcacagtgcttctttcttcgatctatccaagggaggcttattgctttaagcaaagtatccagttctgcatccgttaatgatttctgaacatacagaaaagaattgatagctaaagttttcttttagtagtttagtcaccaatcaaaaaagtagctaggctgaagccgaagcacattccctagcgtacgagatatgccttttaggaaagagatcccttttatgagcaatggtttttgataatgctaacccctgttcaaagcaaaggtcgaagctggccaccctttactcggcatccgttctcatatgcatagatgctccgagaagcttcttttagttagccaagcgggtcatgtggatgggtcaagagatgcgtaaacgtgcccaacaaggggtaggtgtggtaaaagggtatgcgggttgatgtgtctttcaccttgctagtaagagtggtatccttattggcagcaataccccatttcagtttctggatttgcggaatgatttgaacccctattttaaaaaccaatctatttggcccggtacggttttccttcaataccactcctacgatagaggctgatatgactacgagcgagatatgactattcctatccttaagcgaatgctgaatgaaagtaaggttttccctcgaagtgaaatgaaagcaaagggtattgcaaatcaactaattgttgtctaataccacctcctcctatatctactattggttgattgaaaataaaccaaaagcaagggtggttgcacattttctgaaaagataagggttcggtatgggctcaatggaacaagttgaggtatataaggaatagcagaacatattgattatcctattggattggttccgctcagtcgagatatgatgagtcaatgggcattgagagtttcgattcaatgtgggaatgactaagacaagttaggcgaaacagatatgcaccatagaggtttatccaccttaggtttgtagacaagaatagtagtcacagcgagggatgcacataaataagatctgcactggtataagtgataggttttgggtaagctcgctcatatcgaaagaagattcgaaggaaatgaagcataagctgtcaccactaggataaatcaaattgaatcctaggctgtttcgatagacaaaagaaaatagaaaaaagtagtgagtgagaaagaaatccgtatgtttggaaacgaagtagcagatttttgagtagtctttttttggctggtaactattcaaacagagctagccctctttcttgatacctatgtactgtccacatagagttctgtttcctgaaaaaccaataagcattctacacaaaaaacaaggcaaagctgactaccatatactactgtccctgctttacctgctgtccaagtaagtactaatttcgaatgcgaggttgtgtagcaaagctacaagccgaaagtcaagaatgaactgagttaactagctggtagcactgtcctacttgtctattcgttccaactattctatttgtttgcttgctggaacaagggaatatagggctgctgagctgtccaagtagaagtagctttcctactagttgttccaactaaccaacaagcaccggattgagcgcactagcgcgaaagcgttagcacgcgcatccgttttcttgctccactcataagaccaatctggtaaatcaagaaatgaagaggtattggtatatcaatgaacacactccatagagtttctgctcaaatcagagtgttggaaattaagaaacagtttcatcccgccttccactaatccccgcatttcgctcaaagctgctctctcatttcttcgcccttaggaaggtctctactgcaactgagtttgaaagcttttactcatcaaatatttttggcaagtaaagtaggtatcaatctgcttgaaagcctgcagagtccaattttgagtattttcagttagaatctagagtcagcctattcagttcttagcccttaagggtaaggcagggggtaatatggatagtctctgtccctgtattcacattccaccttcaacaaagtgttgatttcccgtaaagctaactgtagtcctttaagtaagtagatatcttaggcaagttagcaatctcgttatattaccaaggccttcccttctatt

SEQ ID NO: 33823 - DNA, 413 bp, Oryza sativa
atcgacttcttcgcaagtagcccatcacgatgacttctaaaaagaatacactttaagatgtggccgctcccctacaagcacatatatggatatggagcactcttttccaccctatccttatatatttcattcccgccatggacagcaactcactcttttcgaactgcactttgaaagccaaagccaagaaagaccatatcaactactctccaaattgcaggataagtcccagaattcaaatggaagacagaaagagaaggcaattcaaacctaatggccaaacattacgaatccaagacagaaagacttatagccataaaagaataacaagagaacaaaaacaactccatattctactggcctgcctctctgatctactatccaactgccatggaagcaccactgaagactgg

SEQ ID NO: 33824 - DNA, 650 bp, Oryza sativa
caatcgtattcctcgtatgtacatgtttcgtattgtgataaagcacctatgccgctagaaatagtagcgccttaaagaaagcgttatttacaagatggaatagtgctacgtcataagcagaaagaccacaagccataaatgggttacctagccacataattacagacagggacccaactcttaggccagtccgaagggcattgatggaacaaacaaaggtagaagatcttgattctctgcaattcggcttcaacccgatggagctctcttcaaaacatatctttcggcgtcagtctttcctgccttaccttaaccccgctttcacgtggcgattcggtatgaggtttctctgatctgtttacggtattcttgaagctttctttcttggtcaccggacagagtgagaactgctctgctttctttccctagcacacacttagtagatagtaggcacaactccgctaagagctcatcgaacttgagttctagagtaagaccacagctcgatatggctcattcactagtatggtttaccacatgccagtgatagatctctctcaagtgaggtctggtatcggtgaagtcaatcattgaattgaagtggtagagtgcataaccgggcataaggccccatgtatttcttatcagtg

SEQ ID NO: 33825 - DNA, 153 bp, Oryza sativa
ttcatggggagcgggattgacgtcaaggggtgggacttcgagctgctgccatttggctcaggctggaggatgtgccccgggtacaacctcggtctcaaggtcatccagctcaccctcgccaacctgctgcacgccttctcctggtgcctcccc

SEQ ID NO: 33826 - DNA, 2085 bp, Oryza sativa
cctctgatcagagtataatctattcgaatagccgcgccctcggttatgggcaagccaagcaatgtacccaggttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcctgagggttcacggccttgattaataattttgtgtagctctagggtcgtctttataaaatggctttgggcaactaagtgacttttaaatgctgttttctgcaaaacttaacccctatattattaccccttgtacccccttgcattaatcatgcatctgccggtgtggcttgctgagtactgtggttgtactcattcttgctctatctttctcccccccttcagtaagagaagctttggagaagaagtcttaggtggagtcttggcttataccccagttgagcgcctgtgaagatggagccgtaggcccgctagtccgctgctgtttatttttgattgtcaggcctgaagcgcctttgtaataatgtaaatattatcgatgtaataaagatgtgtcttttatatcatgtttgtttggtgtacccctgcttttcctgggacggggattaatacattagcgttcgggaaaatgcaattttctcggtcgcgacagccggcgatgataggtggatttggtaattggtttgttccgattctgataggtgcacctgacatggcatttccacgattaaataatatatcattctggttgttgccaccaagtctcttgctcctattaagctcagccatagtagaagtgggcagcggcaatgggtggacggtctatccgcccttaagtggtattaccagccattctggaggagcagttgatttagcaatttttagtcttcatctatcaggtgtttcatcaattttaggttctatcaattttataacaactattttcaacatgcgtggacctggaatgactatgcatagattacccctttttgtgtggtccgttgtagtgacagcattcctacttttattatcacttccggtaatggcaggggcaattacaatgttattaaccgatcgaaactttaatacaaccttttttgatcctgcaggagggggagacccaatattataccagcatctcttttggttcttcggtcatccagaggtgtatattctcattctgcctggattcggtattattagtcatatcgtatcgaccttttcaagaaaaccggtcttcgggtatctaggcatggtttatgccatgataagtataggtgttcttggatttctagtttgggctcatcatatgtttactgtgggcttagacgttgatacgcgtgcgtacttcaccgcagctaccatgatcatagctgtgcccactggaataaaaatctttagttggattgctaccatgtggggaggttcgatacaatacaaaacacccatgttatttgttgtagggttcatctttttgttcaccataggagggctcactggaattgttctagcaaactctgggctagacatggctctacatgaaacttattatgtgggtgcacatttccattatgtactttctatgggagccgtttttgctttatttgctggattttactattgggtgggtaaaatctttggtcggacatatcctgaaactttaggccaaatccatttttggattacttttttcggggttaatctgaccttctttcccatgcatttcttagggctttcgggcatgccacgtcgcattccagattatccagatgcttacgccggatggaatgctctgagcagtttcggtcttatatatccgtagttgggattcgtcgtttcttcgtagttgtcgcaatcacttcaagcagtggaaagaacaaaagatgtgcggaaagtccttgggctgttgaacagaatccaaccacactagaatggttggtacaaaaccctccagccttcatacttttgaagaacttcccactatcaaaaaaacaaaaagctaggcccacctctcctaactattgcccataaaaa

SEQ ID NO: 33827 - DNA, 283 bp, Oryza sativa
caaatctgaattaggtatggtattcactctctcatttaagaatttagaaaaatatggacttcgattcctgtcccgttagcatctccgatccgagagttgggatgactctgttagtttcggtcgggagccggacggtaatggacctacaacccttgcttgtggactagctgcagagctcccctttgttctattggtttggtggttgctaccaagacaatttttttatgcccatcaaagaacctcgagatgctaatccacgaaaaacgatacgagaaatgagaaa

SEQ ID NO: 33828 - DNA, 514 bp, Oryza sativa
tcacaaaacactgggatccctgtccaaccgattgacacaattggagaaaaaaggtcctattatgggaccattcaagaaatatgggaactggactatggcctaaacatccaaatccatgtgctccgtcggaaatgcgtaaaaacacaataagggtttccactcattactacgggctaaccatagtccatcacagtaaaacaggccacaaggatgatccatgggttttagcagaacgtgtggctcaggtgttttatgtgaaggacccttcagataaaagaaaaactattgtcatatccggaaagcaacagatcgtcggcatccacaacatctaagaccccaatgattacaaccagttcgacgatgtaccattgtttactgatcttcctatgcgaattaagaaggttgagagaacaatcgatgaagcaaatatgtcgtacgttcgagcagatggtgttgccaaggttattaagtcatagttatttcgtaacctttagttctcattgattccaaatgt

SEQ ID NO: 33829 - DNA, 389 bp, Oryza sativa
tgtggcactctagtcagcacgcgttgtcccattaatgtcaagttgtgggaaacagtggacgacaacatcaagacacttctctggaatgagttgcagaagtattttgtgttccctcctggatcagaggttagggggagagattacgcacttaaaaagatgggagatcgatggcgacagtggaagtccgatctaaatcgggattatgttcagaagaatctcccgccgtttacggattatggacatatatcgcaggctgactgggacacgtttgttgcggatcgtacaacagctgaagcattggctttgaggaaaaaaatgtccgagctcgcgaagaagaacaaatatccccatagattggggtcgagcggatacgctggtcacgtcgatca

SEQ ID NO: 33830 - DNA, 257 bp, Oryza sativa
gagtcgatccacgactacccagatcgaatcgtgacccgacgatgtccggggcagtcccgttataaagtaaattccaatctcctcccatttccattccgggatttgaagaggttggagtaaacctgctggtctttggtgctctgccttcactcgttggcaaacatcacagagtgcgacgaattcagctatttctctcctcatgctgacccaccaaaacttttctttgaggtcttgatacattttagtgctgcctggat

SEQ ID NO: 33831 - DNA, 669 bp, Oryza sativa
ctggtgtgtggcaaaagcgaccttctcctgatcattgcactgcaggagattcagcttcttctctattgcatggagccagtcatttgcctccatagggttggtggtgctggagaaggtgggtggcctgacacgtaggaactcaggcaacttggactgagggggagggggaccaaactgctggtgctgctgttcggcgtgctgcatcatcctctggtgcatctgctggtgctgctgctgcatctgctgcatcatggctgccatcatctgagtctgatgtgccataacttgggcaagggtcggattctcgggaagtggtggcagaccattgccggaatcactgctggggtgcacaccatcagcacgttcttcgccgttgctgccctcgcctatcgtgcgggtgccagtcctggtgtagaccatctacagggaaaagcagacgggggaaaagaagaaaaacagatgctcaggaactaagctttattacaaaggaatttaaactgcaattgttctgatctgaattaaaacacttaaaagagcaagcaaaaatccttattaagacagccatatcataggcacatgatatggaccgttgactgaccccaaacaagcaacctaaacacacaaactaacaaggagaaagctagacagtcgataaactaatgggaaaaa

SEQ ID NO: 33832 - DNA, 589 bp, Oryza sativa
gacacacatgcgccattgcccagttttcttccgaactagaaccgggttagccagccagtcgggatgaaggacttctttgatgaagcctgctgctaacagcttggttaattcctccttgatcgcgtccttcctgtcttgtgcgaagcggcggagtcgttgtttaataggtttagcgtcttctttgacatgtaaggagtgctcaatcacctctctaggaataccaggcatatcagatggtttccacgcaaagatatctttattattttgaagaaaggtgacgagcgcgctttcctatttacaatctaactcggcgcctattacagcagttttagtgggatcagaaggatctaggggaatttttttagtcttggcttcgccttctccgctctttgagaccttggtcgcgggcacttctccttcgcttgccgtggttgcagccagtcggatatcttctcgggcagacgccatctcgcgagtctgggccatctcgcaattttccttgtcgcatgtgacggcttgcttgatgtcgctccgtagagataggactccccggggaccaggcatcttcatcatcatgtaagtgtagtgc

SEQ ID NO: 33833 - DNA, 355 bp, Oryza sativa
tgaagtatcatgccgttggctcgttcgacctgtccattgctcatgggatgcgctactgaggcatagcaaattttaattccgaagtcttcgcaaaagtctttaaaaactccgctagtgaattgtgtgccattatcggtgataatccgattaggcactccaaacctatgcacaatgttgatgaagaaatctcgagctttatctgctgtgattgtgacaaccggtttagcttcaatccacttggagaatttgtcaatggccacaaagagatgcgtgtaaccgccgactgcctttttgaacgggccaaccatgtcgagcccccaaaccgcaaacggccaagacagtgggattgtttgca

SEQ ID NO: 33834 - DNA, 985 bp, Oryza sativa
aaaatcaaaaccggtgcggatactaatttcttcttgagctcctcaaaactcttatcgcactcagctgtccacttaaacttctcatctttcttaagcaactgagtcatgggtcgggcgattctggagaagttttcgatgaatcggcggtaataacctgccagtcctagaaaacttcgaatctgcgacacggtcttcggtgggatccacttggtgactgactctacgtttgacggatcaactgccacaccctgggctgtaatgacatggcccagaaatttgacttccgtcaaccagaagtcacacttgctgaacttggcgtatagctggtgctccttcaacttctcgagtaccagacggagatgttgctcatgttcttcctcggattttgagtagataagtatgtcgtcgatgaataccacaacaaacttgtccagaaattccatgaacactttgttcatcagattcatgaagaatgcaggtgcgttagtaggtccgaaggacataacggtgcattcatatagcccgtaccgagtggtgaaggccgtcttcggaatatcctcttcccgaattctcaactggtggtagcctgatcgcaggtctatcttagaaaacactttagctcctttcagttgatcaaataaatcgtcgatccgcggcaagggatatttgttcttgattgtgacctcattgagtgcgcgataatcaacgcacatcctcttcgtcttatcctttttctccacaaaaatgaccggagcaccccaaggtgaagtacttggtcgaatgtaccctttctgcagctgctcatcaacttgcttcttgacctctgctagttcgttggctgccatcctgtacggtctcttgtaaattggggcggttcccggtgccaagtcaatccggaattcaatctctctcttgggtggcatggtagtgaggtcttcggggaacacttccggataactcgcagactatgggtatatattccatt

SEQ ID NO: 33835 - DNA, 1696 bp, Oryza sativa
gggggtggaagcggtacgccgtgtcatggaagatgtagttgtggcgctcccgcagtctggccatcatcaagtaggctgcctcctgacaggcgtgatctgctgtgcctcctgacgcctcaactgccatgttagcgaggcaagtccccacgtagccatggacctccaagctgacacggtgaggaagctcgccactgagcggtggaatagtcgtgtactccggcgcgttggggtagcccaccaccagtgtcatgcgtgccaactctgccacaaagtcgatcatgccttctccgcggtggttgggtgggtgaccggccatctagagaagacaagtgagtaggatcaatgcatgctcaaatccaaatttaaacaaagcaataaagactcaaataagggaatcgaataagagcgttattttatgcatagatcagtttgcataagagcgaataaataagacagactcacataacgataaaataatgagaaattagatacatactaataataacaaacaaagcataaataccttgcaacccatgttactgagctaggacctaatgcatttcacccatcaaatcccaactgactgacgaataaatcccaatagttttactaaaaccctagactgactcgttttggcaaatcccacttaaatgagcgacaagatttttcccttgaaccacaagaacagatcccaattttcccggaacaaatccaattgcaaagaacatatgcaatgaaaaggattcagagggctcttaggtttttttccatttggcttgtcctacggtcaaggtcggctctgataccaacttgtcacgcccagaaattcccgaatagaattccaagcagaatgtgcattaaaatccccgtccaggaccagccggggtacacaaacgacaatgttgacatacagatccacgtcttacaaacatcataaagtcttacataaatgcagcggaagaaaagaaagacaacaggagctaagccttgactaaactttgactaaactgcagcgggaacaccactccacaggcatcctcgacggcacggacgaagcctactcctcagagaaaccttcatctgacccgaactcgaactctggggttgggaaaagtagagcaagactgagtactacccactgtactcagcaagtcataccggaataggggtatgatgcagggaaatcatcaaagaagagctgaagtggttcatttgcataaagcgagcatttataaacagagattgaaagatttaaacagttgtaataattaattaatattaactatccactgtccaacgctaacccacgttgcgacaggcccaaccatccacctaaactatccaaattaaaggattacactaaggtgaaactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggaccattcgcatagccccctctaaccaagcacaccacacctcaggtttcacccccactcctcgcaaggcagcgggcagtcccctctcgtgcctaggtgaatccggaagccgcataggccatcgcaggacccatccaaactccatcacgcccacccttgcctg

SEQ ID NO: 33836 - DNA, 481 bp, Oryza sativa
cgacggcgcgagcgagatcggcgggaggtgggggaaggacccgacaggtgggccccacctgtcggcgaccccgagagaggaggcggcagggcggcctggctgggcctcggcctgcggccggcccagcaaggaggaggggaggaaggagggaatgggccggcggcccattcgaaaaaaaaggaggaaaaagagaggaaaaagaaaaagaaaaaggaaaaaggattttccctggaattaaaatattgcttgctcaattttaattggttaaaattatttctagagctctgaaaattccactaaaaatcctgttaatgaatttcgacatgtagaactcaagaaaaattccacatgtcaaatccgattattatttgcattactttctaagggttttttcctgatttcacctgcatttttttagggtcatttataaaaattacaattttggcttgggaggagaacttcggggtgtacaccccttgat

SEQ ID NO: 33837 - DNA, 375 bp, Oryza sativa
aggttgttcataagataagttggcaagaatggcttgccatactcataagtttcaggcacatcggcagataaccaggattgcacttcatcttgggccgctagtactgacttctgggagtctgacaagacgtgagatactgacttctgggagtttgacaagacgtgagcaagttcttttctcttctcagaattcttgaaagctgaaaacatgacttctccttatccttgtcaatctcctttgggtcgtatgtcgatatcaactttggaattatacgacgaggttccaaagtattagactttggttcggatgtagtaccatgtggtatgtgcacttcttctaccagagcagattggggtgtaggtgaaaaggttttga

SEQ ID NO: 33838 - DNA, 677 bp, Oryza sativa
tcagcatcaaatgcattgtcttgaaatggcctggaccataagtcttgttctgttggaatagtccattgttaggaccaaggcgcaattgaccttcactttaagctcatgtggagggaggccatttggagtgatcgtgttcagaaagtccaaagagtagctattttggggatcatcatcgactgaatcaaagctgaggtaaatcttttcctttccaggaaactaatcaatcatcttcgtgttcagcttatccacgaaatcattttttgttgagaggatggcccgtgtgctcatatattccacggaggtcgtatttctctcgtcatcaagcgaggggaacacatattcaatcaatgtgttcactgaatcttcattgtccgaataaccaatgacaatttcatcaggcagacggacgtcatcatctgcgatcgtgttttcagtcccgtttccaatcctaagtagataatcgaaaaccaagggtcagattgtgccctcatattacgcgaaaggcatatcttccttatattttccataaataagatctctacaattcagcatcaattatctgtgcccttgtcccacatgtcaccacgggaagaacttatctgaaatcaccccgcaatccatgacgtttcctccaaatggcaataaatgtccataataagggtctcaactgccaa

SEQ ID NO: 33839 - DNA, 273 bp, Oryza sativa
atttatccgtcgactgctacagcgtgtcgctcctcgcgggcgcgtccgttcgggagtccggatcctgtatgctcagattgtactcccctcccggctcattgctcccgtacatccgatactgccccaatcggacaatgtacacatccatagaatgccaaaaggcctggggccggacggcccagccctagtacaacacggcttaactgggtcagtcctgtgcaggcccgacccaaccattgggttgtcactactacagaatagattttcctggac

SEQ ID NO: 33840 - DNA, 606 bp, Oryza sativa
gaacactgacttactgaagaccggaatggaccaatgtgacattgactcaagaaggtttacaaaaaggccaactatagaaaagccagagctgactgaatgaaataccgcagttcactctgactccggttcggtacctactctatatctgaagattgaccacagcgtaatgccttaccgctttacaccttgctttccttatttagctactttacctcagaatccctctctagagagaattctctttcaagtttgaattgttccattaacccatctactgccaacacaactacttcttttctcttttcacaaataccttcttttctctctttgttggttaattgagtagggtattctagtgaatcgtacctgttttccgacaggaagctttggctgaaaggataggaatagctcttgcgcaaggaatataaatagcgtacgcgtactagtccagggaataaaaaatatcttacctgtgagggggaggcaaaagggaaaaagctagtattttgaaaagggtatagtagctggtattcggattgagcagtgccataaaaagaaagcgttgttgtttttcctgttcaaccaccccaacctgtaacgtataac

SEQ ID NO: 33841 - DNA, 725 bp, Oryza sativa
  unsure (1)..(725): unsure at all n locations
tttgcgccaccattgattggtggcctccagagaagtgcaattatgaccagtgtccatgggggcaagcttctatcttaaatttggtaaattgctaatttcccaagaatgtgtgtgttttatcatgttgtaattgatatttttgcaaagaactaattttgatccttttgtgaatttcccaggacttgactaatcctttgctagctaaagctatccaaggtgaatattatacctattttctgcgaacaattttctactgtaactaaaaaaaatggacaacagtagggaatttccatactaaattgcaaataggattaaagttacaaagtcaaagactcaaagaattcttgtcaaagatttatctgttcctttgcaactacatatgccagcaactgtgatcaatttcattctaccgtgtggaggtttacttgttacactgactaatataagatattagagggtaaatcccgttttaagaaacatattgacatttgtggttcattctgtacctttatttattaagcttggaatttgtttagagctactttccacaaaatgtatttgccttcttatggttttatacactttcccatgattcatggactttttttcccattcatttgtatttggagcatttagccctcaacgaatcagacgtgtaggttccttannnnnnnnnnnnnnnnnnnnnnnnnnnnnnnnnnnnnnnnnnnnnnnnnnnnnnnnnn

SEQ ID NO: 33842 - DNA, 617 bp, Oryza sativa
  unsure (1)..(617): unsure at all n locations
ccatccgtgttgtttgagaagcactcacctagtcgttttagaaaaagagttcaaataaacccaattgcaaaaacaacagccttcccttgaagcctgcattaaacacttatttcccctggcttgctgagtactcccgtactcacccttgctctatataaatatcccccccagttgctgaagaagatgaagcggatcctgctgatgaggagttcttccaggagcaagccggctacgatgagttttagggtttcggcctagttcccaagtcgcgcctgtgatgaatggtccaagtcctggcttccgttttccttttgtaatgcagttgtgagctcgggatctgtccgcagcccaacatgactgtactcctactctataataaagagacctctgttgctgtgatattctgtctccctgtgataccagcactgtttcctgggactggtatcgattaacaggttaaattggagcgtcacgggctagtcccggtcgggactagttcggggcgtgacaaagtttgaggacctgaacggtcgatttgcgagtttagagnnnnnnnnnnnnnnnnnnnnnnnnnnnnnnnnnnnnnnnnnnnnnnnnnnnnnnnnnnnnnnnnnnnn

SEQ ID NO: 33843 - DNA, 1279 bp, Oryza sativa
  unsure (1)..(1279): unsure at all n locations
attcgagctcggtacccgaattatttttcctagttattttttttaagttcgacaaaatttataaaaaaagtaacatctaaaatgtcaaattagtttcattaaatcaagggataatttcatttttgcccccattttcatctctaatattgattttgcccctactttttagggttttcgtttttgcccccacttttttgaactgaaagaggtgtttgcccctgttttggatggaggttagtgggaccgaatttttggaagaaaataaagaattttcgatttattgaattacctttttacccctgtgaaatgttaaccatacagaacagggatactactcctctcggcggcggcgatactactccagaccgcgagcacgctgtgaccgcgagaaacaagcggcgggcgccggcggcgtatgagagcgggcgtcgcccaggctccgcttctcccggcgcgtgcagaagagcggccgggtagagggtggcgcggcgtcatccaggggccctagcggcggcccagcggcgcccaaggcggcggcgagcgggcggtcgcggcgtcggccaggggccgctcctcccggcacgtcaaggagagcggtcggggagagggcgtcggccaagtggcgccctaggtggcggcggggagaggggtaggcggcgggggagggggtaggcagtgggggaggtggctgggcggtgtcgaacagcagggcctcggatgcggctggcgtcggccctgtgatgtgagctattggtgaatcacggaggaaatcttgcaaatggaggagattttcatggaagaggttaacaggtaacccctttgtgctattcttgtgactgtagtacttcatacctttgtgctaattttgtgagtgtagttgttctcagtttggtttgtacaacgaattagctagtagtaatacaattcaatgtggttgagataatttaccaatgtgccaatgtggttgagatcatccttgttctgttagtaatacaaaatgtgaatgttgtttgtgctgacttggttgagataatttaccaatgttgtttgcaatgttgaaatctctaaacctccccctcaaacaaacttatatatttggaattgtatttttgtggctattggtaacatgcaacaattagctaaatgtatatttttgttgctatgatttgtaggacaaatcacagtgagttgaaattagttgttagagatgggtcatttttcagcttgccagatgaannnnnnnnnnnnnnnnnnnnnnnnnnnnnnnnnnnnnnnnnnn

SEQ ID NO: 33844 - DNA, 1104 bp, Oryza sativa
  unsure (1)..(1104): unsure at all n locations
nnnnnnnnnnnnnnnnnnnnnnnnnnnnnnnnnnnnnnnnnnnnnnnnnnnnnnnnnnnnnnnnttttacatttctgctaatatatatgtatatattactcctaccacatggtatatatatggtgatatatagttttccttgttagattttgattaatatttagtgtcgatcgttttctcttaagataaatacgtacctgtacgttctttatatacgtgaggcagtgaaaatgtgcccaaaatactactagtactactactccagctacctggcaaaccaacatcagttatacatgctccacgttaatccgtacgtttttatattgtagtggagtactatatatcataatcacatctaccaatacactgtcagttgttgtttaatttgctgcatctgacagtatgttttcaatcctttgccagctagtataagcttgtgtgtgtgtgtgtgtcccctttaatttggccacttaattcggctgagtaaacaagcatatatatagagaataatcgttacttgtttcttcttctgcgtccgatcccgtggcccgtgattgcttgcaacgaccagcagtactggagggaaagtattctaattcctcgagtggatgttttctcgtttgctcaaaaaccatttaaacggttatgaaaaattttggaaaaaaattgacaacattcatacaacacatatatacaactttacagaattttaagtctaaactcaactcacacgtcgagatataaaaaagacaaattcagcatatgaatagtagcatactgtttatatctaaatttgtcttttttgtttctcgatgtgtagattgaatttgaacatgaattttggtggactagtaggtatcattatactctacattgtcaattttttcagaatttttcacaactatttacatcgaatttggaagaaaaatgtatactaggggatatccccgagagattagaatccactgctggaccacaccaaaacgagcgcaagatcgatcaagcaaaaattattggcccggcccggccacgctttggnnnnnnnnnnnnnnnnnnnnnnnnnnnnnnnnnnnnnnnnnnnnnnnnnnnnnnnnnnnnnnnnnn

SEQ ID NO: 33845 - DNA, 12587 bp, Oryza sativa
  unsure (1)..(12587): unsure at all n locations
tatatatatatacatatatatatatatacatatatatatatatatatatatatatatatatatatatatatatatatatatatatatatatatatccagccatcactcagatcacaatcacatgccatgctcttgtttgcattattcattaatactataatccaactgcatgctagttaatttgatcagggtcacgaactcgcgtgcagggtaaattgaaaaacctgatatttgcgtgatctctcttgatgcgtggctacactactttgcagcttaattatttaatttgctcgtgcaaattaaagtgagtcgttcctctccaaattaattagcttagcgcatatgtacgtgttactttcaagtgattactatttattcgttttgttgactgcacgcgtgtggaatattgctctcgccttttctatatacgatcagtaggaacaatatttcccttaagtaatctagagagtagtacatataaaccaaagtactttgggggttaaatagctatagtgttggggagtaattaaataaacttgtccggctgattattaatttgtttcttgggttgtgacggctgccacgcacgtgcagagaggaaagtacacctggcacattatggcatggcatatcgtgatgttacttctattttataggtcccacacaaaaattttatacctgtcataacaaacagttgaacacatgtataaagtattaaatataagttaaaagttaactaattgcacatattgcgaccaatttgtgagacaaatcttttaaaccaaattactccatgatttgacaatgtggtactaagtaaacatttgctaattatgattaattatgcttaataattcatctagctatttattgatggattctgtaattagtttttttattaatgttcaaacaccccatacgataccctgtataagtacccgacacattaactggatctaaacaacacattaactgcttttgcattctgctgctgctgctgctctagcatacacaggcctgtcagaggaggaatcaaccaacgacagcttcaagaaccaggatctgtttgatgttgttgcgtcctgtgtgaaacaaaccgctgatgctggtcagcagcagccgagtttcagttacccagcagctagtactcctatttcagtactacaagttctgcgtcccagggatcctaacctcaacttcactggtacactatttaattagcgatgaagtgtttatatattaattatacagtttcaaaatgcatgccaatatgaccactggtatttgcaaattaataagctatcggttaaacttgaaaaagtttgacgccacttattcatatcagctagctagctcacgcagtagttctattaactcataatctgtcagtccctaaatatttgacgccgttgattttttttaaatatgtttgaccgttcatcttattcaaaaagtttaagtaattattaattcttttcttatcatttgattcattgttaaatatacttttatgtatacatatagttttacatatttcacaaaagtttttgaataaaacaaacggtcaaacatgtttagaaaagatcagcggcgtcgaatatttagggacggagggagtacgtgtgtatatgtcggcatgcacactggctaacgcccattaatttccacctccatgactccatttgatccatgtattagctgtgctggtgggtgaaggctcaaggaagcgcaaagatgagccaaatggatgtggagctcatcatttgggaaaggaaaatatggagaaagaccaaccctccaaagacatggcaacatgcgtccactgctccaaagtatatacggcaaaatcgactaacggtacatctcatctcaggaggcacctcacaagcaagtgcctcaagagaaaagggctcactgaggaacttgctaagctcaccagtacaaagaaggcccgtaaaattcgttagtgatatatgcgacttaaatatattaattgcagtttcaaatttaagtaaggcaagggtatggtatgctcgaattgtactgtcggtgctaatatctgtattttttttatttttaagggagtggtactccgtattcttgtgcgtgagtgtgcttgttgcacctatttgtgcttgcgatgttcaatgtaagtttaataacattgttgttctctttatctttaattttattccgggccgtcgataagggtgttcaagctggaacagggcccaaaaaattaggaccccaaatttcttatattttaatctactagcaaaaatgcccgttcgttgcaacgggtgaataaattctaatgataatatacgtttttcatgcataatcatgtcaatgataatgtttgtattttaatgagcggctttttttttataaacgacgcatttctttctaacagtttcttcctagcatgtttttttgattttttttactgacgacaaataccatagttttctcccttttttgcttttcttttctcacgcgttttttgcttttttttaatgttctttttttgctttttttcccaatacatgagaatataaaacgaaataaaagccgtgtaatagatggcaaaaaatcgatggatcctatccgactcaagcgtccatcaattaagcgtttttttctgacagttttttctagagcgatttattttttaatagacggtgttttttcttgcgcggttttttcaaatcattttttagaaatggcgcattttttcttacattttttttccttgcatgcttttttgaaaaaatttaccgatgatggaaatagtatttctcgcacgtttttttaatggaagatggaaaaaacctttttagcatttttttgcgtttttttctcacgcattattttgaaccgtttttatttttctcgtgcattttctctttttaaatagttagattagattatagatagagaagagatatatactgattagaaatcggaatttgtttcgccctttccatttttttctcgcgtgtattttttattttgtacgaaccagctttttattttttacgaaccattttttcgccactttcttaggaaatcggacgaatttttttagatgttttttcagattttttcgcctttataggaatcagactttattcttctgtttttaaaggaatcggatctagcctttatttttcaccactttttttttgccttttataggaatcggatctgtggtttttttcgccacttaggagaaacaaaattttattgttattgtttttctctttttcccttttttttcttttttttgcagtttttctttttctttttatgcacctttatgcccttgttctcctccttttattattttttcttcaaaaaaaaacctcaagtatcttattacaagattatagggactcaaatgtaaatataaaaattacagggactcacatagaaaagtacaaacccaaaaattaaaatcatataaaaatggaatgctctcgaccggtaggttccgtttttgcaaacagatcttcaatccggcacatcaatttttttcaccaagatgaatgggatatcacggtatagattgaaaccgagaggagtgtgcctaggatctcggactcaaaccgagaccgagaggaggggtgtgttttattttccgtttttaagagggaattggatctagagttggactttttttttctctgagagggagccagacttttttttgatttttttcgctatttattttgttttcacgggagtcggacctgagatgagagggagtcggacattttttttatttttttcgctatttattttgttttgacgggagtcggacattttttttgccatttttttttgacggacgaaggaaactcttatttttcttaagtagtagagatagagatatataagtaccgtgtcaaatataatatgattcgactttttttttaccttgtcacatatatttttttttttgggaatccgacagatttgtttttcttttttttttttgctctttttttaccacgtccacgcggattcttttttttctggccggtcttttttttcaccttgtttttttttcgctcgttttttaggaatcggacagattccttttttatttctttcgctcttctttttaccgtggaatcagattcgtttttcttttcctttttttcgcccttttttgatcggacgttcttttctttttttttttgttcggattttttcccgttttgttttggatcggacagatttttttcgtccggttttttttatggacgacggaagcacctattattttttaagtagtagagatagagattatattgtgttttaatatatttaaaaacctatcatattgtttcattttttaaattaacattttggacatgatttctgttggaattaatagatgggctaaggcccattcgaaaattaattctttggaaaatcacaaaagctcacttcatgggatggcatgcatgtggagtttagtaccaccttacttattctaggaaatggggacctccttaaaagggaggatgccctcctagccatttgaagcatgtgtggtggagagaagaggggaaacacacacgctcgctcgcctggcctggcaaggcaggcggtacgcgtcgaatggtccgcaaaattggctcctcacccttgagcagatacagcctccttttgcagttttattccgaaaaaatacggatttgttttgttttggaaacattccgaaaaatccagtgcgtgaaaacggcgtggtgtccggataacttacggccagttcggttacgcgggcgccctgatcaagcgacctatctctatataaaccgagccgtcgccttcacgcaacacacgcgaaatcaatctagggtttgcctcctactctgtactgcgccgtcgctcgtagactactccatcccgctcgccggcgtacaccggcgatcgggagagcaggtctccggaacctctgtcttcgacgtcctgaaccgggagaaggcggcaataaggtttttgggaagcttttcgcgcgactactccttgttcgtccgcgacggctcgccttcctctccgctcgcatgctgcgcgccttcgtcgacgcccgcaaccgcgagtagttcctgacgagcaaccggtctttccgccacctcggtacgtgttcgacatgttgcgcatatttgatctgttcatgttttactgcttagtttacatgtgtagatataatgatgcgttcaatctagtttacatctgcaatgtcatgatttatttatggaataaattaaatcattatgtgcttataatttcaacaatccaaaaaccttattttaggcgctgtgattttactatggctggttttgccgatgcactgaggccagataaattcaccggtatgcactttaagagatggcagatcagggtcactctgtggctgacggctatgaaatgcttatgggtaagtactggcaaacctgaaggaattcttaccgctgatcagcagaagcaatttgatgaagccactactctctttgtgggatgcaatctcagcgttcttggcgattgtctggtcgaggtgtatatgcatatgaccgacgctaaggagttatggaatgcactgaatactaaattcggtgctactgatgctagtaatgatctgtatatcatggagcaatttcataactacaagatggctgacaaccattctgtagtcgaacatactcatgagatacaattcatggctaaggaactgctccagccttcacgcaaatacgcagccgcacaaaacagccaagcgagagcacggcaaatttctgctcgcctgcatgtatatatgtgatcatcagcctggccagaagcttgtcgactatagcacatttccacttgcaaccagctgcacgagtcttcacctctctgatctctatgtgcatgctaacgcaaatagtactaattaacgcaaaaaccttccttgactatggttaagctcagctaatccataatatttccattccaagataaatgctaagcctccctagcacatccgtgcgcacacatttaatcggctctcaaactaaccactccaaatcatgacagctaaactaagtaatctggcttacccaaataaaacaaactaatagccaaattgtgctacaaacataaggcatcaaatagtatcagcttgagtgaagatacttctacatgtttgtttcctctaagatttaatctgctgattaatgatgtggcaaatatcatattctcatggtcttaggtagtaattatataatgcttttgctaaaatgaaaatacagtctatgttgatttcttcgcaaaagtaacaggatatatattcagtaactggagtaatgcccctcttgtattgtatattataggctgtaattcaactatccatgaaggcaatgtaacacatcatgaatatgaggtttgtaaaggaagagatgtcagaatatgtacagggtgaaggtgtgtcaaatggaactggcctggagaacaaactccaagaagagcttacaaattaaggagatgcaatcatgacaatccccttcaggttgctattggttcgcagtctctggtccatctgggttgatctgatgacccaccgcaggatgcttcgcatggacccgatctcatgtcccatgggatgccattggcacgccggccagagcttcagccttaagcttccggctactgctctcccggcacaggcccagatgcaggtggtacatatataatccacttatgaattacacacactaattaagttgattaactgtagatgcatactatccagcaggaatagtactgtagtaataatgggagagctagagatggatgacagcatcagcgtacttcttccatcggcttccatgcatgagcagctgatcgatggtggccgagctagctgcaccacccgcgctgcccagcaacagcaattaactactacatgtctctctagcgacaccgcccgctcccggctcccgtacgtggtcgtggacagttaatggccccgagacttcaccggccgtacgtacgtatacatgcatgtgagctgaccatccaccgtagtccctccgtattttaatgtatgacgccgttgactttttaatcaacgtttaaccactcatcttactccaggatagagttcaactcttactctagtcctaatacctattatacaactccaagtcctaaactgtaaccaactaggtacttattcgacacaaaactctaacaaatttcaccttggcgaatatgccacgccaacctgaatttgttacttgctcgaaccttcgtatacccagacttgagttggttccttttcgccgctcacgccgagctgccccgacaaaccttcaccatactcaccataacagcatacggacaactagctcccctttcttccccaaccagattggccatggtaggtatccctctccctcgagcccatctagccccttctgcctgtctccccacactctgctcgtggcaagagcacagcgccagtagccgaagatccctactgtgaaaccctggatgtacattgggtgacggctgccggagaagattcagaaggacatgtcggcggcgccatggggaagagggtgcgtacagctgcggcggggagtgttctgcagtggggagggagacgtcgaacgcgcaggattggggaaggagatggagccacccacattgtggggccctctctctgacaccctcgagggtatacgtatgatatgtattcggtatgggtagggcggtctgtgtggggagtagttgcgtatttgctatgaaatatataaaattatatgtatacataaaagtatatttaacgatgtatacataaaaaattgaatgtagagatggatgattttgtgtaatatgtgaactcacttggtataaatatctagtagtaagagatggatttacaataattttattattaattttgtggacatatctaggcggtttggtggctgccacccccacgaaatgtatttgctggctaaagtagtgggagaaatcatgtttcgtgacagctattgccatcacgaaaagattttccttacagtaaacacattactctcagtaaattagccaaaacaaggaatagccttttggtgactgccatacaatcactaaataacttgtgacggcttgccctcgccaaatattggatttcgtgaccaatcaagtgtgacaggtgtttcgtgacggcatgatgccgccaaagttcttggtgacggcggcattatgacttttagtgacagtaaggggcagtcaccaaagatctaatctctagtagtgccacttaaccgtgttcgtgtgccattactggagatatctaatctctagaactataagcttaatttgcatcgatcctccgtaatgcgcatgcatgccctctcttttttaagctgcaggggcacacgtctctctctctctctctctctctctctcttcctgttgtttttttttcttctcaacccgatatcgatttacctttttccaaccatattttgtggataggtccatgttttctcaatatacttaacaaggctaaggtggtgtttggatccagggacttaactttagtcaatgtgtatttagacactaatttagagtattaaatatagactatttacaaaactaattacataaatgaaaactaatccgtgagacaaattttttaagcctaattaatctataattagagaatgtttactgtagcatcacataggctaatcatgaattaattaggctcaatagattcgtctcacgaattagtccaagattatggatgggttttattaatagtctatgttcaatatttataattagtgtctaaacatccacgatgtgatagggacttaaaagttttagtcacatctaaacaggtctaagatcgtgccttggtttccaagggtacaagggcgctcgctccaccgcgcctctctgcactcgcgaaaagctatatatactccatatccgatctcgcgagctcgaatacgccatttaattagctaggctgatcgatccatccatccatccatcgaccgatggaaggcagcaacggcactcactatccccaatgctcaactggtacgtccatgcgtcactacaatactagttaaccatcttttcttcactgatgagtaatatcatgcgtgaagatgaacatatatgtcgtctatatataatcaagtcaatagtgtgtgttcggatccttgttttcccaactctctgatctctcgtattctacgcacacgcttttcaaactgataaacggtgtgtttttttttaaaaagtttctatacgaaagttgcttaagaaggttatattgatccatgtttttttaaaaaaaaatttgctgatacttcactcatgcagggatggagaccggatcgtcgtcctcacacaatacttcatcaccttgcagcagcagcagcagctcaacatcgtcgtcactcccggcggcgccacagcagctgagtcgtagtcgccggaggcggggatgaggtgtgtatgcgtgcgtgctagagtagtgttgctactactactgctccgtttcagattagaagactttctagcattaccaacattgatataaatgttaataaatatagacacgcatatatgtctagattcattaacatatatatatatatatatatatatatatatatatgacactcatatggggcaccatggtgcccgggcaccatggtttcaaatgcacaaaattactcaaatttttcaaaatttttaaattgtgagtatatacctagttataagaattcgattcatacatatatctatcaacaaaacaactcaaatttaactttatttcacaattcatgtttacatacctaactaattatatgtatggatgctatatacctagaatcaaaatctaacaaaaacaagttcaaattcagttcaaacttgctttgaactagttagtaaagtagttaatgttaatacctaaataattgaaaaagtttcatactcatttgaattggttatatactcaatttcaacaatggtgcccgggcaccatggagcaccaaacaaatttactatatatatatatatatgaacatggacaacgctagaaagttttataatatgaaacggtggaagtagtatatactgtatgctatactgtacaacgtacgtctatatatacgtgcgcgtgtgcgccgtatacgtatgcatacatgactttcatttgtactgtatttgtttgccaactatatatatatatatatatatatatatatatatatatatatatatatatatatatgtatgtgtgtgtgtgtgtgcatgcaatgcaggtcacaacattggttcaattattggatctcggacccgacttcacaggtaagcggtacaactcaagctactactcccttcgttttacaacgtaaattattctagcattttccacattcatattcatattaatgaatctagacatatatatctatttagattcattaatatcaatatgaatataaaaaatactaaaatgacttgcgcggtgaaacggaggtagtatatatatacttgaatggtgatgatgtgttattgtagctagttaatatgtactcctaaaatattgtacatacgtaattactccctccgtcttaaaatataataacttctccaccaatattctcttttcaaccaataacaacccaccacaatttattttattttcccacctacctccactactaatcgaaccacaaccctccactattcacttctacctattttgctaataaccgtgtccaaactctaaaacttcttatattctgggatgaagctagcgagtagtatgtatgtagctcaattattctcttttatttaacttatataattaaatattaattttttggactgtaactaatacgttcttgcatgcatgcatatgtactagtcctccctgattccatgagatccatgttacatgcgatagaggacgacgaagacgacgacgttacgagtggcggtaacaataacccaatttacaatgaagcatcagtcacggccgtacgtcggccgtcaaggagatggtcagccgtatgggcccacactgaatttgtagatccttcggaaaattacgtcaagtgcagttactgcgccacgatactgacggctaattccaaagggggcacgagccacgtcaagtgccatgtcatcagatgcctgactagacttgggcgacataacgaatgtgaagaactcattgccaagaccaaaaaaagagcgagaaattaacgtaagtcctggtgattccaatctcgtgcgaacgaaacgcaagaatcttccacagcaataatacgtctgcaccgtcctcaattctagcaaagatcaagaaggaaggaagaacatgggtcaaagcagaggctgcaaccttacaggagtttggaattttgggagatatcgcctaattcctgattttttgcttttttttccttttacgggttattctattgttttcgtcgaaccttttatatttctcggtataattttttcttgctctattaatatacacaagataaagcttttgtctttccttaaaaaaaaagaaattcacgtacgtgcatcaatatttggcatggtcgtagtgcatgtactcttacagtatctgtccctccattacatgataaattaatctcgtataggatataacaaatattatactactacgaatttatctatgtgcgtagaactataatatatcacatgttatactggttaacttattttaggatagagagcaaatatttatttttgtccttgtgcgtacttgcttgtcatggatatgagcttatatatgaatgtatagtacgtgttcattggtggtgatcagatctacatcgatcgctattgtatatataatgtagctagtcatattatttcctcttgggttgtgcttttatatataattaacaaatatatatatatatatatatatatatatatatatatatatatatatatatatatatatatatatatatatatatatatatgtatgtatgtatatatatatatatatatatatatatatatatatatatatatatatatatatatatatatatatatatatatatatatatttgttaattatatataaaagcacaacccaagaggaaataatatgactagctacattatatatacaatagcgatcgatgtagatctgatcaccaccaatgaacacgtactatacattcatatataagctcatatccatgacaagcaagtacgcacaaggacaaaaataaatatttgctctctatcctaaaataagttaaccagtataacatgtgatatattatagttctacgcacatagataaattcgtagtagtataatatttgttatatcctatacgagattaatttatcatgtaatggagggacagatactgtaagagtacatgcactacgaccatgccaaatattgatgcacgtacgtgaatttctttttttttaaggaaagacaaaagctttatcttgtnnnnnnnnnnnnnnnnnnnnnnnnnnnnnnnnnnnnnnnnn

SEQ ID NO: 33846 - DNA, 5997 bp, Oryza sativa
  unsure (1)..(5997): unsure at all n locations
nnnnnnnnnnnnnnnnnnnnnnnnnnnnnnnnnnnnnntttttaagaataattcaaaacttggacacatgatctcatagttcatagcaaagccctcctaaccaactgaccctacaacactatgtgttttgagatcatatattggtttttttatctatatatttgatcaaattttgtgaacccaaacccgtatatgtactgtaggaatcatatcttgttactacaattcggtagtaacattatcgaacaagtgcagtaacacgacacgttactgcgaaatttacaggtcggtgctatgaaatttatcggtcgttactgtactttttgcagtaacatcatgatgaaactgtagtaacagagaacatatgttagtaacggtagtactatagtaccactgcttatgcattgctaaatttttaaatctcaatcttatgtaacatacaagttgttaatatctatatgaatgttggtaatgctagaaagtcttataacctgaaacggatgtagtaatttatagaaacacccagacatgtgtctattaacgtataaaatctatatgctttataggttgattacatgttttcttgtttccatcgtattatcgttatggatgctttgcttagattaattccctgcttttgatctatatgctatggagaaaaccgtgtgagagaaatcactaaaattgatgggaaatcctggattggagacatgcctaattcggttgagccgaatcggccgactcttccgcctccctcgcatctctctgtttctctctttctctaatgacgccacgccgggaacacggtgacatagtctcagactgtttggctggacttggagacatatcgatcgtcgttcgtcgtcgctgttgggtatgccgtcgaccttgtgtcgatgccatcgtgggaaaccaccgtctcggagaaagccctaaacccatgtcgccgttgctgctggagttaatgtcgaagcgaggtgccgccaccattgacctccgtggtgggaggatatgggtcatcggttgcctgctactagattaacctccgccgagacaatatggccggatgcaatttggttgttgtcgttgagttcgcctcgccgccgtcatgaggatgcgcgggttgacgcagagctccgtcgtatgccaccgagccaccgccgtcccaaattgccacacgggagtgatatcgtaacaatcatatcaaatactcccttagtaaaaaaagacgcaatcctaagtttgaacctggacacacatatatatacaggtttaaactcagtattggtttacatttttagggagggagtaccataccgtacataccatgccagtttaactcaaagcaaaccatgcatcttacgggatatgtgacccaaatattctactacggagtacactagaataccagaccacagcttcaaaattcgttgctactcgcaatctgccactttgagatgcttgtcaggaattaaacaccgggtgcagcatctgcgttgagacccgccggttgattagcagattccggttattacccaaatatattttatctgaaaaatcaaagatcgatatgattgaaataccgcgagcgataattagtaaaccaaaataatgcaacgtaactatatatatatcagtggtgtaactagaatttaaaataaatgtggtccatctatatataatagatcaattaaatgggtgatccactatataatttttattatattaactagcacatatactatagttttaacctcgattaaatttttaggtggtctatggaccacagtaccacctagttagttacaccactgatctatatttgtatctatactaatataaaaataaagagttacacccctccattcctactggccaaatcacccgcaccgcatctaagagcagggctaataagccggtgattagccggtggatctgacgtggaagggaaaaattcttctacaatcgcctgctcagctcaagcgcctaggcagactgacaacctaaacccacgttcagagaggggagtaattaagagtgcacaccaggttcacaacaaatataaaagatttatttattgatatgtatagcgcttaatccatcggcgattaatccatccatcgcctgcgcaatccccgccaccccatgccccggctcatgctccgccctatttaggcggctgtgttcttatcttcaagttcctaactcctctccctcattttatatgtacacgctttttaaacgactaaacgatgtgtttttttactaaaaaaattctatacgaaagttgctaaaaaaatcaaattaatctatttttttaaaaaaactaatacttaattaatcatgcaataatgcatgctccgttttgcgtgtcactaagctctatactccctccgtctcaaaaaaaaagacaaaccctaagtttctgtgtccaacgtttgaccgtccgtcttatttaaaaaaaattataaaaaaattaaacagaaaagtcacgtataaagtattactatcatattttatcatctaacaacaatgaaaatactaattataaaaaaaatttcatataagacggacagttaaacgttggactttttttgacagaggaagtatatcattattgctgtgcggcgcacgttacggcacgtacccatccccaccggcagagcgtgcagctcctggagtaccacgggatctcgcgtgagattcagatatatccggctcgagcaacagccaacagctaaccagccacgccaattaaagctgctgccattaacagtgtgaggttttcaagctgctagttgatgtagtatataccttttgaagagctaattaattccttgttaccggcagcattttgacagctcatcgagccagtaatctacattgattgttaatttgttccatgtagtaatgatttgaatgatggtcctgagtaatgtaaggttgtgctgtgtttaattcacattaaaattgcaagtttggtcgaaactgaaacgatatgtcggaaaagttgaaaatttgtgtgtgcagaaaagttttaatgtgataaaaaagttagaagtttaaaaaattattttggaagtaagcacggcgatagaatgagaacatacattacatatggcattcatttcatataataatgctactggatctcaaacttgtatatttctgatggtgtgtttctcattttactttttgcagctcaatatttttttctccatgcactcttattctcagattgtttgtcataaaattagtaaaacatcactcatcctgtccaaacatttggaaatgaagcgaacagatattaacggtagctgaggtatgtcgattactttcgctctgaattaacttgacagattctataaggaattataaatgcagctgttaatttgatttacctttgtacatgattcaagattcaagtgcaggagctggaaggtttttacccctgatcaagaagaatatgaaccttatggccagtgttcactgtggttttacatcatgattcacttgatttatgccaaagtgtaaatataagcccatcaaatgtgtcgtgtattttcctacgtcgctcactgggataggttctgaacttctgatcatgtctctttaactacaattatttttggcatttataatttttgatagccacactttaatcatgtagataacaaaatttcttggtgatattgctaatttcagttgaattaagtatagtaaagtatgctagagagaattatatctccctcactgctgacaaagggaagaattggttcaaaaagaacatgtagcagaagaaggaagcatatctagagcaataaatttgtctatctctacttctatttgaggtgagctgaaaacaatctataatcccatttgaatacaattagcatataaatacatgtcataaactcatagtgttgtggtataagcttttgtatttgaattcataatcaacaagatgatctgacatgcacatcctactacagggagcataggacaagcttgcaatgaacaagctttcgaagaaatgcgtccattcaataagatgatttttttttctctacagctaattcaggccgacaacaatgttgaaatgatttttgtaagcaggaaatcaatgtcagcaagctgaattgacagcccgctcctcccgtttacagaactcaccaacaagtaagagtattcataattctttcttctatgtttaaattggagtttcgctctctctcttatatatgtaacacatgaaaatttgaaactattcctatgctgaatgaaaaagatatcaatgttatacatgatgccattgtatccttatatttactttttctatgtgctcggaaaaatgatctgtcaattttatattgttgcgcattgttgaggcacgaagcctaaaacaattttaaagtcattgttgttggcaggcttgccaggtaaaaaagatagaaaccacacgtcatgacttcaatttagtttgtataggcagtaataagtcccataaaagacaatactaagaatttttttgggtaaaaatgcatgttttttccacataaagttccctgtaatagtaatatgatcgaatttgatatggattttcacttgcaacttttcttctttttgcagcaaacttatttgcaaagcactcaattcactactttgcaattgcttcacaagttaaattcgtgctttgaaatttatacaactcattcataaatagcccaccatccagctgcaatagtttcgatgttgaaatgcttcaatataacattggaacactggggaaactttgattggaggttggaaagtgtgaggaaaaaatttttatggcatcaacatttaatcctacatgtgctaatgacggattaattaggcttaaaaattcgtctcgcggtttccatgcaagctataaaattagttttttcattcatgtccgaaaacatcttccgacatccggtcaaatatccgatgtgacatccataaattttcttttcacgaactaaacatgcccctaatcaggaaaaggttagcgcaaaaggtatgcgtgttgtgaaacaaatatgtaggagataagtcacggacgaacgacatcacagatccgcatggtgacctcggcctgatgagacgatcgacgacgacttttgatgatggtggcgcaacaacggcgtgcgggcaccgggcagcggcgctccgactggcaatctcctctagcggcttgacgatgagcgtgataaaagtagcanagccgacaggggcgagcggtagggcgtcgccgacgagatgatctcccagttgatagtggcttctctccatcgggacggcgccatcttgcttcgtgttgagatatcgaccgacgcgggcgccgggcagaaaggggagaatatgcatggcaggcatcacggacggatggtctgcatacgcaggcgcgatcccaggccgtccggctcatatgcacgtacatctgttgatctcttgttaattggtttagcaccggtctacttctgctggtcttgctagctagtgaagcatgcatatatatatgcgtacgcatacatggccgaattcacatcacacatctaccctcccaaatgtcaggccacctctgtacgcacatgcatgcctgaatcatttaattagcttgctaattaacctgtttcctgctgcaatcaaccattaacacacaatatacaagtgattatattttataaatatgtacaaaataccatcaaacatatgcattgtgatattaaattgtagtgctgtannnnnnnnnnnnnnnnnnnnnnnnnnnnnnnnnnnnnnnnnnnnnnnnnnnnnnnnnnnnnnnnnnnnnnnnnngcgcttttggcgcttgataattaggagcactcacatcaattgcgtggtgcacaatgtgtgttccccgtccagacccgtcgttacaaagcaagaatggggggtnnnnnnnnnnnnnnnnnnnnnnnnnnnnnnnnnnnnnnnnnnnnnnnnnnnnnn

SEQ ID NO: 33847 - DNA, 758 bp, Oryza sativa
aaccctgcgaggcacgcaccgatcgatcactacaccttcactttctcttctcatcatctatatcacgatcgatcacaaagaggttaacagtaacacatggggttcggctcgagggagatggcctgcgcgctcgtggcgctggtgctcgggctctgctgcgtcggcggcgcacgggcgacggggaggatcgacgaggggctggaggtgatgtggggcgacggccgggggagcgtctcgccggacgggcaggtgatggcgctgtcgctcgaccacacctccggctccgggtggaggtccaagaacacgtacctgttcgcgcgcgtcgacctgcagatcaagctcgtcgccaacaactccgccggcacggtcaccacctgctacgtaagccagcactcgcactgacacattctttgtgtgatcggatcttttttttttcttggctcgtgttcgagctcacgtacggtggattccatgcagttcatgtcggaaggggagtgggatatccacgatgaggtggacctggagttcctcggcaacgtcaccgggcagccgtacacgctgcacaccaacgtcttcgccaatggcaccggcggcaaagagcagcagttccacctctggttcgaccccaccaccgacttccacacctactccatcgtctggacctcgcagcacatcctgtaagctcatgcaattcactcatcaaccaaatgcacattctcagtttataatcactcactcgctcgccgccatggatgccg

SEQ ID NO: 33848 - DNA, 1552 bp, Oryza sativa
tcgagctcggtacccgattagcggcaaacaacaacagatggatgcacatgtgaaaccctttctcctggagggaatagatagatcaaataatagaagcatcggtctaaccttgtacgcataacgaacataaaccaatggcctcatcgtttggcatattcatatgcttatcagccaaaatttaaattttcaacgttaaatttatagctgattttaggatttttttatcgaagattatttttcagcctttgcttttagatcgctaagaacatatatataaaagttttattcacaaattgattttcgtttgtaaatatgccatttggcatattcaaacgatgaggctgcaagtacggccaagtacgtcacgcatgcatatgcatgggttgggccaggaccaagcgctagcggcgccccacatgcatgcagcagtgatcgatcagcctcccaatatgcatttgcatgcgagggtttgatcgatattgcatgcatattggtacggcacccgagacatattggtacgccccatctttttcttcgcttttttctcccctccctctccagatcccgactccctcccgtttttttttctttttcttagctttttttctccccttcattctcgacgccctcctcgtgttttctttgctttttcttctcccgttccggtgcccccctatctatccgtctcttattttttttcccatggaataaaccttcattttttttctcatttttttaagaataattcaaaacttggacacatgatctcatagttcatagcaaagccctcctaaccaactcaccctacaacactatgtgttttgagatcatatattgttttttttatctatatatctgttcaaattttgtgaacccaaacccgttatgtactgtaggaatcatatcttgttactacaattcggtagtaacattatcgaacaagtgcagtaacacgacacgttactgcgaaatttacaggtcgttgctatgaaatttatcggtcgttactgtactttttgcagtaacatcatgatgaaactgtagtaacagagaacatatgttagtaacggtagtactatagtaccactgcttatgcattgctaaatttttaaatctcaatcttatgtaacatacaagttgttaatatctatatgaatgttggtaatgctagaaagtcttataacctgaaacggatgtagtaatttatagaaacacccagacatgtgttattaacgtataaaatctatatgctttataggtggattacatgtttgcttgtttccatcgtattatcgttatggatgctctgcttagattaattccctgcttttgatctatatgctatggagaaaaccgtgtgagagaaatcactaaaattgatgggaaatcctggattggagacatgcctaattcggttgagccgaatcggccgactcttccgcctccctcgcatctctctgtttctctctttctctaatgacgccacgccgggaacacggtgacatagtctcagactgtttggctggacttggagacatatcgatcgtcgttc

SEQ ID NO: 33849 - DNA, 750 bp, Oryza sativa
  unsure (1)..(750): unsure at all n locations
cttcaagtccattagtgttctgcttggcaactttagaaggatgagaatcattaaatactacctgttgtatacatgtggtgtaaacaagatatttatttattttcatcactactatagtgagccttgatatttagagtttagctatgtagaagctaccagtttagcatgtaacgcttgtaaataatggcaagaaaataacagttttatgtacaagatagcttgtccatcaccatccaacacaataacataactgctataaaataatattacccaagaagtgacacaagctttacagtggattccaaagtaaaaacacactcaaaggaatcatgacgttcattctcaagcacaagtcaccaccaacataacctactgagaaactttgcaattcacatgcttggacagaaatagaaaatatggacagtacttcaaaacagggaaagaaacttactgttgccttcagcctaaaagcaaatgaccttaaatcataatcattattcttcatgtcccagatgaattcatcaaaagagtctgggaccttcaaatcaacaggtacttcttcagaatttatttcgtcaagcatcctatacaaatccctcatgaccctctgcgcattagaatatagaaattaaataaggaactaagcaaatccacaaaattgaaaggagaagggtaatatcagaggagatgtgannnnnnnnnnnnnnnnnnnnnnnnnnnnnnnnnnnnnnnnnnnnnnnnnnnnnnnnn

SEQ ID NO: 33850 - DNA, 712 bp, Oryza sativa
atgatacttaaggacttatctttctctttgttgtgcggcttgatccatcataatttatacatgttcaaatttgttcatagttgaaatttgtgtggtcaatgacttgctactaattcatgagttgttactatcagattgtctaggcagacggttaggtccacggcttcttggtaggggcaacgatggctccatggtactcacatctcctctgatattacccttctcctttcaattttgtggatttgcttagttccttatttaatttctatattctaatgcgcagagggtcatgagggatttgtataggatgcttgacgaaataaattctgaagaagtacctgttgatttgaaggtcccagactcttttgatgaattcatctgggacatgaagaataatgattatgatttaaggtcatttgcttttaggctgaaggcaacagtaagtttctttccctgttttgaagtactgtccatattttctatttctgtccaagcatgtgaattgcaaagtttctcagtaggttatgttggtggtgacttgtgcttgagaatgaacgtcatgattcctttgagtgtgtttttactttggaatccactgtaaagcttgtgtcacttcttgggtaatattattttatagcagttatgttattgtgttggatggtgatggacaagctatcttgtacataaaactgttattttcttgccattattt

SEQ ID NO: 33851 - DNA, 769 bp, Oryza sativa
  unsure (1)..(769): unsure at all n locations
tttctcttcgtccatggaggaagctggccactgccaccggcggccgcaacgaggacccctcgtccccgtcgccgccattgccgaggatcatcatgtccccgacgcccctcctcctcctcctgctgctgcagcagctggtacgtatatatatcacacacatctatatatctccctctcttctgtataattttcttcttatgtttatgtgtatatatatatatatatatactgtatgtctgtatgcgtgcttgctctccttcttgctcatcgatcagaaattcggcaaaatgtggcgaaatttataattaaacgtccactgctggctgctggtatgtattcaagtgctaattttttcttcttcttcttcttcttcttcaccaatggagatcgatcacttctgtttctcacttgcactgaatttcaattaatttcatgcttcccctgcaccactaacctagctagctagtcccaagaatatgccgatctaatccgccaccatcctaatcactccggccaatttgcttcccaaaatgccgccgtcgatcattacattgggatgaacgacagagaaagagagaggagcagattaattagtgctactacaagacaccgcttcaacacaacccaacggctagtttcaggccactcacatggagtactcctacgcattagttggtgataaatttaatcagcgattttaagcatatatatatannnnnnnnnnnnnnnnnnnnnnnnnnnnnnnnnnnnnnnnnnnnnnnnnnnnnnn

SEQ ID NO: 33852 - DNA, 1408 bp, Oryza sativa
  unsure (1)..(1408): unsure at all n locations
tgggtttgaatgcgggagttctctaagcgggaaaaaaaagcttttgggaaaaggttacaaggaggggaacatggtctgaagttgtatgagttaggctttgaagtgctgagtttggtaggatagagttccatggagtgttgaagaagacgattgatcgatccgggttagggtagggtttaatgtataggctgtaaatcaggggaatttcgaaaatagctagcgagtgaagagtatcattgaatttgtttgcctatgagtgatcaaagggccggggttgtttttcttgaagtgatgttaatgaggtcgaagtccccaagtacattaaactatgtaactatgccgacataattgtttggtgaatggaatatggttcattttttttgttgtgtcgttgtttaacctctgtaactatgccaaattgtgtggtgattggaatataggtatatatttttctggtgtcaccgattaccctctgttactatgccaataattgtttcatgattggtgatgtgggatgcccaatgtgctgtcttttgacaatgtctttttatatcgtggttctaggatgcccagatacggctgatgggtgacgtatccgtatcggatacgccatcctgattactgtgattttaaagaaaagaaagtagttcggatacttctcatatacgtgcgtatcccgtcctgatacggccaaaccaacgcagcaatgctgctccgcatcacacggacggaagcgtcgacccaatccacccgcggcgccgggaatgcgctgcctcaccgcctgctatctcactcatccccgaagcagtccgaggcaggcgcagccgcgcagggcctccactagccggctgttgggttccgccgcgtctcgccatctgagctacaggatgtccaccggcatctaggcgtcgttgttgccgctccccggcggagggcctctgctggtcggcggtctctgcatcacaaccattgggcgaagcgtctccgccggcctccaagcccgtcaccaccgctaagtctcgatctgatttgagttttgttactgtatgtgttttcccttctcaatttcttagtgcaagactgcaagtgctatctcttttcttagatcccgtgaaatttggaattggaagctcaactacttctctcctacatacaacacattatccatgggatctacctgatgggcaagatttcctgtgatagcgctaaaagatttttggtgcattagacctgctagatgatatagcactgtcaatgatgctaacaccaattaaacttattcagccattgagtcgaatttgataccctgactagttcatgccatgtaatgctatatcttttttnnnnnnnnnnnnnnnnnnnnnnnnnnnnnnnnnnnnnnnnnnnnnnnnnnnnnnnnnnnnnnnnn

SEQ ID NO: 33853 - DNA, 492 bp, Oryza sativa
  unsure (1)..(492): unsure at all n locations
nnnnnnnnnnnnnnnnnnnnnnnnnnnnnnnnnnnnnnnnnnnnnnnnnnnnnnnacctacctaatttggcgcatttgatccttcctttgttaattgctataccatgtccccttgtaaccacccagttgcgcctcgatactcgcgcactctgtgcgagtatcgacggtcgccttcaaatttaaaatctgagtaacaacttgggtaaaactggagttttacaaaagacttggaaaaacccgacacctgggtcggggcttgcgaactaaatgaatttccaaaaccgcggaccggggaacgtaccgggtgtacggtttcccgctcttgcacctaaggaccgtttccttggaatttcatccgaacataagacaaggacgaccacacgggtggaatgggacacccctggctgagtaactagcttatcaggggagccttgatgccgagagacatgtggattcgccggggtggtgtcggggaggacccctgggcttcct

SEQ ID NO: 33854 - DNA, 510 bp, Oryza sativa
  unsure (1)..(510): unsure at all n locations
nnnnnnnnnnnnnnnnnnnnnnnnnnnnnnnnnnnnnnnnnnnnnnnnnnncaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatatatatatatata

SEQ ID NO: 33855 - DNA, 1186 bp, Oryza sativa
  unsure (1)..(1186): unsure at all n locations
tgtttttctcgtaagtgaaaaaagcaaaaaaaaaaacatggtaggagaaactgttttaaaaaaaaggcgcctcttcaaaaaatggtttgagaaaatcgcgcaaaaaaaaaaccattgtttataaaaaaacaagccgctcattaaaataaaaacattgtcattcacatgattatgcatgaaaaacgtatattattattagattttttttacccgttgcaacgcgcgggcatttttgctagtatatatatatatatatatatatatatatatatatatatatatatatatatatccttatatggtactagtattaatatatatacttatatggtactagtattaattaatttcttgcactgcaaacatgcatgtgcattcgatcatgcacgtgtacgtagaacaagcggactccacgatgtcggtgttagctgggttactagctcaagatcaggatggtgatgatcaagaggttactagtcatgcagcagctgcctccacgcagggggacgcgaacttcaccggcggcctcgacggcgtcgatgatgcagccagcctttgggtgcagccgaaggcgaagaaccctcttgttgatgaccccgacttgataaaataaaaaccccgggggccctttttttggncctgggaacgacccctccctcaaacttaaccggtacgtacagctacggatgtttctcctcaccgtcattggtgatccgcgcagacagcatcattatatttttttatataatagcatatatgttttcgtagtatattattaaaatatattaaaataataatttattttctcatataatataatgagactctcccgctggcctagtatggatttcaccggtgcgtacaaacgagcttgctacgtactctctccgtcccaaaaaaaagataaactttaggttttcgtgtccaatgtttgactgtccgtcttatatgaattttttgtataattaatattttcattgttgttggatgataaaacatgattaatactttatgcgtgacttatctttttaattttttcataattttttcaaataagacggacggtcaaacgttgtatacggaaacccagggtttgtcttttttttttgggacggagggagtnnnnnnnnnnnnnnnnnnnnnnnnnnnnnnnnnnnnnnnnnnnnnnnnnnnnnnnnnnnnnnnn

SEQ ID NO: 33856 - DNA, 296 bp, Oryza sativa
agaggcgagaaggggtagaccctagaaaaccatgacgaccagtggcgggaagctatccttgggaacacaatggatggtggacagaaccgtcgcttgcttaatgaacaatggaattaaaacttgaccagtttatgctaggtcttaggtttgtgaaatgatatttgaaaactcagctttacgcaaagtaaccataaccactccttgtattatcctgtacattactgcattttgagtggtggcttactgagtacttttacactcattagagctctatatatattttttagcagagtgtt

SEQ ID NO: 33857 - DNA, 921 bp, Oryza sativa
  unsure (1)..(921): unsure at all n locations
tgctagaaagtcttataatatgaaacggaggaagtagcgtaagaataaaaattagaaattatacaactctaaatttgtcatcatctcaaatacattactaacatacattatatttcaccttcaatatagcatcagcttaaaagcttaaaagcttttgaccttaggaacattctcgtcttttcaaagaatttctctctccaaccgagttgaaattgcccttcagcaaattaccagttttttatacatttttacgatgtctaccaacaaactacacaaattttgagtgttctgtagcaaattttgccaagtaagacatacggatgcatatataacagaagtttatttttcccctctatccagcttatatataaaaaaaacataaaaaaattaataatctaccactacatatttaaaagagtaaaatccatcaccggtccctaaacttataccgctgtgtcatcccggtccctaaacttgcagatcactcgtttaggtccttcaatttgttcagttgtatcaccctggtccctaaacaggacggtctaaaaactttatatcaaaaaataattcataattttttcatgtgaactctaatgaagacaaattttatatcaaaattgtagccctcgacgcgacctacaactttgtagttgaaaagtttttgaattaaaactgtttagggtcccataatattgttgcatgtttatagattttgaaattttaattttaaaattacattttgggacaaaaaatgacttaaaataaaaacaaattcaactacaaagttgtagatcgcgttgagggctacaagtttgatataaagtttgtcttcattagagaacacatgaaaaagttataaattatttnnnnnnnnnnnnnnnnnnnnnnnnnnnnnnnnnnnnnnnnnnnnnnnnnnnnnnn

SEQ ID NO: 33858 - DNA, 29669 bp, Oryza sativa
ctcccttcctttcctctcccattcgcctcctcaccgttgccgccgctcccgtgctctgcctcgcctccgccgtccatcgccaagcgccgggagagccggtgcgttcgtggacgcggaaggggactccgggcgcgccctcttcttcctcttcctcagcccgaggccggagagatcactcccgcgccgtcggcctctcgtcactgcgccccgtcccgcacggtagtgtctctctccgttcttcctcctcgctccatctcctccccctagctttcggtagtagcttgagtagactccccgtagttagccggcgccgccccgaccgttgccgtcgctcgccgtgtgctcgccgccgtcgccgcccgagctccgtagcacccgctcgtcgccggcctcgctcggcgtagttccacccaatccgacgctagcgtcgagttcccgaagccgcgtagatgctctcaccgccgggaatcgacctctcgtgacctcgtcgccgtttccctcttctcccgccgccggttgccgccgccgcaatccgccgccgtcgagcaacctccggcgaatccgagccgatggcttgccttcccttgtcacgtgcaaccgcccggtgtgctcgctgttgcccgtatcgccgtggttcgctccgccgctcgccgccaccgcccgccgtccattcgaggccgggtcgtcgtctacctcccgccggcccgcgtggcagccacgtaggcgccacgtcggcgccagctcagccagaccgggtcgggccgaccccggtcggtccctccgcgtgcgcgcgatccaccgcgagccgtgaggctgcgcgtgggcccgccgcacctgcgtccaccgcggaccgcgcgcatgcaccgcgtcccgtccccgcccacgcgcgtgcgtcgcatgctccctccgcacggtgagccgagccgctgacaagcgggtcccacccgggaccgcgcgtggtgagcccggtccaccggctctctctctcctccctcccgcgcgcgcgcgagtttgggccgccttgggccggccggcccatttagctcggccggaccgctccatttctcttgggccgcgccctagctgtccaagaaaagtctatatttcctccctcccttcttttctttttcttttccaaaaaggatttaattaaatcctttacctttagatcaaaaattcaataatcttagaaattcaatatcttcccaaccgtaaatccgtttgactccgttcaacttctaaaattccccaaatctcgagatctatcttatggcacgcatagaggtcgttaatagggctttattttcgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgcaaaatattatgcattggtaggatcgcacttaatctgtttgtcccgtctgcaaggcagattggcggacctacctaatttgtcgcatttgatccttcctttgttaattgctataccatgtccccttgtaaccacccagttgcgcctcgatactcgcgcactctgtgcgagtatcgacggtcgccttcaaatttaaaatctgagtaacaacttgggtaaaactggagttttacaaaagacttggaaaaacccgacacctgggtcggtgcttgcgaactaaatgaatttccaaaaccgcggaccggggaacgtaccgggtgtacggtttcccgctcttgcacctaaggaccgtttccttggaatttcatccgaacataagacaaggacgaccacacgggtggaatgggacacccctggctgagtaactagcttatcaggggagccttgatgccgagagacatgtggattcgccggggtggtgtcggggaggacccctgggcttcctggcacagtatggtctgggacctaatctgttgttggtctgggacccctctcgtcggcatatggtaaacctgtgtcggctttcgaaatgccttgtcatgaaagcttggaggtctcctgacgtggctgatccccacgggctgggtgacccgggttagtaatgtcgtgtgggtaaagtgtacccccccctctgcagaggtcattgaactgttcgaacagccgtgcccacggtcaagggcggatgtgaggtgattcctagcgtagttttgtttgactactgcttgtgaaattgctgttgtgaaaaggggttcgatgtttgaaaaatctgtagctgatgggatcagctaggcccgggtggccgtttgaaaagttgttggcccgggtggccgtttgaaaagttgttggcccgggtggccgtttgaaaagctgttggccgggtgccaaccttgttgcaatcctaaagactgatacattgcacatactccgaccggacgagacgcactgtcccatccgtgttgtttgagaagcactcacctagtcgttttagaaaaagagttcaaataaaaccaattgcaaaaacaacagccttcccttgaagcctgcattaaacacttatttcccctggcttgctgagtactcccgtactcacccttgctctatataaatatcccccccagttgctgaagaagatgaagcggatcctgctgatgaggagttcttccaggagcaagccggctacgatgagttttagggtttcggcctagttcccaagtcgcgcctgtgatgaatggtccaagtcctggcttccgttttccttttgtaatgcagttgtgagctcgggatctgtccgcagcccaacatgactgtactcctactctataataaagagacctctgttgctgtgatattctgtctccctgtgataccagcactgtttcctgggactggtatcgattaacaggttaaattggagcgtcacgggctagtcccggtcgggactagttcggggcgtgacaaagtttgaggacctgaacggtcgatttgcgagtttagagaccgggatgacacaacggtacaagtttagggaccggtgatggactttactctatttaaaacataaatgcgcgcgtttatagaatctgcggagggactgcacgcaacatacacagtgtgtgatttgtatgtagccatgtacctagctagcaacattttgaaacggagaaagtagtagaagcttgtttatattaattaacttaattaattaataattaaggcccgcttccactatgatcatgaactagctgagcagtggatcgacgacgcaaacgcatcaatttaaaggagtatatagtctgggggtgcccaggcccgtcgtccaactaactgagatgtgatgtgaattactgtactaacactggtgttaatttgtcagtttatcgatcgattgatcgatcgggccgggccacccgatcgatagatcctataatatttagctattgcatgcaacaagtcatcgatatatgaaacaaattataaatgtccgatatttgttcataaattaagtgccactgccatgccaacacactaacatatatagctagatctatcgaggtagctagagaagctgatcgtgatatcgagagctaattaagctagctgaaccaatcaatggaaggcctcgccggccatggcgacctcccgacagccgccgccggcggcggcatgctggcagttgatctccttggcccagctgcaggtattgtatacactctagctagctataacatgtctgttggtgtcatagtatactaattatatttagatcatggtgttataatatatgaataagtagtttcgctataaattttatcaaaagtcgtcggtacggtgtcgacaccggtcattacactgtagatccgtcttgggcatgactacgtaatactctctccacctaaaaaaaagaaaatcaactttctgagaatgaatttggatagacgacaataatttatccatattcatttttaacagttgatttttttttggagaaagtaaaatcgttcattttagaacggaaggactacgttacttaatgtgtgatctatatatcgcatgcacgcagatgcaggaacagtaacagaggagggctacttcgtcttcgtgcagcagctggtagtgcgcatcaccggcggcggcgccgccgccgccgccggcatttcgttgccaacgtcgtcgtcaatgcaggaagaagcatctgcagtagtagacgttacaattgatggattagcatcagctactacccacggcaatgccattgttgccgacgacgacgcgggcgatgacgggaatgtgcgtcgtccgccatcgtcgtcgtcgagaggaggaggaggaggaggaggaggaacaataaggacatcaagatcaagaagaagaagaaggagatcggtggtatgggagcacatggaggtggatccgtcggggaacgaggcgtcatgcaggtactgcaccaagacgctgtcggctaattccagaggcggcacgtctcatctcaggaggcacgtcaaccgatgtgccctgcgacaattggcacgtgcgttggacatatgatgaagaagaagaacataggtgcatcagtgcatgatgatcgatcgtgttccctttcaatgctgtctatatataattccacccattcacaaattaaacacacagaagtttaaggttaatgtgaagttattactttgatgctatttgtagagtttaaggaattaaagatcacgtctagtgatataactgctattagctagtattaagaacagttagcagactataaaccaattataaccaaatattgaggagataaataaaaagagataagagcagcgagctacagatttgtaaccagctacagcacatactacaagaagcaatgtgtgtatgacagtcaggggcgaaggcaagcctagggcaactagggcttgatccctaggcttgcctccaaaatcatgtataaattatgttaaatcaccaagtaattttagagaaaaatcaacaacttattagttgagcccaaggttagccctactattcagtaatttctagctccgccactgatgacaggtgagaccaagtattacttgtgtattatatatgtttataggtaactattgtataaattagctactaaattaacgatttggagctaatggttcactatactattaaactttctctaataagtaataaatatatatagtgatgatcagctagatagactaaaagtactctaaaaccgattatacttatatataaatttgaagttaaaattgttcgtttatatttacggaccgagagagtagcgataagagtactgcataatttgaaagtgatcgatcgaacaagcgatatatagcatacgtacggagcacgtacgtaatgcatgcttcagttcttttttcatgcacatatatataggttactactaattaattaggtgctcctatatgttggggttttgttcattattgtatgtgtgctagcttgcgtgtttgtgatgcatggtgacgatatatattaattgctgcggatatattgtactccagtactcatgctatatatatattcgatcaaatgaaacaaaagtcagctaaaatttctgttgatgttgaagtcgatacgatgggtcgaattcgatccaagatgagctttttgggtgccgatcgatggtgcaggtcaccagcatatatgtcgtcctgaacctcacgtggcggcgaaactgcaccatccgctgcctttttttttttttccggtgccaaaggcgcagaagtactacttatatagtgtgtgtgtgagatatataggagaaatatatagccctcaacgattccaaaccgtataaaaaaagaccccaaggcattatggacaaatttaaccctggtttcattgacatgcactactggagaagtgatctttgatgggtgatgtaaaaaccacattagtcccggtttggatagggaccgggactaaaaagacacgacgtatttaatgcctcgcacttatcctctagcaaactcctccttagcacaaactcctcatcccttatcctccttgtcattttaacttcttcctcccttttcttatcctgtctctcttatcttctccttttgttgcagcgagcaagccggccgagggctgtgcggcggcctatgccgcggcgggcagcgcggatgtctgtggatttgttgacttatacatgatgtatgtggatctgtaaatttgtgatgtaaatctgtgaatttgtggatgattttctaatgtttttgttaatgtggatgattttgtttttgagtacgttcaatttgaaatcaatatgcaaacagtaaaaaaaacaatgataaaaaaaaacctctaataccggttggtatccttagtcccgattattttacccagaactaaatatacccatcttcaaccctggatttggggttccggtttgaaactcgggactaaaggggttgtaaaccggggctacaaagggtttccccagtagtgatggcatacaacgggccccacatgtcagtgtgccgttgaggcgttattacatggagtcatcatcatctctctcgctgggctggcgacgccgcggcggaggtggattcgccgctgctgttcctcaacggcgcacaacatcatgacaccgtggttcccgttcaagcagtccagcatcaggcccgccttcgacgtggccaccggcgagcacaaggtcgatcgtcaggcccttcaagaaaccgagcggcgaggcgagctacgagctgaggtgtacatgcgaggggggagcagatggttggcacgcgccggccaagtgatgctgcgcgtcgccagcttcctcgtcggcttgccggctagcttgccgccggtgtcccggcctcgacagatttctttaggtcttgttcggttacacccgaatgcaatccggactgggaatgacaaatatagtaagaaacttatgataatacaatgagaggccgggatttattcagggctggtaaccaatttacttatgatagggacaataagagaccggaatcgatccatgtaacatcctgaaaattcctgacaataaaaattgctaaaattttgaactttttaaaacttttgcatcatgctggatgttatggttgttattacttgccaaactgtaaatcgtctcaatagaaaaatcaaattaaaagatgcacatctaagtaataactaaagtttacgacaatatattgttaaccctataagtatttatgcacaagaacacaagccaaataaaacacaagtcaattattaatttctataatgtaaattacaaattgtatgttaaatacttgaaccatgtcgacaagtgtcatgacatctaagtaaccacgaaatagtcgccactacaatgattctatatatataggagtgttgcactggaataactagattaatatttataatgttcatcaagtctctcaggggataaattcactcatgtaaaataatttgtcatgtaaataaattgagttctatgtataaaaagagcttatgggagtattcgattcaatgtttaagaccaatattgcaccaaatctcataatacctttatagaataaaacttaaataaattaaacatatgtatgtaaaatatattgctatacaaataaattcgaccaatatgccattgtattagtagggacaagttggaatatttaattcaatcatattctataagtctccaaaatatataagttcaccttgagtcaaaatccaagttaatcaaaacaattcaattgtgagaaatacataaatattcaaatcaaacatttgaattctcaaagcccaaaatgtatagattatatttcaattcaattccaatcccattcacttttgcagtttagcccctccctcttcctctttttccttttcttccttctctctctttttctgtctgtcactgttcatgggccatcatctattcgatccggtcccatgaccgcgcccgcgtcctacccgcatgccgcacgccgcgcctcccttccctcacgtcgcatccatccgcttccaggccgtgcgccgcttgtgggccatgcgccgcatccctccgcatccgcgctcgcgcccggacgccgcgcacgcgatcgaccgcgccacctccgcatctcgcgtcgcccccgtgcaccgcatcgtgccgcgccctaactccgtgtcgcgccaagtccgtccttccgccgcgaatcccggcatccgtcagcgccacgctaggtgggcccgcgactcgaccccggtcaagccgccatctccttcagccgtcactccaagagatgaggaacgaagccgattggataagcgcgtcgccattgccacgtccgccaaattatccagacgcatgacgtcccgtcgcccctccatgcacccgctggacaaaacgatgcgcaccctctcaagctagcgccgaggttcacaggctaggagctgtagggtgatgattaagccacagagacttaatggagaagaggatggaaaccttagggcacccacaatggttatctataggctctctacaagagatccatgtcagcatattttcctacttggaagagattaaatgaagagagagagtaaagctatctactaacctggagatagtctatagagaaaaacgaggcaatgcattagagagctatagatacccatgtagacataccattaaagtggtttactattaatctagtctattgctgagatgtacatgttttatagatagcaccttactttaccattgcgggtgctcttagccgcgtcaacctccctaacctaggccgtagacagccatcgagtgcgcctgtcatcgacctcatcctccacgccatcctggcttatccccaagccaagcccccataaaaaccccaatcccctctgcctctccctcggatacacatttcgtcgaacacctagcatgcgtgccggcatcgtcttctctactccaccaccgtgatatcaagcatcgccattctgcattctcttggtaattcctcgctcctgagctcctattaatcccctaggaactaacttccccatcaatgtcgccgatcatggccataaccatgccgagtccgagctccaaagctccacccatggaggtcaccgtggacatgctatcccgggggatctcccttctattttactggaaaaacggaaccctcatgcgccatagatgctcacgccctcaccaatatggtcgcaaaccatcccgttcgccgtagctgcttgcagccgagctcggccatggcgttgccgtgccgcaacgctcgcccctgctccgccatgcaccgccgccgccggtggagggctgctagagctcctccgcaaacccccctgtccgccgccgtgccgccccggccccgtgcccgtcgcgcccagccgtgtcctggtgctgcctcccaatggctggaggtagaagacgacgggaggaagaaagaacgacagaagagagagagaaaccgtgtgggacccacatgtgattagcgcacagtaatcctatccctaacggtgattagcccactcaatggcaggtggggtccctatagttaaaatataagaaaacacaattatatattttgttcctatgacaggcgggacccactggtaattaaacaagcaggtttgaccctaagtcaaccagggccggtcccacatgtcaaccacagtgggttttggataatgtttccgattaaagataaatcatttatgaacagtacatttttacaatttctcggattaactcaaatttgaatctttaaactagcataacttattcattttagctccgatttgagtgaaacttgaacctaaattcgtctaaattcataatcttcccaatggtatataactcactatttaataaaatatatttataattattaaataataaatatcaaatgattagataatgattaaactaaaaatgtgctagcaaataaaaattatcattgtacagtgaactaggtagaggaatatttgttgttaacatgttctgtcactatgggaaccatgtgtagctatatgtattagttcagtttaaagcaaagataggagatattagtatcatttactattccatgattatatatagtcaagttcatgattcagtcattgtctaaatagaggattaacttaatgagtttataactgaaaatctaagtacacacataacagtccttagtttgtctatgaggtataatgacagagctgggtgtgatggaatcaatcgaatgatagatttaaccggtgcaatatcctatatatatatatatatatatatatatatatatatatataatttggttgacacctattatttaacagaacaacaaataactcatgttcggtaaataatccaattaacatattattgaacttgcatgtacagtacatccatttaacacatacacagtaagtcaatcacctactgttgcacctattaaactatgaattgtttgataaacatcaaagttagataaaacactaattataaatcttgacctcgttacgagaccacacagacaaataatctgtacctatgacctcaccgatctaacatatagagcgtgtatgattattaacccttttataatttataatgacaagtaaaatatgatcgtaattaaaataatgccccattggtaaaataataatataaatgattccctgtgattgcttgttgatcctaattaaattaatccatccaacaacagaacctttagtataagaccatttatctgaatagatgcatgcgtagtcatataaccctcccataaccctgtaggtagactaaaccacatattagcaaaatgtgtatatcatatattgtgctagttagtaccagtagagccataatgattatataaaatactaagaaaccttagcccataagctttcttgtctcatcagcttcttatctcatcagctacttgcatgctatgtaatttagagcctaagctacctccattttccttacctatataaacagtgcagccatagtagagacttcgtagcaccttacaatccattagcaaacacagtaatgtgagcagccgtaggttcaaccccaacatttatattttgtttgtgcatatgtgactgttgtttgaacattgatttttctcgcgtattatagtattggtgtatcgattagtcgtgaggcaacgtatgcagcttccaggaggtgaaggttgatcaagattatatcaagaataagaactatcctgagcaggcaagtcatcaccccattccttgagcatgttgatcccaattatgaaattgttttgtttataaataaaattgcatgtagtgataaatgtcctacttgttattatgccatgcctttgattattggttatctaattattcccttgtacccataattacgtatgagtccctagtcacttatgacaaatgcttagtactgctaatttagatctatgcattctcatatttatcaaatgctttatgtttgggtaactaccttggggaaggtagttgagatacggcatgtggagatatgagcgccacattgccatgacattgatgagatgatttgtgaaagaaagttaaaactaaagaaatgttttcgactggggcggctggaggacttgggtggtgtccggtaaaggctagtgccgtccctggtcaattaaggaccgagccatgaagctaagcatgaaacgactccagtacaaccgtacttctcgtatgggtatagacctagcggagtaaatagccgagcggaggcagtatctctgcatagtggttttcttgatgtgtgtgaggcagggcctacggtggggcagccattggtaggaccgcgaggggcgggtgcctacagtggtgtcgccatcggtaggactgccatgtgtaaacctaaacttaactataacttaatgcatgtgtgagtcttcccttcccgggagcgccagaactcctctcactgctagaaaccgtgtacgcctagagtgcatgaggactcaagttcatggagcgggtactgccaaagtgaggttattgaaaggctttgccatggcaagtctcatccgttgggacgtaggctcatgtgttgggcaagtcgcggagtaagggtaaagtgtacatccactgcagtgtgagtaaaccaaatctattcgaatagccgtgctcgcggttattgagcaccgggacatgtattacacttggctagactctaaattcttaaaatgatgggtgggatgttgcatgatgattttgtactggtggatcaacttctcgagaggcgagaaggggtagaccctagaaaaccatgacgaccagtggcgggaagctatccttgggaacacaatggatggtggacagaaccgtcgctgtttaatgaacaatggaattaaaacttgaccagtttatgctaggtcttaggtttgtgaaatgatatttgaaaactcagctttacgcaaagtaaccatagccactccttgtattatcctgtacattactgcattttgtgtggtggcttgctgagtacttttgtactcattgttgctctatatatattttttagcagagtgttgaagagaagccattgttagtacgcttgcgtacttaacaagatgatcggagtgcgattccattctagatctcgttccccagtcgactgcttgtggcatgtcaaccgggcccttgtattattttgtcttccgctgttgttctctgatagttgttggcctgcctggccctaatgtaagcatttaactctcttagcctgaattcattcgtgatatgttgtgattcggctatgtatgtgtgtaccaactactgatccagggattggtactgataaacacagaagatttccgatttccaaaatcgggggtcgacaatccactagtcaagaggtgtggaaccaatccgaatgttttgttgtccttatcatgagtaaattggtttccggtctggaataaatcctggtctcttattatatatattataaatttcttactgtgcttgtcattctcggtccggattaaatccggacgtaaccgaacaaggccttactggttgcgcagctcgctcagctacacggaggtggtggggagcccatcctgtcgttcaacgtcatgccagcacaagtgttacaaataatcttgtgtcgatctgctttgtgtttcgtttttctggtagtttttgaccagctacgcatctggctttgctcaaaattaattatgtctttccatcatatggttcaccggttgtatatcgatctccatattgcagtccactacaatacaatacatggaaggaaacgaatacaaattaatatgattgatgaaatgatatataatactgtgtaatggagtaatagtactgatacataatgtaactcagtaacttctacatatttacatatattaatatagcgcagtgggagcctctcctgctctttaaatatcaaaaaaaattagagtaatactgaatttctttttattaggtacctagagacagtgaggacgacgtacgattatcgagctgattatgatggggatggaccaagtgtaaaccaatcggtgactaggagtagcccacggtgtgtttgcgaggacatggacacatgaatactacatgctgtatgcatgcgggggtgaccgttgacccagagtttttatttctctctttttttttagaacgaccggacattgtcaatgttgggccgccggcagcctcagccggttgatcaaatttagcccagcccatctaacaaaaatggcccgaagccatatctataattactacttactactctatccatctttaaaaatatagtagcacttataaatttaatagttcggccccttctcgctgcttggagtttgtgtttagctgtcgtagttttttaagcttcagcttcttagtttgctttttctcccttctcctggcataaaccggtctgtctgatcgcgttgcgtaactataactcttttcttctaatatattgacgtgcaatccttttgcacattcgcggaaaaaaaacttataaatttaatagtagaaaacaatttctcaaccagtggtgacgtgacaagaggcagctatggcaggacagcactatcatgctagctacacgtgacgtgatagagttatttggccacgccaggcgaactggtgtggccaaaaggtttagatttgaaagtacttttgaaaatggtctattaataaaattaaaacataaaaaagtcaaaaaaaaatctttcatctcttatccctagctcggctcttttagaaccaattccatctttctactgacagctgtgaagtccaaagtagtacatgttgtaaaaccaacgtaagtccaaaggaatttaatttcctttttcgctccaatgggaaatgtttggtctacgaattatactagctgccctgctttcgctactctttgggctaaagagtccgaaggtggataaaatttcttagtttcaacaagtaaaattggaataattaagttgcttttctttcattaaaaaaaactgttcaaaaacatccccttttaccatatggatgaccaataacaaatccacctgtatggtatgcctgggctcatggtcatgaaccgtgtaaagccccaggtccaaaatggttataggtcaactcaatttgcagagaaaatcctttctataccaatgaaattatagctaattctttttatgtttatgaattttgcttactttcttgtatatctaaaaatgattttgatcccttccatgcttctccgttgaccattagtatcagtggttctccccggcgtcgatcgggaatgaagacgtcgatgtaaaattagggtgcgcacggcgtgcagcacaaacagtagggtgggtgtaattttcgtcggattgatatgggaaaaatctaatccatatatatagcaaactagcaacgtctaaaaaaaatcgcatgttttagaggataaaacattcaaatgatgtttggacagtaaaaagagaagaataagactaatataacaacaactgagaagaaaataaaatcagccaaaaaaaatcaaatcatctcgtaaaataaaataaaagaaaagaaaagaaagagagcaaatgatccattaaacaacgacgcaccgtggagtgatgtccaagaggtaatagcctctcctgcgtcgtcgacctccagacggctagctcctccccggccgccgttgagcttggaggtaccgcatgcagctagctttcctgacggccggcgccgctggtcaccggcgcacggcagctgcatgcgcctgcgacaaaggccaacagatatctctcagttcaccacccgctggacgtaattaagggaggcatctctcagtagggcgaggatcagatctctcagtgcattatcgccattagcagtagagaaattaaggggggaagagataccttaacgacgaaggaagaattagctagctgcttcttatatatctccgctggtggagactcaatccacacacggctcccgtgtagttctcacttacaaagcaatcatattaattaagcgagagagagggtttgtacgtaactatccataaggtgtagattggtttaaccaaactactccatggttaaacccgactagctctttgcgtcatttaaatgtgacgtcatgtctgaatttaaaatctctccggtcctctcacttttatcgtagttttatttatacctttcgcgcttgtctagctagatatgattttgtctgccttttcccatagcaacgcactggcactttgctagttagggggtgttctagatcccacccccaaaattttgcacccttttagatcgaacgtttaaacacctacataaagtattaaatataggctaaaaaaataactaattacacaaattacgactaatttgcgagatggatattttaagcctaattgctccatgatttgacaatgctgtgctacagtaaatatttgttaatgacggattaattaggcttaataaattcatatcgcaatttacaggtggattttataatttgttttgttattaggctacgttaaatacttcaaacgtatatccgatgtgacacggcaaaaatttttaccgctagctagctggatctaaacacagcgttaaccatataaaattccacaaaactcctaccccccccccccccccccgcgttctactaatcgcagtcgcatccaaaggtttgaaacccctcgcgccaaatgcgaaaaaggcaccccgcatatccccacgtgcgctttctcctcctctccgcttgagccctagctcctccctgagctccctcccccgcgcgaattgaaaaccctagctccgatctctctcatccacttcgacgcggaggccaacgatcgtaagcagcttggtgagcaggggctagctagctacgacgagcagcctctggatgtacgagagcgcgcgcgtggtctcagatcgtcgactgagggcctcgatcgtgatggctagggcgccgcgcggtagcgaaggcgagggcggcggcgaactgggagcgcctggtgcgtgcggtgctgcggggagagcggttggcaggaggcgcgccgccgggaatgcgccgccgtctctcaacagcaacgtccacatcgacgaggcgcttcccgccgccgacgagaaccagctggacgaggaccctaccgtcgccaggattcgtaagtttcgtcaccatttttcgctccgttaggctattgacctgctgtatggccgggtcgccgcggctcaggattgccctacccatgaagttattagtggtgtttttcctagtattttatgcagttagtatcggctacacgaattgactatgctagttcattaggagtacttttgcttttttttttcttacagccttctgtactactaaatttagtcaacagttacatgatcaggctaataatatctttcgtaacacactcataaataatatttatgataatttatttttagatatgagataaaaataaaatttatttattacttattaaaaattatttatttaccatataaatagatttatcttaaaaatattatttttttgttatatctaaaaataaatttgtcatacataaaattttgttttgccttcgcgggggcggaaataaaatattatttttgttaaataatatatcacaaaataaactacatcagtatacttaataaatttatatttttcttgatatcaaaggacaaaatggattttacgataggaatttaacggtcatctaacgaaagaggtatagaagggatgcaaactgaaatttaggggtatgaaaaggaataaacaaatctcaggaatataaaaaggattgggtgaactttcaaggtacacatggaattttctcaataaaatttgattataccactcactaacaatctggaccactagttaatgaccaaattgccgactgggtggggcccatgaggtaaattaattatgttggggaaaaggggagaagagaggaggaagaaagttttggccttggtccatttttatttcttattctggcccggctaaatcctagtgggtggtatccaggcacataggccttctggcctgccggctacatgttccttttgtttattttcaaattcgtgtgtgtataatttttttttaaagtttacttatgcatccaaggtttatacaccaacagttatgtgtcttatttgtatttggatttgaatttcaaattattatacataatgttgttgctatattaaaagtttctatacaaattaagtgtttgtgtataaacttttatgtactattaatgtttgtttatattttttagtgaaagttttaaacagattttttaattgggctgaattggtgtatgcatgtaggctaaggacccgtgtacactggctgaaacttactagcttcaatagcttcaatcaacttttagctaatgttgatgcgcctgttttagacaagctagtggccataactcgagcttgaatcatccaatcagttatccattttaattacaagtgagtgtgcgtggatcttaatttaaccctaagtttactcccaggatccacctaagaaagagtcagtagctagaatttattattgtgccatggagttacaaaaactaatgtgtaactttaattagtgagtgagaagagaggaaagacgtgagccacatacaaagcgaacacaagtactgaccaaatccaagacggttagacagagcactcgtgaatatcgagtactaataaaccaacaaatagttaagcaaattaattaagtctcatcgccgatgacaaaagatcgtcgatcgatcgggtcgggtgccccgcccctgagcttagctagctagctcgattaattgaagcttgcactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttacaaaccgggactaaagatcatctttagtcccggttcgaatgctgtcggggcctgtcaggcccccccaggatctttagccccggttggtaactttagaaaagatacgagaggctgcgcgacgactaacaaatgcagtggaagcctcctctcagggcacgttccgaccagacagagatagggacgagctgacactcgccctgcagactccaaagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgaacccgtcaggaaaccgtagcagctgcgcctcaacggggcaggtaggatcccagagcatggacgccatgcaaacacaggacgaaatacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcaccgactcctcctcaggatcctgcaccgactcctcctcgggctcctacacctactcctccgcaagctcctcttccggcaccttcaaagtcaagggcccccccagctccatcgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaaatccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccattggtgaccggtaaagaaatgacgatagaataatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcatttaattaattaggtccttgtatataagtagactatagaaaataatatactcccttttatcgttgtagaatggagattcaaagggcccgacggcggagggttttcgatactggattcatcgaccctcggaaagtaaacgtcgcaatgctcgactaatatccacaagaaacagaggacaatctcgtccatctcctgaaggcgcagcattacaagacgttcatactgttgccgtacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtctatgactcaatggataaaaaagagtctacgtttgacaaggttttcgaacttatagacaggtaccgtcataagttcctttgttaattaagaaaatcttgttatgttaattgctactacgaatcatagctttagactccatgtagggcttggtatcggttccgtcatttggtccgcggcaaatggagagaaagacttaggcggaagttcaaatttcctgtgagtacacatgctctacatttatatttctccgattcaaatacacatacaagtgtatattaattagatctctcgttgtttgtcatttatttgtagtgcgcaaagcaaaagcagggaactaacttgtgcggctattacatgtgtgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatatacatatatatatgtatgcatatatatgtattgaaacatatatatgcatggtttatatatatatatatatatatatatatatatatatatatatatatatatatatatatatatctactacttaaaaaataagaggtgcttccatcgtccgtcaaaaaaaccgtgtaaaaaaaccgggcagaaaaaaccaggtttatccgataaaaaaaccggaacggaaaaagaagtccgatccagaaaaaaaaaagggggcgaaaaaaaccaaaaagcaaaacggacggagtccgatccaggaaaaaaaaaggcaaaaaaaaaccaaaaaaaaccggacagagtccgatccaaaaaaaagccgaaaaaaccgacaaaacaagggacggaaaaagccatgtttgtctgataaaaaaacaaaaaaaataagtctgactcctatatccttaacagtaaaaaaaaaaagttcgactcctatatcaaccaaaaaaaaatctgactcagattggtgaaataaattgatgtgccggattgaagatctgtttgcaaaaacggaatctacatgtcgagagcattccatttttatatgattttaatttttggatttgtaattttatatttgagtccctgtaatttttatatttgcatttgagtccctataattttgcaacaagctacttgaggttgtttttgttaaaaaaaataaaagagaaagagaacaaaggcagaaaggtgcataaaaagaaaaagaaaagccaaaaaaaagtctgactcagattggtgaaaaaaattgatgtgccggattgaagatcggtttgcaaaaacggaatctacatgtctgagagcatttcatttttatatgattttaatttttagatttgtacttttatatttgagtccctgtattttttatatttgtcgtatattctcctgtattagaaaaaaagcaaaaaagaaccttcgaaaaaaacaagcaaaaaaacgtgtgagaaaacaagaaaaaacacacgagaaaagaaaagcaaaaaaaggagaaaaatatggttttcttcgtaagtgaaaaaagcgaaaaaaaaaacatggtaggagaaaactgttagaaagaaatgcgccttttcaaaaaatggtttgagaaaatcgcgcaagaaaaaaaacattgtttataaaaaaacaagccgctcattaaaatagaaacattgtcattgacatgattatgcatgaaaaacgtatattattattagaatttttttacccgttgcaacgcacgggcatttttgctagtatatatatatatatatacttatatggtactagtattaatatatatacttatatggtactagtattaattaatttcttgcactgcaaacatgcatgtgcattcgatcatgcacgtgtacgtagaacaagcggactccacgatgtcggtgttagctgggttactagctcaagatcaggatggtgatgatcaagaggttactagtcatgcagcagctgcctccacgcagggggacgcgaacttcaccggcggcctcgacggcgtcgatgatgcagccagcctttgggtgcagccgaaggcgaagaaccctcttgttgatgaccccgacttgatacgctttgctgacgacctcctcaacttaaccggtacgtacagctacggatggttctcctcaccgtcattggtgatccgcgcagacagcatcattatatttttttatataatagcatatatgttttcgtagtatattattaaaatatattaaaataataatttattttctcatataatataatgagactctcccgctggcctagtatggatttcaccggtgcgtacaaacgagcttgctacgtactctctccgtcccaaaaaaaagataaactttaggttttcgtgtccaatgtttgactgtccgtcttatatgaattttttgtataattaatattttcattgttgttggatgataaaacatgattaatactttatgcgtgacttatctttttaattttttcataattttttcaaataagacggacggtcaaacgttgtatacggaaacccagggtttgtcttttttttttgggacggagggagtaatgaataagcatcatcattgtgaattgatgatgattatatatcacatgtgcgatgatgttgttactatacatgtgttaaaaaatatgatgtgcatcccctccatgcagcagctgccatcggcgccgccagtgtcgaatatgatgtgcatccaaacggaggccagggaagaagaaggtcaacaataagaagaagaagaagaagaagaagaagatcagtggtatggaaatacatgacattagatccgtcgggaaacgaggcatcgtgcacctactgcaccaagaagctgtcggctaattccaaaggcggcacaagtcatctcaggagacacgtcaacaaatgtgcgttgcgacgactgcaggcactcctcatggacatctgaacgcgtacgcaacgtctaccatggactgccgttgctgctaaattgatcgatcgatctcatgtttgttttcatgcatgcatgtatagctcagatcgatctgtagtactacttgtaattagcatatgcgtgctaaatttgtgttgtgtgtgcgtgtgctcgtttgtacgtgatacatcggtactgtactccttttttattcccctaattgattgtgctatgaaatactccctccatattttaatgtatggcgctgttgacttttcgaccaacgtttgaccatttattttattcaaaaattttatgcaaatatgaaaatatttatatcatacttaaagaacattggatgacgaatcaaatcacaataaaataaatgataattacatgaattttttgaataagacgaatggtcaaacgttggataaaaagttaacagcgtcatacattgaaatatggaggtagtaattatttattcacgcttgattaaataaagaaagaacatgtgtaatgtactccttttttattcccatattcgattgtgctatgaaataattatttattcatgtaatttccccctttttcttaaagcctgattgatcgagcatcatgttaagcgggatgaggcgtacgcgaaggttgctgatcgatgcaatatggctacacacacgcactttttttttttgactaaagggcttttagttgaaagccaaatggcaaggtccgctggggatcccagctacattgtcagcttacaaacaagcagcaggttaagcatgaaaaactttaaacatagaaagaggcagacacaaaagctaccagcaccaacatctaccacaaactgcccttagggcttgtttgggagagtttaatattctgagaagcagatagttggtagacagcttctgagaatctagaaaaaccgggtttctcagcttctggcttctagttcattttctggattttaaactacaacttcttagaacctagatcaaaagctggactgtttgggggagtttatgattctgggagaagctgtagcagttataacctcccccgaacaggcccttaacatcacagctaccaaaacacaggaaaacaacactatcaaagctagcccacgccagcccttggaggtgtcaaacttgtcaccagcatcctcaacttctctaccaacgcttccagcttgtgttcttcctcaggtcgaaacagtttcctccactgtaaaagattggaaatgatttgaaaaggaatagttagtggagaataaaccagattcgctctaagcaccatattattgtgagtgagccaaagattccaatagattgcagctaaaagactcaaagtgactctaaaagaagtatggtcagaaatccctttgcacaacaagaagaaatctttgaagtttccgggcaaggtaatccaattaagagcatcggcctacaaatacaccaaatcagcctcaccatgtcacaggtaaaaaggatatgattagttgattccagagctccacacagttgacagaattttgaaccctcccaaccttttttcttcagttgttcagcagcctgaaatcctatctctaaaagccaaccataaaaaatgtttaatattcatggacaaggacaagttcacaactcaatgttaacctccctaatccctctaaaggttaattaaggctctgtagagagatctagttgtatattttttgttaactgtcaaaccccataccaatttgtcactagagtccgagctctctatattctctatgacacgcacagattgggcggtcacggtcgcccgatgacagagtcaagttacagcccattgccacatcactgtatgatgcggcccagcccatcgatttcactggtatacgggccacactagccgataggctacgatatgagccttggcagccgagtacactctagagatgggattcttcgtgtgatgacgcataaagcgagtgtaactggattctcagccttcttcttcctcctctctccccatctcccctctcttcatctctctcctctctccaggcgccggggaggtgtcctgggcatgcggcggcggcggcggcgctgtctcggaaggggagcgcagatttggcgctgctgctactgcggtggtggcaggcgtcggctccggatccgcaagctccctgcctcgccggtgacctcctcctttggccacctccaccgccgctccgctcgcccctctgctttgccggcgacctgccgactccccgccccctccctccccaagcactcccgctgtcgctgccgtatcgccggccagacgacctccctagcccctggagagaggagaggggagagagaagtgaagagaggggtgaggggagatggggagaaaggaggaagaagaaggctgagagtgatatttttttaattaattcttttagtgcaactgacaagtggggtcactgtttttattaattttcaaatcaaattgccacgttagatgaaagccgggtcaatttagccacgtaggcgccacgtaagctaaaaccaccgtcttattcgccatggaacctatattgcaccggttttaacagttgagggacctgttgtatctggttgaaagacgaaaatcggattcgttgacaagataagggacctcagatgaacttgttcctagccatggctgcgaactggttgagaggccagtttacttgttagatcggtgggctgggccatatcatatggtggtgtggtgatgggcaatgaactaagagttttcgttttatgaaaactaaatcatttttttataaaagcaaaattattctggcaaagtcaaattaactaaattaagggacatgcacctcagcctaaggttttccgcaccaaacttaatttaccacacgtgtttgccatgcttctctattctgcttttttgatctatcgatcactcgacaaatatgttgtgtaggatcgaaacacaataactatttaagcctaccgcgggttgttcaatggtagaaacgcccagaaccaaaactttaagtggcactaaaagctaccctcaaaatccgatggagattggtctgatcgacctgattactccagcctgaccgcaccaatacctttggtctgaatagtgtagatgccctattccaactgcccttcactctactgtcgattgatgccattgctggtctaattggagtgaagccatcggtctgaccacgcagttgctgccggtctgagtactgctatctagttggtgtgaccaccaaacccaagcaaatacaaattgaagaattcttgaaagtagatcaaacttccttaccttaattcatgtttacaaaatgcaacaacaacacttttctctcaaaattcgactaaattcaaaaccctaacttttatctcaactcaactctcacaacccctcttgtatttatacctagaggtaagagcctaaagccacgaatccaacctatacaagtctatctaatccactaggaaaccttcatgtacaagtatccaacttatcttattataattcagactccaatcttcccaaatttggtctccttccaaattcgattttgccttttcatacgcacacactctccaatatcgtatgccgcatgaaatcttcaccaaccacgtaaattgttctttaggataagcatccctcatgtatcccgatcgtccagatgtcatcatatcccaagttgaccctcgattatcatcgacaacactctcccggggtatcaagacatacctacacatgaatcaaacaagaaaccatatccgagcacaagttttttcccaacttaactaaacattagaacacaaacaatatctcatagtatatatagaaatcatctagaagtcataatcacgagataatcacaagtatccaaataaacaacctgaaaccgacttcaatcaggaatcagtaggttagactgccaggctagtcggtctgatcgcatgctacacgttggtctgactgaccttctccacctggtctgaccggtcccacgtaatccacaccacttaactaattattcaccaaatatatatcaaaaccaattatctcatatgcctattgttcatcacaaaatatctatgttaatagaaaacactttgatttcacatatgctgctgaaaaaaattatagagtaaattccatattaggccaaatgtttaaaccaacatttcacgatagatttgggcttagctcaccttttcacttatataacaccatatgtctttgcatttgttagcgatttggactagggttgagtaaaaaaaaatggcatatgggccggagagaaaatatagttcaaatcacataaaacattttttaatctaataagaaaacggttcttttagcaaatcacaaaaattggagatgatgcgaaatatgttcatatgtaaaaagggcacaagtattgatccgcacaacaaagatgaaaattagcacaagaagggaaatagaaataaaagtagctggctagctagatacatttcacactgaaaaagaacaaagaaataatacacgatatcattttgcctttgtaaaatgcgtcgtggacttgcctttgccatgtgctttctggacaatcagatcgacggcacgtacgtcttggactcgatcacggtaataaagcacagtagcttcaacggctgaactgcatgcattcgagactggctcgggccatatggatcccgatgatctccgatcccccaatgcatcgatctctctgcagctagctggtgcttgcaacctaaatatatgccctggaccatcacctgcacaacggcacaaaatgattgagattgcatgaaaatgaattaatggaggaaataatgtagaaacttttacatttctgctaatatatatgtatatattactcctaccacatggtatatatatggtgatatatagttttccttgttagattttgattaatatttagtgtcgatcgttttctcttaagataaatacgtacctgtacgttctttatatacgtgaggcagtgaaaatgtgcccaaaatactactagtactactactccagctacctggcaaaccaacatcagttatacatgctccacgttaatccgtacgtttttatattgtagtggagtactatatatcataatcacatctaccaatacactgtcagttgttgtttaatttgctgcatctgacagtatgttttcaatcctttgccagctagtataagcttgtgtgtgtgtgtgtgtcccctttaatttggccacttaattcggctgagtaaacaagcatatatatagagaataatcgttacttgtttcttcttctgcgtccgatcccgtggcccgtgattgcttgcaacgaccagcagtactggagggaaagtattctaattcctcgagtggatgttttctcgtttgctcaaaaaccatttaaacggttatgaaaaattttggaaaaaaattgacaacattcatacaacacatatatacaactttacagaattttaagtctaaactcaactcacacgtcgagatataaaaaagacaaattcagcatatgaatagtagcatactgtttatatctaaa

SEQ ID NO: 33859 - DNA, 708 bp, Oryza sativa
  unsure (1)..(708): unsure at all n locations
aaatatattaaaataataatttattttctcatataatataatgagactctcccgctggcctagtatggatttcaccggtgcgtacaaacgagcttgctacgtactctctccgtcccaaaaaaaagataaactttaggttttcgtgtccaatgtttgactgtccgtcttatatgaattttttgtataattaatattttcattgttgttggatgataaaacatgattaatactttatgcgtgacttatctttttaattttttcataattttttcaaataagacggacggtcaaacgttgtatacggaaacccagggtttgtcttttttttttgggacggagggagtaatgaataagcatcatcattgtgaattgatgatgattatatatcacatgtgcgatgatgttgttactatacatgtgttaaaaaatatgatgtgcatcccctccatgcagcagctgccatcggcgccgccagtgtcgaatatgatgtgcatccaaacggaggccagggaagaagaaggtcaacaataagaagaagaagaagaagaagaagaagatcagtggtatggaaatacatgacattagatccgtcgggaaacgaggcatcgtgcacctactgcaccaagaagctgtcggctaattnnnnnnnnnnnnnnnnnnnnnnnnnnnnnnnnnnnnnnnnnnnnnnnnnnnnnnnnnnnnnnnnnn

SEQ ID NO: 33860 - DNA, 2406 bp, Oryza sativa
  unsure (1)..(2406): unsure at all n locations
gtctgtagtaatgttggatgcaagattactgaattaggatggggagaaaagaaggtaaaccttattgtcaatcatgacataaacagacagattatcatgtgaaatctgtagtaatgttgaatgtaaattaagcaaatctttgaacatggtgttgacaggggggcaaacaaaatgtagtacctttctgagaacggctttctttcttgctaacttctacttttctcacttttggtgaagctgacttcaggttttctccttaacgtcagcaacagcattttctgctccatacaccttcttgttgctcttcactagggaagcaggtttttctttcttgactgctctcatctttatgctcaaaagggacttggatgacaagtttatagaacgagacagtttcactggacttattttctcttcttccttcttttgccaaacacgagcattcttggcaacattcatcactgtcatctttctgtcagtttgtttctctgaattaactgatggagatggagcatcatttgcaaccaaggacttcagctttgattgcctagtaggtttggaagattgatccatcacagtagctggtgatgtaactttgatctccttcacttttggtacattcgatgcgacggtagatctgaattcttgtccctattgaacttggtggctctcactacctttgatccattggagctttcaattgttgtacctgaagctttccgatccaatgttcttacaattttctggcttgacgcattgcttcgcgttgcagtcgatgtctctttcaccttcggttttactgaaacattatacaaactcttcgatttagttccatgcccagatttttcacgcttctcggaggccatcacaatctgagtgctcttcttctctgaacctgcacactcatttcctgatccatcatcacacatgtcatccacaagtaactgttcaccagctttgtacacacattcaggaggcgaaatggcatctgcgatatgatcgtcagacgcgtcactgtcctggatggccaacggcatctccagctcaatgcttacagctccctctgatgattctccatccacaaaacatgcagcattgccatcagggatcaagaatttatcatcaccacatggcagatcagctccatcctcaacacgtttggattcttcagctgatgacaactgatcttgcacgcatggtgaggtttcagagttgtcagatgccatttcaataggcggcttcttcacctcgatgaattcaggcttgtcatgaacattaccatctttcacaagacaaatcttcagctccaggtccttgtttctggatctgcctttttgtgtctggatttcatcctggccttgctttccgcacccggcattggcacggtcctgatgtcgcctgcgacgaacaggccagtacttcttgggttcaggggaatgatgtgccccaaatttgcagctgtcatggcaagaaccagtggatgctctcaggtaatgtggcactgacttctccttcctcttcaggtcagatggcacactgctgacatccacattttcaagagaattcaccgggaaatcgccgcttgtcgatttagatgattcgggagttgagactatgataacctctttgaccacttcctctgtcatttaggagcacagatgctgcaatttttcacaatgcagacacacatgtgagcacatgaagaactagcatacttacatccgacacaagcacacaacaatgtaaaatgtggagatcgcagaacatacatagcatgataaatacagaactttaatcttctatttatattgtattgctgcatatgcaacactacagtaggtttgggttgcctacttgatgacaataggagccacataattcatcagcaggacatgcaagttaatcagataattaatgagtgaatggcatgataaatccagtcctcaaaacataataaatctcgctcagtaatcaataaaacgaagcgatccattccaagattccaggatacataaaacatagtgataactaataatcaattactaattgattcaatcaaatcgtgatcaaacagtgctatcatatcaacaccatctcatcagtaaaaagaaaaaaataacccccgaaactttgagtacttgatgaacacaagaacaacacacacacagcgggcaagaaacccaaagactcaccgccgccgcctccctagccgccgttctcgccggcaaaacgacggcggcgacagatcgcagggacagaaagcgagcgaatcaacgagcaacgagcagatataactgaacggaatgattgcgaggaaaatggagatggaaagcgagagagatttggagagaatggagaggtcgctnnnnnnnnnnnnnnnnnnnnnnnnnnnnnnnnnnnnnnnnn

SEQ ID NO: 33861 - DNA, 4981 bp, Oryza sativa
  unsure (1)..(4981): unsure at all n locations
caaaacataataaatctcgctcagtaatcaataaaacgaagcgatccattccaagattccaggatacataaaacatagtgataactaataatcaattactaattgattcaatcaaatcgtgatcaaacagtgctatcatatcaacaccatctcatcagtaaaaagaaaaaaataacccccgaaactttgagtacttgatgaacacaagaacaacacacacacagcgggcaagaaacccaaagactcaccgccgccgcctccctagccgccgttctcgccggcaaaacgacggcggcgacagatcgcagggacagaaagcgagcgaatcaacgagcaacgagcagatataactgaacggaatgattgcgaggaaaatggagatggaaagcgagagagatttggagagaatggagaggtcgctggctggcttttgctgctgctgatgatgagttggagtagcgatgcaggtggaatttggaaccgaggaaggtggagaatggagatgcagaggtggtttggggtgcacccggtccatggaccaccgaggatggtttttccatggcttcccttctatgtttttgccttctaaaattgttgccaactttgttagagtttcggctttcttaataaatttttagctaaaaaaaaagtagtcggtgttatgttcgttggatttacgttgagatccgcgcatgactttgctttctccgttggcacctgactttctcgatccatgttttgtgtgctgatctagctagcgtttgtcatctatatagtggtagtactgataggagtattggtttctctagaagttcgtttcctttaccgtgcaaatgaaaccaagtcatgccacactaccaacacattgttactcaaccagaaatcgtacttatgaaaaaataataaaaagaaaagagcgataataagactacaccatagttacaatgcaactttaggatgggttatgttttctagtctagctactagttttcatgttaatgaattttgtatgtttaatattattcttatttaataatttgttgttaattatgttttagggaccaaaattattgtttggttgttgtcaactatgacgtgtcacacatttttagataatgggtccaatcggcatagagacatttttttttgtcataattgatatatcaatttacaagattgatccatcaataactattggaccaaaagtagaaatagataatcacttgagatttcatttcgaacctacaaaatattgaagccactttcgttttcaccaaaggcaacaccatgtcattttgttgggatttagtactctacacctcccatggtgcatgaaacgggtccacgcaaaattgaagggcccccatctctgatatggttgacaagcaaaattagatggcatctgctcaactaaaccaccgacctccatccaacccaactcctctctctctctctctctctctctctctctctctctctcccattgacaatttggcatgtcaccatcatgtgattctcacaacaagaccaacagctcttgcatgcaagcctagtgtttgtttatctgcacccgcttatgcatttctgcctctgatagcgacctgcttaattaaacaagatatttaactatttgtcactcttacaaatagtaattaagaatttaccaccgaacccacatgtcatagacacatgagggcccacatgacatataccgcgagtggcagccatcagtccaattattagcaggggcggatccaggaacaaaaaaaaattagggggctcaattacgcagtttcttcaacctctagctatttaagaacctttagttatcatttatggtgaaaaaatcgaagggggtgctccgagggtatccatgggtcttgtagttgtaggggggactcttgcacccacgttggatccaaccctgattattagtaatgagctttcattgagcttgtcatttagctgcctaatgctcctgtgaaaactctaacagaaattacagatgttactacttactgatcagtgatcacacacacacatgttattatgttaatgtccaagatcaactgaactagtgatggcaatggcaataggtctcaaatgcaaaaacacattactaaattttatattttgtctgagttcattctcttggaatattctgggttaggtatacaatgctagattgctagtgtggtagtttttgcctaacaaggcaggacaagcaactagtgtcagaaaatggattgtgagacaaatttttactgaaatcctttgccaattctaggcttttctgttcacataaactggccaagtttaagatgtcctaaaccagtagtaggttttagcagagttccaggacataaacataaagtataagtagaccaaatgttgacactgacaaagcaatgaaaatatcaagtataaggagactagtagcagatcaaacaaagcatgggctaaaatcttgagtttcagttcagatgctcacagttcaggttgtaattcagtaaagttgcaatcacttgatgttctactgaaaactgaactgcaactacatgattacatgaaggtaccagactgcaattactgaaagtaaagctgaactgcaacacaacctgagaaacaaaacaagggcctaattatttgagttgtaagctgctgtccacagttcagaactgaaactggtgaatatcttgagataagacaggcaaaggccaagcaaagaatgaaaagagaaatagttttgacaagctagtaaagagacaggagcagatcaaagataagcatttgacaacaagatcatgtttcaccatagaaatagctcaaatcttggcttttcaattcagacaacctccattcaagttgcaattcagtaccaaatgctctgctgagaactgaactttcaactacaggattacatgaagatactaaactgcaaactactgaaactaaaactgaactcaaagcagtatctggtaaaacaaaacataagggcctaattattcaagttcagaactgaaactggagagagagagcatcttgtagatggacaggcaaaggatagttggggctcaaaactcaatccagcctcttgaggaggtactgcacttgcacttccttggtcagtggcatgatccacttgtcatacagctccacggccagctccggctcgatcttgagcttaatttcgttctccagatcttcactcaccacctggccgaaggtcatggccttgctcatcacgcgggccctcacgtcatcctccaccttcgcgaacgtcagcaattccatcagcttgtcactgtcctgaaaacacccaaaaaaaaaggtttgatcagtgagatgtacaatgctgatagatcaggattgcaatgtagtactagagattaagatggttgtgcttaattgtgtgattactggttagtaagtaactcaagcagataatgtacaatgaagtagagatgatgaactgtactgtgttccatttcagaaaaaaagaaagagagagaactgtatccttgccttgtttaagattgcaggcgtgtacgtgtcaggtgccccctggaacttagcctctgccacatacttgccatagtgaatcctcttggagagtgcctgcaattgcaagagtttcccaagttcagttcaaaccaaagaaaaaaggagtgaacttctggttgcacaaattttcatgaggcccaaaacatgtttcacatactaatttcattttttgagcagggtgccacattaagagtttaagaaattctgtgtaaactgcaacattggatcataagcacaataatattgtttcaacaagaaatcacttgtcatttggactacccataatacattcaaggtttcaagactaagttgtgacatgagtttaaatgtgaggtgatcagattatcaaacaaaatcacctgcagaattaacatgtcccagcatgcgctcgatccacagttaccgtcacttccttccttcacaagccttggcagaaggtcaccaaagtacacatcccagatccttttgtttatgttgatgttagcagcagctggatgcagaacctgtgtagtgtgtacacaagtgccaattttgtaaggttcagtatcaaatagtacagtttttgctgatgacatgattttggagacagacagtaacagacaatttgttctgaataaagagtagcagatgactgaatatagatgggtactaagatgttgacctgaaacttctaattttaaatgtcaccaatcataagtagtaagttcagaaatttatattaggaaacagtgacatgatcacattatcataagaacctaataccaatatcattatcagcatgtgcacgaaagaactggaattgcagagctagtaaacagcatggcaagacagacagatttaaacatataaatcacattgtcaaaaagtacagcacatcagcatggcacaaaaagagtaaaacacagacagatttaacagtcaacacataaatcacattatcacaaagtgactctaaaattgggggagtgagatatatatattacattctcatactcaacagatggctccaccacctccagcaaattctcagggaagaaaggatgctcatccgggctcttgtacctccccatctgaaaggatgtcacaacattattctgtccctgtcacaaattcagaatgcagaaatgaatgaactcactctagcatgcatcttctcggtctttttaaccatgaactcgaccagggagccattgaaccggacgatcctggaagcgttggggtcgtaggtgtccgggttgtagcagaactgtgacctctccagaaggccgaagatgatggtgtcctcatgcttcatcagcgtgctcctgatgctgccaatggtcaacacattgctcttgttgctctnnnnnnnnnnnnnnnnnnnnnnnnnnnnnnnnnnnnnnnnnnnnnnnnnnnnnnnnnnnnnnnnnnnnnnnnn

SEQ ID NO: 33862 - DNA, 971 bp, Oryza sativa
  unsure (1)..(971): unsure at all n locations
nnnnnnnnnnnnnnnnnnnnnnnnnnnnnnnnnnnnnnnnnnnnnnnnnnnnnnnnnnnnnnnncaaattcagaatgcagaaatgaatgaactcactctagcatgcatcttctcggtctttttaaccatgaactcgaccagggagccattgaaccggacgatcctggaagcgttggggtcgtaggtgtccgggttgtagcagaactgtgacctctccagaaggccgaagatgatggtgtcctcatgcttcatcagcgtgctcctgatgctgccaatggtcaacacattgctcttgttgctctcttccacaccctctttgctcttttccacggccctacaacaacatgattagagataaatagagtcagggtgttgaacaaagctaaataagcagtaaacctgatcatatctaatagacggtgtgatgttagaattaacccaaacggaatttcaaacgatgcagtaggtttaattggtacaactgtgtatatgtcaaggtttaatgtagtactaaatgatgaataatgcaataaatgaacagtgaactcttaacacagctaaaaactaatgttacacttaaaatatacttgaacagtgcaattaatacgggaacagtgaactaatgttacacagtatattattatacaaatatacttgaagatttcagacaaacttcaagatgaaactttagcctgacccgcatgaccagaaataagcttcaagatgttcaagaaagctaaaaaaggggggactaacaccttgcactagttcatgttgtgacaaaacaagatcaaggtgaagcccaaagtgatccaaagtaccatagttatcaacttgcacgcgatgaataatcataaataaaacaaccgaaatctctaaatggagtaaggnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33863 - DNA, 1107 bp, Oryza sativa
  unsure (1)..(1107): unsure at all n locations
nnnnnnnnnnnnnnnnnnnnnnnnnnnnnnnnnnnnnnnnnnnnnnnnnnnnnnnnnnnnnntgtgtgtttctccggaataagttggcacctgacatcatttgtttatttttctatgttatcatcacttttaccagcgtgttttttcttcttttcaaaattctgtaggctgcagaagagtgcacatctgtccttgagttggatagggagcatgctggagctctcatgttacgtgcacagacacttgtcactctgaaggattaccagtcagctctatttgatgtgaacaggctgattgagataaatccgtcatctgaagtatatcggaaccttcatgcacgactgaagacacagcttgtaagtttttcattctctttgctgtgctaattgattcactttgctttagcttcttgcatcggcattactctagttgcaatttcattcgatataactacaacaaatatccttacataattcaaatatgctttttagttgctaccagcacataacttctcccctttatttacaaatgttttctgaatgaaagaaactataccttagcttgtttacttattatcctactgcctgttaacctgttatctgtgttattttaacctttataggcactagctcccattccagaatctgaagaggaatcgttatatcttgaagaagataagcaagagttgcctccagagagaaatgtaaatatcgagatttgtattaccaagtctgataaacctgcaactgaaatgattctcaaaaagaaacctacaacagaacttattgtcgaaaataaacctgcaactgaactgattcttgaaaagaaacctgcaactgaacttattcttgaaaagaaacatgcaactgaacctccaaaggttgaggtgcctcccagtctgcctcaaaaaccacaagggtgggagaccatcgcaaaaccaaagggacattcaggacttgattactcaaaatgggacaaagttgaagatgactcaagtgaagatgaggatgaagaggaagaagagcttcctcagtataaattcaaagtcagaactgtcggtgtgcggtctgtgaannnnnnnnnnnnnnnnnnnnnnnnnnnnnnnnn

SEQ ID NO: 33864 - DNA, 682 bp, Oryza sativa
atgggggcgctcggcgcggctctcgcacgcgcgaacagcgagcggggggggaacgctccggggtgggaagggagcaagagagagagagagggggggagacgcccgggagagagggggccggggaagagatgggccgagcggaattcggcccatcgaacctggggaggcaaactagacttttgcggagggattcgatttggaaggaattggattcggggttgaactcgacgatagatcggggattgagatcttgagatggcacggacactagacaacaatcaaagaaacagatttcgcaattagggtttttcggagataattttcccgctaggcgccacgacggaacgggcgctacaaacttgttcgactgtgtcatcccggttcctaaacttgcagatcactcgtttaggtcctccaacttgttcagttgtgtcactccggtccttaaacttggatttgaatatcgtcttggtcaaataggacggtttaaatattttatatttaaaaataatttataactttttcatgtgagctctaatgaagacaaactttatatcaaacttgtagccctcaacgcgatctacaactttgtagttgaatttgtttttattttaagtcattttttgtcccaaaatgtaattttaaaattaaaatttcaaaatctataaacatgcaacaatat

SEQ ID NO: 33865 - DNA, 1213 bp, Oryza sativa
  unsure (1)..(1213): unsure at all n locations
ccgcctgttgggttccgccgcgtctcgccatctgagctacaggaatgtccaccggcatctaggcgtcgttgtggccgctccccggcggaaggcctctgctggtcggcggtctctgcatcacaaccattgggcgaagcgtctccgccggcctccaagcccgtcaccaccgctaagtctcgatctgatttgagttttgttactgtatgtgttttcccttctcaatttcttagtgcaagactgcaagtgctatctcttttcttagatcccgtgaaatttggaattggaagctcaactacttctctcctacatacaacacattatccatgggatctacctgatgggcaagatttcctgtgatagcgctaaaagatttttggtgcattagacctgctagatgatatagcactgtcaatgatgctaacaccaattaaacttattcagccattgagtcgaatttgataccctgactagttcatgccatgtaatgctatatcttttttctctatttatagtgttgtaattatttatgtttttcttctatgttttttattttttttaaatatatatagacatatccccgtatcggtgtttttcagaaaatgccgtatcctcgtatccccgtatagcatatccatatatgtatccccgtatctaggtaacatagtcgtggttgtcttatactatgttggtggcaaattgatctatgtatcaatgtatgccttttcagctttccgatggaggatggaaagatacaagttactctcggtgatggtagcgcacatgagatggaagatcctccagaactgcatgatcaacataccatcaacatccaaggctgccgtcgacatcttcgccaagttcctcattgaaagagaaaaggtcaacaacaatggcgatgaagagagatatccatctgctatcctctattcaattagagtacttactatggctggagaagttgagatgaaattaatggcgactgacattgcccgcatatgtgttattcttcaattagtctaatctatagcctagtattgcagctgagatattatcatttctgtaggaacaaattatactttagtttgtagcaaattcctcaagtaatctaatcgagactaaattggaactgggatgatactgctgtaggaannnnnnnnnnnnnnnnnnnnnnnnnnnnnnnnnnnnnnnnnnnnnnnnnnnnnnnnnnnnnnnn

SEQ ID NO: 33866 - DNA, 11931 bp, Oryza sativa
  unsure (1)..(11931): unsure at all n locations
tgaacctggcgcagtgtcgcgtccagattcataggccgcgccgacctataagtacactcgcggggcacgctctctctctctccgaggattgcggttgcaagcaggataaacggccaccggtaggcgtcggcggagaggagaggagcaagagagggtgggaaggagaggcacctccggattaattcctccgcgggagctggatattgtgagggaatcgaggtgggtttcttggggtggggattgcggggggttcttggtttttgatcgggcaatgcggtttttggttctttggtgttcgcgtctctgttcttggttggttggtttggtgctgttcgtggctaatttctcggtgttgcttccggtttcggttgagttttgcttcctctcgagtgaggatttgagtgttttggtgagtgttcttggatcatccgcgtcttgctttgagggctaattcgagttgttggttgtcgtttcagcgatcgagtcgtcgtcgtcttcccctgagcaatccggacgcacgcgccccccgcctgttctgcttccatcttctccacgcggatcggcgagacaagaatcaggaagcacccaggtaaagaacaccagactcacttcacttgttgttgcaaccattatggccccttctgtcgttcctggactatctgatcgaacgccatctgtgtgttcgcgcaaatgcttcaaaggagcaggaattagtggtttcagttcatgtgtgcttcatcttgcgtctcacaaacgttcttgccgaccttgcagttttctggaattccagctactataacacaagccatagccatttcacttgttgttgagttgttgctttttatgtttattattgtctttcctgaactactccttcaattgctaacttggtgattgcaaacatgcttcaaagaagcaacattagctgagttcatatttgcttttccaattttttttgccactgtagatagtgattctgcctttgttttatatacagcaagctgaagaaacaatagccgagttcatgtttgctttatcttacaatgttcatagaatatccagtttggccactgtagaaagtgattctgcttttccatacagcaagctgcagatcttttttttttcccttggtggtgaaggccatggttcttgatgcattacttggtttgcttccatggcagagcagttctgtagtttgttcagtcacttatcctatgtggttctgaattttacctctgggttgagaattggagcagtttaatgagctttcttgatcgcttgcacctgctttgagggctaattcacttcacgcattcttttttcagcgattgagtcgtcatctttccctgagcaacccggagtgccccacctattctgcttcctcttctccacacggatcgtcgagacaagaagcaagaagcatccaggtaaagaacgccatgctcacctcacttgctgttgcaaccattagggccctttctgttgtccctgtactatctgatgaaatgccatctctgtgttcacgcaaatgcttcaaaggagcaggaaattagtggtttaagttcatgcttgcttcatcttgtgtcacactgtgttcttgccatccagatatggctgaagccataacttcttcactggttgtaaggttgttgactcgttgctgtatgttattattgtacttcctgaaattttccttcaaatgctaacttagtggttgcaaacgtgcttcaaggaagcaacaatatctgagttcttgttgctttgttttacggtgttaaatacagtatccattttgcttacagtagatagtgattctgcggttttataaagaaaactgacgattgatttcccctgagtggtgaaggccatggttctggatacattgtttgtttccatggcagagcagttatgtagtttttcttttgtcactagtactatatgcgcctgtgatgctagttcttactaatattgtgttttgtgttgttaatataaatatatcttggtgaaaatttctgttttgacattcatattgtacatactcagtaagctttaaaattatctgacaataaaatgcgtatgatgcagcaattagtgaatccatgttttcttccttatgctatgttctaacttagtgtaactttccaatgatacagatatggcaccaagaggaaagccttggaagcattgttgcaacaagtgcgacaagagcttccgttcagggaatgctcttggaggccacatgtcctgccacaggagtgttggtaatcagccaaagagcacgtcaagcccacccactgttgttgatctgcacatgccactgctgagttcctgtgatgataatcttttgcttttgcccccagaaacacaatgccagatgtgctcaaaggtgttctccacctccggatcgctgagggagcacatgatgatgcacggtggggagaaggtggtggtcaaggctgaggaagaagctgccgggctgattgaagcactgggcattgctgatagcatgcaagatgtaatggtgttttcttcagtgaagcgtaagcgatcattccgatcaaagaggcagacaccagcactcagtttggaggagatagaggctgcagatgctctcctactgctttcagggtgctttgacaagacttcagcttatgaggattgctatctgggagatatagaagacagtagcttgagatccattgtgctgacagaggttaacatgaatgccgtggatcgttgttcggttcgatctgttggctccaaggagccaataaatgataataactcaggttacaaggattgctatggacaaagtgacaaggaaaactgtttgatcgttcccaaggaggagatggatccaaatgattttgatcatgagctggttagagatgctgctctcaggaaaccaagaaccgacaattcagatgaggagatgaagtttggtgatcttccagctgctgctatgaaggacaacagccaccgttgcaatacctgcggaaagtcatttggatcagggcaggcactgggaggccacatgcgacgtcattatgttcggaagtgcaatcgtcaacggggggttgctgaccacgctggttctgttcttatgaaagtgcaaaagctgaagcttagattggaccccatcttgtttgatgtcacacttccagctctcactgatggagactgctgcatttctgtgggtgtgaagcctgaacctcagctgtggtgtgtcacgagcaatcttcagtgaaccaatccggtgctcgatgtggtctgaaactctctgttcttttggtgaaatctggggtgttgtctgaaactggtacagttccttgagctgtctgtagactgtaggtagttcatcagccaggaagcaaaaaaaacccatgttgtcttccgatagatagtcacaagctcacaatactgataggagtagttctcttgactgacaaacttccatggatagcaaaggccaggatcttgagtgatagcttggttactgaacagtgaagctgatttccatgttgcatgcaatgcaatggacgagcttgtcattttttttttgtaccaacaatctgtaaaatcagttttgctttgctttctgtaaatgtctgtaccttgattcttgaaaggaatgctggtcagaatgaggtgaatttttgtactaaatggtgatatcctcattgtatgcactgatcagtcaatattaaagtacagtgacattttttttcaagaaaaagagaagtgagataggagtagttctcttcacttgagtgataggagcttttcaaattttcttttgtactgacgatctgtagatcaattttactttgctctacacttctgtgtttctgtaaatgcttgtctgctgaaagaaatggtggtcagaatgaggtgattttaatttgtacactaaattctaaattttgatatatattctactaatcagtcaatattaaactacagtctcaatttttcaagcaaaaccagtatatgatgtttttttttctcatgatagtaatgtgacaagttcttcttgacaacatcacagccgtccgatcatgacacgtgtcctcatcctgcgcctcaccacgaaccccctcttcttccccgatgcgtctctctctcccctcctctctccgcttccgcaaccaaaacctccacagctcgccgcggcgctggcgcggccgcgcaggatgaacctaggacgcggtacagtccaggttcatacgatgcggcgccctataagagcacccgcgcggctcgcacgcgcggcggtcagtttacaagcgccgtccaccgagagatcgagctccaagaatcggaattggtgggatgggtttaggaagctcgattcctcgccgcccgtgaaggcattggtcaattggcccccccaagaaccgttgcttagcggcctaggaggctaggaccccgggcctggaacaatctgaggtgggtttcaggttcttggggttcttggtttgttgtccatggtcgggtttttccagttcttgatttggtcttccaccaagaatatgggctcttggtttcgtttgcctgattcgatgagtgcatttcctgtgttgtttgtttcagcggttcaacctgcatgattttcgcctttccctcacgaatttgatcgcgagttcgctacccacattcgctagaagccttcaggtgcagattccgtgcccatcctacaatctgaagctctctggtctttaccgtgtaaattcgttgcgcattgcaccgtgtaaattctggtgtgtccttgtttggttaaatgctcgaaatgaagcaaaacaaatagcgagaggaattcctcatgattaaaaatctctagctcttggttagtaaacgattctatgatggcgtttcttcagttcttgagttgttttgtcaccagccaagaattctgaggcttcttgctgattcatttcttcttcttcttctttttcttgtttctggagcaacctgttgattgttaccttgagaaatctgattagttcttgtcttccttaattgatcgcgtggtaatgtttacgttttgtaagttattgcttaaaagttgaaagagtggcttgctttgttccttctccatgctgcatgtttacttactgcgatatgaccttgctgtgatccagaaatggcttctgatgttcctcaagatgacgtgcaatgccatttttgtggcacctacttaaggccaagaagttttaggaagcatcagcagcgttgcaagtacaatccggatgcgcttacgcgacagaatttgtccgcaagttcgataccaacatctgctacaagagcgacgcattcaggtgcagattctgtgcccatcctatgatctgaagctctagtctttactgtgtaaattcaattcacattgcagtggctattcttagttttgtgatcaaatggtgtccctttatttccctaaatgcttgaaataaaccagaagttagcaagaggaatcatcccaagacaaaactctccagttatttgttagttaatggttctgcagtggtgtttcagttcttcaattgttctgttgatggcaagaatttttgccatttgctaagaatttggccgcaccctgtgtctgccttaatgattcttacgataattccacaagttcttacttatccatccttttgatctttttttctaggagcaagttgttagtagttaccattaagaatctgactaattcttgtctttcttaattgatcacatggtattagtgtttgcattttgcaactatttacttgaaatagtggcttgcttgctaagttctgattctctatgatgtgtgtttacttactgcgacttgctgtgatccagaaatggcttctgatggcgtttcagttctatcaatgatctcagtacagtgatctcaatttcttctactactactactttttcttgtttccggagcaaacctgttgattgttaccttgagaaatctgattagttcttgtcttccttaattgatcgcgtggtaatttttacgttttctaagttattgcttgaaagttgaaagagtgggcttgctttgttccttctccatgccgcgtgtttacttactgcgatatgaccttgctgtgatccagaaatggcttctgatgttcctcaaggttacgtgcaatgtcatttttgtgacacctacttaaggccaagaagtttaaggaagcatcagcagcgttgcatgtacaatccggatgcgcttacgcgacagaatttgtccgcaagttcgataccaacatctgctagaagagcgacgcattcaggtgcagattctgtgcccatcctatgatctgaagctctagtctttaccgtgtaaattcaattcacattgcagtggctattcttagttctgtgatcaaatgatgtccctttatttccctaaatgcttgaaataaaccagaagttagcaagagtaataatcatcctaagacaaaactctccagttatgggttagttcatgattctgcagtggtgtttcagttcttcaattgttctgttgatggcaagaatttttgccatttgccaagaatttggccgaaccctgtgtctgccttaatgattcttatgataattccgcaagttcttacttatccatctttttgttcttttcttctaggagtaagctgttagtagttaccattaagaatctgattaattcttgtctttcttaattgatcacatggtattagtgtttgctttttgcaactatttacttgaaatagtggcttgcttgctaagttctgattctctatgatgtgtgtttacttactgcgacttgctgtgatccagaaatggcttctgatggtcctcaagagaactgtcagtgcagtttttgtcacaaggacttcgagggtagaagttcttgtgcagagcatgagctgcagtgcaagaacaatcccgacgtgcattcgcaaacagaaccttcaggcaatgctcagggtggcataggcagcttggatgttcatgtaccaaggcgaaagcgaacagccagaaatcagccgctgccagaacaacatctgaagaagccagcttctgattatgctcagggtggcaccagtgatgcaccagagactccaccgaagccaacaacaagtgaagtgaaagtggattctgctgtcaatgctcctgatatcactattcctgacaacaaagatccttctgtgatgcagaaacaaaagaagaagcttgatctcaatctgcaacctcacagtgacagttcagatcaggaggaacaggccgacaatttcagctctatcaatgatctcagtacaattgatacaaattcagacaagaagaaaaataccatcactggtgttgctgataccaatattcctgaccacaaagatccttctaggatgcagatgcaaatcaagcttgatctcaatctgccacctcacgacgacagttccagctctatggatgatctcaaaactctggctcccactgataccaattcagataaggagacgaacaccggcaatggtggtgttgataccaatattcctgaccacagtgatccttctgcgatgcagacgaaaaacaagcttgatttcaatcttccgcctcgcaatgacagttcagattcattagtctgaaatgaaagacttgattttcgtctactggtagatagttacaggctatgatactcatacgactttctgtttcagaagcaacaagtgtacaaacctcttctgaatggcaaagtccatacttctgtattctttgcactcttgcttcgatagtgaagcagtgttattcagttacatgcaatggatgaacattttactactaacaatatgttctaatgcatacacttctctgtttcagtaaatatggatatactaatgagtaacgacatgattgctgtgtaaaaagattctggttaatgtttgtgtaatttggttgttgcctagattatggcagccttgatgtgatgccatactgatctatgagtgtgttattgctgtttttttttttaatattgaaaggccatggcttggatgtgtgtgctagagcagttttgctcagttcctgcaatgtactgttccattatatatagctgatatatcttgaaatgatttctgggtaaataaatgctagttaaattggtgcagacagtagtgcactggcccttttgctcttgggtgtttcttgcgaaatatggcttgatgtgaaactgagcctggtggccagttgtgcttgcttatacagttatacttaccggttagtagcatgtgcacaacttgaggttattcccattttgtgcagttggtactgtatattctgaccagttagtggtaagtatgatgtgattttggcctcattaaaagttagtcacatttgttctttaagaaaatgtcattcatttttctgagatcagtttctgtgaacttaatttggtgccaatctgcagttgctctcttctcctcatggagtcactgctgccttgtcagatttcattagttttgccaaggttcacttctcaacctgttgatacatactataagcttatttaaagttgaaaattctaccttcaagaaagacaagaacataaatgaagctttgatacaacctgaagtcagtccagtaattgtgtcttttaattaacaacactgcctttttgcatccaccactgtcagaatcaaatttacactgcaaatacagtttttgcaaggagtggcatttgcagaaagaaatcgatgctcattttttcagagttcagcagaaaaaaaaaactgatgctcttatgctcagcctgatatgtgcatagattcctcaagtatttctgcttttgtcaagttatgcccataataaagaattactccctaagtttcagattataagttattttgagtttggtcaaagttaaactatttcaagtttaatcaagtttgtagacaaatatagtaatatttataacacaaaattattttcattaaatttataattgaatatatttttataatatatttgtcttgtgttaaaaatgttgctgcatttctctacaaacttaattaaatttaaagtagtttcgacttgtagtctgaaacgtcaaacgtaaggagtaccaaactatgattacttgcattatgtggacctcttattataatgtggctgcagtgacaggttctcctcgcggcaacaccatagccgtccgatcatgacacgtgtcgtcatcctgtagcccagcaagaaaccctctctccttctactcttcctctcccaccaccgcaacccaaaacccccccgcttccactgctcgccggcgccgcgcgcaacgccgcgcgatgaacctagtacgctgaagagtccagattcgtagaatggcgcggcctataagagcacgagcaccccccccgcgctcggttcagtttacacgcggcgtccaccgagagagaccgacctccaagaagagcaagaagcgagtggggaacgggggattaacaagaagctcgattcctcgctgctcgtgaaggaatcgctccccacgacgacctggacgtgtaccgatctgacgtgggttcaggacttcaggtttcttgagttcttggttgtgctgttcatggtgtggttcggttccacagttcttggtttggtcttcccgccgagaatctgatgcgagattcgtctctgggttcttggtttgtttgcctgattcgatgatttcatgctaatgaattggttgcattcattgtttcagcggttcgacctgcaagaatttcgccttccctgacgaatttgatcgccttcccgcgttctgaaaccctcacgcattcagaggtacagattccgtgcccaaagctctagtctgttccgtgtaaattcaatccacattgcagtggctatgtgactatgtcttgccttttcttgattctgtgatcaaatggtgtctccgtgtttggctgaatgcttgagataaagcaacaattagcgagaggaactcctgattaaaagtctgttgctcttagttagttaatgatgtcgcaatttggagaatttggggaatcaactctttgattacgctcaaagagagagacgggaaatatctaaatgcccctagatatactaccctttaacaaatgattctgtggtggcgtttcaattcttcagttattctgtcgatggcaagaatatttttgccatcagccaagaatttgtcttggttctgtgagttcttgctgatccatttctttattcttgtttctggagcaaacatgctagttcttgtctttcttaattgagcacatggtaatgttcgcatttgcaagttattgcttgatgaaagagtggcttgcttgtttaattatccttctccatgatgtgtgtttgcttactgcaatgcgaccttgctgtgatccagaaaaaatggcttctgagtgggactcaccatgccagttttgtggcaagaacttcaagagaagaggtgatctgctaaatcatgagttgacttgcaagtacatttcggatgtgcatccgcaaacagaatcttcaggagatgctcaggctcgcaaggatattttgggatttcatataccaaggcaaaagcgaacagttcccgcattcccagcttctgattatgctcagggtggcatcaatggtgcaacaagtgaagtgaaagtggattgggatcccgaagaagagactgatttttagaggctctcttgcttctcagggagcaacctgcctatcctggagaagagacattttctgatgatgaaccgggtgctggtaatgtagacgatgaaccagctgctagtaataatccagatcaggtgctgaagatgtgctctgacaagggttcatctcctgtggaatgttatggaggtgatgagaggagggtcggtgcgtgcgccattgcgggggtggaggaggatgatctcagcccaaatgttggttgtcgaggggtcaccgattgtgttgatgagtctaatgtgattcaaaagcaaaaaagacagcctgatcttagcgttgccgatctcagggaccttgttgagatgaaacagcaaaacatgaaggctgataccaatattcatgaccaaggacatccttctgtgatgcagatgcaaaaaaatgagcttagtcttgatctactgcctcacaagaacagttcagatcacgaggtaccaacccttagtgtcagctctatggatgatcccgatggcctggtttccactgatacaaactcagataaggagacggagactgtcaatgttggtattgatatcaatattcctgagcagagagaatcttcagtgacgcggatgcaaaacgagaagcttggtctcaatctgctgcctcgcaatgacagttcaggtcatgaggtaccaatcctcagtgttagctctaccgatgatctcaactccctgattcccactgatacaagctcagataaggatacaaactcaaatgtagcagacaggttaggccactgtcctgcacaagagtagtagtggagtccttgttgcggtgaaaaaggaggtgcaggcctagtgtttctgatcaaactcttgaagtgaaacctgagggtgaattctgaactgcagcaatgaagggtggttcagtgtgcgcctacgttttgtgttttgtctaactgatgatggttttttgattcattggtcttcatattcatcggtctgaggtgaaagacatgatttttgtctactggtatatagttacaggctataatactcatactatctttttgtttcgtaagcaacaaatgtacataccttttatgaatggcaaagtccatatagttcctgtattctttccacacttgcttccatagtgaagctgtgttgttcacatagatgcaagtgatgaacattttactactaatgatgtnnnnnnnnnnnnnnnnnnnnnnnnnnnnnnnnnnnnnnnnnnnnnnnnnnnnnnnnnnnnnna

SEQ ID NO: 33867 - DNA, 13263 bp, Oryza sativa
  unsure (1)..(13263): unsure at all n locations
ggcgtggggagcggcctgctagacctcattaagctcaaggccgccgcccgccacttctcctaccgcaccgtcttccacaccgtcctcatcctcgccttcctcctccccttcgtcttcatcctcaccgccctcgtcaccctcgagggcttcaacaagtgctcctccctaggtaccttgccgccctcttcatgaaatgctcttcaaatggtcttgaaatggtgttactgtgcccctgcacagctagttcttcaggagtagtttatgtagcttactggtggtataccagaccagggatgtgcaatgtgcatgccgcggcggcgtgaattacacgtttcggtagataacaaccgctgggatgctcataattttcttgtgttttaaccgaaactcatgaaatgtactacacgcctgctttggtgctatgatcacttgccgtcactagattataggggcttatttgggcatgataatgatagtggcattgttttttttttgttgcatactatttgcttagttggctgctttaattgctttcttggttcacctgatgttccaaaactgctcgttttggcctcctatagaaagggttagtacaaatggggttgctttgcttaccacttatgtggcaacttaatggctgcttctatcactcttagatgttaaggtgttcatgataatgatatcttgatggttcattgagaaattaggcacatcacattgacacggtagaccaacacttccgtaagtaaactatgaatgtgaaatatatgtaacatcacttgttttctactccgtatgttagaaaatgaaacaacttttctccattgttacttccgatacttcatacttggtgagttggagctactatgaaggctcatactgaaccagccagaataccaaagtgtgcccctcgaatgcttttattttgttcgaataagtcattactttagcctaaactatcctcagacaaattccaatccataagttacgttactaatcataatgtacacatttataaacaaggcccatttccctatcatctaatccacttaatttgctattacatcatgatcctgctaaataatctgttacatgcaccccccttggttgtttttctgtacatggacctgaaatcttgccctatgttcatatgttggattcaaggttgcagcagactatgtttgtctttgatcataaaaatgtaaatagtggtaattcccctgtctggagaaaagagactgctgatcttatcagttctaaatgtgtaacagcatttagtagaagctttagttttatttttctcaaatggaatcttaggggttaagcagacattgttctaaagctcaggggggttatctggactttcgccttaactctactttagttggtgcctatgttgttatcctatcttttgtcgatgatactttatgtacttatctttctctttgttgtgctgcctgatccatcataatttatacatgttcaaatttgttcatagttgaaatttgtgtggtcaatgacttgctactaattcatgagttgttactatcagattgtctaggcagacggttaggtccacggcttcttggtaggggcaacgatggctccatggtactcacatctcctctgatattacccttctcctttcaattttgtggatttgcttagttccttatttaatttctatattctaatgcgcagagggtcatgagggatttgtataggatgcttgacgaaataaattctgaagaagtacctgttgatttgaaggtcccagactcttttgatgaattcatctgggacatgaagaataatgattatgatttaaggtcatttgcttttaggctgaaggcaacagtaagtttctttccctgttttgaagtactgtccatattttctatttctgtccaagcatgtgaattgcaaagtttctcagtaggttatgttggtggtgacttgtgcttgagaatgaacgtcatgattcctttgagtgtgtttttactttggaatccactgtaaagcttgtgtcacttcttgggtaatattattttatagcagttatgttattgtgttggatggtgatggacaagctatcttgtacataaaactgttattttcttgccattatttacaagcgttacatgctaaactggtagcttctacatagctaaactctaaatatcaaggctcactatagtagtgatgaaaataaataaatatcttgtttacaccacatgtatacaacaggtagtatttaatgattctcatccttctaaagttgccaagcagaacactaatggacttgaaggtccctaacatcatgctaatatgcttctattgttcagcaagcactaatattttcattgcctgcataacattacgcagatggagagcatggacagggaattgagaacatcaaggttatcagagcagttaaacaaacactacgcagcaattgctattcccaaaggccttcattgcctttccttgcgtctaactgatgaatactcatccaatgctcttgcaaggaaacaactccctccacctgagttgatccctcgtctttctgacaattcctatctccattttgttttagcatcagataacatccttgcagcctcagttgtggtcagttcaactattaggtcatcattaaaacctggcaggatagttttccatgtcatcactgacaagaagacctatcctgctatgcactcatggtttgctttgaatactctttctcctgccattgttgaggtgaaaggtgttcaccaatttgattggttaacaagagaaaacgtgccagttcttgaagctatagaaactcagcacactgtcagaagtcgtttccatggaaatcaccttgcaagaaatagtgcaggtgatagcccaagggtttttgctgccaagctgcaggcagggagtccaacatatacttcagtgctcaatcatattcgaatatacttgcctgaggtacaataattttttctaacttattttcagtacagtttcatcagctttggcataattgataaacaattaagcatgtgttgtcatatgtaatagaaacctgagtttaagcaatcgaaatacaacagatttgaagtttctttccttgttttaaatgtaaataatatatatgtatatactctgcataattttttttcttgcagaaatctgtattgtgcaacaatttataatgttctgtagttagttggactttcccatctgtagttgtgcaaatatattctaactgcatcatttattttttcaatctacctcatttttttcctgaaagatttgtagttgtgcaaatttattctaacttgcactttgtgaaatgcagttgttcccaaacctcaacaaagttgtatttcttgatgatgacgttgttgtccagcgggacttgtcatcactttgggatattgatctaggtgggaaggtaaatggagctgttgagacctgcagaggtggagatacttgggtgatgtccaagaggttcagaaattatttcaatttctcccatcccctcattgccaataacttcgacccttcggagtgtgcatgggcatatggcatgaatatatttgacctgagtgcatggagaaagacatccattaaagataaataccaccattgggtcagggaggtaaaacatcgatgccactaccttttcatctgcacacccccagttgtgttctacacatttttttccattttatagtaactaagtgaatattttctgatattggaatttggaagtctaacaggctccttgtttaaacataacgctctttttgtttgtggcaacgttctaaaagcaactatataaaattaatgcagagctgctgatatgttaaaaactagggaatttctcttgatcacttcaaaaggcatatggaaatatgctggacactatttttaatgatcatatatttgaccaatgcttggtccaaattttaacgttctaaataagctctgatgagtttgagctacctaccttactcatgctaccttctttccctgcagaatctgagctcaaacttcacactttggaggcttggaacattaccacctggccttatagcatttagaggtcatgttcatcctattgatccatcatggcatcttttaggcttggggtatcaggaaaagacagatatccccagtgttcagaaagcagcagtcatacattacaatgggcaaagtaaaccatggctggatattggttttaagcatctccagccattttggacaagacatgtgaactactcgaatgagttcataagaaactgtcatataatggagccccagttatagattggctagataaaccattctataaatattggcgtaaattatggaattaaattcattattttggagaccaataccagatagtccagaaggatacccacgaaatgctctctgaacagtaacccggagctggtacacgagcggatggagaatatttaatgaacacaaaggaaatattttcttcctatacactaggatctctttccctttatttattccatttgtatcatagctcatgaaattacagtattgtttaggatggttcttttgtatttattggagcaatataaattgcctgatttggcgggattgatggtaggcccatcgttattgtaattgttgggtatccagttcaccacatgaacaacatgggccagattttgattttgcaaagcaagccctgtacatttgcttcctgttttctttatctttttgtggtcatctggtatgatactctggtgtcactggtgtcatcagaattggattattatacttactgtaaatttgtaactcctgtcatatttggtctttgactatctataaccttttcaagtttagtacatacatcagtgtgtattgatcattttattgtacattgtttacaagaaataagaacttaaatgaatttctttagacgaacttcagtggatattggttatggttagcaggtactcctaaaacaatactggttggactagtttgagttctaattatttcttaagagggtgttctttttcttcttttaatctgcatgtaattctttatttttcataattcactcataccagcataaaacatcaaggacgacatttttctttcacatgtacattttttatatagtatgcggaacatgagcatgatatcactacatcaaatgtgcttcattgtgacccaaccaaacatagaagggaatggaactgcaggcttgctacatactgatcagtaaacactggaatcaagttattctatatatagcccaattggggaaaaaactagaaacacagaaaaatctttacagtggatgtaaccctgagaacacctatatcatcacatcagaaaagaaaaacctcatgatatttctatctaaactcgaaatcatcgttcgcaaccttcagcctcgaaatctgggaagacgacgaacgcgatcgacagcggggcgacatagattggggaattgactgagaccatcactggtggcagtgaagggatgtcaccatctccagtgagctgaagaggagctccattgagcagcactgtcctggcaaaagggttgccatcctgtggagtcagatggtactcctccctcttctccagcccatccgaggctttgctcccaacccaggagactgtcctcttcaggccatggacaaaggagttgtccctctttatccctgccatttctctgaaattaatgttgaggtcatttctgactgagaccatgaatcccatgttcttgttcaggttgagcatgaggagcgcgacgccgccctgtagcacggaaaaaccatttcgagagcatataggtcagcctatcttcactttcagtttaatcaaccacatgaatatatgatgctagaacactgtagtactatgcttgtgttaccaaaaagataacatggcagcattacagtttcatcttaggttgtttcaggtatctggaagtaaatgggtaggtaaccgaattctttctttggactcatcatggttcataccttttgctttccgcaatgcgcataggcacgcaagtacgaagaaccgctggtgtctaaggaaataactcccttccccatgagccgatgccacagcaaggcactgaacatataccgcggtttagtacaaaaggtatatagggtagtaaagcatgattgtggcagagcaaagtataggaatacttgcctgtagtaatcagggtttggaacaaaagtttcggtatcaagaaggccatagttgcctccaatcaaagtctgtctgcagtaaacctttgtgtcatactttgctgactgaccaagctgatcaagatacctagttgaaacagcaagtttacgaacaaaacaagaaaaatccccatggttggaataattatctgttgaactggcaagtaattaccagaagctattcaggaaagtattagacacttttcggctgccactgttatatgcaccaccagcttccccaacccagggagcagaccatggtccatgccgctgtatcgtcatttggagatctctgaatgtatcagagctctggctcaaatactgcggattcaagatcctatttgcaacttgcggatcgttacctaataaaatttggtttatgtcagtcatcttaaatgtgtagtacaacctaaaaacaaagatgaattaaggagtggttctaacattatatctaggaagtacttaccagcaccaagattgtaaatatgatgagtcattgtgtcgagaacatttggaccagagatatcaagaagctgagcataccatttttggtcatagaatcctcctggggcaaccaccaatggtttcctagagtttccatataactggctgatgatgttcttgagctcaattatatcttttccatattgttcagctccaacacttgcaccaattccacttccactcaactcattacctagtacataagcacaactactgatgtaaggattacacaaatgaccgatgcttctgactcattgtaggcagcaaatgaaggttttagtttttataattcataccaaattcccatgagtctatagggtagttcatcgaaacagtgtactccatgaactcccgagcattactggaattccaagcacctccccaaacacctctgcccatctgctgtcgcccttgaagcgcgttaaggccgaatgtaacaactgcactgaagggattaaatgaaaaaatgggtcaggaaacacacttaatgaaggtatatgataggttccgatttgtgatgtggtcaacaatttatcttataatatatcagaattcactacagaaaaaagaatgcacatcagaaactactggagaaggaaggccttaccctgtatccataaagatcttattaatagcatcccatctttccatggttatgcatccttgagaaaatccaaacaggccacttgaactctttgaaaatggggtgcatggagatcctaaattcggcgtgccatacaccacctgatcttgtaaggaacctccaagtctgatacgtagagggctaaaggctacaaaaacaaataaatgggaaaaaaagtccatgaatcatgggaaagtgtagaaaaccataagaaggcaaatacattttgtggaaagtagctctaaacaaattccaagcttaataaataaaggtacagaatgaaccacaaatgtcaatatgtttcttaaaacgggatttaccctctaatatcttatattagtcagtgtaacaagtaaacctccacacggtagaatgaaattgatcacagttgctggcatatgtagttgcaaaggaacagataaatctttgacaagaattctttgagtctttgactttgtaactttaatcctatttgcaatttagtatggaaattccctactgttgtccattttttttagttacagtagaaaattgttcgcagaaaataggtataatattcaccttggatagctttagctagcaaaggattagtcaagtcctgggaaattcacaaaaggatcaaaattagttctttgcaaaaatatcaattacaacatgataaaacacacacattcttgggaaattagcaatttaccaaatttaagatagaagcttgcccccatggacactggtcataattgcacttctctggaggccaccaatcaatggtggcgcaaatgaactcgttgctggtcgaagcgatcgtctcagcaccccgaacgacgatggtcacatccgagtaatcctcggatcgaatcaatgtagggaaacagagaagaagaggtatgagaaaccatagcctcatgctttcttcccctgcaaatggtgttgtccacccaacccaaaagacaaccagaaatgtctcagatttattgtgctaattaaataaggcaactactagttggtaaggactaaggagaaggccttaagttttaattttatcaacatggatgaaagtgacacctgccctatcatcatcttctatatgtcctatatttacatgtttaacaggtcaaatcaattacaaacgaacagtttaaactttgtttccatgcaagtaaacaactatgttactatctcaattattggagcaacttaggcatctccaaatgcagtatccagagaaatataattcttttaacatttgaggaaatcatccatgaactagcactaaacaacaaaatgcaaaaaaaaaaaagaaagaaagaaagaaaggatatttcattgaagaaaggggaaagtttatcagttgagcagggtgaaattctgcagttggcaaaatcatcccaaactgcaaagaggaccctgaaacttgaagaaaggaatccttttcaacatgcaaacgatcgacctgagcacgccatttctgctcaaattcgagaaagctgaagatcaaagtttctctgacatagaataaagttcagcaaaacccaaaataaacccagcagaatctgaacatcgaattaacaaaaacttctcaaactggctgatggaacacgctaacccaacttcctccaaaactgcacctaaacagaatcaaatcctcgaaggctcgaacaaactgaaaccaaatgaagcaaccacaaccaaagccaacacaggcgcagcgtaatttgccacagatttatatactaaaaacagcagaaatactgcacggaatccaagagaaaccaagaagagttccattacctgggaatcaaaccccaacccaagaatgtcccaagctgttcttcccaagaacagcaacagctcgtatctttcccaatgcaggggaaagaagccaagaaaagctcgtatctttcccctcgcaatctctgcccagaatcaaacccggaggaaatggtcgggaggatttaaaaagattgcgcaaggttcgagcttttgagcggttcttggatagaaaagaagaggagagattcttgaggaagtagaagtattggtggtagttgctgcctctcttttatgtctcccttggaagctactctcactcttcccttgctatagtacagaaagctatgtgctcctaattagatttagagtactaatactgtattatcttttttaaaaaataagtactaatgctcctactaacctttaaacagtgatgtttttgttctttacatgtgcttctggaaagttactgcctcagttgttttcttttctgggttgagatgaactggtctaataaatctgaaggcaacagccgcaacagaggagacatgataaaacaaaaaaaaaattctgactccaggttgtattaaaaataatatcctgattcctgcatttttattattacatcctgattcctgcttgataaaaataacaacttttttattacatcctgattcctgcatgatatttgaggaattttagtttgatttctgggtaaaagaattatgagtatcttggattttgtagaaatattttgttcacatgtaggatatagagtcatttacgtgttggatttttctcatctggaaatagtgtagtgtagttggtgtgagatgaatggcagacatgtggggcccattactcagcagcaggcatatcatagctgttgtctgttgaccgggtaaagtatgggcataagttgacgacaatgttccaattagctgcaagagtctctgtgaaaaaaaaacgatttttttaccaagataaacacctgttatactttttttttggtgccaaaagaacatcaaagttaatgaaatggcacatgagaaagtgattagggctgttaattcttggcttgaagaaagagcaaggaattatggcttgatgtgattttcagcaagaagtccaaatactaagttttgatttacaggacgaaaaggattggggagatgcaagtcaaagattaaccaatccacatcacaatttcaatgcaaattgcgtgttttcaaaaggacaaaaaaaaaacaaagtggagagaaaaaggtgaccttgcttctatccactttcctctgagatgcaacttgcacttgttgagtgggtaggcttagacaaacaaacctttccatccaatgtattgatccaaaaacctatcctaattaaatcaatgtttgcaactgtatcatgattgtgctgagggatactactaactcacaatcatcatcctctattcctttttattgctatcaggatctcagtagtcaatggtcacctaatgcaaatatgcaattagttgatactatttacctatgattctagaatgaatgagggtaaaagcacttgacaatttgacataactgcctgccctgtgaaaatggcactggttaatatcagtaattggctgtacatctttatttccaattatctgctgcaaatctaccgtattatgattcacaaatgctggaggtaaatttgtgagatgccaggaacatgaagtaactggtgagcactggaaaaattgcttgcccaaaataaaaaaaaaactcagtgatattgatacccttgtttttttttttagataatgtggtatccttttaaatggcatgattcgttcttgtcctaaagtccaatattataatattagaaatggttagatgaagagtatgtcatacaaggcatgctcatccaactacttcaaaccaagactttgtttttcattttcatattcaaataatatttatctatatcctacatccttttgggtgcttccgttgttcattgtgtcatcatagtatcatattgtcacaaactggtccaaatcattggactgattacgtgttggaattctctggccgcttcttccctcaaatgttgactctgaattccaattgatatgccaaatgaaatttataaacccaaattggatttgggcgtcacatcttatacttttcaattttgatgctactgcaggagccccctgaatccatacatgaatggtggttttgatgggtttgacctgctcaactaaatcacctcagcttagactccatggtcaacgttccagtcaagccaccaagaatgatcaaatcgtccttggaactcaacatacgtaaattacattgaacctgctgcaagtaggaagcaagcacaggaaatgaagcaaaaaaaaaagaatcaaaattggcagattctaacacagtttaggaattaagccactgaaatgaacttcagcatagtttataagaagtggatttttatctcttaaggggacatcccctcgttttgtgtatggtgtttaaaaagttatcaaaaagtttgaaataaattgtaaaaatagatcaatatatgatatatcttttcgcaaacatgaaaattaaaattcgacatatacaattcgaaacaaaaacaacaaatttgaccgtgaattacacgttcttttcatagtcaaatttgttatttttgtttttatttgtataagttgaatttgaatatgcatgtttgtgaagtgatatatcacatattgatctatcatactaatttttttaaaaaaaaattaataatttttaagtggcatacaaaaacgaggggatatccccttaagggatgaatatagttttcctagtttataatcactgtatattttctgtatttggtaaattattgcgcaaacacaaaaggtactggtcctgtatttcactaattaagcaccaagtcctatgactatgagaaaaacctcaaacatgcaaacttcaaagactccaaaatttacaggaagttcacaagctccaaaacgaaaacacacatcattcagctcagagctgcagctgtaactggagccaccttactttcttgaagcgagatcactgtctcgaaggcgccgacgagggccttcaccttgctcttcctcgtctcacaagcttgctcgctgtctcctcgatcacattgttcaacaatccctgctcgttcttcttcttgtccctgacatcctgatgcctcaggatgacaacttcaggtttcgaagagcctgaatcttttgacccggaagaggctgcactgtcactcttccttctccctctggtggattctttgctcctgttgctgtcttctacagtctttgcaggcctgaaccggagccgtctcggcgtgctgctcgactctgaattgctctgtaggttcagtacctttcctcgtcggaaagttagcttgcgaggcgactgcgctgggatggttgaggactttggctgccttgtgttttcagttcttggagtggcagaattttctgctaaatttgaatgagcacatgtcaatgtttgcttgagaaacaagtgttttctgcataaattgtctgtagtaatgttggatgcaagattactgaattaggatggggagaaaagaaggtaaaccttattgtcaatcatgacataaacagacagattatcatgtgaaatctgtagtaatgttgaatgtaaattaagcaaatctttgaacatggtgttgacaggggggcaaacaaaatgtagtacctttctgagaacggctttctttcttgctaacttctacttttctcacttttggtgaagctgacttcaggtttttctccttaacgtcagcaacagcattttctgctccatacaccttcttgttgctcttcactagggaagcaggtttttctttcttgactgctctcatctttatgctcaaaagggacttggatgacaagtttatagaacgagacagtttcactggacttattttctcttcttccttcttttgccaaacacgagcattcttggcaacattcatcactgtcatctttctgtcagtttgtttnnnnnnnnnnnnnnnnnnnnnnnnnnnnnnnnnnnnnnnnnnnnn

SEQ ID NO: 33868 - DNA, 694 bp, Oryza sativa
  unsure (1)..(694): unsure at all n locations
caagatacctagttgaaacagcaagtttacgaacaaaacaagaaaaatccccatggttggaataattatctgttgaactggcaagtaattaccagaagctattcaggaaagtattagacacttttcggctgccactgttatatgcaccaccagcttccccaacccagggagcagaccatggtccatgccgctgtatcgtcatttggagatctctgaatgtatcagagctctggctcaaatactgcggattcaagatcctatttgcaacttgcggatcgttacctaataaaatttggtttatgtcagtcatcttaaatgtgtagtacaacctaaaaacaaagatgaattaaggagtggttctaacattatatctaggaagtacttaccagcaccaagattgtaaatatgatgagtcattgtgtcgagaacatttggaccagagatatcaagaagctgagcataccatttttggtcatagaatcctcctggggcaaccaccaatggtttcctagagtttccatataactggctgatgatgttcttgagctcaattatatcttttccatattgttcagctccaacacttgcaccaattccacttccactcaactcattacctagtacataagcannnnnnnnnnnnnnnnnnnnnnnnnnnnnnnnnnnnnnnnnnnnnnnnnnnnnnnnnnnnnnn

SEQ ID NO: 33869 - DNA, 510 bp, Oryza sativa
  unsure (1)..(510): unsure at all n locations
gatattgttgcttccttgaagcacgtttgcaaccactaagttagcatttgaaggaaaatttcaggaagtacaataataacatacagcaacgagtcaacaaccttacaaccagtgaagaagttatggcttcagccatatctggatggcaagaacacagtgtgacacaagatgaagcaagcatgaacttaaaccactaatttcctgctcctttgaagcatttgcgtgaacacagagatggcatttcatcagatagtacagggacaacagaaagggccctaatggttgcaacagcaagtgaggtgagcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33870 - DNA, 1272 bp, Oryza sativa
  unsure (1)..(1272): unsure at all n locations
nnnnnnnnnnnnnnnnnnnnnnnnnnnnnnnnnnnnnnnnnnnnnnnnnnnnnnnnnnnnnnnnagaggggattggggtttttatgggggcttggcttggggataagccaggatggcgtggaggatgaggtcgatgacaggcgcactcgatggctgtctacggcctaggttagggaggttgacgcggctaagagcacccgcaatggtaaagtaaggtgctatctataaaacatgtacatctcagcaatagactagattaatagtaaaccactttaatggtatgtctacatgggtatctatagctctctaatgcattgcctcgtttttctctatagactatctccaggttagtagatagctttactctctctcttcatttaatctcttccaagtaggaaaatatgctgacatggatctcttgtagagagcctatagataaccattgtgggtgccctaaggtttccatcctcttctccattaagtctctgtggcttaatcatcaccctacagctcctagcctgtgaacctcggcgctagcttgagagggtgcgcatcgttttgtccagcgggtgcatggaggggcgacgggacgtcatgcgtctggataatttggcggacgtggcaatggcgacgcgcttatccaatcggcttcgttcctcatctcttggagtgacggctgaaggagatggcggcttgaccggggtcgagtcgcgggcccacctagcgtggcgctgacggatgccgggattcgcggcggaaggacggacttggcgcgacacggagttagggcgcggcacgatgcggtgcacgggggcgacgcgagatgcggaggtggcgcggtcgatcgcgtgcgcggcgtccgggcgcgagcgcggatgcggagggatgcggcgcatggcccacaagcggcgcacggcctggaagcggatggatgcgacgtgaggaaagggaggcgcggcgtgcggcatgcgggtaggacgcgggcgcggtcatgggaccggatcgaatagatgatggcccatgaacagtgacagacagaaaaagagagagaaggaagaaaaggaaaaagaggaagagggaggggctaaactgcaaaagtgaatgggattggaattgaattgaaatataatctatacattttgggctttgagaattcaaatgtttgatttgaatatttatgtatttctcacaattgaattgttttgattnnnnnnnnnnnnnnnnnnnnnnnnnnnnnnnnnnnnnnnnnnnnnnnnnnnnnnnnnnnnnnnn

SEQ ID NO: 33871 - DNA, 526 bp, Oryza sativa
  unsure (1)..(526): unsure at all n locations
nnnnnnnnnnnnnnnnnnnnnnnnnnnnnnnnnnnnnnnnnnnnnnnnnnnnnnnnnnnnnnnnattcaagatcctatttgcaacttgcggatcgttacctaataaaatttggtttatgtcagtcatcttaaatgtgtagtacaacctaaaaacaaagatgaattaaggagtggttctaacattatatctaggaagtacttaccagcaccaagattgtaaatatgatgagtcattgtgtcgagaacatttggaccagagatatcaagaagctgagcataccatttttggtcatagaatcctcctggggcaaccaccaatggtttcctagagtttccatataactggctgatgatgttcttgagctcaattatatcttttccatattgttcagctccaacacttgcaccaattccacttccactcaactcattacctagtacataagcacaactactgatgtaaggattacacaaatgaccgatgcttctgactcattgtaggcagcaaatgaaggttttagttttt

SEQ ID NO: 33872 - DNA, 673 bp, Oryza sativa
  unsure (1)..(673): unsure at all n locations
nnnnnnnnnnnnnnnnnnnnnnnnnnnnnnnnnnnnnnnnncatgtaggctgctatcgtatgcacatggcacatacacataaattgtttatctgtaaattcataggggcaatatggacttgtttaagtttactgtaaatgactcagatatatagatcattatgtttttttttttgacagttatagatcattatgttggcagtttatttctgtgttttttgagacagtttatttctgtgtgagattttattctgctgttgtagctcatgatgttttttccttggatttagatgcacatgttcaatagctgtttttgtagttgtaaaatgtgctgtaatgatttgcaacttgtccttttggtgcgttctggcgggagattggattcggcgtgacaattaataagacgtatagtactggttatgcccaatgatttattcaatgccatattttggcaggatgaggaacctgaccatcaatatggttctcgccgaatgccagcacgtagtcgttttggggatgaactggaggctgaagcactagctgagaggcgcatagttagtgcaaagaaggtgagcaactcatcagcatgtaacccttgttatttttatccaatatattgctgtttatacataatctgtattgtttgcacattttcagtcaagtatgggcagaaa

SEQ ID NO: 33873 - DNA, 738 bp, Oryza sativa
  unsure (1)..(738): unsure at all n locations
nnnnnnnnnnnnnnnnnnnnnnnnnnnnnnnnnnnnnnnnnnnnnnnnnnnnnnnnnnnatttaacagaaaacaaacatattatcaaattatattatatgttagttttagttagactaattttatattctagatgctgctaaattttttctctagactttcaaactcaaacaagtttaacaaggagagaaaaaaaatcaaaatgacttatactaatattttaaaaaaagagtaaaaaaaaatctagcaaggctagggtaggagtagcaataataccacacgtgggcagtgggctgggatgcttgtgttgtgtcttctgcttcctggaggaagcaaccggccagccagcggtttggtttggtttgacccaaccatgccacgctggactccgacccgaccccgacccgacccgacccttctcctcctcttcgtgttcatcgcgtcgggtcaaatccctcctcttcttcttcgtctccgtctccgtctccgtctcgtcgccgcctaatcccccaccacctcgaaacccagatcaaaccctccctcccctttcacccccgcacgatccacctaccccctccccccttcttctccctcgcgcgcgcacgcagctagctagctaccgcgaggaaccgaatccaatcgagctcaggacgaggcggaggaggagaaaccaccccggattctcttgatccggagtccaagaaaccacggggtagtgccgtagtggaagcaatcaatc

SEQ ID NO: 33874 - DNA, 8701 bp, Oryza sativa
aggcccgaacgtttagagttgttgagttgttctgctcgcaacacatgctttcaactcttcttttctcgctttttcaaaaagaacagaacagagaaagaaagaaaacggtaatccagtacattgcgcccttaagctatcatattcttggctattttcaacctagatatttgcaagggaataagcatcaaaacagcacgcactggtgatggtttaccagatcatctgtatttttttttagaaaataatactactatatcatctatattagtgtaggaaaactggtagcacagctaacatttgatttcaagacagcatcccgaatacattaacaattgacaacatttttttttgttatttctaaacaacaatcctcaagcaaatattggtgtttgcaacctttttcttctcatcattcgtcatcactgtcaaaaacgactgccttccgacgatgaactgcctgttgttttcttggaggagaatcatcatccgagtcgatctccttgcgcctttggctggcactggcacccccagattctctcctccgttttggttcctgcagcagaggcttcagtttcagtttcgatttatatacagctaacctcatcatgtttttctttcaagtttgctatatattaactacaacaaaaaaccaatcatagattcctttcagctatatgctaactaagtatgcacaagtagtcaaacataaaccgaatacatttttttctgtttccttttgtttcacttcaacatttacaaggcagcaagcctgcccgctgacctgttagttactcttttgcagaactactgaacttaaacttacctatctacataatgccagcattgtaaactaaaatatcaaatttaatcatatattcctagtggttactgtcaagattcttgaacatcttgccctcacatatgctgcaaaagtatttaattcattaatctctttactgggcatatccaagaaagaacctgacttgcaaatttggaaccttacgacaatgttcattcgtatcacatattcacattgctaacttgtgaaaaagaaaaccaagagttttcaggccatgccatcggtcttacctcgatttcttcatctgacatagctgcttcttcttccacatcttcctcatattcatcctcttcatcaagctcatcttccctcccctgggttggtgagtgctcaatatcctctccttcagtttcatactctgactcctccctttcactctcagaatattcattttcctgtcgtctaggcggacgagcaggaaaggatggtttgcgaggaatgtttctgcccatacttgactgaaaatgtgcaaacaatacagattatgtataaacagcaatatattggataaaaataacaagggttacatgctgatgagttgctcaccttctttgcactaactatgcgcctctcagctagtgcttcagcctccagttcatccccaaaacgactacgtgctggcattcggcgagaaccatattgatggtcaggttcctcatcctgccaaaatatggcattgaataaatcattgggcataaccagtactatacgtcttattaattgtcacgccgaatccaatctcccgccagaacgcaccaaaaggacaagttgcaaatcattacagcacattttacaactacaaaaacagctattgaacatgtgcatctaaatccaaggaaaaaacatcatgagctacaacagcagaataaaatctcacacagaaataaactgtctcaaaaaacacagaaataaactgccaacataatgatctataactgtcaaaaaaaaaaacataatgatctatatatctgagtcatttacagtaaacttaaacaagtccatattgcccctatgaatttacagataaacaatttatgtgtatgtgccatgtgcatacgatagcagcctacatggtttcaaaaaaggaaataaaattaaccagacaagaaaattttggatatcatcgcgtaaataacatgtagggctgaagaggatttcagttttcactgaacaaagtttttaccatgcaacagctttaggtcggagagtgaaattgaactcaaatcagttgctaaaatcaaataaggagtgggcagtgatgcagtgttaataagatgtggagggaaatttggaagcatagaacgactgtttgtggcactgtgcaactctactctgtatgtggcagcggtgatccaatcagtagcaaatgaaggtgaactttggtgtttggctggggtttcaaagcttcgaaaactgtttgctaggtcgatagcccttgcggcttaactaggtcattcggtttgtttggttcttttgtaagacatgacggtgtttacagagtgggtttttttctaaactcccctgtgctgcgccgcccctacgcagatctcctgcgtgttcgagaaaagaaaaaggtgtggagggtcttgcacttgaccagcattatattgcagccaaaagtggccccaaagactggcaaacattcaaatggcatttactagtgagatttaataggatgcgtctggactaaatatcatttatcactaatactataacagtatgaacaacaataactaattgtatcaatgaccttaagcggaagaaataagagaaatgacaagaaacccacctcatctaatgcatcttccaaaaatccgggagaaagctgccttctttgcctggcgggctgtgtgtacttgcggctaaccttttctcttttgcgttgaagaattgaatgggctcgaatattttggcccaaggcctgcatagtgaaaagggacaaacttcattcaaaatgcatatataacaagtttagaacagaaaggaaatacagcaaagcacgaacaggattaaatgcatttattaaatcagtatgtcaactatttggttattgcaccttcataaaaggaaacttcaccctatgtgatttattttttgtgaaaagttcactggagcaagccacaataaatgttatacagcgtagcactaagaacaaatcatgttacaataacttttagacccgcagatcaaagctgaaattcacgggatctagaatgtgtgtttaactgccacaaaaattaagtttaaaatccataaacaacatgctaattaatgcttgcttatgcactggagaaaaacatgcaggataaacagaaaacacacaaacaagagaattttctgaatacaaattgcagtcttgttggataatgggacctctgatatcacattgatatttgttggtttgacaacataaatttcttaatcttagaactcatactctcatcatgaaaggaaaaaaaaaacagagaaagcagcaagatcgtgtaactcatacaaatgacttcataatgattacatctttatttttaggataaatatggtgaaaatcttgcactttaccgttcaagagatttacaatcaacatgccaagatttgcacataatgtttttagagaatcatctatttacccccactatatagctaaaaatgttattacatgtttgtactccaagaaaaacaatttgtttgctgattgccatgctctaaatttgcttgctgattatcatgctctaaaagcatcaactgtcctctcaatcattttaaatagtgatcctgactagctatgcgcccaagaataaccaaatttgaagctcatatttccatgaagaagaccattcttgtagtttgcaacattagaactttagtagcatttccttaatggtactagcttaccagttatgctcctatttacttatttgtcagttatctggtgcaaattcagtgtctgctcaaatctctcatggtcagatacgaaattatatttacttaatttgaagtttgcattctgactattttactgattactctactctattaagtattacatgcatccaactcctataatctaaagaaataggtgaaaaaaaatataaatgtacatattttgtcaagcccaatggcccctatagaaacaaaatggaaagtgagaatataacacaacagaaatcatgttgtttttgagaagcagcattggggcaaatgtaagtcatgcacatgtcattcagtgttgcatatacatccaatgtattaagaaatggagtttttcgttaccctttctttttcctgcttcactctctctggatccttagattcgatccatttttgcatcttaaccgttttcttattctgagaatcaacaagagcagttaataaacgatgtgatttcgaagacaaggaagatggcatgaatctcattttccgtaagagccttccttgtgattgaaggactccctgcattataattcaaaattatatcaggttagtgacacctatgcagtaagagcatgaatgaacagaggtggtagcaaacattgttgaattgcagataagaagtactttaccttcccattcctcagaaacagatgggactgatcatgatgtgcttcatgaacagatatatcaagaacttcattgccaatcagcagctgcatggtcccatctttccattttacaatgcgcgcattactttcacactgcaacaatgctcatatatcatatggatagccacatagtgcaccaaccacctgttgtcacaaactacttaaaagacaatgacagaaaaaaaggaggaagaagaaacggagcaagcatcttatggtatatataatggcattttttttgcagggaaatacataacagttgggcaagttgactagtatgagagaagactcagtgcaagcatcaccaagggctagtttacaaactagattatagtaagaaagttaagaagcttcccacagcatcttcagggaggggaatttagaagatggcaacgtagcataactgagtctgcaatgctaaagaatttcaaaatgctacttgaaaaacattccacttacagatgtagtgccattagcattcttaacggttctccaccgcacaatattgtcctccagtcgtatcctttttttggtcccagattcatctgtaacaaatacatcctcctccacatatgttttaggatcaaaaggctttgggtcaatccccataatatttgataccttgatcacattcatctacaagttaagaaattagtcagtaacaaataaccatatgaatagctgcaaaagcacaaaaacatttaagcatcgatcataacattcctagtaaagcctacagaacaagacagcaaaattctcttcaataataccatggcataaaaagaaatttcaactaccaaagtgccaatgtcacataagagttaatagcaacacaggttctttatttcttacattgtgctgtaccagtcaattgtgcagttctgcacaacaacatttacgcacaagcacagaacatcagcaattaaacagtaacagatacaaagaattaataataaaaaatctggtgcatatgcagcaacgcaataaatatccatcaaagataactgatgtctgccaatatataatcatcttggcagaaaagataacagtgctgtatggtcaaagactgaaagatagatggttaaaaaggggtagtcaactcactctctcgggttgagctggtggctgcttaagtggaaccaccaggttcagcggtggaccaactggtttctcttttggtttcagttcacgattttcatctgattcatatctcatatcttcatcagccactacatcgtcgggctgcaaatccttctcatagtgaccttcatcttccatgggtgatctctgaaaaagaaaaggagggaaatttgagtacctattgcatccagaaaaagttaacaggtaataggtgtgaaagttgatcaatactgactggagcacaaatcaatattcatgcagggtacatacaagaaatgaatagggagaaagatttttagataaatacacaattagcaaagagccaaagatgctacctgcattaataaatttgttacatagttaagcatcaaatggtaactctgaatttaaaagaagatgaaacacaaaattatctaagtattgaattacatgaatacttgtgctgatattcagtttaaacaacatgccaccaagtcatcgatagcatactgtacttgctcagtgcagaatgtattaaaaaaatggctctgtttagaacttccgtgaaaatctttgctggttttctttaagcctgacgaaagatattcctactttaaacctagaatggtaggtaatttgagcataaaaatctcacatgggaatcttcatcaatttcttgttgatcacgatatggagcaggttcatcttcatcgctttcaccaaatacatcacggacaacttcctgatctctctcctcctcaactggcgagctgcataagattatggttcttacgagttactacttactacaaaggtagggaggatatacataggcaaagaatgcatattgagtcactagcaaaatactaagacagtcaatcaatcagtggatagattgttatgtcgtaatgtcagatctggaaagcatataatgcacagataataaataggatcctggttttatttcccccttaaccttgatgctttccttgtttgacgaggttcctcatcttcatgagctcgaccagcataatagtcatcttcagacccctcagattcagaggcaacaactcctcttcttctgctagctactggccgctgttgataggcttcatcttcactatccatgcctgctgcatcattttgcatcacccggtcactaagttctcctggggagctctggaccttttccccatcactttctccttgatcaagatcagcacgatgagcttcagcttcactttcttcttccatcccaacttgcccctcactttcaccttctccttccgcttcaccttcccctccattatcagcctcaccttccacttcttcctggacaagcaaatcaagcagcaagcatcacatcagacagctgcagcagaagtatacagcatgcattggcgaagaactcgggcacaagaaaaacctacaagagctaaactctatggcaaggaatggttggatttttacaccgtgataggtccaaaatgtctccaaatcacttgctacagctgcccactaaaaacttcaatactacttttggtctacaaagtagaattttctactagcaaggttatctctcagaaatttcaaacaggtgattggggatcaacgaagcacaaatctactggttcatcaaactgctgtatcccaatcgcgagattaaacctaagccctagccagccccaggaagcaggggaggggagattgaggttcggattgtatattgtttaccgagtggtagccggagcgggcgtgggcgtcgtcgtcgtcgtcgtcatccaccacctggtggcgaagctgctgctgctgctgatgcggatgcgggtggtcgtcctcgtcgacgaaatcgacggcctcgtcgtcgtcctcctcctcctcctccgactggtcgccgaagagattctgcatcatctggttcctcgtctcctcctcgacatccctctccctgtcgccgcccgccatcgccgctggttgagcgagctcggagcaccgaacggcgacggaccggaccggaccggcgcgtggagaggagcggcggcgcggcctgtctcagcgtcggcggcgagaagacggccgcggcgcggtggcgcaaggggagccgccgggaaccctagcctcccagcagttcgtgagactaaaatcggatgaataggattccagcggtaattttgtcaagtctactgaaaaatatgactaaaattcttctaatttagtgaaaaatgatgtgggtgaattagagagggttggttggttctagttgagagtagtatttgggtgaatccaaattgtataatggtattatagcgaagcttcattttgacgatggcataatgtccattttctcctattctacggtgagggatcgatggtggtggatcgtgttgtaatatgtgaaatttaagggtcctttttgcaaaagtgcctagtccctaccgccctgtccgatgtcgtcccttcctcgtcgtcgctggatggggacaaggagctcggtggtggcgacgatctcagacggcggtgcaaatccagcccaccgccctttccgtcgacttcctccggcgattctcaagccacctcttcgtcggccacaacccgtctgcttccgtgcctcccctctccaatccatccacctccctccatgccgatgcgctcgacccgatgggctgtcggtcaagcttggcacaaagtggaaggaccgggcaccagctggaagcctcttgagtcttgattgtttgatggcggacgaccactacgacatagccccgcagctattacacctcaaccaacctctttccgccgaatccgccgtctcaaggtgctctggatgatgatgcacgtttcgtcgccgcgatggtagcccggagcctgctgttctacaagtttcgtgcaggggctcatggacagggggagtcagggaccccgctcgtcttcgtgcagaatctttaggctgctgctcggtcatgccatgtagccgaggtgctcgaagaattgcctatacggagaagccgcacacgcccacggctgtggtcgctcctctatgtttcggctggagattatcgaccactgctccgatgtatcggagtatctcgacttctgtggatcaaccgtgctgcatactgctgaa

SEQ ID NO: 33875 - DNA, 1274 bp, Oryza sativa
aagatacaagttactctcggtgatggtagcgcacatgagatgaaagatcctcaagaactgcatgatcaacataccatcaacatccaaggctgccgtcgacatcttcgccaagttcctcattgaaagagaaaaggtcaacaacaatggcgatgaagagagatatccatctgctatcctctattcaattagagtacttactatggctggagaagttgagatgaaattaatggcgactgacattgcccgcatatgtgttattcttcaattagtctaatctatagcctagtattgcagctgagatattatcatttctgtaggaacaaattatactttagtttgtagcaaattcctcaagtaatctaatcgagactaaattggaactgggatgatactgctgtaggaacagaattatgctttagtttgcagctgatccttttttaggaacaaattatgccaaagtttgcatgtttcgtctctcacccagcatatgtggtataatatgcatctagcagtctcttaccctattactgtatggtctactggaagtaattgcatgttaaatcttatattttggaattgcaattgcatactaattttttttatctggcattacatttatttttttggaattgttgtgattacaattgagttgtgtggtggattagaatcgagaattgtgtgttggcatgtatccacatgttggtcactgctacgagcattgcagatctgaaatttgaagctgatatgatgaataacgacgagagctgagactaaggacctgtttggagagagcttctagctgctgcagcttctcccagaattagaagctccctcaaacatttcatttttttattcagattccgagaagatatagtcgtaaaatccagaaaataaaatagaaccaaaaattgaaaaactcagtttttccagattctcagaagctggctacaatctccgagcttttgatgatgaagatagaactcgagaaagtgttcatagatgattactcgtttgtcagctgataatttaattgtgatgatttactcagcttgtttgcagtgctgtgatttacttacatatgctagtgaaaacatataaattggcgaagtttgaccaggagcactaaagtttcattgggttttcagttttcacttcattattttgccgtttctctttgaccaaggtcaaccgaactgcggttgagcgaggcggtctccattcccaccgtccgattacgacacgtggcgcgatcccagcggcctaaacccttccac

SEQ ID NO: 33876 - DNA, 1333 bp, Oryza sativa
catcttgaaacaaacattacatgacattataaactattttctttctttatcttttaccacactagataatgcaatacttaagtcattttggtgaaccacatgcttcactaaccataccattgtcgtcttgatgccacaatttgtatagtatatggcttcaagtttgttcatgcattatatgcttactgcaccatgtgttttgaacctcatattcatctttcttcctatagacgacagccttgaaaaatggttcatttcgccatgatctccactactggcttggaaaggatactagtcaggtagactctcaaataatctggcagcacctcacttgacttagctctcccaagctaactattaatacacaaatgcctaatatttgaaaggacgaagctggaactgctgcaattctaactgtggagcttgatgctgcccttggagggcgtgctgtccagtacagggaagtacaaggcggtgaaactgaaaagcttctctcctattttagaccatgcatcatgccacagccaggaggggtagcttctgggttcaatcatgtagaggtcaatcagcaagatcatgttacccgcttatatgtgtgccaaggaaagcatgttgttcatgttaaagaggtaatctattgaagttgatcactgcctttgtttatgcaaaggcttgctgggttttttattcttatgctgcttgtcatacaaaccaggttccttttgttcgttcatcccttaatcacgaggacatattcattttggataccgcgaccaaaatttccagttcaatgggctctaactcatgcattcaagagagagcaaaagctcttgaagttgtgcaatatatcaaagatactttccatgagggcaagtgcgaagttgcagctgttggtaagctttttgttttttgtttatgtgcttttgctttgaatattcaaagtcacatttaaagcatttgacaatctggattcctctcatagaggatggaaagttgatggccgatactgaagctggtgaattttggggtttgtttggtggttttgctcctctcccaaagaagacatcttcagaggacaatggggatgataaggaaactgtgaccaaattgctatggtaatactcaagtcaaatcactatcaatattccaatacccgcatcaagaaagtgttagttttgaatgagaataatttgcagtcaaatgatgctattttgagatcaattctcttaaaatttatgaaactgaattagtgatttctattacttcctcccagttttaaccaaggaacgctggagcatattagttttgaatctttggagcatgagttacttga

SEQ ID NO: 33877 - DNA, 1264 bp, Oryza sativa
acatgagggttacaaaatagacttattcccaatccggttgatccacaggcaaaacgacgccatcaggcccaaaactggggccttctccggcccgattagctaggctggccgtagtgctgtaagtaggcctattaagccaggcccagttactcctactcgcctcgacgccgcctgctcgcttcggcgcggcggcgccccacctcccctcctccgacacgacggcgcggcgcccttctgcggtcgacgcctccgtcctccaccctccctctcctccatcttcccgccatcctcaactacaagacgacactgcggtggcgatcgcatcgatccctctacctcatcacgacccggcgggggcgaccgagcggcggcggcggcagcggcgacggcggccggatcatgggactaggaagggaggtgtggggggtggttccgccccggcgaccgaggtcgaagcggcgctgttctgagcaggtgacccaagaacgtacgcccattttcttgaactcggtcaaaagaaaggtgccgattatattggttaaatctagccttgatttctttaattcgaactccgttgtggcacgcaagatgtgtggtctgaatgtgtatgtaatgcggctcagttacttgttttgtttggacgatgcttaatgagcttaaggattacgctagctgtttactggtaataattaccttgccaggttcttttagtatattttaatttcgctttcatgcatataggtcattaactgcgcaaataattaggttcatggatgatacctttgtggacgcaagtagttcaaggacaatggacatataagctctgggactgggagttggagccattgtctaagtgatgcttttagaagatctactcaagcagatatatggctatcacgtcacgtgcagagattcttccaaatgtgctaatgaattagcatttcacttcatagaagcactgacaaagaatctttaactctttcacaagatagactggtacaacatggatgtatttactttcaagaagagcaaattactgaatgttaacagttcatatcctagatatgatgcatgctttgacataacagggataatatggcgacatgataaaattgattaatttcaagctgaagcttttgcagtgtgctttcatggatcatgctctactttaaataatggaacgctttgctccagccagtacaagatagcacaacccatctttggttgtttcacttgtacatatagctctttgctatcttgcaaa

SEQ ID NO: 33878 - DNA, 557 bp, Oryza sativa
aaaaacacttcccataccagcatgtatctgactggaaggaattgcattagttgagtttacctgagtctcatcagcagtttgaggtagagccactcctgactgcattcctcccgtagataaaattggtgccactgatgaaaatccagggggaactaatggtgcaatcaaagcccctgtcccagtagcagcctgtgctcctgcagatacacttgcaccagccatagcctgggtccctgcagatccacctgcaccagccgtcccactagtactcgcaccagcagagtgaaatccaggtagagctgtgcaaatactcttcaaaaggtccttgatttctcccatctcacctctcagattactcagatctgtcatctcccgcctaagctgcaggatctcagctctagcgtcaaatccatccacactatccaaactgttaacggacctggtgcgagccggcatgttcactgacaacgaaattcggcttgagggttatctccaagattcaccctctcccctttttgatctcgtcgtcgcaggtctaccgccgcctgagtcaggtc

SEQ ID NO: 33879 - DNA, 583 bp, Oryza sativa
tacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggctccagtaccgaagatcccggctgcaaatcctgctggacaaggaccatcagtttcgtacaagtatttaacagtagtaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagccaaaacaaaaatgaactaatatctgggctgaactgtaccgtgcgaaaccggtgctgtaggtcgcactgctccgaagctaggggcgctcgaaggcaaacgaggtcctacgaggatggaacatcaagttacgacggggtgatgttttcgtagaaaa

SEQ ID NO: 33880 - DNA, 480 bp, Oryza sativa
ttttttaatcgtcaccaaaattttcgggtccgccaatccgtttacgccacgctgcgtgagtaactttcctattttttacgttttcgtccacaagtgacgccctccgcccaagtgacgccctccgccctcgcatgtatcacacgacgaacaaagaacaaaatcgctcaatccgaaatcggaaacaaaatccaaatcaaaacccaatcactaccctactacaaaaatagacattattgccggttgggaaccggtctttggtggtgatatgatttgcaaaagaaaaaaaaagcaggcttggctcaaacgctccaaatccatcgaaaataaattgaaaagagagaaaaagaatcacaaagttcataaaacaaatggatgatttcaacaaaacaaatcacataatatacacattaaataatcgatcacacatcacataatcaatattacaaaatttatcacacgggatttggaaattcaagacca

SEQ ID NO: 33881 - DNA, 692 bp, Oryza sativa
tatggactctatactctacttctaatattccttatttttaattccgaatttcagttatttcctaattgtatttctatatggactctattctctacttctaatattccttatttttaattccgaatttcagttatttcctaattgtatttctatattgactctatactctacttctaatattccttatttttaattctgaatttcagttatttcataattgtatttctatatggactctagtctcctcttctaatattccttattttttaattccgaatttcaactatttctaaattgtatttctatatggactctgtattttctttttctctaattaatgtgagaaattctagaccatgagagcgaacgtggaggctcttttttctattcctttaataatataataaataaatgcttcatgtatatatctaaagattcgatgtgatatttttagaaaactaaaccaggcctgactttgcattgactgcaaacttggatcgacgactcgatctcacaatcacgcctgcagcatgacggtaacatgtttttagccctgtgctgcagttaaaaaaagaagggcacgcgagagccatgagctgcaccgagcgtgcaaaagcatgtggaagtgtacgcgttgcacggcgtccatcagtttccacgcagcctgaaattctgtggtggttgttccgttc

SEQ ID NO: 33882 - DNA, 439 bp, Oryza sativa
aacttacatcagtaattttgtgctttcaggcaatttcagaagagaactaaagattaaggaggagaaggtcgtggatataccagctgtaatgcccacgataatctagtaggtacaacaaaaaaaagaactggccctaataagcattttcaggcaacgcgatattagattctccatgtttacagctaagcaaacaaattagagtaagtttcaggcattcaagttgtttctccattttcaggcacaagcaacattagcttctcaaatttcatgctaatcgatgataatttcaagttggtccgaaaagttcctttaaacagcaaattctagaactacgctaatggatgataatttcaagttggtctgaagatgacgacatcaacagttcccttaataaacagctaagttcagaaatacgctaatggatgataatttcaagttg

SEQ ID NO: 33883 - DNA, 894 bp, Oryza sativa
tttcactagctagcaagatgtttcaggctgcaaaattccaggctgcccaggtaacctgtccattgtccatatatgacatattacatcacattatcactctaattcattggtgcttccatgcaggctcgcctctatgaagggaaagaaccgattcaatttttcgtcatatttcagagtcttcaagtttttaaggtttttcttctactcagtagataagtcaatatccttgagtggatctgacagagtgactgttagatatatataacaatttgacacttaatccctctccccctcacaccggctttctaatgtagggtggacttagctctggatacaagaactttattgctgtaaatggtaccgatgacgacacttacgttgaaggtgggcttgctctcttccggattcaaggctcaggatcagaaaacatgcaagcaattcaagttgatgcagtaagtgcaaaggcatctgtttggtccagacatatgcgagagcgtaattcttatattgttatcaatggtttcatctctatgatccttttttactaggtgtcttcgtcattaaattcatcctactgctacattctacacaatggaaacactgtgttcacatggactgggaaccttacaacctcactggataatgacttggttgagagacagctagatgtaattaaggtgtgaatcacttattgcggaaaatattaatctttatacccatgcagttttcctgacacttggtatgctcctatacatttaaatccttgattgaaatcttacagtaggttttcatattaattagcaaaatgcagtttgaatatcgtagaaaagaagagaaggctatatagttgatcatgatgcgaccagattataaccatgtagatttattagatac

SEQ ID NO: 33884 - DNA, 107 bp, Oryza sativa
cactttccaagttcaagttaattgtcaatgaaaggcttaaatggatgtatagaactcaatgcatgtgaaagggcatggaataattttcgcgtctcaaatgaataaca

SEQ ID NO: 33885 - DNA, 590 bp, Oryza sativa
taggccggtggatgccctaacggctcttgccgttgccgcagtggccggaaatggaacgcagatgcgcttcgcgttactcgctttccgcttgctgcgcgcagcgcgagaaaaaagcacacgaccagaattccacaaaaccgtgtcccactctcagtctccccaccttttgtcgtgtctccccatcttcacttgttttctcgccaaatcctacgtgagtcgctctctcgagcagtcgagcgcgcacagggcgccccgctgtcctccgcgcatcgccagcccacgcccccgcgaacctgacacgaacatgcgcctcgccactgcagcctgcactgtactacacccctcatcctcctcgatcaattcgtacacactctcccaaccacctccgtcaccctcacgcttaactcctaccccacgcccagcaaaaacatcgtctatggctgtgtttagttggggaaaaggaaatttttgggtgtcacatcagacgtttgaccggatgtcagaaggggttttcggacacgaatgaaaaaactaatttcagaactcgcctggaaaccgcgagacgaatcttttgagcctacttaagccgt

SEQ ID NO: 33886 - DNA, 402 bp, Oryza sativa
aggctgtcacaaatggcatatacgagtactaagttagtgctttcttccaagtaatttctaactttatctagatatacgggtgtatatccaaatacatgacagattgacagccagcaaagtaaatgatgtgttcagcaattctgtacaacaccagcaaccacagggaccctgtctggttgtttgcagcaccgaaaatgtggacatgcttgtaacatccaaatactacatgcaaaaagaacttgggtatattcatgtgaagttgtgaacaaacgaacaaaaatgtttgaaaaatacccttcaaagttcagaccaataggtccttttgcaggatgcctttgaaactttagctgttagtagtccaagcagttttacttcacaagtttagcgcaccggtttgagtta

SEQ ID NO: 33887 - DNA, 484 bp, Oryza sativa
gaaaggttataatttgttacgaagaaatgttggtagataaattgtcatatttttaaacaaattctaaatgctataatttattatattttataacaaagggtttagctctttcgtctgtacgcttctcccttcacagttcatgcatcggcattgagaacgtgatttctctaaaaccaatgtacaaaatgggtacaaacggtcaaaacaacctatggcagaggcagttcatctcaaccaaaaaaaaaggtcgacatggtagtactagcaatctactcccccgtcctaaaataaatgtagttatgtactatttatgtcttgactgttcatcttatttgaaaaaaaattataattagtatttttattgttattagatgataaaatatgaatattacttattgtgtgactattttttttcaattttttcataaaatttttaaataagatgatcggtcaaacgtgtccttacggctacacttattattgg

SEQ ID NO: 33888 - DNA, 697 bp, Oryza sativa
ccctaaactctttcatgcttattttataatctgagctattttgtactgaaattttgatagaatacatatgcatttagaacttacgtctagtcctctcttttttttttgaaaattttgaactattagcgtagttcgaaagcactaaagactaatttaacatcaaaaatttaaaatttaaagttcaaacaaacatccatggaaaattttgaaaatattcttgaactttaataatgatgtcatatatggcttaaaaataacagttttaaatacagcttgtataaagaataaaaaaataaatgttatttaaacattaaagtgaacgatttttattagtttaggggtaaaatgagccaaaaaaaaatagttcacgggttaactgatccattgaattagttcggataagtaaaatggatttattttcattaggggaagtaaaatgaatttattttcattataatacaatggattatttattgtcacattgactatgggtaatagaatatcttgtatatttcatcaccgattaagatcaatttttaccagagttggattagaaattagcttaaacgtatcttcgggataaaaggggacagcacgcaaatcagaacgcaacatgttccggccggagaaacgcagaccactcgacagtcgcacacgcgcagccgacgtaactaaccaccttaccaaacgggacgat

SEQ ID NO: 33889 - DNA, 761 bp, Oryza sativa
cagtatatactacttccaccgtttcatattataaaactttctagcgttgtccatgttcatatatatatatatatagtaaatttgtttggtgctccatggtgcccgggcaccattgttgaaattgagtatataaccaattcaaatgagtatgaaactttttcaattatttaggtattaacattaactactttactaactagttcaaagcaagtttgaactgaatttgaacttgtttttgttagattttgattctaggtatatagcatccatacatataattagttaggtatgtaaacatgaattgtgaaataaagttaaatttgagttgttttgttgatagatatatgtatgaatcgaattcttataactaggtatatactcacaatttaaaaattttgaaaaatttgagtaattttgtgcatttgaaaccatggtgcccgggcaccatggtgccccatatgagtgtcatatatatatatatatatatatatatatatatatatatatatatatatatatatatatatatatatatatatatatatatatgttaatgaatctagacatatatgcgtgtctatatttattaacatttatatcaatgttggtaatgctagaaagtcttctaatctgaaacggagcagtagtagtagcaacactactctagcacgcacgcatacacacctcatccccgcctccggcgactacgactcagctgctgtggcgccgccgggagtgacgacgatgttgagctgctgctg

SEQ ID NO: 33890 - DNA, 624 bp, Oryza sativa
cagctgtttttctccttcattggtactccaatcttggctggaattttgaatcttttgtccggaaagtgataaaatttagaaagacaacacaaccattggcacttcttacagttgtgagcgctaagctgagcctccaatggcgtggcattttactgcggctttcatgatcgcaacctgtttgatgttattcccaagaagcgagcagtcctcgcagggtgaggtgctgcagcagctaaggaagcagctggagtacccaaggcagctggatgtatggaataacccaaacagtgacccctgctacacccagcctacttcggtggtcaccgtggcatgcgaggggaacgccattacagagcttaagattatcggtgacaggatcaccaagccaccaaagttcagtggctatcctgtctccaatatcaccctctctgaagcctttgttctcgattcgtttgttactacattggcaaggttacctgccttgcacgttgttatcctagtatccttggggctatggggtcctcttcctgacaagattcaccggctgtcatctcttcaagtgcttgatttgagctccaatttcctttatggatcgattacctccgaagctgtcagccatgccaa

SEQ ID NO: 33891 - DNA, 748 bp, Oryza sativa
ccttattgaacgttgtcggtgtggtgcgcacggcccatagatcagaggggagttcttcgacccacttcttgtcgtgtgacatgaatctgtcgtagactcgggtcttgatcccttgtagtactatgctgtttgcccttttgacctgtccattgctctgagggtgagaaaccgaggcaaaacaaatcttgactcccaatccaatgcagtaatcctggaagtcggcattgatgaactgggagccattgtctattatgatgcggtgaggcaatctgtatctgcagaatatcctttgataaacttgatggcgtcgtcagccttgatttcccccgtgggcatcgcttcaatccacttggtgaacttgtcgatcgccacgaaaaggaacttgtagccgccctgtcctcgtgggaatggtccgagtatgtcgagcccccaacacaagaacggccatgtaagagggatagtctggagcgcttgtgccggtagtcttgtgtgtttgctatgaaattgaaaggcttcacaccgctgaaccatgtcgcaagcgtctttacgcgcggttggccagaaaaaaccttgtcggaaagcttttcctaccaacgtccgaccggcggcgtgtgacccgcacatccctttatgtatgttgaggaggagatgtttgccgtcatcgaacgagatgcatttgagaagtaccccttttggcacctttttgtacagatcgttgccgatcatacaatagatcttggcttgtcgg

SEQ ID NO: 33892 - DNA, 244 bp, Oryza sativa
accttatatattgcttagataccttgtttgtgaccttttgattcatatacattttgtttgttcaagctacaagttcatagctagcgttttattcctttaggaggagcccttggaggtcgtcgccgactgcctcctccaccttggcggtgttcgtctccacgcccttcccaaccccatttagaaccccaccatgcagaccttggctgcgcgcacaaatcaggcctcaaaatccaatcaatcacca

SEQ ID NO: 33893 - DNA, 1280 bp, Oryza sativa
gaggacttctcggatgaaaccagctttgagaagcttgtcgagctcttctcatatggctcatttccgatctgatgcgaatctccgcagtttttcctttactagcttggcatcggggtcgcaccatgagtttgtgctcaatcacctccctggggacccccggcatgtcggacagctgccaagcaaacacgtctgcattgtcgcggaggaaggtgatgagcgcgagttcctatttctcatccagtgacgccccgatcttaacagccttatcggggttggcactggagagcagaacgatcttgattgcgctgtctggcttcgacgtcttgttggttttgttcactttcttgggtggctcagctatggcgggcgggttgggagcatgctcgaccatgtcgaggctccatttgtcgcactgcaccgccagcttcgcgttttcctgaatagtgattgttctcttcggcccaggcatcttgagcacttgatacgcatagtgagatgcggccatgaacttcgcgagtgcagtcctcccgatgatggcattatatgttgtgtcaaactcaacgacatcaaaggcgatctgctccgttcggaagttgtttgctggccaaaagtcacaggtagcgtaatcttgcccagggctggacgatgagtgaggagtaattccgggaagggttgatcaggggcgtcaactcacttcgggggtccccatcgcgtccaaggtgctggtgaagagtaggttaatggagttgcctccgtcgatgagaacccgtgcggaataaatgtgcttagggacgtcctagggttgccctagggcgcacaccccttgggctaagcccacgacacaattacaaggcccaaaactcaaaatcagattcggactagatgagatatgtgtcttgttttgctgattgtcggcagctcggtaggaattttgacatgggaccaaaaccatatgaaagtagacttcataatctttccaacaagtgctcatgggcctctaaattccttctagatcagcggctagatccgtttgaagttgatgctatcaggaggcccgaatccgaatccaaaacgtgtacaacttgatctcttgtcttctatgggctaaaagtgacatggtgagatgaaagaagacttggagaaggtcttggtttggtccccaatcaatttcttcaatcatccatgcattccttacgctcagtctcttttctttcacccaagcaagtacctctgcaaacgaaaacacacaaaacttattgtgttgcaacatttgtgcaaac

SEQ ID NO: 33894 - DNA, 1667 bp, Oryza sativa
gattccattcttcatcctttcaagattatcttcgaaaatttcagtaaaactcataggtaccaatttcattttccgaccattatgtttaaatgtgtatgtattagcaacaaaattatgcgatccattattatcatatacccatggttgacctaacaacaaagaacatgcttgcatagggacaagatcaaaattggcagtatcatggtaatttccaatcgaaaagtttattctcacaattctatttaccttgaacttaccacaagagttgaaccatttgatgtaatatggatgaggatgcggttgtgtaggcaactcaagtttctcaaccaaatctgaactcaccaagttattgcaactctcactatcgattatagtacgacatgctctatccttaaccacaaactttgtttcaaataattcatggtactgccattgctccgctttctccatttgagaacttagcaaggtaaatctaatatagaacatatgcacttttggttgattaatacataaagtagccatggttatatccgagttagttgtgtcctcatcacttctccaacgccagttgcttcgtgagtgcctttttgaagacgaaacaagtctcgagagagtgcttgtccgactcgtgtatcgggcaccatatttgcttcgtgtcgtcaccttgtgggtctaggtgcttgggtgggtcagcatattctgctgtgaggacctctgtttgagctttccttttcctactcctgcgactcttcctcttgcttgcctcaggtgcatccttggctggtttcttctctccccctgtcttcggcttgtcgttcttgcgtctcagggcgtcgtccgcgtgagtgcattgatcgacaatctcgaataacttacgagcagtcgtgatccatcttgtcgccaactcctgggtagtgtagcgatctcgaacatcagacttgaaagcgcggattacggaagcatcggtgatctcggggatcgtatttctgcactcattaaagcgccgaatatagtccctcaatgattcgcccggattctgcttcaacgcgtgtaggtcgtcttcgatcgcgtggcgcttgtatgttccttggaagttagcaacgaactgctgccacagatctgtccatgaagaaatcaagtagggtgggaggtgaaccagccatgaacgtgtagatcccttcaacgccgccggcaaataatttgccaatgcgttgtcgtctactccggcagcatagagtactgtggaatagacctgaagaaactcctcagggtcggtgcttctgtcgtatttctctattgttcctagtcgaaatttctcaggccatctaacctctcgcagaaaacgagtgaaagctctgcacccgccgctaggggcggtgggttgtcggtgatcatgtgctcgtcgtggatgcctgttcgatgatgaagatgatgaagatgacgaggatgatgacgagtcactcggcttcggagtgcgattacgaggatgacgctcaggttcttgagaaccttgtcatcgcccaccgttgttgtcccggcgctgatctccatcgtcgtcgtcattacggcgtcgtcctcgactggtatcgcccggcatctgttgctcgcgattagtgcgttcgcgacggttgtggcgatcatcacggtctcggttctcgctcggatgc

SEQ ID NO: 33895 - DNA, 1012 bp, Oryza sativa
ttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccgaggcgtggtgaactccgggggggaatcggcaaaaacccacaatcgggtcacccataaccctcggtcaccacgttcccggcctggccagtctcgacatgtggatctccccaggcactagccccgacccgcgccttttgaggaccagaacctgggcacaaacccttattcaagctaagacacaaaaggaccacggcacagatcatcctcatctcatactcacagcaagatgaaattaacacaaaaatttcttcatttttgattacagattaagttgatatatacaaaaaagaggcccgaaggccttagaagaaagaaaagaagaaaaaactaaagaatggcgggggtctgggggctcaatccgatgcgcccggatcgccggcctcgacgtcactgtcgtctgcaccaccggcattgccctcctcgtcggagttgggggcgaacgcaagccgaggggccgagccctcgaagctgtcaacgatatggtcggcggcatcccggacctacgcgcgcgcgcggtcctcggtcccaggagggaactcatccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcgctgggcgaggcctccctggttggcggcgtactttacggtccgccctctccagaggcccacttgccgaccggcgcaatctaggcgggagatggcgtcccaaagcatgccaggccctacctcgcctgccaagcggagggcttcgacctccccggcggacgagtccagcgcgccctgc

SEQ ID NO: 33896 - DNA, 3507 bp, Oryza sativa
ctgacaacgaggacccccttgcaatgaaatgtaacacaccaggtgtcaagtgaaaaatggatctagcctcttatctgttgttggataacttcgttctatatgtatattctcatattggaacacactcttttggttatttgtttcaataaaaaaaatgccgtttttcttcttccttgtcgcagtatgcctatgttggtttattaaatgagttaataaaatttaataaatttataacaatacttttcatgattaatctaccttttttatgttttcaaactaagtatttataaagatctattaatattcactagtgcggatctgtatcaggcgtgaatcctcatctgtggtggcggacggtctggtcacggatgcggacggtctggtcacggattagtgatcagttatgtgaaaactcatctttatcgggagagctaccgtcaccgataaggcttgatcacctttctcggggtaccgtcacagataactaatcggtgacggtttcttgtttagaaacgacaaagttgttcgccgtcgtgactcgtgacatgattttttttctaacctgacaccgatgagtttatttataaaaaaaaatagatccattttattggctagtgttaggcatttgctagccatgcttgctgcaattaacagaaacatagatatatactagaaaggagagcgcggcgcacgccgcgcgatagcaaatagttctgcataaaatggttagatagtagataatattttgataaatacggtctacatttgtttaataaacagagtacaataaagtataagtagtccttgtgaatccattaggtggcttaatagaagacaacacaccaacaaagatgaacaataaaaaagtgaattgggctataattttcatcaacaaaaaggacaaacactttcaaatgggtcatttagtggatgctatgattggcattcttctccaccataaaggactacaagtggaaagagctcattacaaaccacaattctgtctgcaaacatcttcaaaccagttcagcgcagctgcaagatgcaaatggttcgctattcaagcgtgtaaacatgttttatctttcagaaggtcactgaaacatagggcatacgtgagttagaacaaaacagatgattgcttaataccttaggaggcataatatatccatttcaacttttctttcgattacctgcatgctcagtattcaacatgtcttcccaagcacttttacattttgtctgcaggattatccaagaatatgaattagaaatgaagattgctttataatcgatgaacagtttcagataacaatggtcgatagcatttgttctgaaatcacaacattgtaccaagaaatcaccagtttcggctgaccatttctgccaccagtagttgtgacaattatgtggccggtttctgctcccttgccgttaatattagtcacttgaacttcctgtatttaccatttagcttaacatgttacaatgaagtcaaattcacatggcacatagaagaaattgcacttctcgtcataataaaacttacattgtcatcccttatcttcagatcatgcatctgatcaggcaacttctcagcacccattgtggtgaagctgctgttctttaacccagatagcgcagcccctattgaagccatctgttataaaagctaaacaatgttgagtcagctttgcatccacacagaattccgcaatgcatctatcagtcgacctgcgagatcgtcaacaacaaaacatcagttaaaagtgaaaccgcaaggtttacaatgcaagcagcaaacgagaaggattactccttcacactgctagcaactcggtgcatctaacacgcattgttaatacgagtatatgaccaccagcatgaaacactcatgggagagctatatgtgcattggctacagagaccatactgcttgcagcagtcaactgacttggtgtttgtaagtttcatgagcagaagagttggatcagagactcggagtattattcctgcatggttcaggaaatgatcaaatggaatctttttattatgtcaaaatggcaatacatatacaacacaacaatttgctaagtacatataattaatgaatagaacgaaataatcggaaagattaactttttttccctaaggagaaaaacagagagcaagtgacatgaacgatccccactacctatttaccttatcttgtactcctatttggttgtcattatgatgctggcagctccattcatgaagatccacgagctgagtatagtgggttgcccctcccaacattaacatgagtaatgaagggaatctattccttgaatattgagctaggatcttcggcctaacaagaacgactaagacgacattagccacaaatcataagcatctcagatgaaagaactttttttttgctaactcctcttcaggggaaaactaaatatttaccgttaaaacataaacagctacttgcacagagcctgtaaaactgcaattgccttaaattgtgccatatttgttattcatgtatacaaagagaagaacacagggagactatagtagcagttcgtaatggcattgcatatatacactcacgtgtcatataaatttaatacatatagaattatagacagcatcacagaatgaacacatctaaaattcctcatgattctgtgttgacaaaacagaacgaaactaacctgctgtagatatatatgttgtaccgatccatgaatacctcttgttataggtaatttgggaatgctaggattgattttgatagatcaactatctagtaaaccatagaacaatacatcaactccatagaacatagaaatagaaagaaagataattcttgtacgcaacatgccatgttaattctggaaggcaacaatggtgagaaagcctaattttgtagggaattttttttacatgataagatagaagcaaggaaatattaactattatgcaattactggattgagtagctgatgtatacacatgtcaattacaaacaatggcaatatatagcggaccgtttgcaaggttacacaaaaatatagttgaatttcagaaccatctgtagccatcagacatgcaaagaaccttagggaaaatggcagatcctagaaaatgcaaatagtcgaagccaaatgcttaatggtggggtaaaaagagaaattcctgcagcttacctttttccgttgactttgcctggatgtcttattctgaatggctacataagagcatgaatcagagattgagggaagtagctcaagaagctcctgcgatggccgatggaggcctagtcgacagcgttgacctctagcagctacaggagtggctgttgatgaaggccagacagctagaagccggaggggccagagacgctgagggtctgacatgctggagtggacgcaagcgggatggtggggggactcacctagcatgctgagtcgaggaggtgtcagatccggcaggaggaggctgcagtggagg

SEQ ID NO: 33897 - DNA, 561 bp, Oryza sativa
tccctaacgacgtgcaacttcttgtttgtcgggtaatgtatgtagaaaattttcataacctattttgcaagtacaaatggttcatccatgtatccaaccttgcttagatctatagttgtgaaaccttccttatctacttttactccagtgcgtaaattgacccaatggcaacgaaacaacagtactttgaatttggtactgttcagttcccaggtctgctctatacgactgtagtatgagctagacccaagttgatcaataaaagcatctatatggacctcgctgttttgtactgtactcttgtcatcttgtttgacggtataaaacaatcccatgattgtcattcccacgatctaaaacaactatggcatttcagatccatgctgaatagaccgaaagaacttttatatctttcaagcaggataacatttggattttctcattcttcgataaggtgtggcaagttgaagggaggtacactcttcctgtgtccggattagttgctggtgcgaattcacttcgaatatttatctcctgtaaatctagacacatgtttaatcc

SEQ ID NO: 33898 - DNA, 2915 bp, Oryza sativa
cgccgtgcctatggccgctgccggcgaccataggggcgcgggtgccgcctgccgccgaccgcgccgtcgtggccgcttcgggcgcgccgagtggccgccgcgtggggcccggccgtcagccgcccgtgccctcgagtgaggctgacgcgtggggcccacggctccggccggtgtgagcccgggtgcacccagtccaccgtggaccgtgaggctgccgcgtgggccccacccccgtggacccggtccgcgcgcgctctcccctcggctgacgcaataaatcctttttaaattaaaatttaaatgaagaaattcgcaaatattcacttaaagagcatataaacttcaaatggccataacttggccatttgaactcggaattggaccgttcaagtctctaatttttcctcaagaagtcaagaacccatttttgtactttgttcctgcttgttatatggagtttattagagtaaaatactttttccttttctttggtcgtgtagacgctgtagcttcggaagatccgctctacgtggaggttgaagccgacgtttggaaaagcgagcaaggcaagtcacatcatccttgagcatattgaatcccagtttataaaattattttgatttaaattaatgcattatcgctttatttaaattcccgcgttatcactgttttatttagccatgcctatttacctttgttatgaccttattattaccttgttcaccctaggaaaataaaaccccaactagtgggtactctatttatggttccactagtatgaacttaggtagatgcttcgctggttaattaggcaacattaggtggttttataactttagactttgggaattctcatatcacttagacactatggaatggttggattatggtggaattggacacatacctccccctctattcaaaacccccaaaatggttttaggctgggctcgaggtgcgtggttgggttttgtttgtcgtaccttgggtactataaggattaagctcgtgcctctgttgcaaagcactaccgtacttccacatgtctagtgggtaaggcttagtttgtggctcagtctggttataaacaaaagtacacggatggagatggatgaagtcgggggtcgatggacatctctagggcaaatgaaggctacacgagctgcggcccggtagtcgagatgtcatggcacagggctggtgtcctactgctatgggctcagtcctgcctacctgtcctggaggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtttagttctagaatcgtgtttacaaaatagccctgagcaactaaatatctttaaatgctgtttactgcaaccctaaaccctttatggtataactcctttgtactcccttgcatttattctgcacttgtgggtgtgtcttgttgagtacggtggttgtactcagtcttgctcaatttttcccaaccccagaagaggagttccaggaggatgaaggcttcggtgtctagctcgtgcctgccgtcaagcgcctgtggtcgtcgccctagtcttccgctgtttctcgtttgtctctgtgtgtgctgggccttcgttgcccatgtaataagttatctatttacgcttccgcttgttaaactctgaattgtatcaacttttggtgtaccttgcctcctgggacaaggattaatgcacgcacgtaaggaatgcccgttgggttatttccggtcgtgacaagttggtatcagagcccccttgaccctaggacgagccgtagatcccaagccttagcaatattttcgaaataaaaatcctttgtatttgtgaaaatcctctagtctctctctgtcttgctgcttcatttatcgccaaaatctgacctttaaaatgttgcttttctttttgtttttgtttgtagatggccggcagcgtcacccgtcgtggtttggacatgactggtttcgtcttggagctgcggggcatgtgcgtggccgtggggtatccacacggagtggactaccaggccaggccgcttctggagcaggagggtgacgatgcagagccccacgctgcttgggaggtcactgcagtgatcctcgctggctctcccgagcggacttcgctgacagtcaccgcgggtggagactccttccccgccgcttgccagagcgccgctctcctcgccatcggcactcttcaccagcgctacccggacgagttgcagcactcgccctaccgctaccaccctcgtcgcggaggagcccgcgaccacgccaccttccgggatgctagctcggaggatgacgctaccatcgtgcacttggcgcgcatggtggaggcgtacgacgcggctcgtatcgacttccatcagatggtgcgccgtgggatggtcgagaacaacctgaagatcctggagctgcgtcaagagaacctgcagctcaagaaggacctggacgcagttgaggcgcagctgcatcagctcaagatcgcccagggagagatctgccgccccaagcgtcgccgcgcctgccgcagcctgaagatcaccgcccgcaagagcac

SEQ ID NO: 33899 - DNA, 671 bp, Oryza sativa
taagcgagagattgagttccggatagatcttgctccaggaaccgctcctctgtacaagcgaccctaccgtatggcagcaaatgaactggccgaagttaagaaacagttggaagagctgaaagaaaaggggtatatacgtccgagtacttccccctggggtgctcctgtgatttttgtggagaagaaagacaagacaaagaggatgtgcgttgactacagagctctcaatgaagtcaccatcaaaaacaagtaccctcttccccggatcgatgatctgttcgatcagcttaaaggtgccactgtattctccaagattgatcttcgttccggatatcaccaattacgtattcgcgaagaagatattccgaagaccgcattcaccacgcgatacggactgtatgaattcacagtgatgtcgtacggtttaaccaatgctcctgccttattcatgaacttaatgaacaaagtgttcatggaatacttggataagtttgtggtggttttcattgatgacattctgatatactcacaatcagaggaagaccatcagcaccatctccgtctggtattgggaaagttgcgggaacatcaattgtatgccaaacttagcaagtgtgagttctggttgtccgaagtaaaattcttagggcacgtgatatctgctaaaggag

SEQ ID NO: 33900 - DNA, 1199 bp, Oryza sativa
tccaagaccacacggatcggtggtcttctggacggcaaataggaagacgcgctcgtctccttcctgcgggcaaacgctgacgtcttcgcatggagaccggcggatatgcccggggtccccagggaggtgattgagcgccgtctagccgtgcggccgggcgcaaggccggtccggcagaaagtgcggcggcaggccccggaacgtcaagccttcatccgcgaggaggtggcgcgacttctggaagccggattcatccgtgaggtcatccatccggagtggctggcgaacgcggtggtcgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacgacaatgcccttcgggttaagaatgcaggtcctacttttcaacgtactactcgaatttctttgggtaaccaattaggacgtaatgttgaggcttatgtcgatgacttggttgtaaagacgcgcaaccaggaaatgttactctcagatctagcggaaactcttgagagtctccgctccgcccgcataaaactaaaccccgataagtggggggggctgtgtttcctgcgggcaagcttctagggttcttggtctctgcccgaggcattgcaggccaaccctgagaagatacgggctatagagcggatgcgcccccccagtctatacttagggatgtgcaatgcgtcactcggttgcatggccgccctaagtcggttcatatcgaggctgggagagaaggcgttacctcttatttaagcttctcaaacgctccggaccgtttacctggacggaggaagccgaaaatgccctcacccagttgaaggcgtatctaagctctcccccagttctggtcgccccggagccagacgagcccttgttactctacttagcggcgaccccgcaagtagttagctgcggcgtgggttgctggagcgcgatgagaacaattctcatttcacgcttccccaccctgtgccgacttggcccgggggagagcagggaggagaggct

SEQ ID NO: 33901 - DNA, 999 bp, Oryza sativa
ttgcatgccccaagtaggatccaacacaatcacggccagtgatcacaagaaagtacgaccgaactgcaagtttgagcactccaatcacaccaaaaactattctaactttaggatttgtagagggaccacgaggtggcaactcttccactagactcattgatccatttgtccgatcaactgacaggaacaaatcagcaagaccgtcaactggttcaaatacgtaacggtctgcaaactcccacagccttagtcttgtgtgtagctttggtgaagggcatgcttcagttgcaacactcatcgtgtgatgccctgatagaggaatacatgagtaaatgttaaatcatcagaatgataaatatgggccacagatataaccagtcaagacatgtgatgcccataatatactggaacaatagtaacagatgaatacctgaataatgttatcgtgctcttaaaataaccaataacagtacaagtgtcaggattttcctagtaaggataagcctattgtaatcatagaatacaaacacatgcacattaaactaacatccttaaaaaactaattgggatttgtgggccatggaaccaacatccttcagcatctagaactgttagatagccatggtccgatgatcatatcatatcgcatatagcaagacaaaaagagcatatgagacaagaagccaaacaagtatgacgaaaagggccagggaaggtaccctgccatgtatcctttttatcacaatagatagatagggaaatcaaaccggataactataaatgtcaaataaacaagaaagctattacataagaatgcacagataatataaatgtgaaaagaaaatccataacctgattttaatactcatcacatgatcctgaccttgcatcataaagaatgtacacagttttctatcaatcatgccaacagtgcctaggactcacattttctttttttctacaaaatgctattccatgatttcatataattatgcactg

SEQ ID NO: 33902 - DNA, 2481 bp, Oryza sativa
atttatcgccggctgtgccgccctgggaagataccactgtgatccgaagtatgtttctacctttcaatccttgaggacaaggattgtctcgaggggaaggtaatgtcggaatctggagatgagaaatggactgaatatgttctgaatttatgaatctctgaggatgcttaagccaattgaagagaagaggataaggaaacaattcaggagcggattatgaagatcggacgactggtaatagacgaggcatattagttttgcatctgggagcttgctcgttgtcaggaaccactgtttacatttcattttgtcgcttctctgttttcctctgcttttaagctagctctcgtgtggaaccaagggtagatactgaatgtactataaattgagatgccttatggccaaggaatggatatgaacaaacttatgattatcttttatttcaaagtaacttagcttttgagccttttgtgtcttgcgtcatacactaaatttcatgcagtgggggatggcaagcagcagcggacggacgtgggtgacaacgagccatggtggacaattggagctggatctgaactgagggttgctagacgttgagccggcggcggctagctaggatttttaggattttactcccttgctcttgctccggtacaatatcaatatacagggaggagaaattgggaatttaacttttcctggagtttaatcctaaatggcatatcaattatatacactagtgatagaaagttactttaatacttttcatacaaactatctcatatatacccttaacatacacaatgctagacaactgcagtcttgtttctacgtgtggattgaatagaagccgtgatgcccaaaatatatgaaaccctaaaccatttgcaattttgatcatcatatacatctttgcaacattttctgcaaaacgtttatataaataaataaataaataaataaatgcaatagaacaaatcaattcctgatgttcccattcaacaagaaaatataaagccgtgatggtcagaacatgtgcaaaatcttacaaagagggaaagttaaacttgatacaaaactgagagcacacatgcatgcccagaaaggtgagtcgaccatgagtgtgtatataatcccttttgttcgcatcaatggcgcgataggtgaaagcgaggacggttcgtgaacttccgtccgttagctttgacataacgcgtgatgccaaagcaaaaaccagaccatagtagtgacagcaccaaatggaaaacatcattacgtgctgcaaggaaatgaatcaagttagtatgacaaagcatgaagaaggatcaaattaaacttgttggagtgaatttggcctagtgacttggttatgtatttgtttccacatagtaatatgttggctgcaaacaactcgtcaagtttacaacagttgagtgcctctaatctgcataaattaacttaaatcattgccatttcggtaggatgaaatagtacctcttctcagtgacattatcaagaatatcacggcagccaaaagcagagcaaaagcaaggcggaaggactgcaaatgaaaactcaagtaagttctccactaaaatatcctaatttaaatatggaaaaatattgtaggatcgtaaagggcctttcccaccccaaaagctagccattgaggtgaggggctcccccacttatatcttaagtccctcagcctttcaccgtgtatagaccccacagaacaggcccacggtccattaggtatacgggccccgcaggcacccacggtccatcaaaccttcacatactgtgtccatcgggccagagatgttaacctagccaggctctgataccaattgtaagaccgtaaagggcctttcccaccccaaaagctagccattgaggtgaggggctcccccacttatatcttaggtccttccacaaccaatgtgggactattcaacaaatatctccactaagatatgcataacgacattcaaatgcccatgtaactctatcaacacgaaagaactaaattgagggaatacatcaggggtggaaatcttcgcaggtaattacactgctggttaccggccaggagctccaaaccagttactggtatttccggtcagaacattatgagctgtatattttttgcagcattaagtgtgataaatactaagtcattaaaaaaaagcacgcattatccatgccataagttttaatagcaggtttttgcatcaaaaactggttgcatggtcggttacggctggtaaatggtttgtgaatttaaagaaatggatatagtggttttaccagatagaaaaggtactctcaaggccttggtatggatcatagcatcaccgctgtcaacttatcctagtaagtagatggaaacatcaaaattatgcatagaaattcattgtaaattgcaatccttttaagcatgagaattcagaaccaagagtaagaacaataaatgcattc

SEQ ID NO: 33903 - DNA, 568 bp, Oryza sativa
tcttctagcaacatacctatgctacttaagataatcctcaattcgatcatacagttgagaaaggcgttcaaagtgaatatgaccacagatttgatggaagtcaaaatgcacaaatctgcaataattaggtttaatgcaattataaacagtaaaccccaatagaataactctagagtggagcaaaacttaccttatatcttcactcaagataggctcaattgattttgcatatctttcatacaggcgaccttcgccaccatgctgaatatattaacaaggtatatgataggtgaaaaatatcacacaggagtagaacaaactagtaccaccaccgcatattactagcatgttaaaaataagaagaggcaaaactcctaaacatttaactaattctagagcaaacaattatcgttatgtaatataagctgaaatgaactagttaattctatttcaaggaacagaatatacaaaatcggagataaaaatgcaatttatggaatgaacatgggacactattcgtcaaagtgaagaactcttttttctttttcttttttttatcttggttatg

SEQ ID NO: 33904 - DNA, 994 bp, Oryza sativa
ctgtcggtctgactgtctgacctgttgtcgagcatagtccagtcagctacgaaatcggcgaggacctgggacttaatagttgttcgtggcacaaagtgaacgtcaaattggcttagctcgactacccattttgcaatgcagccgacgacgtctctgtttctcacgacttctccgagggggaaggaggaaacaactgtgactctgtgggcttggaagtagtggcgtagctttcttgatgtcatgattactgcataaagcagcttttgaatctgtgagtatcttgtctttgcgtcgtggagagcttcgctgacatagtaaactggtctttgcaccttctctctcttgacaacaatgacggtactcacagaatatggtgtggcgacaatatagaggaataattcttcattaggttggggagcaacaagtacagggggatttgacaggtagcatttgagcgcgatgaacacgtcttcggcttcctgtgtccacacaaatttgtcttgtttcttcagcagagcgaagaaaggttgtcctcgctctcccatcctagcgacgaatctgctcagtgccgccatgcatccagttagcttctggacttccttgagtcttgtgggcgactttatgttctcgattgccttgatcttctcgggatttgcttcgatccctcttccggagacgaggaatccgaggagcttgcccgatggtcctccgaacatgcacttctccgggttgagcatgaggcgatattgtcagaggttgtcgaacgtttcctggaggtcatcaatcaatgagtcgcttgtctttgtcttcacaacaatgtcgtcaacgtaggcctcgacattgtgtccaagttggtcattaagtgccccttggaccgtgcgctggaaggtatttccccgcggttatcagccccaaacggcattttgatgtagcagaatacaccgaatggcatgatgaatgttgtcttctcctcgtcctcttttaccatgctgat

SEQ ID NO: 33905 - DNA, 882 bp, Oryza sativa
ccagtaaagaagcatgtatattaggtaagataggctaaaactttgatactatacaataattatgattaattaccaagttagtttttagggttcaagacatgactagggatgatgtatcgcaaattatgtaaagaaacttaaaagtataaacaatcaagtaattaaccattttttaggatggtacatgccttagctaatataatctagcaaaacaatttagctgatatcggcgagaaccctaaagggagaactggccaatagggataaatcgagataataagactagattaactaagacatataatagcagatggtcatgataaaagggctaaacatctaaagggacataatagccccgatagtacaagtcatcgaatcaagtatacctcttgtcgagagaactcgccgaagagaagaacaaaagggtggtgatgcgccgaagttgtattggattttgtcgtccttttttttacaactagtaattgtgcacgtgcaatgcacgtagtttaacagcatttgtcgcaataatatatcaacacttcaaattttaagaataatatcagcaataatgatatggcctatttttataggtccctgttacacacttgccatgaaaatagtgcaacgttagagaaaattgcttgacgaacacttgaaaagctggaataaaaaagatttgtctttcagtgggattgaaggtaactccactgtcgaacaaaaagaaaagaaaagcataagcataagctatctaaaagtaaaaggctgaaaaataaacttcgatgaaaaacccccaaaatctacttcaaatttaaggttgaaaattcaaattttggctaataagcataagcctaagcaaaaagacctttgaacatcacgcacctt

SEQ ID NO: 33906 - DNA, 1477 bp, Oryza sativa
tcatatctttctggtaaggaactaaaaataaaatgaggaattaaagtcgtacgaagtgatagcaatcgaatttgtaacttgtggttcgtgaatgcctttgctgtggtaggctctagtccagagaagactctgaactggtgtgagaggctccaagtgctgatgaacattgctaaggctgtgcatttcttacatactggaataattcctggttccttatataaccggttaaagccttctagtattttacttgatgaacaccttgtggcaaaactgagtgactatgggctatccataattacggaggagatatacaaacatgaggttggtttgccatatcatagaatgatcctactcctcttcccctgtatttaaaggagtctcaattatagaccattctttattttaatgcccttattcctattggtttacactttacaggcagcaggagaagggcagagatgtgtagaagacaatggtggagaattgtaagtacctgcagaacttgtagcaaagtatttcttacacaaagttgcatacaactaataaatgatcagacatgctgaaagtctaatataatatatgtttttagggaaaatttggaggatgatgtgctttcctttggaggtattttacttgaagtacttatggggccaaaacgtcataggaaagatctctctgtgctaagtgagctggtatgttccattttgtcttttgcgtaaagataattaatcaaatatccagatgatagttataataatgatacttcgatcaatatcacggtgatacatagctcgagcgctgtctggactgggctaatttcatgttgtattaagctatctatcaactcaatacagatattttgttggttgggtatgaccgtataactttcgtcctcattgtgctctgcaatccatgatatcataagctgaattatgacaccacacactaataagttctgagtatgaaatgtatgtttcaagcacttctgcttccctgcattagcccaacaaagagcattacatgcacaaatattaggagcaatgttgcttgcagagtaagaactacaaattttaatatccggattaatttggcatgataaaacttcaactgataggatccttagctctctaaaaccctacatgactcatatgctctgatcataccagaacaatcaaaattttacctgtatctgcaggttctgtcaatatcaaaacaggaagagcgcgagcaagttcttgatccggttgtgctgagcacctcttcgcaagattctttgtcgatggtgatttccattactgtcaaatgtttatcagttgaatcttcagccaggccttcgatcgaagaggttctctggaatctgcagtacgctgcacaagtccaggcaatatctgatggggaccagagatcagaagtttcctcgcagacctgttaggctaactgaacataaaacaccttggaggttattgtccatatctgg

SEQ ID NO: 33907 - DNA, 1980 bp, Oryza sativa
tcgatcgaacgccgttggcagccgctccctctcactatgcgaactctaacaaactcctccttagcgaatatgccacgccaacatgaatctgttatttgctcgaacctccgtgtgccagaacttgagttggttcttccaccgctcatgctgagttggcccgacaagccttcaccaggatcaccacaacaagagactcccgctatccctgtaacttcttcctcttgattgcacctgcaacagtgttccaccctctcttatatcaccacaatcgtcttgctaagtgaaattgaatttctttctacctgttacatcatagactcctcaaaaatcatgttcaactacatctactgttttaaatttgacttgttctaatccatggccagataacacgcattgttaccaaatagaaaaatcaaactcactagcacatgaagagaaccttttcttctttgatgtcttacgaaccgagctaattaacaaatccaatatccacgcttctacatagaaagtctcatgtaatatgttgccagaagttgtttctattgaaatctggagtcactgactccaaatcaacaaaacatcttatgttgaatcccatatgagtactaacatcctttcgtgtgagatagtattccgtcccgaagaatcggaacgtaataccttcccacacgtatcgcaacatacagagaggtggtatttgtagaaaacgtgaaccagagtcatctactagcgcgaaatcatcccaacatattgctttccacacagtagcagaatcaacattcatacctattttagcaagcagctccgggtcgtatgctcgcgtatgagcgaacacttgatccctgagaaggttgtaggcctgcatcaactgatctttttacaagtacagctcggagtcgggacaaaacgtcaagccttgatcctcatgcattgacacttggccataagattctgcatgtccttcactcggcacatcctctttggacgagcacgcactcgagctgtaggaatggtggtgtgagctcgatactgataggaactataaaatggaaggtggactgctgaagtataaaggaaggatatatgcaggtaaaacatcttaaaccaactactaagggcataccactcctcctttggggccattatggaatgagggccacttgccatagaatcaaaatgtttttttactagcctggtctcaagagggatgctgacaaaatggttagggaatatcgtatgccaagcgactaaagaagaacacaagttcatattccaggactcctcaatccttttgatatagttgacatggcttggtcacacattaccatgaatttcattataggctaccaaaatccagaggaaaggatgtgatatcggtggtggttaacagattgactaagtatgctcactttttggccttgtttcatcattattcagtggagcaggtggtggatatctttatatggatatataacatccacaaactacatgggatgccaatgggtatcataattgatggtgacaagatattcactagctgtatatttcaggaagtatttcaaatcaatgaatatgcagctgagattcaacgaaaaaaatttggaaaaatattcttctttttaaaaatttgtgtttatatacctgtatgggagggtttagcacaaatatacctaatttgcagattggaaacgcgggaccacaaagcaagcgcgacatggacatgcgggaacggcggatgcttcggtgccgcggagtgaaaacgcggaatagcctcggtcccgtggagcagaagagcggaaccacattgctccggcggccctgtcctgcggcagcgtggtagagagcggcgtcgtgcgggatagcctcgctcccgcggaaccgtggtgcgccaccgacgcggttcagcgtcccgaatgcgcgccatctttccggtcccgctgctccgcacctcggaagagcagcgccgctttggccggcatc

SEQ ID NO: 33908 - DNA, 591 bp, Oryza sativa
tccggcaaggagtccctcgtattctgccatattattggtcgctcgaaagtcgaggcggaccaagtatctgaggacgtctccgctcggagaggtcaacgtgacccccgcaccggcgccctgaagagacagggagccgtcgaactgcatcacccagtgggcggtgtgaggcagctgcgaggggtccgtgctggcctcggggatcgagacgggctcgggagccggggtccactctgccacaaaatcggcgagggcctggctcttgatagcgtggcgtggttcaaagtgcaaatcgaactcagaaagttcgattgcccatttcaccacccgtcctgtaccctctcgattatgcaagatttgaccgagggggtaagacgtaactactgtgacccgatgcgcctggaaataatggcgcagtttcctcgaggccatcagaatagcgtaaagcatcttctgggcctgagggtatcgggttttggcgtcccggagggcctcactaacaaagtagacgggccgctgcacctttcggtggggccgatcctcttcgctaggggccgcatccctggggcactcttcgtccaagcagcctcgcgg

SEQ ID NO: 33909 - DNA, 1412 bp, Oryza sativa
  unsure (1)..(1412): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccacttcatcaaaaccttcaacgatttcaccaatatcgttctttgtagactgatattcttgcaccctcttttgtaaccattctaaattagcctccttactcattatacaaatttatatggcttagtcgtgctatactagccggctttacagagatagatacaaatttgccatcggagatactaataaaatcgtagctagaaagatccctccccgataagcattggatattcccatggcgccactcaaaagtagcatcggccattgcaacctcggccgatgtatccgcttgaataatttcaacatcatcgccgtcccattgaattaaacattgatgcaaggtagaaggcacacaacaattggcatgaatccaacaacgacccaaaataacattgtagttaccttgcacatcgacgatgaagaaagcggttggtagcgtcttgtttcccacggtgagctctgccgaaaagataccctttgcctccgttggttcaccattgaaaccattgagaatcatgttggtcttcttcaactcatcatcctcacgccccaacttcttgaataatgagtacggcatcaagttcaccgcggcacctccatccactagtatcctagagatcggcttcccatcaacatggcctttgagatagagagggttcatgtgacggtttgactcatcgggcttctcaaaaaccgtgtctttaggacctaatgagaattgagcaacctcggcttcatccatagcacaaaactgcataggcaacatacataccatgttcatattcatgtcttcttttggagatgattcacctttatcaaccgattgttcctccttctcctctacaacaaccggtttttccttctctatggacttatgcctccataccggtggtggtcgcaactcattgaaccttttatctctttgctcttcggcttttttctctcttatctcttgagcc

SEQ ID NO: 33910 - DNA, 251 bp, Oryza sativa
taccagatttttaaaagaaccgacctctaaaatatgaacttgggtgtcggttctttgaaaaaaccaacacctattaacaaaactgtccggacgtcagattgattgaccgagcgcactactctttatcttttctgattgccaagcacatgcactactccgcctcctccttttttcccttctccctctctccccaccaccacttcttctctacccggcggcgccaatccgagccgcactgctcctcctctcct

SEQ ID NO: 33911 - DNA, 1869 bp, Oryza sativa
acagcatgccacggatcgaagggttaatggtatgcttaagaaccctgcagattcattttaatggagaaatattaataaaaaataccttaaatttgttgctgaccagagagaatgtaacaccccagaaaaccacataagcctgggatgccactaaacaaccacacataagtgccaaaacaagcaaatttcggcaacaactatcttagacaagaaaacatcgcggaagcatcaacatatagattaaggttatgatacaacaattgactgacatgtagggataggcttgaaaaagtggctaatcaatggtcaacaactctagtatttaattaacccattatgtctaaacacaagtattcttatcaagatattacaataatcatgactaagtgagatcatgtcgtgcgactgtgtagctaatcctatcccttcatgcaaacatgtcacagcaagtacctgaaaagactataagggggtgagaataaatctcagcaagcaaatggctttaacaagctatttaaaccacatgtttattatataactaatttaaataccaagttatgattcacataaagacaagttcaaaatccaaggaactaaaacatcatagcgtcaccaatcaaatccatatactcacaaatcctagagaagaaaacacttctcaaagacatcttcgatcaataattttcataacgtcctgcaatatgtgcatatacaatgcaatgatatgtactcctgccttcacacccaacaaggtgtgaagctgcatcgtattacggcaatatacgatgctgtaccggtacggtcgcaaccataggttcacgacataacttcaaatgcaatgcaagtgatgcaaatgcagtatgaattccagagtataacatcggaaccacattccttcgatggagatcagtataaggttattataaccaagagcataaagtataaccataaacagtgtaaaatcaataagtatgattcagataggtaaatcctcggtgtaatatataataatcttggttgatgatatataatttcaacgtggaggtagaatcaaataacaagtcaaggctgtagcaaaccaccgctacgtttacttgccttcaccgatgatgagatgaactctagttgcattccgaagtggcatcacctaaataaacaccggctcagactcaaacaacatgcataatcattcaagaatcacacatacgcttcctacgctgggatcccaccccaaacaacataaagcaaatcactgataatcttcctataaaagcagcatagattaacaattgatacctccaattctacatcacataacacagaaaaatatgtcatttctgacatctacagaacaagaattacaactttcatttagataacaaaattgaattcttccatttagctggcctaaaacatggcacaaaacagagaagtgcatctgcccagaaaactgtgcaacaaccattcaagagagcactgacaacaaactacaagataaaagctaacaatttttatgtaggaggtagatcacaacatatgctacaacttctgtaaaaacaagattctctgattccatcattaagatcctctaaaatccctctgaacctcgactacagaaaaaatgcatcgatattcagacagtcaacttcagaaattgatatctcctaaaccacttgatataaactcatgccatttggtcagaagatagatctacacgttatctacaacttttgtatagagacgtttcgcaggaaatcccattatgatggccgaaaaggcatccaaaccagaactgtgcaggggacagatcagcaaaaacctggctgaggaataaatcggttgatcccaaacttactcgcttccaacact

SEQ ID NO: 33912 - DNA, 508 bp, Oryza sativa
gctcagtgccgtcgcccgtggccagccgtatggagcccggccgggggacgccgaccactcgatacggaccctcccacattggtgaaagcttgctcaatccagcacgcgtttggacgcggcgtaggacgaggtcgtcgacgcagagtgatcgggcccggacgtggcgctgatggtagcaccgcaggctctgctggtagcgcgcggctcggagggccgcgcgccgccttcgctcttccaagtagtcgaggtcatctctgcgaagctgattttgatcagcctcgcaatacatggtagcccgaggagacctcagggtgagctcggatgggagaaccgcttccgcgccgtagacgaggaagaaaggcgtttccccggttgctcggcttggtgtagttcggtttgcccagagcaccgctggcaactcctcgatccatgaatcgccgtgcttcttgagtatgttgaaggtcttggttttaaggcctttgaggattccgcattggcgcgctccact

SEQ ID NO: 33913 - DNA, 733 bp, Oryza sativa
gccgcctccacccttcacctccgcctccaccggatctgggaggaaggaggggagccgccgctggctccacccctcgcgcagccaccgcctgaagccgccgccgccaccgccagtaactgccgccgccatggcagctcgagccggaatctgagctgagagaggagagatgggagagaaggggaggggaggagaggagagggagagaatgaggggagggtttcaggattggggtgttagtctaggacgttttgcggaaaaccccctatagttttcatgtttacagcgttacccctagaaggggaattttctcttcttcgttcgtattgtattttcctggaatacgagagattatacattaaaaaatacaatgggacgtaaggcatatatgatattccgtgcaaacacgaggacttttttgcaaaatagcctactaatgcaaccggctctaacccgccgtcaagaccggcgcgtgcacacgccccacagcgccaaaaaaaacgttggaccggtgaccgcttacgagcagtcacgcaggcacgcgcgaggagccgggaggaggaggaacgacgtgtaaagtaacgagatagcccaaaaataattcaaaaatcggagaaaaacggtggggttaggggagttattgattgatgattcccagcatccccataatcccagatcccatacatttcacaacaacatatacataaatacattcatatgcattttacaatcacgt

SEQ ID NO: 33914 - DNA, 723 bp, Oryza sativa
ttataccgctttccttattatggaacctaattgtatatttggttattacttattagatcagtggattacacttgtgatgtagaaagatggaattgaagttaaaattttctaaatgcaatgtgtttcatttggccgatatttgttttttagataatggaagctttattaagactcagttaaatacaccaagatgatacattccaactgagtccacccccggcctctgcatagaatgcacacaaccaaaaaactggacctaagaacacttccccatcacaaaacatagaaactagtggctatcaatccgtagactagatcgccacccatgctcctgggtaaaaaactcctgtgccacctaatccaaacgttgcgataccaccgcaatagtatcccgaagtccctgtttgtggaggatggcccaggagcgtagccaccgggtgactaaagtagtaacctgcaaaggagaagacaccaccttgttatcaaaaattacctcgtttctgcttagccatatggaccaacaaagagatgctgcacccatcaaaagcagatttctcatgtctttaggaacacaagtaagccaacgcccaaacaagtgagtaatattttgaggaggttgtatgttcgaagccatatgaacaacagaccataccaagcgagaaacacgacattgaaaaaacaaatgttgaatggtctcttccttgtgacaaaagccatgttgaa

SEQ ID NO: 33915 - DNA, 542 bp, Oryza sativa
gggagcgtgtgctcacgtttctcgccggagcttcaaggccatgaagcgagagcttctggccgcggcctctactcatgaggcgacgtgtcgggcgcggtggtcggaggttgccctcaccttcgaccagaccgaccacccaccgtgcgttgcccggggagggcagattgcgatggtggtttctcccaccgtttgcaacgtgaagttggggcgtgtcctcattgatgggggagcggccctcaacatcctttcccctgcggcctttgacgccatcaaggccccggggatgatgctccggccgtcccagccaattatcggtgtgacgccggggcacacgtggccgttaggtcacatcgacctaccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctacagatgaagatgccgggccccggtggccccatctctgtccatg

SEQ ID NO: 33916 - DNA, 339 bp, Oryza sativa
cttaagtcgcggccgcttgcagtgagccgagatcgtgccactgcactccagcctgggtgacaaagccagactccgtctcaaaaaaaaaaaaaaaaagtatcaacattgactcatcatttgtaatacgtatgccacactaatgcaagatattaataaagaagactccggggtggggagagggtatgtggaaactctccctactttctgtgcaatttttttataaacctaaaacgagtttttgaatgagtgtttaaattttttcaagtaacccaatatttttatttttttattttttttattatactttaagctttaggtacatgtgcacaacgtaagggc

SEQ ID NO: 33917 - DNA, 20665 bp, Oryza sativa
  unsure (1)..(20665): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagagtcacagtttgttgcttcagatggagcatttacttgaagagtcttctttcgtgtattctcttccatccatccagtgctgcccaccttctggagagcaaaatagtattcctataaacatctgtacttcctacacaggcagaaagtatgttttgcttcctgcgatttgtaatgtacataattaccattgcacctttattttgtataatttttttatatgtattttaatgttcctaaattaagctatataatctctttctaaatttttatttctattgtagcatgaattactccgcattctttatccactatttttccactgcttcatggatttagtggcagagggacatacacaggaaggtaatgctagtaggtggatatgataatgaatcttctgtcagtttttttttttttttgctttctatcagtttattcggggcagttctttctttgatacactaactttgagcactgcagcttgctcatttttccacacatttcgtgaagaccatgaacactcgagggatctcaagaagctggaaagcatcctttctcctttacatttggaagttagtgactcagcttttccacattgcactaccctattttgaatgaagacttattttttgtttatttgattctatctcctcaaagtttacaaattatggcttatccttctaaatattgtaatttcagcaaatggaagtggctcgatctttaaggcagaataaattcagaattaagctatgtgaggttgtataccatttccaaatcccctttcatttcaaccctgtaccatgtactattttttggggcagcatttcatgatagccactgtaatttcttgattgctgcaaaattgcttttctggaaatataatcagctgtcccaattaaagtttctgtctttttttattgcagtattcatatgaattgcttctccagtatctccacaaaacacaagctcttgtggtgcttggaataatcaatgaacgcatagattttcaaggtaagtttccccaatctgttatgactcatgattagtgacctaaatgttcatcctgcatttgctccttgtgagttatctgaatcttctgttccaactttcctttacaatattgatagtatcccctgggcagtctccattaatcattgatgactcggatgctgttgttctgattggaactagcaaggacttgacaaaacagataaatcagaaggaggtgcattggggggtatgttctgtaccagtctggtggtttcccaattctcatcatttattttatcaatagttaaggatacagcctaaacgaattgaaattatatagatcgatcagttaatatttaatgggattctagccgtttttattatttgttcactatgctcagacattttatttttgtgatttaaattctgtaatgcagatacttgaagattcacttgaagaacgtatggagaaggcaatttcagattctgataaaactgaaatagaaagcaaggatgcagacacagaagacaacaaggcaagaaactgttttgtagtatgccagtcttttttttcattttgcttcctatgccctcggtcattgaaacacaagctttccttttttttagtgcgtgcgattctgttagcaacttgtgatttttatggttgctttattataaaaacagtactttctgatgtgcactggctgtcagctgtatatgatatcaatgtttcattgatttgttccactatgtaattctgcattctcctttgttcagtgctcccgtaaatgctagcaggcagactggttagaacctagcacctgggaaggctaggcagctgcatagggggaactatgttcctcactcaccattgatgtttcttagccttctcatttcactcttttcttatttttgctacagaaaagatcctcagaaggtggaaagcagggtggctcacataaaaagatcaaaaaggacaagtttgtaggaaccacagggaaaaacatgaaatctgaaactagcatggtttctatagcaccacgagttaaaccagagctaacgcttccaatgacgtacgtcgtacaatacatctttaatcacttcaaattttcttttgagaagtccaatttggtcatctaattttgaatattgtctggtttgtgacctaaggttaaaaagttctcctgaaatgattcaggattttaggttatgataaaattataacttcctctgcatccatttcctggtccgtggttgggaagaaggcaaccacatgttttttaaattcatgtggccattgtttcatttttcctgcagactgccccttttgaaacgcaggattaaaaaacttaggaatatggaaaacaaaggaattttgtaggttgattggaccgtaggaaaaacatagcaatgggcttggattataagagtaaattgggtttcttatctacttatacacatcttaccctcactaattgaatagacaagtggccatgagctactagatttgccttgatccaacgcgagataacaaaaacatgagcttggaatggatgttaaatttcctatgttttcctctagatttgtaggaacaggaaaatctcctgtgattttcctttcctcattcctacaaatcaaaggcatgaacaatgatcttccctataggatttcaattcctttgttttttctccaattcaaaggggcctgcatattctatgcaccaacatattgcttcctcatccacactgttcaaatgatttggttatcccatgtccacctgccaatatgttattgcttagatgttgtttaaccgtagaatatttgagctgttcaaaagcacttttgtaagacattaacaaaaccaaagattatatttcctttgccttccaaactatcatcacgacatggccattaaggctctgttcgcaaaaacaggttcccaacccaaacagtacgcacagaaaacggagcggtccattagcacgtgattaattaagtatttgctatttttttttcaaaaatggatcaatatgatttttttaagcaactttcgtatagaaactttttctaaaaaaaccaccgtttaacagtttgaaaagcgtgcgtgtggaaaacgagagtagggtgttgggaaccagctcttgcaaacagagcctaagcccactgataagattttctatagtgatgtttttttcttatattaagttgtaataatttctttgtacacatgtttacttttatttgttggacatctttgttgactcatcagccttacctttatctgtaagaatctgatagacgtttactgattattttttttcaggtctgttgaagttgagcagtcaattcttgaggacttgcgaaaccgtgcacaattgaatagcttgtcattgccatctgttagcttctatacattccttaatacacataatgggtaaacttaactatggatcaatgcctgacaatttttattttcaatttttcctccttcagtttaatcattatatgtggaactcaggttaaattgctcatcgatttcgcatgatggttcattggtcgttggtggattcgctgattcatcagtgaaggctagtccttttaggtggcatcttcttattatgtgatttctgtattaattcgtaatagtaaaaagtgtaaaatctccttggtgttcactaggtttgggatatgtcaaagattggccagccttccaaagcatgttagttgttcttcactccttatttttgattatttgttctgctttgtgttatgctgaaacacttatataaatttgcgtctggtttatgtgactaattggctattgccttcttaaaaatactataatggtacattcatttgtatcattcgaagttccagttacaagtcctaagaagtatgatgtttttcagtcatacttgctggatgtactgatgcacttgtgtcattacagtatttgactctggaacctgttcagaaccttatgatagtcttagaacattaatcctcctagcatcaaagtcaattatgcaatgatggtatttactgattgaagaaactataattttcagcttgttcacaaggcgagaatggaccctcccagattgagcgggtatcgacatcagatgaagcgcgtaaatcctgtacattattccaaggtcattctggaccagtttattctgccatgtttagcccaattggggacttcctcttgtcatcatctgcagactcaacaagtaaagccttctcattgtgcttgttttgtatcattctcttccttgttactttattaattagaattcacaatttatctatatttttttgacttgctacagttcgcttatggaacaccaagttgaatgctaatcttgtttgctacaaaggacacaactaccctgtttgggatgtccaagtatgtgattaccagttcttttagtatattattagtgtggatacaaagctgttttcaatgccaaaaagaaaaaaggaagcatgggtttctgtgtgctccttatgaactattcctaactagtatttcatcgttagtactctccatgatggagtactaggtacttatatgtcctgtgaaaagctcactgtcaaattcttttggatgcaagttatctgattctgttattgtagtccttgtgctatgatagttgttgacactgttctgttttcttttggcagtttagtccagttggacattactttgctagtgcttcgcatgacaggactgctagaatctggtccatggataaaatccagcctttgagaataatggctgggcatttatctgatgttgatgtaagtgtactcatggttttggtcattttcttatatgggatcacttaatgttggaatatttccatacatgcttattctctaatttcctatattgatgtctgcatttttttaaaaaaaatacttttgcctgacagtgtgtgcaatggcatgtcaactgcaactacattgccactggctctagtgacaaaacagtaagactatgggatgttcaaacaggtgaatgtataaggatgtttattggccataggagtatggttttatcattggcaatgtctcctgatgggcgatacatggcctctggagatgaagatggaacaatcatgatgtgggatatatcttctggtcgttgtgtttcaccgctagtgggacataactcttgtgtgtggtcgcttgcttacaggtaatcatcatttgatgctggtcggctggtaaaaatataatatctatctagccgatttctttaatatgccaatagagtagtattatggaactacggcactacgctagttataggcttatagcatggcttggcaaactggctagtgcatatgtagcaggactgagttttggaaaatcaattggtttatttgaattgagtaagcatgatctatctatatacaagaaatcagctcatcgtttcttccatcctcatctagatgtgtttaaatgatatcactcacaagggcatcagaaaccagatctggctgcgtctggtttttgccttttcagttttagagttgggctttgggatttacactgtatcagtggaagcaaattggagtatttttgtatagaacttaaatttgaaaaaagtgttattagaggggtgaacctgaggagttctaatggtagcaaaaacatccacatagatgtttccagtttcaaggccagttaccagctgttaactggtgaaatttacggccaacagtttgtcttttttctttgataatctgctttgaatttcttgaataaatcaatgagattaatacagacttcaaagtattatcattgcgttggcatgtcaaaaccttgctgttagcagcaacacaccttcttttggggagaacaatagaaacgtgcatgttgttggttacaagtgattacatatggaatgttttgtttagactatcctgtaaatgatcatttgttgttatgctttgctttatttaagcttgcgatttaaggacttctttactcgcacaatgctttccatgtatggtgcgcatgatttgtgtatataaatgctcgctgttatttctttcagagggagtcatgtttgctgttttgtgatgtctataatctgcgttctgttgtagtttaaggaaaagtatggttgatcttagttaatacattctgccattattttagctgtgaaggggcattacttgcatctggatcagccgactgcactgtaaaactatgggatgtcgcctccagcactaagactcttaagatggatgatacgtgagttgatcgaagtgtttataaagatgcttgtaccaaatcattgccttactcttgttgtaaaatgtccttgtacagcaaaggtggttcagctaaccgactgaggatgctgaaagccctccctacaaaatcaacccctgtttacactctgcaggtgagaatttttttccctcctttagtccattatgttgccttaagttatggttgttaccttatgcattgtaaacataactgctttcatcttgttgcagttttctcggaggaatcttttatttgcggctggtgctccctcacttggctcctaagcttctgtatgttctatagagtacaagtagcattctttcagtttttggttttagtaagtagtaaagttgatgtctactggggtggcaggtgtcgtagcatctacattttcccttagtgatcccagtgaacctaggggtaaattgtagcactggggcactgcaattcgttgcaatatgtgtagtgatgtagcattagccagttcaaaatatatgcaatttcccgtaatgatacatctaactttactctacgtgtgccatactgtttcaaccaatcattctttccactcaaattctaccctttgtatggatggggtcaaatctgaaccgaggtataaccgtgtaacctcattttctggatagaccatgcccgcgcgataactccttctcacagagaatgattaaagcagagtttcttatgttcggatttctgccaatttaaatttggttctaactctcttggtaccaaacagtaagctccataggcactgatccactgctcttacctgctagctgctactgttgctcactgattgctctactgatggccaagctggccaccttggcaacagtcgaccaacagcccatggcctaggtgctgggatgaacagccctggatcttcactgttaaaaaaattttagagggtgagagggcatgaggcaaactcaaatctgtcaatctaccaatggtcatgtagtgtggtatagtagagtgcagaagattcatgtatttacctgtgaaaatgatggtggatttcggcagaattgaatcggagacgttgcatgtcttgtagtttcaatgttcaaatgatttggtctcccggcacctgtgtccatgcaaacacactccatataccagtgccaccgcgtctctgtctcccagtgtacaaggttatggatctatcagcctgacatttcactctcagctgcaaacttatgatggtccacgctttcagctttctcccatcacgccactgctttcgccatccgtccaaaacgagttttttatttttttgctttttctttttcaaatataaatataccctgacaggtgaactatttttcctgtgaagttcatgtaattgttttttgtttctctcacagcttgtctcagtgagagaagtgaatgcctagatcaatgcttggtggaagtggaactagaaccttagaaactttcaactgtttgctagaatatgtgtgtgcaccatttatccaaatccttgtgttggccatactcgccagaaagactggacacaccaaaccacataaaaggtaaatttgtattcatctgcagagtttacaagcaaacaactggactgtcattgggttttggatccctcctagcatgcatgtgacttttttcttagataaatggaaagcaatgcatgtgactatctggctacctaacacatattttgctggtatcctggtgaatatttggtagaatactcaccacttcatcagaggatgtcacaggcataaaactaccatattactagcaggttgccatcaatcagatgagatccctcatgaaacaaagttaatcccttcacaattatacacagcccatcttgcaggctgtaatctttttttgagagcctaattagttgatcaacatgattggcaaaaaggctcaactttttcatatccatctaaaaaaaccagttggcattgtgtggatgaaatgtagctttcaacatcctgcatttcataatttgcattgcctgcttaagatggattagagagcaaggagggtcatcctccaacctccatgggacctatgtcccaaaggtgagcagcctacctagttggtacatggcaggatcagcttgcagcctcataagctgtgacagtgtgagggtactgaggtcccctctacctctgttcaccatgtatcatacacagtgccagcagcctttttggagtccagacattgctccattattgtgtatgtctcctaggctagagtactagacccttggcatttggcctcttcttctaaggacaactgccatgaatctcacatatatagtgacttgcatggccttttttcagctctggtgttgttattatagccaacattcaacattttggtttaactggatttgactgttagtttaactgaagatgatttcagtgcaaatattgcatttttcaaaatgacattgaggatatagatgcataggatgctgccactattagtgtggatggatagctggagtggtgatggtgaaccaaacaacccctaacatggtacgttctatccacgtacgttttgagtgatctttgcgagtgctccgtgctaagaatattgaaaggatgaagctgatctggtgataataagctggtccttgcacatctcctaccgtccacccacttgtggtagggcatgcctcttatcattttgtggacacaagtgatttggcaacttgatcacactaactattcagatcatggtgcttaattagttttttgcaatattccccttggtggttagggagcaaagatgacccttttataagttgtgtggttattgatcaatccatgatgtgagtattgatgtcttaaaaggttattggagaatgattggcatatcacagtggcagtatagcactagcaagcagcagatgcatttgagtattttgagtgtctgaaccattcaaccaaaacaataatatataactcacctgccaataaatttcaaggtattggagcagtcactgatcactgcatacatttacaattttctgtaacactatatgcatgcatcatcatgtgagaatcttcactgtgcattcctgtcatccccatgaagtaggaccatggtgccttaggtttcttccattttcaattcattccaagtttgtgttgcagccttgcaggagctaccattgctctctgaacaacacacaagaaagatgatggtaggaagatcagaaggggtcactttttttgggctcgatgacatgagtggacaaatctacccaagctaaggttagtgggagcagcccatgtgatgatgtggggtgcaattggatcattgtcatcttaccttttttttcccacccccttcttttcatcttgtgtggcaaagtgacatggcctcatgtgatgatgcatgggagaaaaggaaatttttttttagtagcaatgcaaagtgtgctctttgctgaaaatgcaagaggaaagtggcttttgtgcaaatggcataaaaccttaagatatggggggtgaatttcatgagtgccttgcattatagaaccatagatgtgtagctagcctttttgtggtgctttgttttgataattgtggcagtgcagatgcacagtggcatcaatctacctgttagtgcaataattcattttggtgaaccagtgttattatggttttgttagttgggatacgacaccacatatgttaacaacatgcctaattttatttataatgaaatagcaaatatcaatattttttaaaagaaaaagaaaaattgagagagctctaagaaagatgccttttaagttctgttgttacatgaaaagtgaacttgtgttattatggttttgttatttgagatatgacaccacatagtgttaacaaacatgcctaatttcctttatttataatgaaatatcaacagagagaaatagagacaagtctaagaagaaagatgcctttcaagttgtgttgttacttgaaaagtgagaagattgctatgccctttttcttgtgtgaatggattccatctcttgattgatatggctatatatgccttttaggaagggatccatgccgtccatcttcaacaacacgcaaatgatcaagaaaacatggccgaagttgctgcccaacaaaccctagctagcgagtttccttggatgaaagaatattagcacatcatcatcagaaagcgagctttgtcatatgccctagctacaagactatagggatatggacgcatctcacttcactttacgggtacccattgtcacacaccatatacacaataatataggataagtgaattttagttgattttgcttaactagatggatggtaagactttctagcattgtccacatacatatagatgttaatgaatctaaacacatacatatctctagatttattaatatctaaatgaatataggcaatgctagaaagtcttacattgtaaaatggaggaagtataaacttaattgtatatagttcattattaatcatagaaattaggtaaatgtagctatatgctattagttggtttgtctctgaacaatgaaaatcagtcccttcatctcgtttatggttgattattagttataacgcttattaacaataaaaatgtacatgcgttaaaacttgtgtatgtgttatatatcttagtgatttataagccgatgttaaaaataaattacgctaaaattattaaaatcaaaagtgtttgatgcagctaataggctaagggcctgtttggcacgggtctaactgcacctcccctagagcccagtaagatagtttcaactccatctaaaataggagcagagctaggtaaagcgttctcataaaataaactagagaggttcagtttggtttagactgctccacaaaattccactccaaacctaactcctagagttaaatttagaagttaaacctctaccaaacggaacctaaggctgcctttgaaagtggaggttgagaactccaattgtttgcatgcaaaacggaacgacaaataacgttgattaattacatattagctaaaataaactagaaaactgaattaatatgaatttttaaagcaactttcctatatgaactttttaaaaaaacacatcatttagcagcttgtgaaacgtgtgcacggaaaaagatgaagtagaagttgggaaaaggtgttgtcgaacagaactaagatcaagtttaataatataatcaactactagtttcaaaaattaacatattatctataactaacttgatagctcacttagagcacccgcaatggtaaagtaaggtgctatctataaaacatgtacacctcaacaatagactagattaatagtaaaccacttcaatggtatgtctacatgggtatctatagctctctaatccattgtctcgtttttctctatagactatctccatgttagtagatagctttgctctctctcttcatttaatctctttcaagtaggaaaatatgctgacatggatctcttgtagagagcttatagataaccattgtgggtgcccttataccatacttacttatagatatatactataccattaatgcatatcctatctcacataggttattggagcttgtgttgtagttgactacaaatctttaaccaacttttctctttccttcaagtaaacacaaatatagtgtggtaatatgtagaacatacttgcatcgtcatattgagttgatttggtttgtggcctaaataggccttaccaaattttgtctaattttggtaaggtaaagttgtatttggattgaagtcaaaatagcctaagtttactattgaaatggtctattttcttagacatgctaaaatttggcttcaaaccaaatagacagtaaatactattgaaattgtcaaatattggtaagtctaatttaggcctcaaaccaaaccagtccattatactcgctcgggtcaaaagaggctataggcagggtagagtgtcatttggaccttgaacattttaaagaacaaaacattcaagttaatattttactcctgatgagagagttgctgttacagagtgtgaaaaaccttaggattcctgaacatattttactccctgatgggtaaaaagaacagagtgattaattaatgtctgatgctgggcccatccaagaccaatcatggtggagctgcagtaactgttactccaatattgaccaaatgtttgtgtgtacgtactgtagtagtagaatgtatgaccagctagctagtcagattccaaagaaagatagtactagtagtaaaaataactgaaaacaggcgtactatagtagtaatacctagtactactgagtgaaagcagggggtgtactcttgtacgtgtttcacgtgctatatgtaagagcaggtacaataacaaattataaataaaaaagaaaataaagaagagagatgagcaattggctatagatttatagccagctacaatatggactcgaagacacaatttatatataacatgtaggatcagatattaatagtatattatatatttgtaggtaactattatataaattggctataaatgatttggagctattagttggctatactactattaaacttgcttggctatactattaaacttgctctaagcagaagtggtgaacaaaagccgggagtacaccctcagttcctaagtagagcaatttttggttgaaagagatacagagtactttcctaaggatgaatttggacatactccctatctaaattcataatattaggatatatcacatctgacagagcgtggggctcctcaccgggagaccgcgcaggcccccctttgccggttcggccgggggctcagggtgaaatcccaagctctctctgtatgtggaaagatcgcgacctatcgaaagagcatgagacacaggcgatgtatacaggttcgggccgcttagaagcgtaataccctactcctgtgttttggtggatctgtgtatgaaggagctacaaagtgtgagccagcctctcccttgttctgggttccgaatctggcccccccccaaatccccccttttctaaatgggcaaggtcctccttttatatttcaaggggataccacatgcacccccctctctcccaactggacttttcttctcttcataaatggacggagatttgcatggttgccctccgaatgaccttctgacgggacggcccatacctacctccacttctgccgaaggcaggcgcgtcgtgggaacgtggctgtctgctgacgacatgatcagtgtcagaccggtcacaagtcggtcattcttgtccaccatgcgtcagcttagcaacatgcatgtttgcccttcttcacacaacatattgcttgtaatggttaggatgaagcctggcatatatccgaccggggctaacgtgccatctctgggaggtaacacgctagctccagctggggacgagtgcctagaagctctcgtcttgacgggatggggcgaagcgtgcgtcagaccgcctgtcgccacctaacccgcgatctgaccggtctgtgactggtcacagaccggataaaccagtgcactgcactgcatttcgtgcggcgtgacacgtttagccgagccgcaataaatgcggttaggtgagccccgctgtgttcacctaacccatacacgcggagtagaacccgcgaggggtcggggcgcctcggccctcgggggcgaggcaggagtggtccgacccccctgggggagaccaagaggtgggcgcacacatcaccctcgggcccgacgtcccccgagggtgccaggccacgtggtgtaaagtatctcttccctcgacagtcgtctaaggtccctctatcaaatactagtctacattctcacacggattctgataatatattgttaatgtaaaatttaaaaataaaataaaatccaaaaagagaaaacactgatttttactactcatatcaccagtttttaatcggaatcctgagctatatatcaaacaatgactaagttccttttattttctttacataattctcgccttctttttatccttataggctaggttaatttgtaacacattttgctaccttaatttaattaaggaacaaatggtatatctccgatacgcagcaggaagccaccaaaataaaggcctatttaatattgactagctaacaagagtaagcatgagataagtttaagactgcttaagtttaactctagttcttttgttgaagttctcaactcaacttaactcttttgtttttcacgtacacacctttaaaactattaaacagtatgtttttttaaaaaatatatacaaaagttgctttaaaaatcatattaatccctttttaaaaaataattgatacttaactatcgtgatttaatgagtcgtttctttttacgtgcgtgagagatgagttttcaacaccgagcaccgaactcagcttgaagctttagattctaagaaacaatggatgaaaatctagcaagtaattaattaatttagagaagctaagataacaacttttatctttcagtttgttatctaagtatagtatcttaaaattttaaaaaaagctaaattatttggaaaactttagttcttaaaaaaattgtagatgctaaagtcttcgtaaacatgtcctcaaactcgggtggggatggtctaggtatgcgattgaactaattaaactatggtccagctctgctatatatcttaatttactttgacacgtgaacttgtcatgaaaaatatataatgcaaaccaaatatgtagtgaaacttgaaaactatcgttggattaaaaaaataacatttgagattgatccacgtcacgaaaagaaaaaaagttttcaggagtaaagtttttactcatgatgtggacaaatctcagccatttattttcagatctcacgatagtttccatatttgtattacatatgtggtttgtattacatattttcctaatttatcgctggccggtgaaaaaacatgttgaagtttgtgttcttgtggcaaacacatatcttagtttatgatttgttttttataatcgatggtattgcttgggaagcttaagattttgagaaatgatagttagcttttgagaatattgagaagctcagattctgacttctagtttatttgggattgtttttgactctagaagaagctatagatgtcagaagttccctaaacggactcctaatgcaaaagaatgcatttcacgaaagaaagttaactttcctctattcaaaggaaatgcttgacatcgggaaaaacacaaaggtgttcatatccaaagcatgattgttggatatttgtttgggatcatatggctatatgtcatgtttagagagcttgatatctgtaactactcgtggagtttttcactgactcaaacaatcaaattctcgcttaaattatatgaatcagtagctagctttttcttattcacctcaaaatatagttttagagcttttattcaccagttttgatgtatacaactttcgatagaattttaataagatcatggatgcaatcactggtttgtctcttaaaatgtgtgttaggggacgcattcacgggagtgcgagtgtagtgctacatatatagtggtgtgtgtccgtgtgccatgtaatcgaatggcctgtttatattgtacccaaaataaaccttataaaattttgacaatgacaaaaatttggcaatttaataatatatattgccaaaattttggtaggattttttatgtatttactaaagtttggcaagaaactaaatgaatgtgtttatttgacaactctaaaaaaaatggtatggtttgaaatgacatcgatctgaataggtccgaaaataaaaaaaatgttgtatgattttataaggtataggaatactgccgttgtgtttgtgtagcgcaactgtgcatagtacagtgtctcatgttctcatgatctcgtccctttgccatgccagacgtacctgcccgcccagtcacctcgcctgcgtaatctctgcatatgcatcgcaattcgcaagaggcgagagggaggatccaatgctgctgacacggtgggtcccacataaactgacaccgtagcacatcagcacgctttctgagcttctccctctccggtctcacggtgtcccccgccttgagcctggtgaatgacaggtgggcccgtcctgcgcgtgggaccaaccggtcagggggtcggtgcggagctctgggctttgcagctgcaggtcgcacgtgtcgcggggctccatagcggattggatgtgggccccactctccccagccgctaagagcatgtacaatagcagactattagccagctacaaacatattttaaagagataaaatatgagagagaatagcaacgggggctacagatctgtagccagctgcagcacggactccaaagacacaatgtgtgtatgacatgtgggaccatgtactaatagtatagtaagcaattattgtatgaattggctattagcttggctatatatgaattagagctagtagtgggctatactattaaacttgctctaaccacacgcgggttttggttatagacttcataattttgcacatccttttacagaaaatctatcgtacggtattctgtggagacggaatagtagtactgccttatctccttttcctctctctctgtatctcttcccctccactcgctctctctctctgtctcttcccctccactcgatctctctctctctgactaccacccatgagcacggaggcggcaacggcgacgacggtggtggcaacggcggcgacgacgatgacgacggcgatgccgtcactactagcccccgcggatgacctagacgacagtcggcggaccaccacgggcgacggccgccgtcgagaagcctcctcatcaagctcctcaagccgctcctcctcttcatcattcttgtccgctggcttcctcgccgctgccgccctcctcctcctcggctgcgctggcgcctcctacagtcggggagcgcttggcacaacatgagcgacgaggagctgctctaggtggcgtcaatggagctacgggttcggcggtttggagcgaggcacgacgacgagcgacggaatggcacaaggtaggcaccagatctatcgcctcctcttcctcttcctccgccgccgcccagctgctcgacctccccgacctgcaactcctcctcctcctcttctctcttgagatatcacgctgatacccaggtaccaaggcctgatacctaggtatcagctcgatacctagggtaccaggtatcagtcgataccagggtactagctgataccagtgtactaggtaccacctcgataccttacccaaggtactagggaggattggataaggtggaatcacaggatagcatggacctccccacgaaattgactatgcgtattaaatctctcgggattttagttatcctgtgactgctaggagcaacggaatcccgtggggtagcaaccctcatccttttattaccgatggtgtaatttccccgtactgagctggatcacgagtcatcaaatattggtcaggatgcatgcatgttaaattatacggagtacttcttgtatcctaaaataaatagtaataaacgtaacacaaccgaaatataaaccgacttaattgcatctaagcgcgaaatgttcagaattatacccctaaccaacatgtccgtgtgagcacgtaatttcggttgatcagacctccaacggagtaagggcatgttcaatgcgtagcccggcgagtggctctggctcacggtgtcgattttttcggtcggagccgtctcccagcagagggccatgacccctctgcaggggacgcgcctcctgtgttcctccgctcctttttgtcgagccacaggaccgggcttcacgttggagacaccgtggctaggggagtggctcatggacactgctctcacccacggattttccccttccacccctagccccagcagtctcgtgcttaatagatgcttcattagcgacggcgaagagggaggcgcataggagagaggcgacgaggggtggtgcgagagagagagaggcgatgacgatgactagatctggccaccagccaatgacgggcagagagggaggcgtacgcggtggtgcctcgttgtcctctgcgacgggagagagaaggagagaggcgacgatgggtggcaaaagagagaaagaggagagtggcgacggcgacgaccagatccggccattgcgcgccgtggcagccgtccgtcggccaccagccggcgaggggcgaagggcttcctcacgcggcggcagcgaccagatctggcgcaggctgtcggcgcggcggtggtggctagggagggtgaggagggaggcgacagcggtggctagggagggcgaggagggaggcagcggcgagcggcgggggagaaataggcgacgcgctcgagagagggggagagattggcgatgcatgtgcgcgagagagaggagaagtgtcggtagggaaaaaaagtcgtcggtgagctggaggatagaggagggtagtataggaaaatattcactgtgggggatttttggttggaacacccactgtgggcctgagtactttcacccaattgcctcatattttaaagagcctatctagtgtagcctttattgaaagatgagtgtctctgagaatgtcctcagttagtgagaacaatctaggggtggctttgattttacatgctctaagtgggctgccaattccctttttttcctagtaactcatggtttgtgttgcatatggggatagattaaaaaacaatctagtttgtttactaaataatatccaacatagattaatctggttggtagcattctacaaaccagattaatctattttggatatttagtaaaccatgctatttcagattaatgccatttcaaaccatgatattatttggtaaaaatgattatgtggctatatttagtaatgactatggaattttgacaatattatattgagcacatcctactaaaatttggtaatgttgtcaatttatcaaaattttggtattaccaaattttgaaaagttgtattttgatatcaatctgaacataccttaaggtcctctttgattcaaaggaaattcataagaattttaaaggattttatttctatagaaaattttcctatatagccctttgaatcaaaggaatgaatcctatgcaatcctatgaaattcctatggaatgcctcttcctatgtaattattggaggaaatttagcatgaggtagaacctcatgttaagaattctttgagtctttatatctactcaaattcctgtatttttcctacggcttaatcaaacggtcattcctatgtttttcctgtgttttgtaaccctctgttttacacttatatttctgtgagaattctatgttttttctattcctccgtttttttatttctgtaattcaaagaggccttaactcagttgtttgttagtagtagttgtttgtgtggccactgtacaaatttcatgtcactgcgcgcatataccagaccaatcaaatgagtaagcacaaagcaatcgatgcgctaacatgtacctactcctgtattacattgcgacaaacaagatatatattgcgaatcaaagcccattaatatcttggttactatttactccctccgtcaaaaaaagacaaacccggatttccgtgtccaacgtttaaccgtccgtcttatttaaaaaaattatgaaaaaaattaaaaagacaagtcacgcataaaatattaatcatgttttattatctaacaacaatgaaaatacggattataaaaaaatttatataagacggacagttaaagttggacacgaaaacccagggtttgccctgatgccctggcacaacgagctgaacttggttttttttttgacggagagatagttaaaaagacggccaatttatttcactgggccttgtgaaccgaattggcgtgctcacactagcatgttggttagaaaaataatgctgaaaaatacatgcccggatttgaaatcacgtggttgcatgtgtgtttagattaaaaaaaagtcatgacctggtttcaataactgattat

SEQ ID NO: 33918 - DNA, 5019 bp, Oryza sativa
ccgttttttaatatatgacgccattgactttttcttacatgtttgaccattcgtcttattcaaaaaatttacgtaattataatttattttgttatggattgttttatcgttcatagtactttaagtgtaatttatatcttatacatttgcataaaatttttgaataacacaaatggtcaaacatgtgagaaaaagtcaacggcgtcatctattaaaaaacggaggtagtaatgtttattagaaataaaaagataatttactagatgtttcacgagtaaaatttttattcatgatgacgtggataaacctcatagatctaattttccacatctaactacacatttctatttaatatgtgtgatttgcaccgcatactttccccgacaatagatcatcctgtgcgcgcttagagcaggtacaataatagactatatatcaactataaacacatatcgaggagatggaagaagggagagatgagcagcgggctatagatttgtagttagctacaacacagacttcaagacgtaatgtgtgtataacagataagacccgatattaatagtgtagtatattgtatatatttgtagataactatggtatgaattagctattaaatcaactataattagttggctatattattaaacttgatcttaaataattaacgaaaatcatcgaggtaggcgagggcagtttggtcagaacacacacaaaaaaaaaagttaaagctcggaaacggcaaaagctatggcgaccgaccggtcacttcccactccccagttcccagtgaacagagcaggagcagcctccactcctcctctgccactccactccccaccaccactcgcatcaccatccatccatccatctccaacccaagccgaatcacaccaatcgccatcgccatcgccatcgccgtgcgtggtcgccggtgccggcggcggagggggagggggaccaagggaaaagagagaaggtgagctgagctgagctgaggtgaagtggtgctgaggcgagtgactggggggcaatggcagcggcgtgggtgctggccgcggcggcggcgttggcgctgtgggcggcggcggcggagggggcaaggtcgccggcggcgagggtgcaccggcacctcaagaggctcaacaagccggccgtcaagagcatcgaggttgggtggccagttcttgaaaacatttgcttctttttattattatttcttttgggggttatcgctcaactttgtgttgttgatgcattgttacattgggagttcaaaatgttagtattttcatttcacattcttttttttttcacttttgtttctatgagttttggtctagcattgatttgctaagattttgagatggattgatttgcagagaagaaagtttgcccctcttttctgtgcttcttttgggctgttcttggtagtttttctcattgctgctgtaaagaatttttcgaaaaagttgcaatcttttggaggtacattttggcaactcaagcaaaagaaggcagaaaagacgtgtcctgctttcaggctggctctggcaaagttgtattattctccaatgaaaaaaggggttgaatgaacaattcctttttttaaatctttctttacatttccgaacaatgatttctgcgttttccaaaaagttcaaaacctgaagcgtttgtcttcttttttttggtattattgttattattatttgtcatgaacaaatgtcctatccgtttgaaactgttttgcaaaccgatgcagagcccagatggagacatcatcgactgcgtgcatctctctcaccaaccagcatttgatcatcccctactcaagaaccatactctccaggtaaaatgcttcactttgcaatcatttcaaagtactcatcaaacctgcatttaccacagtacatctgtacatggtccaatatgttgcattcaacatttttctaaaagaaagctctgtcaaaaatctttatccttgcagatgaggccggcctaccaccctgaaggcttgtatgatgatgacaagagaagcgtggcctctgacaatgccggcgagaagccgatgctccagctatggcatcaaaaggggaggtgcccggagggcaccgtcccgatcaggagaacgaagaaggatgatctgctcagagcgagctcgttgcggcggtatggcaggaaacggcataccgccgtgaacccgctgtccattgatcccaacatgctcaatgagggtggtcaccaagtatgtccgaatacgatgtcatgttgagttgaaatcaaaatggaacatggtaatggcatcggcatgtttggtacttaaccgaaactgttttcttgttgcaaattcagcatgccatagcgtatgtggagggggataagtactatggtgccaaggccaccattaatgtgtgggagcccaagattcagcagcctaacgagttcagcctgtcccagctctggatcttggggggttcatttggtgaggatctcaacagcatcgaggccgggtggcaggtactactgggaagaaaacctgagctcatatgagcttcatcacattcatagttacgcgaattgaatgatgaccgttttcgcggtcggctgtccccctgccatgatgcatggatgcaattgcaacctgtgctgtgtgtctgatcatttgcgctaaccgccgtcctttgattcatcaggtcagcccagacctctatggagataataacactaggctgttcacatactggactgtaagtttcacaaactcaacaatccatatgcttatactattgatggtacattgttatactattaatgttctctgtactctggcaacagacattctgttgttgatgcattaacttcggtgtcccttacgtttgctttcgcattggggtcttttttgtagagtgatgcttaccaagcaacagggtgctacaacatattgtgctccggattcattcagatcaacagcgagatcgccatgggcgcgagcatcttccccatctcgaacatcgccggctcacagtatgatatcagtattctgatctggaaggtgagcaattcttaaactattaccaaggcatcatcacataatgacatgcttagtgccttgagaattagcataagaactaatggggccagagaatctttccccacttgctctaatgctccttcacacacctggttctttgaaaaccattttgtccaaatcacatgtactaggcatgcataactaacactaatgtggcatctctagtgactatattatcgaaaaaaaactctaattatatagtaatattctatgtgcttcatctgtggacaggacccaaaggaaggaaactggtggatgcagttcggcagggagtatgtcctcggctactggccgtccttcctcttctcctacctcgtcgacagtgcgtcgatggtcgagtggggcggggaggtggtgaactcggagcccgacggcacgcacacgtcgacgcagatggggagcgggcggttcccggaggaagggttcggcaaggcgagctacttcaagaacatccaggtggtggacagcagcaaccagctgaaggcccccaagggggtgggcacctacaccgagcagtccaattgctacgatgttcagaacggcaacaatggcgactggggcacctacttctactatggcggcccggggaagaactcgaattgcccatgaatttggtgatgaagaagctgatgatatatatatatttatatatatatatataatatatggtgaagtgtgcaagtgtaaccaagcattaatcatgtgtggaatacagattgatctgcatctgtttcttaatttagccctaggtagtatatgtgtatctttcctactgattttctttttcttctcttcattagttttttcttcttctttttctgatgtgccatgtaaaagtttctgaagagaagcatggcgtgaggtggtggtgcaggggtgatgatgacaattgatttgtgggtaatttgcaagtcaaacggcttgtgatcagtactacaaatttattagctgttgtgttagctgataaaatgacttggtagtagacagtagttctgtagaaacgtgagaaaatttgacagattcgaaatacaaattcaaagcaacgaggaagggagctgggctagactgtcagaaatccaatgtacacgaagagaaaataataaattcttgaggtggcctaccttctcggggaacatgtttgttctcagaagagtgttggtagctgagaaactctgaatccatggttcacctccattttatatcaaactagccaatagatcgtgcgttgcaaggaaaaacaaattaagtttatagcttattcagtcaattaaacacatatttagtctaagtagtacttttatgtttttttattgaacaagtagtttcttttttagataatagaaatgtgttacatctccgatctctgcccgtaggcacacaacaaaaagtctagaagtgaacagaaaaaagcttaagaagtacggagtagttgatttcaaaatttaggaagagccatgtataatagtatagattgtggtataataacatagatcgttagacccaaatgtcagtgataagggtggtgtgataacggccagcactactagtaacattttaagtagcataaatgcataccgatagatatatgatgacattttaatgcaatagctgtatcagggtctttgggaggaaaagcaagagtgatgaatgccaaaatttatatgaagatgtcaaattttatatgacaccgttgatttttgacgtgatatttgatcattcgtcctaattaaaaaatatatataaatgctatttatttcattgtgacatggtttctcattaaataaattttactataaattacacttaggcatatttatacaaatgttttttaaaaaagaatgatcaaacattatttttaaaagtcaacgacatcaactgttaaaaatggagggcagatcaacagtgttagcatcagtgtcaggcga

SEQ ID NO: 33919 - DNA, 20128 bp, Oryza sativa
ctgaaacggaggtagtatcaattacagaagaagagcgagaggaaaaggagggcaagctgtggcggatccagaaaatcgattcgttagtgtcagaacgtgtctatcggtgtcatagtatgctaattacacttagatcatggtgttatagcatatgaataagcagtttcgctataggttttgccgaaagtcgtcggtgtcgcctgacaccggccctataactatagatccgcccctgagggcaagtgtgaggcaatggaggagacctaaccggcggctcaccatcaccggagctgtctgccagtcagtctgccgtggccggcggtggcatggggcatggccgaagcggagcctcctctacttaggccaaaatttggtctggtctgaggcttcagctaggtcacaccaccattcattccttcattcatcgctgcccaaattaagtttgtaatttgcacccctagtctctccaattttacaattcttaacattttagacaacacatggtctccaaaatatatctttgactatatatttctattataacatactagtcgcatacctgtgcaacgcacaggttattatcaatattttaaacattgtttacttcttggattttatatttgaggtgccagtcacttttgtcatataatagccctatggttctcatcactaccctatcactgaaaacaaaaattcctttctaggataaaatgctggaaataggctactataacatacaaaaattttcaaaactacggaacattaacttataactcataacaattttttttaaaaaaaatcaaaattacatataaataaagcaaacaacaaaatgcagttaaaatgatctaaaatcccacactgcatagtgcagttttgaggactaaaaagttacagatttttaggcgccttaatcaccttgtttcttattcataattatatatgagtaaaatatatggctggtccctaaacttgtgtggtggtgtcacttaggtccgtgaacttggtttaatgtaccatcccggtccaaatgtcctttaactgcgtttgaccgcatgccacgtaggtaacacttttgctctcagccccctccacatcacaatacatcgcatatatcttcttatagctatatatagtaacactagaatccaaaaaaaaaaatctcaaatcgttctcccatctcattcttctcctttcatgtatagaaaatgcggttccgattagcaattgctattgctccatgctccaaaataaacttattcttacacaacgggcacttgatcaacaacacattcttcccgtgacttcaagatgggggtgagcttgtagaatccatggggatgcctagcgtgcaagccgcattgcgctgcctcctatcgcaaatctggccgcactgtgccaccgctaatcctgctataccctgtattggcgctgtctcctggcgctaatctcactgccaagaccgccacaaccactacctttcggtctccttccgcttacctcaccgcgaaaccctagatgatttagggatatttttggggatttgggttgaaatgcatttgtcagggcaagttatgtgcgaaaatatatgtgaagggggctgaacacaaaagtgttgcttacgtggcatgacacattggcggtcaaacgtggtcaaaggacgattgaacgggggtggtacattaaaccaagttcacggacttaaatgtgcaatttttaagtttatggatctaagtgacaccacctcacaagtttaaggaccggccatatatttcgctcattatatattgttctcatattcacaaatatcttgatcagaaattgctgacaaccttctgtagaaaaattgtcattcctcctatttggaaatgttaaagcattcctcttacaacaaaacccaataaagcatcaagcacgtggatatcccttcaacaaaacataaatcatcgaaaggatatcagacgacttaacgaagcataaaagcggattggaaatggacgactatttgaagaatgcctaaagatcacatattgataagtccgcattaagtcgtcaactttggatccgactggggatttttgaagaatgtttcatgaaaaaattggaaagcaatgatgttgatgcttgcttatgaaaggacatggggggcaactaaggtcttgttcgtttctccaacaagatggagatgaaattttggttattcgtggcacgcttattaaactgctaaacggtgtgtttcgtgcgaaaactctctatatgaaagttgctctaaaatatcagagtaatttatttttcaagtttgtaataattaaaactcaagtaatcacacgttattaccacctcattttgcgtgaaacacttaatctttatcttcaggagatacctaagcattgaacatcaggaccatgaatatacctgataaactcccaccgaagaacagatccagaggtacttctctgttgctctgcgatatggtcaagaaagcgcgcatagatcaccagattatttacatccattatatatgacatggcaggcactaaaaaacaatttatattaattattatgattaaagagtcataagctaggtaatcgatcaatcaatgttgtttaagatgagaaacatgtgaagaaagaattaaattttgaaaaagggttcaaatcaaatcttgcatcagttgagaaaatagcatgcaatagtagctgcataggattgatccatcgattatgaaaccggagggagcaacttctcttgactttgagtgaaacccccagcccaacttgcatttgcgttggtgagtgaccatgtacattttacacgttgggtggatgttgcatacaaggaattcactccactagtgtaacttaatcatattcagcacatagaattttattccatgaatatcaaacaatgtggatatttcttttttttttgtggtcctgtactcttgttcgtttctccaacaaggaggagatgaaattttggatactcatggcacgttttttaaactgctaaatggtgtgttttgtgcgaaaactttctatatgaaagttactctaaaatgttagattaatctatttttcaagttagtaataattaaaactcaattgatcacatattattaccacctcgttttacgtgaaacacttaatctttatcttcacctttatctttagaagattcaaacaccaccttaactgtacggggaattgtgtccttgcaaagtctaggtttgaagagctactgcagcagtgtgttttgtatctccaagtccaaccgtttaattggaacaagtgcaagttctatctatcgactattagcgcaatttgcaatatggtttttcaaatggtgtcctgcgctattccaccgttgctaaggttttatcctcatccgccatagcaaatgttttattctggttttgcgatagttaaggttttattctgcatcggtcattgaagaagccatacatagtaagccataattgtcttttatctttttttggtgtgttaataaaattaaacaataggatcagaggcattgatggtagggaattttccgaacaaaacgatatatatatttactggttttttttctctttctatacttcttctatctataaatatcaaactcggacctaatgtctcatacacacatcaattacaatacaatctggcatatagcacatattagctcatcagtaagaaatggtgaaccacagctgccaaggacttttgttacttcttctagtgtgttctgccatgcctgcacttatcgagggtaactaatgaatcttctattttacttttgtaggaagggggctctaatttgcttttcatttatatgtcgttttgatggcaccacacttaaaatttcatcttgaatagattaatcgaatttacatgtacattattgcattttcattctattttgacaatatgtatgttcccttgataaacaggagctgatgttaaagattgcattcacaatcccatggaccctcatcaaatagataagaacttttgttgtgtaaaggataatgagtgctggatgtcgattcaagagtgcctggcaaattgcccatgtggcaaaaattgttcgacgtaatcatatgctcattagttagatctgacatctttagctagatactacgttaattatctctactacatccggtaatgctggcgagtgccaagtaaaccaaaggtccggcaatggtgttgtcagcggttgtgtgtgagggcgaccgatgttttcctttttctccttgtttaccgattcaacctaactaagatgatgtttttggtaaggatgatatttttttcttttgcatttattaatgtaagggtgaccaatgtaacccctgaatttatctaaaataaaatgaagaaaaaaattgaactcccatttcaaaatggtagttcaatttttttttcttcatttgattgttacctttgtttctatgaattttggtttagtggtgtagccgcatttgttaagattttgagctggattgatttgacaagttgtgcattctctaattcagaaaagtttgcccctcttttctgtgcttcttttgggctttcttggtagttttttttcttcttatagctgcttgaaagaatttttcgacaagagtaaattgcattcaagatacacgaacttgtaaaatgatcgttttggtgcatgagcttgtttggtgcgtgcaaaaaaaggtgaaaagaacattaaatggataatcttattgatttaagggctgattatgatactatataaacatatatttgagaaggttgctattagccatacacctcttcaataaaaatatagaatgggctatagtgaacgcagaaaaatatatgaaaaaatgagcaatgatataagggttagagatatatgacattcatcatttacacgatgaaggaaaaagtatagaccaaaattataaatattatatgctttatgcatactcattacacatgcacgtcacatagtcaacatcagctttgtaaaattagcattgcaagctattttggtccccgttcgcacgagctagacaagttcgtgtaccgaaacgagcattttacaagtttatgtactaaattgcacccatctaacaagtttgtgtaacaccaatgcaatttactctattcaaaatctaggataaagtggttgctgctctaagcaaacgggcgaccggtcgctttgtagtcatgtacatatagaaaatcctcaagaggatggtaggggtatagatttgtaaactttaaaacagaattatacttttgtaaatttttcaaaaagaatatataaatatgaaaattcctgatttctactttaatggatcttgatcctacatatttgggtccaatctgttcgtgtagccttttcggtttggcccgatttgggctgggaattatttatttgtttcatcctgcccaaaaaatacaaaccagatccaaatagaccgaaaaaaaacagaaggaaaaaaaaacgatacccagcccaaattgggcacgggccgaaaacttgggttagtgcaaattgacccatatataagtaaaaagaatgacaaaatagaaataaaaaaaaagagcgtgcgcgcgcacacaacaaacccacttgggcttagggcacaacgaagttacggaaaaatacgacatgtaaccatagtaatagcattgaagcataatgcaaggctataagctaaggaagcaattgtagtagtggatggagggaggcacagtttaacgccttacgagctgtctagcgaatttatttatttattgaacttagctgcctagcgaatttaacccatggtaagagaatatgtacgcagagtttaacccctctgaactgaatatcgtgccaagttgagcgaacgccaaataaatcagcttcagttgatgcagcagacagcagttctgattgccatctgtccttggcaccatctttgccactgtttgctgataatgcgatgaagagtagatagtagtcagatgttgcagttagcgatatctattgactaccacttccaatggttgctgtgttatcaccatgtcacgtattgagctcatatattcccatgagtcctacaaccaaaatagagggatctaaagaggtcttgtgttcttccggagccagtcgagagaatggccactcaacaaaggggaaacctgaaagtgaaaatgattgtggttaagcaacgcaatggttcatatgatcttggaatgatgtatacgaggaataattttgcttcccaagaaacagtcgacgattcgcatcctagtgaatactacctccgtcccgatataagtgcagatgtaggtttccgtgtccaacatgtaactgtccgtcttatttaaaaaaatatttatgattagtatttttgttgctattacatgataaaacatgaatttatgtgtgactaattttttttatttttttcataatttttttaaataagacgaacggttaaatgttgtatacggaaacccacaactgtacttatattgggacggaggtagtactgaatagtgacataatacattgggaaaaaagctagtacatgacaatcaaaaccatgcgcatgtgctgcatgcaacagtatgtcctaaatattgcgcaacaattgacatttaaaaataaaaaaagtgctctttcttatttaaatagccacacctaatgcaggcttagaaacagatttggatatcaattgttcaaaaaataattttgcctcaatgacatatgactcaccttttcccagacttcgtcatggtattcattgatccaattgatctccgaaggtgatagtaaggacaaatcaacaagcttgctctgaagttaccaaagaaacgaaaattaaatgtacaaggtggatgataataaaaagaagtgtacatatagaacagcacacaaagactcaggttaccagtccttaaaataattctgtggtaagttattaatttcataggccaacgttaaattactcagacttgattactcattagtaagaaagtaatatgtggatcaatgccattattgcaatatgtttccacaaaaaatagtatcaaatcgagttgatggtatacctgaattggaacaaaagttaatttttcaaaaccaaggtacgagacgccaccaaacgaatttggcaaattaacctctttgaccagaagaagattctgcaatattcaagaaaaaataatgagaaatggctattcaatgtactatctgcacaattgctcaatttagtcctaaaaatttaggagactgacatgagcaaagagtggggaaacctacctctatacgaatgccaaaggaattgtcttcgtaataaccaggctcattgcttacgatcatgcccttctgtaaagctgtcaaatttccatatcgatagcttatgctctgagggccctcatggacatttagtgcagctccaactccatgacctgtgcctggaacaagagaaaaattgatcatcaatttacgtagcatcacatgccataacttccagcattcagagatttttgtgtgcttagaaaatgtaccatgtctgtaatccagcccaatcttccacagagaagagcgtgcaagaacatctaatacaaagccaggagttctctctggaaataccgcctgatcgagagctatatgtccctgaaacaataaaactttatgactcgaataaagtatgaaacaaaaatcaagtgttgagtgagacaagtatcatagcacactgaaggcaagacatactaaataactgttacaattgagtaaaaaataactgttacaggtctaaacaaaattaaacattacctgcaaaacccttgtgaagcattccttttgccttggggttggctcaccaaagtgaacagtccttgttatgtcagtagttccatcaatatattgagcaccactatctaacagaaagagattgtcgcttccgacagagctgcagctctctggagttggtctgtagtgtattatagcaccatttgcaccataacctgagtggaaaatttgactacatattagaagtcaagaactgcagacatcacacggcatttgcaaacagcagtagtccaatgtcacattaaacattcccatgatgctcagcatgaaaattgagataagtctaaaccataacatgcattgtactcctaccatatatcaatactcgttttaaaagaaacaaggcagttgtggcactgaatctgccagcacaccaactctgcagtacatttgtaccaagtacttcttaagtttgttaatattgttagtatcttattccatctctaaattcatggaaaggtttatggtgacaaaaattgtcacatatatagtataaatgctaatttacaaatagagtaatgcaaaaagttgtctaagtgttcccttcaacagaagtaacaaaaacatggtgggtgagttcaatgaaaaaaatcacgcaatttattcaaacaatattagcacatgtagatccattttcattcgtagcaacacatggacatttagctagcaaaactaaataatgaaaaggcttagataaactgcttgagaatagtaacaaagttccagatcgattggttcgaggaacgtgatatgctacttgcaagaggtgtttacaaggtggtacgaaaatgtccacgtgttcccaggacattcctggtcaaggagctgccttcgacccagatcatgactaaccattaatgtatgcataattattccctaatatatacaatgaaaaaatgcagtaggctcaagctgagtgaaacatgttacacccctccctatcaaattacgctgtaataaagaggtttgagaaaggcaccataataaatacctaaagacactctaccaactacaaacaatcaatccagataatagatagcaataacaaacaaatattaacatttgaaactcaagatactggccatgtaaaacagttctcagggattttaatattgcagggaaaagttgaaatataccactgatagtgtcaaagcttgtatctataaagccatcttgcttttgacgaaattcaagaagcttttcagcaacttgcacttctgtaagtggtacactttcacgaacttgcccttctagccagcaccagaattctgctaaagcagcagcatctctgtaaatgtatttatgtgccagtatagacaatgcagtggtcagctggacccaaaggccacattaacagaaaaaggaaaaaaaaaaagaagatgcttcctttacaaaatgaaaaaaaaaaaaaaacacccagccgctgcactggtaagtgcagaaagccaaacaacaagaagatgatgaatgctgaaagtgatgatgaataaaaacccattgctaatgaaaaaaaatagtaacaatggtagtaggttaaggatctccattttctgtggagaatgacatcatctaagtacatgtctatggatggagctttgtatttgatctctactatgagttgctcactacatgagaatttggcacgtgatatccatatccatatttaggatatctatttgtgcacgatgaataggtaagcaggcactgtgtttccattgcaaattttgtgacctagtcgtatatagtgggaaactgatatgagatatattagaagcaatatcatttattgtacatcagtacactagtatcggatttgtcggagtaaggggaaagattattagacatttttccatgagtgaaattgtcatatcattagacattttttacatgtataaataattatagagcttactgggcaagtataaagaaaaagaataattgaagtgaacaatccgtacagggaaaatcacatttatattgttgctacaatgcaataaccagactatatggttgcctcaggtatggttctttcaattccaggaaatcaaggttctgtcttcactcttcaggcatttttcaactgacgaaaaaacaaagaattcaaaaacattttttaaaaacgataccttaggtgtgaactcttcataccctcaacttctgcttcattcttaactgctttggctagggtggctggtgaaactttgtatagagcatttacagttccattctgaacaccagagcttccagtagctgggtcaccttgagatgattcttttccaatttgtctccctgcttttcctctctttttcacgtatctctcacagcttgatctaaacacattaactatggcagcatttatacttgaagaatccagccaaagctttgcaccattctctgccaatctagaaaaggaaaagggaaacaatttccagactaagataatcatggaggagtttaagaggtgaacattgacaatttaaattagtctctttcatataatcacattttaagttagagctactaaaatacaattataaaatttaatagaaattggttcaagaatactgactggaacagcacacaagtactgaaccagaccaaggactggtaaagttggcacattattataatcaaataccatggctaaatgccctttacaaattttgggatctcaaaaacatgtttggtgttcaatcagtaacaagctcaagtccttttgtgaggtatacgtgcaataatgcgacataatcattatgtatttctttcaaaatcatgtacatgattttaagttcacagatgaacataaaatcaatatgtgacaggaagaacaggaaatcctaccacttccagggcagagaagaatttagataaaagctgttgaacacggaaatgacgtaatgggtcactggtttcaacaggttatcaactcacaaaatttatgatcagaattgtatatccgattggctaagactaataagcacgctcaactaccaaattaattaaaggtggttcttatctaattccaaatataaagggagatgatatgacatcaatatcagaaacaataattgcttttctgaagaattacctctcaacatcggacaaaatcgcttcatatggttttagttttactccagccttttcgaggtgctctaaaacatcttcagatactttgttgttatccacaaataatgtagcagcggtatcctccacaataaggtagctataaaatacaggtgaatttggaacatcacttcctctctgcataccaaaatgtgacaaactgactagcttaaccataataaaccaaagtgcaagcatgctcaacatagtagaaaaaaaaacaaactctgaacacgaattatcaagtgtgaaaagtgctaatatatcatgccacctcccaattatggattaatgaccttcataatttgcacaataagacaatagtacagaaatgtatccgataagcagaaaacaagtttacaaccataaaagcacaaaacataaaacatccttcaaattatgaaaagaaagtactaagtgctaagcagaaagtttggtaaaaacaaactttggtaaatattaatcttgagctacagatagttgagaatccataaaaaaggaatatagcaataaacataggtgtcaagtcataagaaacgatataagtaactgtgagagccaaaatattagtaccatgtttaacaaccatgcaacttcatcaagcaacgaaatgaccacagcattacacccattttcagcaagctgtgatctaacaaaggacaattttgatggcacgtcaacgccagcatatttgattccatgcactctagtttgttcttttgggggctctggccttgattctccccatatttcatcaactagattcaaatccttgatcaaaactaactcatggttcttctcggaaatagcatcttttagttcttcagctgcatcaaatgagaaaagaaactgcatccttcaaacaaagtaagaaataaagtattaggacaagaataaaatgaaacaaaaatatcaaaacataaacaatttttcagaatgcacatttatctgaaacttagtaggaagactaaatggaataaagttcttggtcagaatgtaacatttacaaagtaaacacaagaaggtttcaaatgactgtaaattttaccaacagtacacattcataaaacggttaacttcttgtgagggagatataaaatttagataaaaaaataagatctcaaattttaagatgcatgtgtgccacaaagcagtttcaggatacgattttgcaatttaatttaaacatcaatctattctttacttctaacatccatacactagtttgtcatttcatgggcatgtaagaatttgaagtacaaaaactgcatgaaaagaagcccaactaaaagaaaagataattatttatcacatgataatggcatgagaaaaggcatattagcaaaataatccatttttagtttggttgatgataaaacaagatctcaccgggtcaatgccaactcggcaaccagatggtaacacctcgttcaaccattcgctagtggtaggaacaccttgatttccactgcgcatgagtgtccaatcatggctcagttctttctcagcctactcaacagaagaacagatgaatgattagccaatagccacataaaaccatggttgctaagaaattaatttgccgtgtgggaattgagtacctggagaaagtaccggccatcagtccagagagcagctttatcttttgtgaccacagccgtaccagcactaccagtgaacccagtcaggtaagcacgcctcatgaagcattctgcgatgaactcgctctgagaataagatattaacaaaagcaggtaagtgggagaggggcatgtagtttcatgagatcaagaatgcattgaggtttttctacttcctagtatcatggagcatcaatagcttcacaaacaaacagtgtagacactatatatcatgtgctcccatgcatacatgaatccttgtttcagatagctagctaacgatggtttactgaaaggccctgacatcaaaatcaggccatagaacatgactacttgccagatacaaaaagcatacatacgcatcagtagttgtttccactaatatcaacgcacgatcgaaacagtcaatctgcaactgcaccataatcaccattgctcaccatttctgcactactttctgttgtctccattagtgtatcatcgattctccgtacggaatgatcgaataattgggagcaaggcagggtgtactaatagacctggtgggcgtcctgggaggggacgatgtaggcgtcgatggcgacgtcgggccgcgcgaggaggcggcggagcgagcggagcttctcgtcctcaccaccaccaggagcagcggaggaggaggatgatgcgccgccccggcgcttgcggagctccgacgaggggagggcgacggcgcggccgtccccgcccgcggcggcgaggaagcagaggcggcggcggcgcggggggagcaggagcgggagggcgcggcggagggggagggcggcgggaggagcgccgcggcggccgaggatggcggcggcggcgagggacggggagaggcgcgcggcttcgatcgccattggagcggaaagtggggacgacgacgatgatatgataagggagggagggattggaggctagagagtagagagagaaccccggcttgctttgtgatgtgatgtggcacaactgggccgccactcgtcattgacgggccggcccgggctggactgggccaggcttgggcccaaacgataagcggttgttgttattataacatctataaaataaatttggcatctataaactaaaccacggtatcccgtggggacgggatagcgctcatcgacccgagccccatctatttgcgctctcttttcagataattttgaggcctcgtcaactcagctccccaccgacatggccagcggcggcgacgacgactctgtctccgcgctccgacgacgccccgcacgagctgttcatcttctccacgtctcgtcggcagacgacgacttcgcctcggtgctccgacgacgccttgacggtggagctggagcgggaggcggtgggtggggtcggggagcacgagcggctcggcaagcgatgcgcgcaacgcgtccaccagcgacgccgccgccacgagcggggaggtgtgccgacacgagctttctcgaaggtgtggtccaagtgccgcgctaccgtcgtcttgcctccatgctccaccacgcgttgccttatcctctctcttctcctcctcgtcctccagactaccaggtatcaggtatcacgagtacctaggtaccatacttggtacatgtgagtattaggcctgatacctttcgtcatcgagatggccggcggcaacggcggtgaggtatgtagtgtggttatacatgacggcagtgtattgcagtagggaagggaacatggacaaacttgatgtgggcgacgtcctcgacgagcagctcgaagtggcagccgacgcacgttaggaagagtcgtgtggctgcgcagctttgttggaagcttgcatgtgggggtgaggtgcgcgacttcggggatatatgcggcgttaggctgtcgccccgagcaatgcgaagggcatcccgttcccacggaatcccgtggggtagcagccctcaagaaagaaagataatagaaaaacttggccagattttgttaggaaagaactcactcttgttttgttgcgcagggctggtccgataaacgatgcatgggtgggtgatcgaccgacggcatgtggccggccaggctggcggagtccgactcccgaattcaatttggtgtttcttgggtttccttgcgtggacttgagatatctcgagtcttaattagtttttaaacctaatatgacgtggagagggtcttgtagcagacatgaccaactcttttataagggatatggctggttcaattgacgaactgatctacaatcaatgctattagccaattaaatcattattttaaaatcacaaataccttttacctagtttttagcctacttcgtccatcttcttgatttgccctgtaagccatctgtctttgtcgcgagaatatagatcctcctataggtttatcctaaaaacctttcattttgcccacaaggcggatttttatcttagtttatctaaaacagctccagtagccggttttgatttctaaacccatcttgatcaggagttttatcaaggtcgagttgattgacgcttcgttcaaccccgtaaggctttaggtgaatcccgatcatgtgcggtggtgtgaccgaaaatggcgtcgaaaatggcgtcaacagatggtaatctttatatttcaccatactattgtttatacccttagtggtttaaaaaccaaaactgaaaaagaaaatggtgaaaattcatgcataataatttaaaatgaagttttaaaatttaaacactcaaaatatagcattcctaggagtaaaaatgtcaaaattcaaaaactggttaggactctctttgagagagctggagattctaagtagttagaatatgaaaaggctgggattactagcttctgattctagtttatttgttaaattatacggtaacaaattctcagaatctaagttatggagtaagttataaccaagaccgtttggggaagatgggagattttaggaagttggcacaatctccctccaaaggcaccgcaagcagcaagcgccacgcgtgagttcaccaacctgctttttcaccaatcttcatgctgaggggttgtttggttcttaactaacattgtcttaactcacattaggcaagtgtggcttgccatacttttttggcctacaaattgtaagccacacttgtggcaaagtgagacaaagcctatgaaatgtagggtaaggtgttaaaaagtgtggcttaccacaactacggcaataaaccaaacacaagactaaggggatatggtaacctaaactgtggtatggcaagttaaagtattaaaccaaacaaccctttaaggaattgcgctgatcagacagtacttcctccgtcccaaaatgcagatagttttgaggttagcacaagtattaagaaattagatgagaatgattgaatgaaatgcgtgattggttgaaaagagaaaataggtgaaagagaatggttgtggttggttgagagggggaggtaggtgatgttagaaatagctatattttgagatggagatagtaggtactactagacagtcgttgtcacaatccagatacacgagtaatcaacaaatcttggtatcatgtcaggtcacagtgctttacaccgtgtatgtatgtcagttgcttgtaagggggataaagggtctgttgggggagcttctagctgctgcagcttctcccataatcagaagctccccaaacagtacagcttttggtccagagtctaagaagctatagttgtagaatttagaaaatgaactaaaagctagaagctgactaccaatcagctgcttctcataattttaagctcccccaaacaggcccaaagagaccattacatgcatggacaaagatggtgctcccatttacataatgataattacatttgaagttgtcaacagggaggcttctctttctggttcaagaaagacacctctttttctcatagaccacaccaattccgtgatgatatactctccaatttgcagcatttgacacaagttacatacacacatacatgtatagctcgtgatagaggcactgctccccacagtttcttctctacacgttgcaatggcaaaaacaaacaaaaaagaattaacctatatatatgtatataccgctatacataaagaacgaatcgagtgggtgttgaatccggttgaccctctaagaccatgcacacggatatgcatatattcctctttcaaaataaacggaaaattgccacatcattcggtttattatcggcttgagatttcttttctttgctcatctatgtgaagaacttggtggcatgatagacttgctgctgcaggctcaacctctaacaaccagcagccctgcgaaaattgtcgtatggacttgatgccggcaacctcaggaaatgttgctgggcttgctcataagttggctgtggattggcttcgttcatgttcatgtactgggggtaaccatacaggttatcgtcgacgaacggattcgtgttcggcaccccaacctgctcagaatcaaattattggccttaatttattatatatatgaaaatgcagtatatgtatatgcttttgtcagtggattgacatggtaaaagaagaatggcatttagagttgaaattgtttgctgtgcgattcgatctacctgaggcggatatgggtcatggaaaagggacaaatccgtctggaacggctgattggttgccatgggatccattgtcatatcctgcgagaagctcatgaaggaggccattttctgatgtttcctgacagtgagggcttcgcattggctactcatctccttgaatggcatgtctgttgatacagacactcgttctgtatgaggtgccgggtctgtgacaacctgtgaaaatgccagaggatgaaaacataagtcaaatcggttatcatgccaagtgaaacgaacttatagatctagcattctttacttttcaaacaggtgttgttctttaattaggacgttgatgaaacaaataggttaatttgacatatggttagacaatatagcatttcaggcatggatcatttgttttctcccaatgataggaacattgactttgatgtatcacattggtgcaggtcttggttgaattttgcaaatgggaatcctcgccattctgctgagatcttgtaactttcaaactactactgtatacctgctgaaaacttggtgggtgttttcctaggtatcctagaatgcagaatatcacacacaatagtaactttattcatgccaggttacctcatcagaagagtacaacaagaacatagaaaatgagtttaagagagcaaggcatactgtttcaagaagctgtcgatactcaaaagatctgttacaggcacagcatttgcagaagcagctgtactttctgaagcttccccaaagatatcgtggtcatttcccaggtcgatcagcacagcctattgaaaaaaaacacaactttagcattttaagtaggacacaaaatatatttgcgagcctcaaaatacctctggatggtgatcattatcatgagatcctggtgatgagttatcaccagttgcttcaaaaaaatgagtgcttgtgggacacatgtcatcgggagagaaatcgcttagcagttgattcttcacactattcaactccgcctgcagaaacagagaagtcatcagcgggtggactttttagcgaatacagcagtttcattgagctcatgttcaaacaatgaatttaggagaccattgagaagatgaacattacctctagcatatttgttatgttgttcatgattgtggagacaatgcattctcgggattgactctctgatagttctatcgctgaaagggacttcagtgcgttagtattatcctctggtgatccgtagattttcgacggatcatccacggaatctttcacagcctgaagcttgcactcatccaccaaacggaggaatggatcaccctagacagaacaggacacacatgtcaaaataaggactatgctattcatgaagtcaagatgccgcaaaaatgcctctaataacaataagatgattaattgtggtttgcttatctccagactaagggttcctttcaaatgcaagatagagaaaacagaggaataagaaaatcataggattttgacaggaacgtaagtacaaaacaaatgatcgtttgaatagaccgtaggaaaaatatagaaatcagatgagagatagactcaaaaggaagttttctaagaggttagagctcttgcaaactttactaaaaaatctgcatgcattgaaccattccttaggaatttcataggatttagaaagcttcaaccctacgtttcaaagggccaaataggaaaaatttcctacaaaattcctacacagatcctttgattcaaaggggggctaaatatagatgcaattgaaacccaactttgatatatgcattacacaaatttggggatatgattttaaatcgtggtttcaagcccgctgtgatattattatcaatgtactcttaccatacttacaaagaaaagtatatatagcataacaaggataacataaaaaaagggatggataaaaagattaaactaatgcaacataacaagcttaatactaaagagtaaattaggtccatcaacttgatactaacatgtattcttaccacttcaaataggtaaacatctcagtttgcaaaattgtctttgtttaggaggttacactatagaaggaaaaaaaatgcactggacaatattttgaatatacatactgttctctcattcagcatttgtttacatattggaataagaggtaacacgttgaaagttcttgaagagaaaatgatcatagctgtagcaagagtaaacaaggaacggcgccgacatggtggtaatgaatctgcaagacttacaaaaagaaaagttaggcatcctcattcatttacaacatgggaccaagttttcatgacgcatggaacactgcatttcaatttactattagtgctacttcaaggcaacttggctacctggttcagtcagtgaatagcccctcagtgaaaatgcaacctgaaaactctgagtaagagcctcaaaaactgatgcctggaagagcaaaagaagggagaataagaaaataggaaatcatgatagatatccttaagcttggcaaaaattaatcaatactagcccctgatagtagggtttagttaggatgatcatcaataacgcgtatgatagatcatagatgtaataataaggaggattaccttggctccagagaacaatagaagcaaactataagtgtgagcaatggcttcatagtttgctggagtattttcaggagatgttgcttgagcccaaatggatgaaagcaaaagtgtgatctggcgactgctcagcttcagcaaaactgattcctgagtgcattcaagataatgcagaaacaattatgtgattttagttaatacatatagagtttaagaacaagccatatttgattaaggtaccatttcatcttctgg

SEQ ID NO: 33920 - DNA, 8836 bp, Oryza sativa
gtacagtagttcatgcacactgctatcaccttgtgagttgtctgagtgcttgtcctttttcaacttgtcaaagatggcagctgaagatgaaaacaccgagacagccctagagagtgtcctctgcatgtcatgtttcttagcctgacctgatacacttgcttgaatcgagggggcaacggaagaggggaccaagacaatagcgaaatgcggtgcgcagctactcgagcttcatgatcagggtggatcatcgttaagagcaactgatgaaacagagcttctggaaacacctgacatcatacacaagaagataagtcttcaaaacagaagaaagtactgcagcaaggagatagtcttctatcttctagttttgacagtataccttattctgataggtaatatttggaacagaagcaattatttgagctgtacgataaacagcagctgcagttgatctagctacaacaggagtgctagcaatattttctagcatcacggccatcatgtccagaactggtccagcatcagttacctgttcaacaaaatacccttgataaaccttctgtgcattgtggatagatcttctgaaactaatcatagcattgcacagaacagaaaacaggttgctgaggggcatcaattgaatcaatcacatttatataaacaatatgatggtgatgtaacaggtataggaaaacatagaagttcgcagagggagagaaaaagaacataccttctttgccagctgtcctagacaatcatctatagcctttcggaacttttcattccattttactagctccgaatctttgctgccgagagtaatatgaaatgtccttttcaaatgcctgacaagatcacttatggcacctatagttgctgctgaagcctgagcgatggattgttctgctagggtggctgctacctccacgatactaagctgcatctcctgttgcttcaccatggtcttgtgttcaatatgctttatcagtagagacaacattaagtgcatgttttgtcctgtaggaagtattttatcaaaaataaatatctaggttctttgcatatgataatgttagtatctgtgtggaaaagatgcaaatgaagcacctgcgttttccactaacagttgcatgtccaacaatacacacagagcaagtccattttcaggtgaccatgaactgttgttgccgaagtaccgaaacaaagactccaggatacgacggaatgttgttgcctccctggaaagcctagccatattgtgcacacatattctggaccaaaacttaggatcctttgcttcctccctgcacatcacacaagtatgttcagaaaccacctactgaaaaagaagaattgacaaaccaaatcaacagagtagaaagagataatattacacagtaaggttaactccacccttaacattaactatgttctcccacaaggggacagcagagatgacaaagggggaagagtcctccgttttggagtcctctgctttggagtcctccgttttgggggcttcttgctccaactggtcgcttgaatccttggtaacttgaccatcattttgcatcttctgaggtcggtagttttcaagtactacttgaaccacctaagaatgaaaataacaaagaaaaaaccatgatggaacatttggaactgtaatatgcttgtgctagcaacctactacctgaaattagccaaaatggagagcagaaagaaaactgtatgcatcacccagttacataattatttcaataatatttctgatcatcttatgagcaacaactagttgatgtttggctaaatatgcataaataaataagatttaaaaaaccatagtagctggtgtaggatttagatagtccacctcaaggggacagtcctaactattatggcagtccaagtccacagattatccagatccagctatctaaaaggtttaattacatatattccatttttgagtcgtatgcaatttaaagtaagatgctatctgatgattatgaaatacataagcacaaaactaaggaaatgaactactaatcagatataacttacattatcgaattccgatgaaatatgtgagagctctcccatgaaccaaatctgcacagcataagaaactaaatgatataatcactgtcaaaaatatttggttcgctaagttataaatgtttagaatagttggtgcatacatttgaagcgaaataaagtagacaaaaaagagaacaaagcatccatttacatcattattgtgaaagataatttacagtaaagcaataaagcactatactgttgcagattagttttacgaaaaaaaaaatatggtgggaacaaaatgtatcaatctagaagttatgttgcaaaatagttcctggaagtaagttgatagtaataatatatgtagttagtacttaatgcttaatgattatgagctcccattcgtcacgtaggaatgcaagaaacctcagatgcaaactaatgtgttttgcagcatacgtgttagtgtttgcttagaagtgaagtgtaatttgaatctcttctgacacagtagttggacattttttaccttcctagtcacttcttcaccatttttgcaatcagtgctagacatgttatatgtgaagtatgatttgaatctcttctggtaacagcattcccatacttttggtttccttcctactcattccgtcttcattttaacaataggttgaagccatatgacgaaagtttgatatggcttaacagtaaagtttaccatagttgaaagggcttgcagggctgcagcgcgtagggcaatggtctgctcatcctctcctacttcttgagatagctcacatagtcttgggactagcccttccaaattgaactgatatgtaccatccacctaaaatagacggaaataaaagcatgaaccagatacatcatgtctttcaaaagaattctgctggtgaggaatggtatcactgatcaccaggcaacggaaatacctgattaactgcaaagtcaaacaaggtttcacatcctatgatgcgcatatcatcctgcctcttttgatctaaaagagtgtgtacaatacttaataagctacttgcaaatagtggcctgcattgagcaaaccaaatgatagtattaacatctgatgaatagaaccagcatgttacaactcgttaaaggaaaagggcaaaacaaggggaaaaagaagactctcacatctgctctttacaagaaaccaacaatctacggtatattagcatcaccacttttgcaaagccatactgttcacttctcaattccttgtagatcctttgctccaaggaaaccgtgatctgctcatacatcaatttggaaaaaaaaatggagtcaactgagcttgaaattttcttgagaaaagattgaggtgaatttgtgtcaatcaatacatgactaacaacaacaagagcatgacaggaacaatctgactattgacagaaacatttttagctccacaagaaggtagagggcgtgaaccttgggcactcggagagggttcctcgagcaatactcgcacaacttcccgatccttctctcattcggttcttcatcctacatcatgataacatacgagcagcaacaacaagtaaattagctaagctgcggagcatcgattagtccgataatgcggcttccacacatgaacagaacaaacaaacaagacagagatgggggatgcagcaaggggcccaacctacctgcgttttggggaagatctcagcaaggatcgacttgtacctcttaacaggctgccttgatcttgccctcaacccggggcagaaatagcagaggctcccgcacgccggcaggaccttccgagatatcacgcccatcccctactactgtaagcagaattgatttagcagagcaaaaaacaaaaaaaaaagctaattagaataattgcaaacacaacaatggcgatcaaatcaagggattccacctccaatatgcactatctagctacgaattttctccaaagcaagatacattaataattgttgttggcaagttaaaaccgagcaggcgaaattcataaattttggggggaatgccatttctaacggaaatcaaatcaaaacgaaaacaaaaaaaattctagcggcgttcgatctcgcttagcggcggctggcttggtgctagaccttctcctaggttgcgtgtttgtttgtttttctttcatggttacagccttccatggctgcaatcttgtaaaaattatttttcatattatatcaatataaaacttagcaaatgtataatgcaggcactttaagaaaagaaaaacaaaaaaaaatcgagcggcaacctgcaacaacagaagcaatggttcgaaccccaatctctcgaccaatcaaacataatttaattaaaacgctatggaaggagatcgatagatcgatcgatggaggagggcaaaggaggttacgttgctaggagaggccgccgcccggcgggcgggctgggcgccgggggggaagaaaccgcggggacggcgtacgtgcgtacggccgcgctctcctgccgatccggccgatggagagatgcggggcgggtggggaggagaggagacgcgggggtgggagggagggagagaggagggaggctgtggcacggcgggcgcgcatggccttgggcgaggaatggggggtggccgccattggtgcgggcgaagtgggcgccggaactcgaggcgcctgcacctgcatgacctccgttgcgccagcaaatgccaggtgggtgcatgccggtgtttgtacaatcatagtgatctcggaatacggcaggtactatagccatccaagtacgagccacaagatgctactggctccgtcctaatttgtatagcaccttctttttaagaaaaattaaacctgataacttttgactaataaatattatgtatattatatcactagatttatatttatgttttaaagtactttcacgtgatactaattttatatttatcggaaacataacatgggataaattgatggtcaaagtatgtcattgaagaatgtataaaatatataggccttataatttgggacggaggaaatacatagtagtactaaatgatgaggtggaggagataagaaagataagagcgaaatattcacttctcagagcaagtataatagcaggctataagcgagctataaccacatatcgagaagaaaagagaagagagagagaagaaagtgggctacagatttgtagccaggtgcaacacagactctaagttgttgtgtgcgtatgagaggtgagaccgggtattaatggtgtagtatgtttttataggtaactattatatgaatggattattagattagctatagataatttggagctaacatttggctatactattaaacttgctcttatgcaaggagcaacccctacacaaactttaataaatatgtgagagtgttagagatattggagattgtgtggtagaggcaacctattacacatgttacctcttaattaatttaatagtatatgtcatgtatgaaattagatgtggtagtaacttctaccatgaagatatgtatattgttctccccactcattcccctatagaaggccaccgaagctccggattgttggtactagaatctaagagcaggtacaataacatgctataagctagatataagaatattttgtgaagataaaaagatgagagagagagaacagcggactatagatttatagccagccgcagtacggactccaagacacaatatgtgtatgataagtgtgaccagatattaatagtaatatagtatatgtttataggtagctattgtatgaattggctgttaaatcgattatagatgacttgaagctagccgttggctgtactattaaacttgcttattcgtaccatgcatgattaacaactaaaaatagcctacatgggtaacagatagataaataaactgtaagggagaatcctctataatattttttataagggttcacaattttaacaaaaaccagtcgaattccacgaaaaaccgaggttttgacgtagcccgaaagtagaagccgtttagaattttgatgggtttcatccaaatttaaatttgaattgataaaaaggaaaaaaaataaaaccctataaatagtatgatatttatagaacctatttgggtataaatttttcaaaaaattggtgtattcggtgtatttcttaaactttatagtaggaaagaaaaagaataacaatttaaaaaaaaggaaaacactttcctgggccgaattccatgcagtaagcccacttagtatttagcccagataatagaatagagaggggatgtagttctacacctgatttcgctcggaatttcgctaaagctgactggtttttgcgagcatactggtaaacttagggaatttgtattcaaattttagtttatgaaatttgttcaaaatctaccggttttcaacctgattttgcgaaaactatcataccgccaaagcccggaatagaaggtcatctcggaatcgtaaaccctatgcagatacatgatagtcctatagcttataattcagtgaaaatgcagcagttatatgatcatgccaacgctgatcagctacctgaccatgtaagatatatatctaaagttcatacaaatacttgtatccctgcatttttttcgaacgtgcaaaaatgattacatgtcagtatattagaaaaaaaaatcttttatactcttatacagcgcaaccggccagacggctattgcttggggacaaggaaaaaaaaagagaaagaaacagaaagaaagactgctagagtaaaaaagtacgaaagagacacgttgctcctatagaaaggagggtgccggcggagccccactacgctcccaacattaacattaacagttttgtatccctgcattaacagttagctgatcatctgaaacaaattaaggatgaaagaaccctgtgcagatacatgatagtcctaatccatcatctgttctggatttcataaattgatttcacatagccctgagaaaagttaccgacaagggattggaaacacacgcactcactatataactttgattaacaaaatgttctcgtctagatttacaaatagaaaacaagatcatttatcacctatggatgtacataaataattaaaagcatccctgaaacttgatgcaaggaaacagttccccttatccacctatctcccattcagcaatttacagtgtgaaccaagaaaattctgtttgaagaagcaactttatttcattttcccacttttgggaacatagcaagcaacattaaccagcaatctcgccggaattttaactgaatcctgtgaaacgcaagtaatttccgtgaaacacattcgcatgcgatgcatttgggaagtgatggcattcatccacttcaaccaattgattgttgaatggtgatattgacggtgaaactcactttatatttcagttccccataattgtcacaagtaagctaggaacaaatccctgatgatgagatcgatccttttatgcatttgtaacatgttcttgtaaaataaatagactttgatttgtgatgccggagtactatgcacatgcctagtagaggtcctagaggacatgtttttttccccaatacttgtttttatttttcttgcctaacctctatgcctttgtttaatatgcatgatctgcccaaaattaatgaaatttataatggttcattactacgaactggtaatacttgtttttttacttgcaaagtacacgaatctctatctgtcgtgaatatgaatatcgtccaagaaaaaaaattagtaacatccacgacactaaatgtggttcactaaatttaatattgaatatatttcgataatatgtttgttttgggttacaaatattactgtatttttctacgaatatgatcaaatttaaagaagtttaactaataaaaaaaatcaaacgacttataatatgaattggaggagtatactactgccactgagttaatcatagttgaacgatttacaactgacagggttttaaatgatgaagttgtaggccgtccaagtttgctgaggagcagagccaatgcttaatctgtcaagaaaactatgatgggtaactaccattcccttggtagaatcaccacaagctcttcgcctcttcctactagtcttatactctagatgtaatccatgaaatcccatgaaagcttgtactaacaatgatcaggattaattaaaacaatgaataaaaaagtagtgagtaagaggtattaattattgactcatttggttcatttgtttcataagagaaattatgcttgagccatttgaacctaaagtctggccagtctataaatttggttgatgttaaacctattttgttttaaaataactccggttactgctctatagatttctacggatttgatgatgtaccgtagtataaggtgaaatttgattttgcacgctctgttgcgaagtgaaaatgtgtgctaaataaggtgcaaaaatatatattaaaaaaagtgcactgtacatggcgtaaaatgcagtacactcataaatgtcagcgatggatggaattcacaacatcaatttctttcacgaggtacagtgacagtgctacaatttcactgcatcccctgttaaaaattgctggagtgagggctctcattagtcattactatccattcacattaggaagaccttaattgctggcattcggtagtgtgaagtctcaacaccatacctgcattttgtaccctctcactagagagccacagtacaact

SEQ ID NO: 33921 - DNA, 42487 bp, Oryza sativa
  unsure (1)..(42487): unsure at all n locations
accgcttaagattaaaatcttcatgtggtacttacttaaaggggttgtgttaaccaaagacaatttagcaagacagaattagaatggtagtttaagatgttgtttttatatgaaaaatgagaatattcaacatcttttcatggattgccattatgcaaggtttatatggagagcaatacaatattcttttggtctatgccctcctagtagtatatcatatattttttatggttagcttttggtggtggacaagaaaatgagtaagcttatatggagtaagcttatacttgtgggggtctctgcaatatgttgggctctgtggttgagtaggaatgatttggtttttgacaaatcaccatctattacatatatacatgtaattttcaaggcaacaaattggcttcggtgttgggctcagctacaaagttatgatgaagatgacgagtttatgaaggttgcatgccgtaggcttgagacaatagttatgcaactttttgccaattatggttggagattcacaaatagatttcaataatgtgttctccttatcttagatggattattttttattttaagtgcgtgttctcaatgttttgttgaactacactcttttttgagtgtaactttataataattggttgtaactcgttttgagtaaaggctgggatattctattccattatcttaaaaataagtaatatttgcatgtatgcatctgggaagaaattaggggacagccacatgcctccacttgaaccaactgattactcaacattttctctctgtacttgaaccacatgccagttccatcaatgcctggattggatggaacttctgcattttctttttctgtactgaaagatatactgatggtattatgacttgggcagatataggagtagggcagctactcctaggcccaaatatcgattgaaattacacttcaaaatttgaaaaagaaagtagaatatagaagacaggtttttgtaggttatactagttcgtccatactcttagagcaaattcctccatgactgctccaagctcctacgaacttactccctccatcccattttaagcgctgctatgagttttttttttcaactttcatcatccgtcttatttgaatttttttatgattagtattttatgcgtgacttatgtttttcaatattttcatttttttaaataagatggacaattaaagttactcatggccgtgcttaaaatgggacggagggagtatatattagacccaagagtagataaccagcaaactccagtgatccagactgccatctatttcttcccttacatattcagtagttcaacagaaaacctgaggcttgaagttttagttaagcagtgcatcagcttacagcaaaggtgatgtggctccaggagatgtgaaactgtgaaaagtaaacatgaataccatagtgtaggaatgagaaacatcgagaaggattagaggagactcagggcttattcgtttcaaaggaattgcaaaggaaaagcatagggataaaaatgggttttaaactaccattcgtttcataggaatgaaccataggaaaactataggaaagttttccattcctccatttttgaaggaaaagcataggaaaaaacaatccactctaacctaatatttgcattcctttggttggcttgctcaacaacataggaaaaattcttgtattttttaatccataggtctgcacatgtattcatatagtatttctacgtttattctatttctacgttttgaaaatgctgtgaaccaaataagccctcaatgtggcaaatagcatagcgttgggcattaatatcccacatgtagagttgagtttagataggttgaggaccagcgtataaactttttgcagtaatgccagttctagctagttcatctgggttaactttaaaaaaaagggatggatgggatttactacaccattttaaaggcacatatatagtatatatgctttgatttcacctacacccccttcccagaaaactagcatgaaggccactcatcagtctgtaggatcgaatcacaagaactaagccaaccagaggggggtgaatggttggtatacccaagaaccgaaaacttttagcggaaataaaagttaccctcgaattcgacagaagtcggtctgaccgagattgatctgccagtctgaccgagtggatgccgccggtctgaccggtatagatcacccggtctgaccgccgatgtcgcctgctgcgcctgttgccgccgccggtctgactgccgtgctcccgccggtctgaccgccgcttgccgccggtctgaccgccggtgagttgccagttagactgccgaaacccggtgaaacataaatcgaagaactcttaaagtagatgacgactttattgattctctatgtgttcacaaagtgcatcaacatcactccttacaaaaatttcgactaaactcgaaaccctaactaaactagcaactcaattgctctccaaagtgataccaaaaagcgatactgggaagcctcacgctccccctctatttatacatgaggtaggcagcctaaaaccacgaaccaaactcatactaagagtcctaaacaccttaggaaaccctctagtacaagacacaaacttaacataaccaatcgtaccaaatttggactccttccaaattcgactccgcatcccatacacacacaatacttccaccgtatgccatatggaatcttcaccaaccacgtgcatcaactctagccttagtatcccgcatgatatctgaccaccacggacatcgttttaccaccaagccgactcccggtccatcaccgcaaatactctgccgaggcatcgagtcacctacacatgaaacaaacaaagaaaccatattccgagaccaagctatcctcaacttgactcattgttagcaaacaacagtattacatacgtatagtatccatctagaagccataaccatgaaacaatcatggatatccaaagaaccaatccgaaaccgaaaccgactcagcgttagccggtcagaccgcgggcctggccggtctgaccgcacacatagcgccggtctgaccggcaacctccgcccggtcggaccggacacataaaataacagaatccgatcatcacctgaaaattgattatctccaaaaccacttcgacgataatctccaaatatcaaaaccaataatcacagatgccaattgttcatcacagaataaggaacaaaacacactttgatcttacacaatcatcactactccatccatcccataatgtaagggataatgggtagatgtgacacatcatcnngcaatgaatttggactatgatgtgtcacattcacccattattccttatattatgggacggagggagtaccattcacattagcatgaacttatggacactcagtagtgaacaagtctctcatgaacaccacacctccattttctaccctctcactagagagccacaagtacaactagcagtagtgcatattaaatggcatagccgcatttaattactaacaaagtggaaggcaatgcaagcttataatgagtacatggatctctgaaaccacaattacccaatcagtttcctttcccctctttctaccacaatatctcattatctcggaatgggatgcatttggagaagataaaagggtagttctccccattcatgctgctcaagaggtcgtagaagctcgggattgttggtatagggatctaagtgagcaccatgcatgattaacaactaaaaatagcctccaccggtaatagataaacaaacatgaagggaggaccctctataagattatgtccctacgtagcagttatatacttatatgatcattgaaatgttgttgcctacctgatcatgtaagatatctaaagttcagtatcctagaattaacaggaagctgatcagatgaaacaaatcaaagaagaaagaaccttctgcacatacacatggtaacccatcacatattctggattaaatagattaattcacgtagacctgagaaaagttgccaacatgggactggagattggacatgcatgctcgttatatcacttttattcacaagttcttatctagatttacaaatagaaaaaaaagatcattttacaaaataattattagcatccctgaaacttgatgcaaggaaaggaactgctcctatccacctgtatgaaccaataactctgtttgaagtacagtcataatgctgcaatttcaccacgtcccctgccaatagaagttctggagtgaaggctctcattagtcatcactatccatttacatttggaagaccataattattggcacttggtggtgtggagtctccgttgatactcaaatttggtactagtttggatttatagcaacttgccaaatttggaaactatcgagtctttcccgcgaaggccggtctgacttccattgttttttttaggaaaacgacggcaggagctctgctggaatttgattaagaaggaaaacagagtgcaaacagatcggtctgacttccgttgtgtggccggtcaaaccggacaatgaactgcagtcagaccttaggtgtccgcgtggtcagaccttcaacacaaagtccgagtccaattaagtatttctcgtgtttccttttttgagactaggatttctcgaatcttagttgatttctaagccgaattggacatgaaaatgaccctgagaaacaagtccacccctcctacaaatataaggggtcaaaaccgattgaaacaacaataaattaattatcaaaatcaatttattacccaaaccctctatattctacatcttcctccttcttgctacctatcccaaagtctattctactcaaattccccaattgcttgtcatcctcgtctctacggcttagaggacgtcctaactggcctgccggagtctaggacaaactggcgcgtgttcaccctaacggggtccctcctgggtgttcttttgagcatccaccgctccttgaggcggctcgtctccgggtgtgccactgcgggttgcacataatgtgctcaatgtgtgaaggcgcgattcgacgtcaacagtctctaacaccgtacctccattttctaccctctcactagagggccactccacaccacgtgacaatacaaccgacttagtgaatgttaattgaaagtatagctgcattcactagcaaagtggaaggcaaaatgtgcagcttataaggtgtacatggatctctggaaccacaactatatatccagtcaagtgcttatcccctctctttgcatgacaaattttaccacaatcttgtgaccttggaattgaacgcactgggagaagatacatgcatgggttgttccctctattcttgcctctctagaggccaacgaagatttggctggcttgctggtccaaggatccaagttagtaccttgcatggttgaacaagatccacttctaagatatcaaagaacctaacgtgatggttgttgagttgtgatccaaattcatttgcacttaataaaagccagcttctgccctagtgaagcggaggctgaagttggcccattgggttgtgcacctggggacgcccgggggtgcgggggcggaggccccgcggtacagatcgtaataccttttagggttccacctcatatatatacctctcgtaagccgccgtgcggcgttgtaacctcaccctcgatatagtaaagatttttttgctggctggcatccgtggttttttctctcctggtttgggagggttttccacgttaaatctcatgtcttctgtgattgatctattgttctttatcgtttgtttgcctatcgcttcctaacaatggtgtgtgtctgtaacttttccgtccttgagctcaacaacatggaaagtctgtgcatcatttgcatgggatgaatgacatctaaaagtcaacatcaaccagcaacgtcctgacaagaatggagggacataatttgttctaccgatgattttattattctagaggaggtaccatactcttttatatcaatttgcattacctctttagacatctcctgaacaattagaaacatcaccactgcactccttcaaccttttcacttgctgtttctacatgaacagatgaaattcatgaaacagagggagagtgttgatttaaggaaatacagatatcaacaatgatatgttatagcccgtattggaatgtatgcatgcatagggaaacggggtagccaaatgacgatgatctttactagggagcaggggcatttagtagacatggaatgtattccacttaatataaactttggttcagatcgaagattacaatcatttccaggagcaacgaccccagagaataggtgtgctagcaagtatttggcatgaacatgttaaccacaatgatgatgttgtgccatgggaatggaatgatacacatatgttgaggaaaagagagaaaccaaagagaaaaacagcacgagcaattcagcatcagaagcagtcgtagtataaactagatagcactggctacgttgtatatatagacatccaactgaggagaaacatgaacactgttgctcactgcttaggtgaagtatgagccttaattaataattttgagtaagaaaatgctgacagcatgttgattaattttgaagtatcaaaatttttcggtatgttggcattcaaaattctaatattatggtagactagtggtccaatggagggcacctatatacctatatataccttccacacatccagattccagcactatttaatcaaatactcatatctaaagtcacaagtccatctatatctgatggttattccgactctatctagggtgtatatataccaatttatttacaagctagtagcaactcacacaaacatggatcagatcgagctcaaactacctaaagatgatgcagatcaactgccagtggcatcacaaatataggcgtaggatgcatttgggaaggagaaaaaggacgtgaaacaaagactgcatcgatcactcgcaatccatagagcgtagtggcattgactgacctcacacaaccttttatgcagtaagacaccagaaagagtagcaacgacctgtatgttcatagttgcaatttctcatatactccatggatttatcagtaactagattaaattgtaccaagtgatattgtggcaccagctagctagtttaataaaaatgttggaatagttgtatgatcaatgtcataatgaaaataaattctatgaattgaaattgaaaaatgtacaaagaataggtaaaacaatagtaagaatgcttgatggaatgatggtattataatgactaccatattattatagctacctatgctatttaaatttgaatagcagaggtagcttttgaatagaggtagctgtgtattatgggatggaggtagtagtaaactttcattagtacaattattagttacgtcttcagtttcttaagggagattactaccattggatgatataccaagtgtaatattatattatactaatgaattttcattaacgatctttagtaatttcattgtcagatccatcaatgcctagactggatggaccatatgctttttttttattttttctgtactgaaatatttcggtattatgacttgaaatatgtcgacagaaatgaacttcacacaatgctccttaccttctaccaacatatatataagatccaagagtagataactagaaaactactgnnnnnnnnnnnnnnnnnnnnntctttcatgagcatcttttctatccttgaggagataccacgaggtactatgaggtacgaggcaccataaggtaccaatctaatctaaccgttggtttaacaggggtatgatcgggcaacaaaaataagctctcctctcttccttctgctgtatcaggtcgtccatgccggctgtctgcgccgtgccatcgtcgcatcgaggccgtcgcgccgccgtcacccatcaagatcgtcgcgccgccgtcgcccatcgtggtcgtcgcgctgccgtcacatcgaggttgtcgcgccgccgcccatcgaggccatcgtgccgccgtcgcatcgaggccgtcgcgccgccgtcgcatcgaggttgtcgcgccgccgccgtccaccggggccgtcgcgcatcgagcctgccgccgcggtcgcgcgaagatgcttgagcagtaggaattctgaaggttgccgtcgcgcatcgagcccgccgccgccgtctccgccgccgtcgcgcgaagttggttgagcagtaggaattctgaaggaagctgaaggttgtccaatcgaagatgcttgagcagtaggaattctgcaagagatggcagtttcttccaatttttacaacctcccaaatctaggctgataagattattcactgaggcttttgcaatccagtatgggattttagcaccaacataacctgaaatctttaggttcttcagaatagaatttggctcaaggttatcaagaatgattgaacaatcttctctgctgttggtgccatcatcctctgaccattctagagataatgagccgagatgccgtttttcctccagcttcgcattcttggcttcttcttcattctcaatattctctaggtccttgataactagtttacagaggcacttactgtgtaaccttttgcttgtcggacctgatagtcttctaacatctctcctagtttgatgtatcgaaggtgctttaactttgccagtttgcccataaaatcagatgtatggaacaataccgttttaaacagaccataaaataaatgcatgcaagcagcccatgctgcataggaatttaatactgaatagaaggagataatcagttcatatcggtgtttcttaggtaagaaagatcatcgatcaacgcttatgttagttaacgttggtcctaatatgatcggttaaaagctgtcaaattttaattaaaaaatttggcagaacctcgccagtacttgtgaacattcacgacaggtagtttataagcaatcagtcataaagtcataatcacatccagacacaaaataacacaaccaactccaagactaaacaacacgacaagtacagatcaattatgtactgagattacatagtttcaaattacataatgttacatactgacaggcctaagcctcagataagcatacaaaagagagttctgggccacatgcaaatattcttcaattttgatcatctaggatcagctgtgagcctgtgccacaatggatggtctgcatgcctttccttttctgctgaacagagagagaaaaaaactgcacaagtcagaaataaacttctcatgcctaaacatagctgaaacatttttattgagagaacagaaactaatctagaatttgagaggccagcatgtcgtttctgacaatgccaagaaacgatgagaccgttaattatatacctataagacagtcagtaattataccatgggcattccgtcgaacgccttgagtgcaaaataaacaagagaagttctattcaactaagatacaatttccatgcacacacatgaattgacaaatagtgtgcagttcatctgcaaacatgcaaatgaatagctagcaattcgtaattcatatctatacacaggatatatattagcagctggaaaaatcttaactaattaagtgtagtgccaaattgcttacctgttttcaggtcctataatagtcccctaactgaagatatgcaaatgaaattctaactgaagatatatcaagattatatctaacccacattttccatttactcttgtgatatgataaatacaactacaatccatatatctcttcatgttttgtgagtatgcgacatgcaactataatgcacatacgtttaacacataaaacatttactatcaagaattattacacattcaatttgaaatgtccccatatagaatcgacccaatggttcagtcttgtctacagctgtggtattgggataattttactgacctagtgaccttaacaggaagaggaagggaaaacgtagatgatgaactcggccgtggagagtctatgaccagaggaagaaactcggtgggtcagggcctcatgggggcaccgcaaccatcctaggaaggcgagggggcggacaatcggatcgcacagtcccggtagcgctgaggatatggttggtgaggagcagcatcaccgaaccgaggccaacacaaccccttaccctccccccggtcctccctgcggagctcgtcggcatctggcgcccttgaccacgggggcggccggatctggcgacgaggtggcaggagtggaggcgctagggatggggagggggagggtgccataggatgcggaggagcggaggagacggcagccaacggcatcggcgtccgcgctcgaacgcgaaaggaggagatggaagccggcgcccggcagcatctgttcttaggcggttgtcggtgagagagaaggggaaatcggcgttcgagagaggcgaggagccggggagatcgctgggttgggtgttattgcgaaattaccaccttacccttccacccatgaaatgcattcggtaccgccctcggggagacgcgggtaccgataccatccaggccgttggatcgcacgaaattgacggtcaggatatggtacctccttccctcaaggaccgtaaaaaatctcttattccattacatgctcgatcagtagtgaaagaaatcagaggttagaagtttatacagtagtgcatcagcttaccacaaaggtggaatggctctaggagatgtgaaaatgtgaatagtgaacatgaatgccataatgtaggaatgaggtacatcgaggaggattagaggagactcaatgtaacaacccagccgagcaataatagtcccacatgtagagtttagattggttgagcaccagcacataaacccgtgcgttctaactctgtatggattaactcttttacatatagccagaatagtagaagtatataaattcctcgaaagagctgaggtgtgggcttttcagaaactaagatagcagcaccgacactaactttagtagagaggtgaagagcctgtaagttctgtcatttgtgatgaagaagaaatgatcagattctctgtgagctcacaaaaccaaaatgagcaagtacttccggacagtatgctcatgcacctacagcacttcatttgaacttgttccacaccttgtttaatagagtttcttattctactagaaagagaaaccattgtaaaacatctatattttctcacataggatcccccaaggaagagactaatattagaacagaacaatcatgaaagtcttcctcttcaaaaaatataaggggaggggggtgtcattaggatgtgacaaaatttggggaaaaaatacgatgccatgataacagaaaagaggaataatgtttttattttgacggaaaaagaggaataatgttggtaatacatgataatcatttcagaaaaaaagggaatgtgtgcaatacatgtgcatatgtgattatcattgaccccttgaactagtcaaatctaacaccaacttttatatatgaatttgaacataacctatgtctagatttgtatacaaaagttaatttattttgggatggacgaagtatatcaatattgcgaatgttttcaatcagagaagtggacagatatgaacattttggtttacacataagaacaacttatcatgtcgtggtcaattcatgtttgatgtctaggtcttttgtcttctggaacaaatttttattcctggtacgaaatagtatcaaataattataatcttgaaaccatcgaatcgtgtgaataaaaaaaaaccagaactgcagaaacacacaacggacatgtctcaaatttcataagttattgaacagaggagtaaattataaatatgattgatgatttctcaaaccaacaggtggtgaatgtaaaaggtgaccataactctcagggaaaaaaaagcattcaccaacctaccacttattcatatcagttataaataactaaacacctgcctttcatttttatcagtgccacttcgttgttttcttcctttctacagttacaagaactaaacttgaagcagttgccacacatcagttaaagagcgaggagtaatctctaccacaaaatgcatgggtatgcaactgtgagcttaattcattggttcacaccctcatttatctgatctgttgtagggatgggatgcattgaggaagataagaaaaggcacaacgataataccgggagtgtttcagcatcgatcggtcctgattcctgaccttctttcagcatgaagtgcgacacttgcatctcacactaggacagatgtcatgacctcagaccatgacggaataactacagccgggaagatagccgggcagcgtcggctcctggagaagggatgtagattcaggctaaggagaagaacattgctgggagagagagattagattaattgatattcattgcttaattgataatagatacaatcccatccttatatagatggtacaaacttgatccctaagtaagaacttaatcttatcctatcttatctctaactactaactaactaataatcttatctctaacttgattggtttgggctgcctataaaccttgacctacggcccaatgcccataacattgtgtgaggttcaactcatgagctcgtcaaccaaagaggtagctaacatagctcactctaggttaatgagaaagacgaatttggagcagcatatgtttcttttccggtttctttgcatgggaaatgtgaaagaaggttctggctgatttttttttattggcaatgacacaactgttcaaatcactgatgagatctagatatcactaacggcaagaaacattaaagatttgcccttcaaatcactgatgagactagatatatcactgtttcaacatttaaagatcgacagggtttcacaagagagataataaatattgtgtccttagccgctactatcctacattgggtggtatattttggatcatgtctaatgccgcgttacaggttttggtaaaaataaataaatgtttgacagcaatgtgaaaaggattaaaaaatattagtaagttgaaaaatgtatattaacatggaacttcacatcgtagaaaaaatatgtttccaaatattaatctcattgtttttaaagtatcacactattaatttatggagttgatgtttgacaattcgtcttattaaaaataattttagtacatatatgtaaaaatataagttatatttaagtaactttagtgattaaacaagttacaacattacttacctaattttttaataagataaataatcaaatgtcatgtccaaaagttaatattatacatttcaaaatgaaggtagtactagcttgtacaagtgcacacacatctaggttggcaattaatatccttagtgctggccatggcctctttatttaggtttaggcttattgacttaaccttttaaatcagttttttggcttatataatttataagctggtggatttaaagtcctaattttaagagtggagtcatacttctttctcttgtaagtaaaaaaaaacttcttcaacctagctagcttttagcttaatagtataaaagtggcttatggttttaggaaagacaaacaaaaaattattatttatttaggcttagatattttaactcataaactgacttgtaagtctaaaaaaagaccaatgccaagatatgcttaggatttagaaccaacgtggccaacatccacgtggtgttgcatgcacatttctgcttttcattgtggagggttgccgatatatgatatgtcacccttcttgtcaagcaaacccaagtaagacactaattaagaaatctggaattttccctaatgacaaaaccaaaagaaataacaatataataataataataataataataataataataataataataataatatacttttaggtagcaccagcacacacagaataaaatagcgacacatacccataaaaactcccgctgcatctcatgttctatcctgatcctcaatccaacaccactttactaagcaaaagttatatgcgcgaaaattgttgtgtttacgatacacaaaattgcaaaacaaagtgctgctgaattctataagaatgggaagcattcagaaagcaagagtttttccaagagaggcagtactgcagtagaacaagagcatagcagcttggctccaagggtagacccatggccgagcagccgaggacacggcagaattgtggccatgtcgcatgaacagcattatttgatgactccataggttagcccgctgtaatagtattttcatgggctctagatgacttcctcgacgagccactaaaagataactagcctcgtttctagttcaaacgaaatgaaggtgtataccgtcttagttatgagagggcgtgcattctcgtggttacagtgataatctgagtagatcggataaaaataaccattctaaaaaaaataaaaaaagaagatgccgtcttagttcgccaaggagcagagacaatgtttaattatcaataaaattgtgatgtgtgatttggaaagggaactacgtaccagcctcttggtagaatcaccacaagttctcctttctagtcttgtagatctgaaaatagaaactaaggtactcttgacgtaatccatcaaatactaccaaagtttgtattaacagtgaccagggttaattgtaactatataaggatgggaacggttggaatcgtaacatctctttggaaaggacgcttggccgatcgatgatttttagtatttatcaatttaacttgttgatatcaaaacaatgctaaaagaaattagagaaatcaaatctcatgtattgcaaaaaatggaaacggtacaacttacaaggaaagaacgctcggtctgtcaggaatttccatagcaattttcatcgttaattaaaactatgaagtaaaaggcatagtgattaagaggtattgttgactcatttggtataattgtatcataacagaaattatgcttgagctctttgaaccaaaagtttggtgggtccataaatttggttgatgttacacctactttaaacaaaaagtgcgctggctgcaattgagatttctataggcaattgttgatgtacgctagaataaactgaatttggcatactctgctgcagagtgaaattaaatctgctaaatatggtgcaaagcagtgtacaatgtgtaaaatgcagtttactcatcatatattcaatattttaacacaatggtataggagtagttccttaatttgtttttatcaagcgatggatggaattcaatacatccatttgaggtacagtgatagtgctacaatttcactgcataccttgccaaaaaatgctggagttatagcccactatggtgtagtagaaagcaatctgaatcactgatctcatttgatcgaagggtttgcatctatttttactaccatcctagttagcgttagtagaaacatggagagacatatattttccaaaataataggtgctgaggggcataatcgtcattagcagtaactaaacatttgttttcctacttttttggcttttttgatggatatatgagtgatgccagcataatgaatgaccacaaatcaatctagccggaaaaaaaaagacaaagttagtcattttaatatcgatctagcttcattgtattagtaaattactaatttacccttaatatcaaatagtttacatcatttctacttgtactaccagtagagagtattggaggatcgcttctggagttaaggctctcatatgccaaaaatacctccatttccagatttcttaccctctcactggtgagcctcggtacaaaaagcaggagtgcatatttggcagtattgactaacacagtgcaagataatgtaagcttataaggtgcacatggatctcaaaaaccacaactatcaaatcaatttcttttcccctcacgctgcaggctgcagcacaaatgttaccacaatctcgtgatcttaattagaatgggatgcattaggagaagatataggggtttttctcaacgcagaagctttggctttctgctacgaggatccaagtgactaagtgagcataatgcatggttgatcaaactcacctgatgatagatcaacaaaccgaatgcggcggtgtgtataggatatctgtccgttgtgctgaacaagctacagagaaatcaggaaatgtatgcaacatttgcatgggatgaacatcattttaaaatcagcaaaaatctctacacccaacattttaaccccagcagcctcctcatatgatttggagaaactaacaggactgatgaatcctgggagatgcagataatttttgtgatccagtaatatttgcatggatgcatttgggaggaaattaggggatcagacagccccatgatcattctgcaggttagatggatccaactaccaatctaccatgcatgctgggtatgttcatacttgcaattccttgcatttgccatggattatcagcaatgtgaataaattgtccagcagatattgttgtacactaatcctagctagttgaacaaaaatgttggaatagttgtatgatcaatgctacagcgaaagtaagttttacaaaatttaaaaatgtatgataattggttaaaaaaatagtgaaagtgattgatatgataacaagtttgtactatcatatactccctcctttccaaaatataagaatttcttggttgtttagcaagtactatggttaggccaaaagattactctttagttactttaattgttattttttgaattttgaatggattagattccctttcaaagcatttggttggctctggattcatccattgaagttatttgaatagtgggaatcagtgtagggatctccttacatcgtggtacaaaatttaaatcctagaaatccttacattttgaaacagagaaagtatatattagctagaaatctttcatcaatatggtcagtaataatgccttcggtttcataaggcatatacagtgctccaattagatgatatacgtacggagtgcgctgttatactagtgagctttcatcaacggctttagtgattacattgtcaatttcatcgatgcatgcttgggttggttggaaatctgtcaatagaaactttgcacaatgctccaagactccaaccaacatatatatcatataaaggagtagatcgctagcaaactcctatggtctaaaccactatgtattccttcccatgcatcattaatagtgcaaccagaagctagaggtggtagcacaccattgcatcagcttaaagcacatgaggatagaagttaacgtgaatgtcgtagtgtaggaatgagatgcatcgagaaggataagaggagactcaatttaacaccacggcctaatgagtattgatggattagtctcctcagatgcagtgattgcatagatagcttgagactgcatattaaccaatgcattttaactatacaactctttccggttgatccttttgtataaagtcagaatgaaagcgcaagggttcaatgatcatcaccatttagttcagtgtaattcaaaagaagacacacaaccacagaaacacacaagggatgcacctaattttcataagttttgaacagagctgtaagttttaaataattttctatttgcatgaaaactgcaaactaatattatagctcttttatatcaaaggaacaggtgccataagggtttccacttatatgaatataatgtagaaggtgaccacatgactctttctttacaaaaaatatgatagcttatgcctagcaattagggaacgtatcatatgcacacaagtcttttcatgtatacactatgcatagtaactagaaaatatcaacaaaaattctataaaaattatacatgtacttttaatagtattaaatttatatcttaagtcccatcttcaaatttattataacagatttatactctcaaaactcagaattcttatctttttttatgactaaaatataatgaatttgagattaagacttcacataagtgtattattattggaagtacttgtacaaatttttctagatttttttggtaaaatttgttagttggtgtgcatagtatgtacatgaaaagactttgtgcacatgatatgttccctagcatttatatatgtattgaaagggaagtagttacaggggggaaaaagtttttcatcagttataaataaccaaacacttcgctttgatttttaccacaaccacttgttttcttcctttttctacacctgcaagcaccaaagttgaagcagataccatgcagaaattgaactgttgaaccattacaaaagaatgggagaggaatcaagacataaggagtagataatgtggatacagcttcaactgagcttcattggggttcaatcttgttttgttttgtgagaatgggatgcatggaggaaaagaagacaaaccagcaccgcattacctggaggatcttaggagaaattggtacggcatttcaaacaggaacatcaagctcgaacgacaagtggtaagtgagatatacaattctcagcatggctggagggacaagtgcaatgtgctggagggatcgatgagaggagaacagaattgaagttgtcaactgaaatcatcaccaagtttggttgctggctggttcttgttttattttcgttgctagcaaaatgcatgtacgttgttacagaatttagaaaatcacatcgccacattgcaaaaaaagaaatctattttcagtttagagcctaatttagaattaaattatatgtttttttttcatctttttatatctcagctataaaagatttgaaatggactcaactaaatcattaatgcataacttcctcccttaaaaagtatttggtttcgagagggatggacatgtgagttccacgtgttatagtttgagggagttggtggtggcagaccgaccaacttgaaactcaaacaagatcatcattagttttatgtgtagctgctctgagcctccgttctccatgtctctctttttgcttttgcctagttgcttacttgcttcctatttacaaaatggctttcaccactctttctcaaactaaaagaaagaaatcaactaggaacggttgtactaaggttgaactgtgacatcctggctcaattaggatgaggcatttgtggcccatgagagctatgtgctcatgtttaataccacctcactagtttagcaagaatggaaccaacttataacgacttgttcctccaaacatatcactcccggataatcccttttacatgaagcgatggtgaaagtgtaaatgggtagtatgtataagtaggcccacccgtcagatgggctggctacgttgttctagagggtggactgttacaaactgagctcaaccaccaattataccgttcccaatgtgggaccaccaaagaggtagctagcaaagtacactacctaggcagcaagagatcaccagcggcacaagaacaggcctctagctcatggcttgaatgtgtgagaatcatagattatttatttctaatctataacatgatggctttagtctaaaatgatcaccctaattctaatgcggaattggataatggacggtgttttgttgacagacatggagatgttgttgatgctatgaatagtcgatagttttaagttggttatttaatttggatatagactgacaaatgattatattcttctaattgattaaattctacttttggatggttgataggattatttacaagttattggaagaacttgcagcatgtggggtatatggttatactacgtgacatatattcatgagtggagttcagagttttggcttgtctccaggcatacatatacctaggcacaagtccagcgcaaaagcatacaaggaagatcataacaacatgtttcccttctctggaaaattttgttggcaacagatgccttctccttctttcagcttctgcttctttagtcagtttggaggaagcagcaaatagttgatgatatgagaattccttctacatcggcttaggtgtagcaacacgactttattattattattattattattattattattttacaaaaatataaaatagatcagtccctcaccacaagtagagcaagttggtgagttattgtaaagttctacaaagctaatttaaaagttattgcattaacttatttcatattacaaacaagagtgtcaatggaacaatgaaaaccatatgacatactataattttgtttttattattgaaattatataattcaaagagaataaatccacatagccgtaaagttctacatgtggtgcattaccaaaatatatatagcttacaaaacatgacaagcttagtttgaaaaattgcaatccttatcacattgacacataaagtgagtgatgagtcataatattatttttcttgctacccatcatgtatatatgatagccacaaagttactttgatgatgatatcaaagaacatttttaggtgcacctaacagaatatccaaataatatgactcacttagatcataatagagcatcaagtaaaactaacactctaaagcaaccgatgggaaagcatctataaatagacaagcacaatgaaaatcctcatcatccttcaccacaattcaaatattatagttgaagcatagtagtagaatccaacaacaatgaagatcattttcgtatttgctctccttgctattgttgcatgcaatgcctctgcgcggtttgatcctcttagtcaaagttataggcaatatcaactacagtcgcatctcctactacagcaacaagtgctcagcccatgcagtgagttcgtaaggcaacagtatagcatagtggcaacccccttctggcaaccagctacgtttcaattgataaacaaccaagtcatgcagcagcagtgttgccaacagctcaggctggtagcacaacaatctcactaccaggccattagtattgttcaagcgattgtgcaacagctacaactgcagcaatttagtggtgtctactttgatcagactcaagctcaagcccaaactctgttgaccttcaacttgccatccatatgtggtatctaccctaactactatagtgctcccaggagcattgccactgttggtggtgtctggtactgaattgtaacaatataatagttcgtatgttaaaaataaagtcatacatcatcatgtgtgactgttgaaacttagggtcatataaatctaaataaaatcatcttacctatttaaatagcattcctctatgaggataaatcctattacattatcgtagctaattaccatcacagggactttacaattttactatatgcatgcatttgatcctaagctgctttggctattagatataaatgaagtgcattaagcaagttcaacctttcattcccaataggaacgaacttgaagcacagatgtcaattactatacccctaacaattgatacactatagcagcggttgtagccgcagctggaggattcgctgtcgagcagaccatatacctgaatttaaaccatgtcaaatatccgtaatgaataacaaataattttatattgtgcatatccaatgaataatcaaacatttgcctttcgactgtaatgcttgcatggcctgctattgtattgctctggaaacacatctttaacagatgttgtattatcacatacattacattggaggagaaggatttaagtgatcatatatagaacagaggatatgatgttttagaaaaaagaagattaataatgtcaagaatactttgtgaaacagtgcatgatgcaggcacatcacttgatacattaaaagcgctgtaaaaaatttatgctggggaactaatgcactactactagcctcactaatatcatcagttcgcggtatgtaacaagctaacattctacactgcaccaccccatccattcttgcttttttctatagaacacaagaaggaacatcagtaactggatgcatgtgtgcaccgccagctgccacagtgttggccattatctctttcttcaaggcatttcttcccatcaactcctgcttgacacaagcaggacaaaaatgtagctttggttaagtcaaggggagtcagtccagctatagatgaaccagcgcccttattattgtgattactgccctagctcacacaccggaaatggactcaaatcttaaaggcatgtgagcttctaacgagcccacattccatctaggtaacatgatatattgtaaggctctatttttttcagattattaaaatggattatttgctccatgctttaaaatatatgtttgctccatattctaagtcaagtattttatttagggtaattattttgatcctagaggagacatcctaggatttctctaaacatcatgaaaatagttatagtaaagaaatttcgtaatatttatgtggtgtacatattccaccctcacaaattaattttcaagttaagctcagtagcaaatcgacaagtaaaaaaggacaggtccagcatataaacgttcatgtgcaatgtacatacgaatttatttattttgtttctcaatgttcagatccaatttaaacttggttttttcgttgagtagtaaattgtcattgtactctatattgtcattttgttagggaatctttcattactgtgtgcactgcatcgaagagaaaaaaagggcgtgtaaatgcatatcctctattaaaatccgacttctatatattttgccccattttctctataatttctagtggttattgattgagaacagctacaaattacttactaagcacctttcatgggcactatataactcatgcaattcttaaggtttacgaatgcgaatacaaatagaaattcgctgtgccgacctgttttcaaagattaaaaaattgaaacatcaatcagaaaccattccagaatgggccaaaatttggaaaacaaattttgaattccatggagaaaattaactggctggcaattgcacatttgcactgctttgcccctataaacatcttcgagtagccatttcattattcccagtaaaatattaatactccttaatcaagaactgccatataggtcatttctcttggtacttcagttcgctcatttatttctcataatttaaatttcaaagtaataagcgatagatcaggatccatgatttgaacatgcaactttaaagtaatgcagtaagatatagatcggtgtccatgacttgaacatgcatgaacagtaaccccactcgtgagttaaaaagatagatccatgatttaaacatacattcgcagatatttgatcattatatgttgtaattatattctcataaaaaaaactaaaaatgcttcatagcatttgtatattatgccaatattgagataatttcgatatctcatatgttttagattggaacagatcacgaaagtttttcttcgaaaagttatggtcattaggacatgatggatttgaggtaacaaaatagatgagatttattaaaacccttgaaatagtccaacaatccagcgctaacatttagcacagtgtaattcaaaagaagacaaccacagaaacacacaggggatgttttaaactccaatttttatatatttggcattattcaaattgcaaacaaatatgatgactctctttctcaaagaaacatatgccgttagggtgatcccagcgcttcacttagaatggtttttcatagcattaaatgatatgccacgtaggaaaaaacatgatgtgccattttattaacttaggaaagagaagaaaattgggtcttctcaaaatgatcatcatctaacaaaatgtctctttgtttatttgtgcaaagagtaaatgtgcatcgtgcaatgtcatgcatgctgccaaccaagattaatttctatttagttgaacctgtgcaacatttaaagtgtgaagtaatttttgttggacttgaagcgacaaagcaccttggtcgattaggccatccccaacccatggtgtccatgggtggtgtctagagcagtgagagatcaataaatgcatatatggacactacctccccattgcatcgtttatataccagttttcataggcaaaaaaaaattagtagctctttgcatgtaacattaacagaggagggtcagctgtggcaagcaagcaagcagacgcgggaggggaggcgcgcagcaggcatggtgacggggtagggcgcagcggatcgagatgcgaggatttttttttgggggggtggggtggggggagagaaacgagtcatccaacccaacgcggatttagctagtttccagtgccttggaacagccgccgaaacggtgtcgcgcatgcgacctggtttctatgtttttgcttctttctcttcttttattccgttgccacatcaactttttgtctagttggcagcctaattaattctatggaaaccaggtgacatggagggttggggacatggtggaaaaaaccggaacgggccgacagttcaaccggaaaaaaccagaacccgttcagttcaaaagaaagaccggacatgcatatgacccgctttgaaccggcagaaccggtcggtttttctatgaaccggtcattaaaccgtccccggttagaccgaacaagccacaataatcttgaaatgggccttgatgtggcccaattggtctgcctagagcgttttggttggcaaaaatcaatctcctattctcggcacgtgtgatatacaatggtaagtgagatatacaattctcggcacggctacattacaaggtgtcgcattgtgtcaatgtttggttaatttgctagattcacataatacatgccaggaagttcagaacaatgtgttgcctttcaccggaaaactttgttggagcaaatgccttcttcttttttgcttctgcttcttgagtccatgtggaggaagcagtagatagctgatgatatcaggattccttctgtgtctgtgtaggtgtagcaacaccactataatttttatttagcaacacaatatcaatttggtctataaaagtatgaattaaatcaatccccaaccacaattagagtaagttggtgagttattgtaaagctctgcaaagttaatttaaaagttattgcattaacttatttcgtatcacaaacaagttttcacaagagtattaatggaacaatgaaaaccattgaacatactataattttttttcttactgaaattatataattcaaagagcataaacccacacagtcgtaaagttccacgtgtagtgcattatcaaaataatagcttacaaaacataacaaacttagtttcaaaagttgcaatccttatcacattgacacataaagtgagcgatgagtcatgtcattatttttttgctcaccatcatgtatatatgatgggcataaaagttactttgatgatgatatcaaagaacatttttaggtgcacctaacagaatatccaaataatatgactcacttagatcctaatatagcatcaagcaaaactaacactctaaagcaaccgatagggaaacatctataaatagacaagcataatgaaaaccctcctcatccttcacacaattcaaacattatagttgaagcatagtagtagaatcctacaaaaatgaagatcattttcgtatttgctctccttgctattgttgcatgcaacgcttctgcacggtttgatgctcttagtcaaagttatagacaatatcaactacaatcgcatctcctgctacagcaacaagtgctcagcccatgcagtgagttcgtaaggcaacagcatagcatagtggcaacccccttctggcaaccagctacgtttcaattgataaacaaccaagtcatgcagcaacagtgttgccaacagctcaggctggtagcgcaacaatctcactaccaggccattagtagcgttcaggcgattgtgcagcaactacagctgcagcaggtcggtgttgtctactttgatcagactcaagctcaagctcaagctttgctggccttaaacttgccatccatatgtggtatctatcctaactactacattgctccgaggagcattcccaccgttggtggtgtctggtactgaattgtaatagtataatggttcaaatgttaaaaataaagtcatgcatcatcatgcgtgacagttgaaacttgatgtcatataaatctaaataaaatcacctatttaaatagcattcatgtatgaggttgcattatcatagctaattaccatcacaaagaactttacaattactatgtgcatgcatttgatcctaagctactttggctattagatacaaatggagtgtattaagcaagtccaacttttcattctaataggaacaaacttgaagcacatatgtcaattactatatccccaacaattgatacactatagcagtggttgcaatggcagctgcaggaattgctagtgaacccaacagcccatataactgaattgaagccatgtcagacatccgtaatgaacaacaaataattccaaatagtgcataaccaataaatacttaaagatttgtctttcaacactaatgtttgcatttcatgcaattgtattgctctggaagcaccttttaacaggttgtatcatcacatgcattacattggaggataaggatataagagatcatatatagaatagaggatatggtgttttagaaaaagaagatgaagaatatacattgtgaaacagtgcatgatataggcacatcacttaatacattaaaagcactgccagaaatctatgttggtgaacaaatgctcactggttgtctcacttatatcaccattcaccaagttcaccgtatgtaacaagcacttggccccatggttccccttaccgtttttgacgcggttaccacatggttaccgcaaaaaaccgtgtggtaaccgtgagacataccgtggtttcaaaaactaaaaaggttaccgcgtgtgatagccgcgcagttttgtaaaccctgcttggccctacaccaccccagccattaattcttgtccttctctgtacaacgcaacgaggaaatacatcatgggcatagggaataattagcaagtttagcaaaaatgaatggcacaattgtatagcatgagtgatgatgcaatgaggaaacataagaacatcagccaggtgtttctccccctcaactcctgcttgtcccaagcaaaacaaaaatgtagctttggttcagtcaaggcgagtcagtccagctagagattaaccaccttattattactatttttttattattactaccctagcttacccaaaaaaatgaacatttttcatttttaattttaaaaataaatccatccaaaacttattttcaagatttgaacatttgaccacgccaactaaactggcgtgtcaaaacaataccgtcatgccactcccgctggtcacaccggcggggaccgacctcactggtaggggtggacaaaaaagcttgggctcgtgagctcggctcaagcttggcttgggctcgcatagctcggctcggctcgaaagccaaacgagccaagcccaagcctccttcctacctcgtttccgaaacgacccaagcccgagctggctcacgagccactcgtgagctcgcttggcttggtacaatagggtcatatgcaaaaaaaaattacaccttttctaactatttatttgttgaaaattataactttgattgtcatattatctatttatgtgttgtgatgacatattaaagaaaaatatcgctttattacacattctatgtggtaaaatattgctcaatttctcctagtcttgcttgagatttacttgatgccaggctcgcttggctcggtacaatagggtcatatgcaaaaaaaattacaccttttctaactatttatttgttgaaaattataactttgattgtcatattatctatttatatgttgtgatgacatattaaagaaaaatatcactttattacacattctatgtggtaaaatattgctcaatttctcttagtcctgcttgagatttacttgatgccaggctcgcgagctagctcgagctggctcgagcccataaacgagccgagccgagctgcagttttagctcgttgtttgtagcgagccaagccaagccgaggttcccttgcaccaagctttcatgattccacccctactcactggtgtggcagcgttatttggccacgcgtggcaggataaaaccgtcacgtccgctacaggtggtgtgccagtgtcatcttgtcacactagatgagctagtgtgcctaaaaggttcaaattttagaaataattttgaaagggtttgtttttaaaatttaaaattaaaaaggttcaaaaaattaaaaaaaatccctagcttacacaccggaaatgaactagaaacttaaaggcatgtgagcttctaacgagcacacgttccattaggtaatctggcatatgtgacatatagtaagggctctatttttttaattatttgctggattattaaaatagattattttcacccatcccatagctggtgaaaacattccccacgctgttccgaataacaatgccgacgctaccaatttattttcacccatcccatagctggtgcctgccacacacctgccacttgggttctttccccgcacccattcacatcactttgtcttccctccgacacaatttttcctttctcattttccagcgttgcactgccagacgggcacaaggaattccatagattcagaaggaaagatgcagagccctttaccgtcgcttgcccagaaccgaagacacagtcattacgcaggtaccaagctcgccataggacaaggagaaactgcgcccgctcgttttcgctcagcttatcgagtcccccaagaagccaccctgggcctagcttcgacagggaacgcttatccggtaacctccagctcgcccgcagagtttcacggagggcccttggccgggtacatgaaatcaccgcgtgaaactcgtcttcctccccctggccgcagatagtacaggtcgcaactgcttgcagctttcgtttacacctgttcttctgggtagccagataatttcgggctagacgccaggcgaaaatacggacctttggtggcacaggtgtactccaaattcttcgccagatggagcgatcaccgtccgtttctctactactgccttctccatccggatggaacttgttcagccacgctaaacgataagcagacctcaccgagaaaatccctgatttttcgtagtgccaagctaggaaatcctcatcctggtatggcgacaaattgattttcaggatctcttccacatcaagtgggtgacagacgtgcttgatcagatcaacgtcccagctcttttccccttgtttcagcagctgcgagacccagcgaagacggcagcgtccgctccttcccataagcatgagagaggaggctcggggaatccatttatcccgccaaatcctgaccttggtcccatccccaattcgccatataagtcctgtcttcagcaactgcaacccatgttcaatccctttccatgtcggagacgcttcagccgggaagaccgcatctactagttcacaattaggataatacttagcttttaattaggatatatatatgtatatatatatatgtatatattgtaatattccagtattccacccccccccccccccccaaccccaaaacaacaaatcagttttcaagttaagctcactagcaaatcgacaaaaaaaaaaagggcagtccagcatatatatataaacgttcatgcacaatgtacatgtacatacgaatttattagttctttttctcaatgttcagataagttttgttgagtgataaataatcactgtacactatattgttatttttttaaggaaatctttcatcattgtttgtactgcatcgaagagaaaaatgggtgtgtaaatgcacattctctcgcgagagattaaaatccatcttctattttgccttttttttctctataatttctagtggatatcgattgagaacagctagaaattacttataagcatatttttcatggattctatttaagatacaaaactactacacatgggtacatgctaaccaaggtttacaaatgcaaaagcgaatagaaatttgctgtgccgagctgtttttcaaaaagattatattcttttctcccaaagatgaagatgaagattaatttttttcgtaaaacgaggtgatattagcatatgattgattgagttttaattataacaaacttgaaaatagattaatataatattttagaacaactttcatatagaaagtttccacacgaaacgtacagtttagcagtttgaaaagcttgctacaaaaatcttaatcttcatccaacaagaagaacggaacctaaacgatagatctgaatccatgacttgaacatgcatgaacagtacggtgagttaaagagatacatttcgatccatgatttaaacatacatacataactgggtgcagatatttggtcattatttattgtatttgtaattatatacgtactcataaaaattattaagaacgcagtaaattcataaaattaagcagttttcatggcgaatctaataacattattttcacatataacattcggatattttgcctatcatgagatagttcgtatatctaaattaatccccaacgattttctagcagtgattcagatatcacaggctaatctcgtaatacataaagatgattatgttcaaaacatgatttaggttaaaaaaattccaagcgaatccgtaaactatattcatgtttcagatagccggcctttggttgattatgaaaaacgattatattattcacattttaaatagttttgtgctatagacatgtatatgaaagacaaaacgagttaaagaaaacttttttagaaaaaagaaactgtgtgaccacgatcttgatacaggaaaagtttgaattagtatgttcaattctgttcatgtacatttgctatatatattattgccttcatttgcaattatactgaatactcgctcgaggaataaatcggtacatgtacgcatgcctctcaataatttgaatgtgaatttgagagtacgtagttcatctcatcataatcatccacacccaaataaattactacattccgattactcataaataataggtaaaactaatttcaatttgacttgatttcatcaatggatcttcaaatcaaatcaaatttcaaacccatccatcagcagttaccaatcctgccatccccggcatcggtgaagaacctcttccagaaccaatggcggcgccacaccgtgtcgaccatctcgtcgatgggcacccccttcgtctccggcagcagccagaagacgaaggcggccatgataacgatccagatagcgaagaagaagaagatgaaggccttcatactgcacatcatggagaggaaggcctgcgcgatgaggaaggtgaagagcatgttggagctcacggcgaaggagaaccccgtcgtcctcgtcgccagggggaatgtctccgacgggattagccaccccaggggcccccacgaccacgcgaagctcgagacgtagacgcagatgagcaccacgatcgccaccgcccacttctcgcccggattgccgttcgccttcacgtgttcccacatgatcgcccccaccgctgtctgccatggatctttcatgttagtttgtagaactaaaggaacgcgaatgctaagaaatgacctaatatcagataattagaaggggtgaggcttcgaatacaggtcgtccccaccatcttgcggagctagccggaaaacctcttgccgttttttgggtttctcgaactgggagaggacttatgtaaaagtttatattaaaaattaatatatgtttcaaaatttaaatgtgtagtgtatttaaaaggaagttatagtaaaattatataataaaaagatatatttaagtgcatcatatatttaaaaagaaaaggtaacataaacatgtactccctccgtttttttaatagatgacgccgttgactttttctcacatgtttgaccattcgtcttatttaaaaaatttacgtaattataatttattttgttttgggttgttttatcactcacagtactttaagtgtgatttatattttatacatttgcataaaatttttgaataagacgaatggtcaaacatgtaagaaaaaattaatggcgtcatctattaaaaaacggaggtagtagaaaaaactatattttaaaagccaactgtgttatatatttagaaatagagatatatatacaaatatgtaatatgtttaaaggctaaattgcttcgtgtgtaatatatgtaatatattacctgtgcgatgagcatttggccgcaggcctggaggaggagcctgcggcggccgatcttgtcgacggcgacgatggagacgagcgtggagacgacgttgacgccgccggtgacgacggcggagagcagcgacccgttgctcttgaaccccatggtctggaatagcacgggcgcgtagaacatgatggcgttgatccccgtgaactgctggaacacctgcatcgccaccgcgatcaccagcggcggcctcgactcccgccgccgcaacctccggtacgccgactcctccgcgctcagcgccgccgccgcctcgcatgcgcgcgcgatctcgtccagctcgtcgccgacgtcgcgcgtgccgcggatcctctccagcgtggcgcgcccggagtcgcgccgcccgcgctccacgaggctcgtcggcgtctcggtgatcaccagcgagcccaggaacagcaccgccgcgggcactccggcgccgccgagggagtacctccacccggtgctcgggtgggcgctcgaggtgaagtagttgacgacgttggcgatgaggatgccgatggtgacgtcgagctggaagaggatgttgagcgcgccgcggatgtgcgccggcgcgatctccgacaggaacagcggcgccgcctggttgccgaacccgacgccgacgccgaggcagatcctccccacgatcagcatcgccaggttcgccgcgccggcgcacagcgccgtcccgccgaggaagaacaccgacgcgagctgcatcgtgcgccgccgccccagccgcgtgcacagcctcgacgccgcgaagctggcggccagcgcggcgaggtacagcgacgaggtgaacagctgcagccgctggtcgtcgaacttgcagtagttgttctccctcgcgcggtgcttccgcgcgtacaccgacgggaagaacttgatcaggaagccgtccatggcggtcacgccgccggagatgccgacgtcgtagccgaacatgagcccgctcgtcgccgcgatgatgccgcacagccacacgtaccacgtgatcttccccttgaactcccgccgctcgccgccgccggcgaccttggcctcgacggcgaaaccacccgccattgatgacgtcaacgacgacgacgagatcaatcaaatggagatgatgaggaagaagatgaccaagaggtggtcgagtatatatagaggattttattaatggagataagatgtggataaattggagtgatctcatgcattcgcatgcagataaaataaattaaaattgaattgaatttgaattaaacttggtcaacgaacagattaactgaaggggtttaattaagcagatcggattagttactagctagaactaatcaggatagagttttccggggggtttttttgggggtttttttcacacggtgacggtgacatgcatgcagtttaggggagttggattagtccttttttaaggaatttatagttggattaatggttaggagtaattaggattaatcggatcagccgatctcaacagtgaccagttctcctgcgacaagcccgttcgttctcttgacacgtggcaccaattcattcgctctcaatctattaatggtaatttaatctccaacccaatccaaatgcaaaaattgaaagaaaaaaaaacgcgtttctcacaagatggactgttcctgtgatgactatttttgtctctacaggccgtcctaaactcgtaaatatattatctctaccgtgtattttattatttttttgaaaaaaaaaagtatgcacaaaaatggattttggccattaatttatctctattgatttttgaaaaaacctttacatgatttttatctgtcgctctgttctgcttatgccaaagatggacgttgtgcaaaattgaattgatcaagagcagcttgtgcacagtaattctctgttgtagtatgccttttgcctcgaaactgattaaaacagaacccaaaataaagagcatgagttaactaaagaaagttaacccgtaatcttgatgctatagcatgcttcaaaattataccctcgaatgctaaaaaaatagtactccctccgtttcataatgtaagtcattctagcatttcccatatttattttgataccaataaatctagacatatatatctatctagattcattagcataaatataaatgtgggaaatgctagaatgacttacattgtgaaactgagaaagtacaggtaataatcatcacttatatttgtcgaagaacaatatgaaaagaaagctatcaagcaggtgccttattgcaaagttacaatacacactggcgaatgaactgcaaacttaacttatgtgtcactaacaacttagaaacgagcaaacaaaaaccagtcagttcatcgtcttagactaaaacaggcaccctgcagacaagtgccttgatcaaacggtttttacacggcaaaccaacagacgaaaattcaccagttaaacacatttcagcatctcttcgtacgcataagaactcttcaagcttctgagcttcatcaggtgtttctttgaccgccataatgtttctttcaaactcctcgccttatctctgcgaattcacacataatatgagcttagggaaacattgcagaagatattggccatgttttaattggctggcgaaaatcgtatgctacctgaaatgtggttctgggagctcattctgagataggcttgcgaaccaaaaagaagtacatcggcgtgaagatttccttcctgtagttaatatatttgcattagaactttgcatgaagtattaaacaggagaggaaatggaaaaacagacagctgaactggaattccagaattcgtgacaattatgttgcttttctgattcctggtgctgaaatatgaatcagagacagacttacttgccaccttcgacgagaccttcagctgccttctctaaaaagttagataccctttcacttccttgtggggcaaggccgacgtattccaatgccttcacctaaaaaataacagaagaggatctcaattccatttccatgcgaatcaagagtgaatatataccatgattaaatcaggctgttatggccagttacagtggacaaagcagcctgatctttgaatattcagtgtaacaaagttttgatcgaatttaccatacaagcaatttagcacatctgctgagcagattatgtcaagtctacccgaaatttgatacttctagaaaaaaaatagtatagtacttttaaactttgctagctattagtataattgtttgttttatttattgtaaatgtccaaagaatgacttttctagctagccctggtagaacttctataggttttcatgttacataaactattacatgaaccattgttctcaaaaccacttttaaaggcagcagggaacctaaaacttcattaattattttccaccacaagattggtgtgcccccgaatgttcattggtattaggccacatgtcactgaaacaatggagtggcactaaaatgcaccctctttgggatgccaactcctcaattttaagcttttttctgttcagagggaggaatttgataagaaagaatgtctatagtacgctttactccaagggacaaatcaaacttgatttcactgtgcatcttgaacaatcaactcagaacataaggtgtagcaacaataaagaatgactacagatgtatctgttggccttaccattgtgcgagtaattgcacgccccacagtagtcagacggaagctactcaaggaaaaccggcttggatccaagggcaggtaccaaggaaccggggaatcttcagcaaggtctttatcccaaataaccttcacagaaaaaaaaattatgcccatgggaaaggaataacaaataacagaagtgttcatgaaactgtgctgctttgaaagaaaactgctgtaactggccagagtttctaaactaacaatagaggtgggctactcttccagccatgggttttcctcaggtaaacccaaacacacaatcaaacaaaagagaggtaaagcacagcgtctacattacctcaaacccagcatcttttgcagcttgaagacattgttgagtgcttcggatatctggcaggccattgccaagctcgatttcatccttgatcctcttgtgtgttgcattgttcggttcatagtgatcagtaatacaccactcatacacagcaaaacactggccaggcttcaatacacgatagatctccttatagcagccaacctttgacatgaaaaaaccaattgactttgtgtcgcaaggagggattaaagttgatgatgagttttaatatacaagcaataatttgcaatcataccggatcaggtgcgtggcatgttgcctcaatggcatagacagcatcaaaagtgttatcagaaaacggcatcttcatgaagtctgcctgtatagagaccaatatgtagaatgtaactgtttgtccttcagcttatatatattgtcaaataagtcttctctgtacagctaagcaagtgcagagagtctacgcaaggtaatttgcaatatgtgatggttgctggaaagggataaataacatttgcacagagatgcagctgcaaatagatgattgactactaaaagatgggggaaagaggcaaagagccaaaaagaatgtctattttagctaactataccttcacaaagtcgcaagttccactaactcctgctacccgattaagctcctggatattaaaacaaaaatcttatgtcaacacaggagtaatgtgatgaacagcaaacgctgaaaactgtttactaatctgaagttcttaaccatatgcagaagtagagtaaatcaaattaagtaagggaacatcaattaacctttcccctagttatctggtactcattgttgttcaatccagtgactgaagccaagctgcaggaaacagcagatcatggccacattagtcatctctagttcataatccatagtgaggggaaaaaaagagaagtttccacacttttgaggacagtattttagcagaaaatggatcatcaacactgatatttgggaaaaagaaatgccctaagtaaacaatgagctcaatgccatcttcacccaaaaaaataacatataatgaggaagtacagggttgatacttaacgacgttgtcctggcaccattatccaagatcaatttaccacacgtttaatttttaaatgtcaaatatttattatgcatattaaaatttctggcccaaacacattacaagcaagtggacagaaggcccatgaatcaaacctaaatttggcaatttctcttagtggtccgcctattccacaaccgacgtccaaaacctacagtagggaagtgaagttaacactttcattctaatgttgtagtgtagaaccagcaggaaatctttatgataggtttaaataggaaaattaaccttcattcctggtttcactccaagctgaagggcaagaaagtgctcatgtcgcttaatgctttcacgtagggattctccattccatctaaaacattcaggaacatgacaagtttctgtcactagatgtcaggtaatatgcaaaacttcaactacgttctcgtatttcattacaatgagcacagatgatctctctaaaaccctcacctgtgagcaaagtggaaggattcaccccaaccatactcatagaagctggtggcaagatcatagtatttattaacctgataaggcattaatgcattagttgctaatataaaaactgaaaaacccaaaattatctccaattagcatggggtaaatgggtgatgcagcaaacaaaaaattgtcacaaactctaaatttgaaggtttccttctttcaaacagaataaagaggggttcaattagaaatatgtgactaaaatacaattgacatatagcataacagcagaacctagaatatgtgtactgtcttgcttcaacactcaacatgacaatttaaaaagcacaatatttgagttgtcttagatatctctttgaatcagtcgtgcttagttaaatttataatctagtcaagaagaactgaagattaacagctttttatcgtgcaaaagttgaagcaaattacagacaaacagttgaagcaaattatgcagatataatccttttaactgagcatctagaaaatgacttgagtaggaaagcaacaaatttacaaaataagatattcacaaaaatgtaataattctgtcttctgagagactaagatgatttaccatgtctgtgtagttggactttcttgcttcttcttttcctccatagtatccatggtatttctcataccttgcaaaaccaatttatttaaaataaataacagtaaaatacaggccaagttctgagcacaaaaatcctttttctgagtgtcaataaaattcttgctaagcagttgatatgttttttatacagggtaaatattgaatgtattgacaaattcttaatagaatgtgctaaaactggcatagatagagatagtttaaaagaggataagcttgttttaataattctgtaatggtgccacagtatgtactcctttccttgattaaccatagagcatagtttgaccttgcacgagaaatcaaggattaaagaggtgacaaaggtgatgaaacattagagaagatgacgtgggtgcactctcattattgattcagaaagatgagcgagcatactttgtggcagtaacaaataaaagcaaatgagaaggagtaaaagacatgggaatggtagaaaaagctcatatcttatatttattgctgggtctttggaatattaatgggaggggagtacaatacgtatggacaagttggcatggcttgaagtagcctatatagtgatggcctgatgggcgaccacaaagcatcacattcaatacacatgataaaaacctagtactattctaataagatgaaataggtgcaatgcatcaggagttttcagatgtccagaactgctaccaccaaaaaagaagaagaaaatttctgggtgcagaacgaaaagtcgagcaaacaacagtgagaaattacgaaatcagtgaatctgtgctttccttgtttaatctcagtcatacaaactgaattctgaaccctgaactctgaagagatgcattcaagtacagcacagcagacatgcaagtacagtacatcaccagaatcaaacctgcatatctaaatctaaatctaaatgccaacaaaaataaaagagagagagaaaataataatcaaccaacgcagagaaacaaagagcagaagatgctttactcatcgacagccgacttgacctcatccttggtgatcttccccccgagtccagatgcaagatccatggccccagacctcgacatcgcggcgtcgatcaccggagctccacctgcaaccaacagcagcaaagttcctcacggaaatcaggagcatccacctcctcactttcctcccaaatccgaacaaaccacacacatatatattccaaaaaaaattcaaacggtagtgcgaaagggatggatatgatttattttcttcacccttttttgcccgtccctttccccccaacctctcctcctcatcttttcacccccaaacaaagaacaaaaatactagccaatcacccaggccgcaaatgcggtgtaccaatcagccgccgatcaggccatggatggaggaggccgcacggcgagcagggccacgatcccgtgacggtagggcgctccccccccccccctctttctctcccggggatgggtctggaactcgagatcgcgacagagccgagccgagacgatgcgtgcgataggagcaatgcatgtgcgccggcgagcggacgcgggaggaggaggacgaggaggggaggtgcttaccggacggtgagggcggcggcggcggcggtcgccggagacgagaactccggccggcgaggagggaggtggggaggatggggtggcttctctccctcgcgtgggttttatcgtggggttgcatctcggctcaatattgattatttttttctatttttattatataaaataatactccatctgtcccccatatatatatatatatatatatatatatatatatatatatatatgggggacagatggagtattattttatatatatatatatatatatataaataaataaaagaacctgatactggatgggataatccctagttaagttttttaagataatgataaaactttcagtatctaaactaactagacttgcacgctaaaatacctggatttgaacgaattattatggagtggctacttaagcccggtttcacgtattgataggagtatgaagtttgtgtgttaaattatatttgttctaaaattttggatttcatctaaataataggaaaataatgatttatttaaatgttattaatataatcgtgaatccagatctaacgatttatgaagttacgaatatcagtttcaaaaaattttggatctagagctacgtgcctatgtcgaagagggccctaatttatggtttctaattttattttcttctattatatgaaagatatatggcacatcctacttcaaatatgtcttttaacacatgttaaaaaagacaaaggctaataaaatgctctaacatcactgaaaacttttaaaagcgtgcttttatcgtagaggagatggtaataaataaagtttttgagaaaataagtccaagcatgcaaatttgtgcatcatcattcttcttcaactacgaaatacttcctctatctcataataagtttatttttagctcattttatttgttttaaaataaatttaattttagagtaaccattgcatcggagtttgtgaaagtagcgaacaattgtactccatttgaagtagataaaatcggaaatggttacattgagatttgataaattaagggtttgttaggcatagctctagctctatctctcctgaaattatagtccaatcaaacggtttcagtttcacccaaaatgcgagcggagttggttgaaatacttttacaaaatgaactagagatgtgaaactgggtttaggcagctccacctccacaactccatttcaaaccctaactcctaaagttaaatttaagatattgagccctatcaaatgagaagttaaatttataagttagaggcctaccaaatagaatgcgtgtttggtagggctccaactctcaaatttaactctatgagttggggtttagagtggagctgtctaaacctagctccacctttttagttcatttatagagcatttttgtcagcttcacttctttttgaataaagctaaaattatttggttggactctagcttcaggaaaaatggagctagagcaaaccaaatagttcatatatgttcttggcagctctttagcttacaagcttcagctatatttaaaatataaaggttggtttaaagttatttcaactttcttccgttgttttctatttttcagcatcatatcaactcaagtcgttaaaagtaaaagtataaaatcctagagccctatacaattattttcattgtttgggtcccgcatcatagcttatatagccacactaaaaatctcagcgaaggaaaaaaaaagaaagaaaagaaaaacatgcacatcgacgatgaactgtcaccgtagagcctagtagagcattatatagcttcatctaattctaataaggtgcaagatagtgtttgcgatagattaagatgaagataaagtagagctgaaaaaactagaaaattattagcgcataactaattaagtttaaatattataaatttaaaaaatagagtttgttcgatatttcaaagcaacttacacatagacattatttagcaatttaaaaaacatgtt

SEQ ID NO: 33922 - DNA, 9345 bp, Oryza sativa
tgtcttctgaagatgattatagagatagagtgtgcttatgtacacattatgaacatctacatttatatatacttttaaaagcactttaatacactatataatagagttattttttaaccgtacgtgtagtcgaactggtgagccagcgatcgatcactattttatctagagatggtaacggggcaccaccctattcactactcgtgactcatgagcacgcatcaatcagatgaaatttttacttatcagaaattggtaaattgagttggaaaaattaatcaaacctataaataaaattcacaattaaactgcagtaaggcctgccacctttgaaacacgagaattgtttttatgcctaacggaatttaactaactaattcatctgaaaatatcgtaaaatttgcgtgaataattaaggagaccgtggcaacaaagatgtgcagctgcgtattcatttatcaaagaaggaaaaacgtaaatagctgaagttaatttggtgtaatataatataatatcaaaatataataattagtattggattgaacatataccaacactacaaatttatcataatattatagtttgaaatcgagggagtactttgttaacgacaaatggcgtataccatcagtacagtactagtactacttaattcgaccgtttgctgacaaggaattgaagcaaaaacgacatgaaatcggagagagctgactgcactaatcagattcacacatatttttcatttctatcgtatcaatccaacttgcattgattgcttttagttgaagcggtgaattcatgttttggtgtgtatgaaatcatcatgcaggtagttgggcgattttgtgaaaattacgaagatgatatacgtaccataacgcagtcggatggcagatagcgtagttcgtattcgtacagcagctctagtaaattatttgtccgattttaatagttaagggtatacaatgtctggctttcgagtttataagggtgtaattcgatcgaccgcaatagttccaagggtaaatcgtacattttcctaattataatgatggtggtatgtggtttgtccttcattagccttcatctttctctgatctcatcttcgtctctcacgtcaaattaggatcctctgattttgaagtcacaacttctttatttctgacatgtaaatccgagttttttttgccataaaaaaagtcacatgacatcaaccttagaggatcatgtgtctcttgcgccactaccgtcgtccctcttcttcctttacttaccttcacgccttctctaaaattataccgcccatcttctcattgctctttggccgaatgtgatactaacaatattctcccaataaacttggatcttcaagatcttcctagattattatagctgcatactcccttcgtataaaaaactaatctagtatatagtatcggatgtgacatatcataatactgtgaatttagatatacatatatctaaatttatagtactagtttggcttttttacgagacgaaagtagtatgtatataaagaagcagccgtatgttcctgttcaaaacgaggacaatagatatagcagaaacaatggtgacacgactacgagccacatgtgctatgagtgggtcatggatgttggcatcatggtatggtatatacttaccgcagctgtcaccagagatgataatttcctactacattcgttataatttaaaatatactaatataatattaaattagacatattataatattacgaatctaaagttcgggatagatatgatctatctaaatttataatattggaatgtgtctaatttaatattaaattactatattttaaaatggagagagtaagtagtactacggctgaggacaaatgtatcggcagatcagatcagatcgtgagtgcagagcaaagctagggtgcgacaaggaaaccaacaaaagattctgcatctgtatatctattttagaaatatataagaaaggttcgggtatttcggttagcaccataaggtatgtgtgctaacgagtctcgcttctcttttaataaatttggatatgagagatatttctctaatatccagcatatttcagaaatacatcacaaatacaatgcaatgctgtgctagctgctacagctatccagatacacaacgtacgtatgctgcatgtagcacaacctttgtcctcaggatggcaacagtaccatatgccagaaaatcagactgaattcttcggtgttgccgtcttagaacttctttgaaagctacctctgatgaacctttgtacaaataaaagttgtggcagatagggtttaaaaagcgctagtgtggtaccaaatccaatatataaggtgctaattaacatttactctctcttttcctggaactagttttttccaactactactctctcattttccacacaagtatatttccaaacggttaaacaacgatatgttcttttttaaaagaaatctataggaaagctcctttacaaaatcatattaatccattatctaagaattttataactaatttaattaattatatgttttttagataacttaaacaactttattaaccaagacagaaagcaggggatacaccccaatacatcgcagaaggatacaacttaaagcaaagcaagaagccatctctaacaaggtagaagctaaccaatctaaggaagctaacttccagatgagactaaacaacagtagagaatcagatcgacagagttctgcggcaaagccgcgacgactgaatccttgggtctccattgacatgctcaccgcttgacagactggaaggctcctacagctgtcaccacggaaacgacacaaatcggaggtttggtgctgagccgtagatcttggtgtagacgtcaccggactcagcgaattggttccacggagtctgccgttagatatgctaatggaccatttttttcgtgcgtgggaaaggagtgttcagacaagcaaacgatgctagctaatagcaatgttttctttccagaaggtagcatgggtgtccttatgggtcttattccagtatttactgttcgatggctaagtgtcctcagggatgggcagtgaaaatgcaattcctagcaaccaacaaaatatttaattagattttttttctttgtttcatgtcatttgctttttcattggaattattatttgcttgataacataccaaaaaagaaatctatctagctacccaaatgatcaaatatgcaactagcacagacatcagacctgttgatataattgtcttttagcttccctttttatatattttgttggagatctggctgcaactatcccattttctatgtccataatgttttggttctggcactgtgcgttacacgtggtatggcatatcagttcaattagaaaatgacaacagtacctctaccactgggaccgggatcctctctatcatcaaaggcagatagccaaagttttgatttgggttatttggatatattgcattataaatttgacggatttgaaatagtttgggtctatgctacagtgcttgatatcaacgggcaagtactggcaaattgtttgattacgctgccggaattggattgtttgagaggcaaccgtaacttcactaactcaaacacgtgacaactattaatttgctgatactcatagtagaaatgatttggaccttccacattttcttatctaacgaaacaaacctatttatgccatcaccataattaccattagaattcgtgggttaataatattgtttctactgacagaagagcatatgaatcaatggtttagataatctatgttgagtgttgacagtattgctggtagcagatttgcaccggtggatgatagtattgtcttgtcacaacaatttggttggcgtggtaaaaaagtttcagattcagaaataagttttgagagggtttatttttaaaactaaaaattaaatagttaaaaaggttttttaataaaaaatccaccggtagattggttgcaaaacttggctacaaaagcatagtctttgtcttgatgtggatacagtgtaaacaaacaaagggtctttcacagacagaaaaggtcaccccatgtgtgtgcttgcacgtgaatgttactctatacaccctccgtgaaaaaaaaaataacttctaacgatgaatctgaataaatgcttgtacagattcatctacagaggttagtttttcataggacgaagtgagtatactatacaagtgacccatttgggacagtcagaagggtgagagaaacaactcacatgcaagagtaggtgatgcctggctgtcacagtgtcactgggtgatccggtgaggtgtagtgcaggaaccacgtgcatggaccatcacactgatgttttttttttctctttcctgaaatacgagcagatgggggggaaaagcagactgtgtatattcaggtttttgttgtgcatgatcacaaacatttgcgtgatcgacacaacaatgggtacagaacaagataaggtccagtcagatgcacgtacctgtgcccatattgttctgcttcttccatttgaccagaaggacaggactattgcacaatcagaatgtgatgaatactcatgggtcgaaattattagtatggtgggtctaaacctccagctgcaaggaaaggttcatcaccccaacccttcttgccttctccatttgatactgacgtgcttagcacagcacacaataccaaaaaaaaaaaaaagtggcagctacaggacttccaaacttttattgagtgcagaaaaagaatatgtatacagactgttagacagactggaccagatgttgaaaccttaagcattttggagcaaacatccatggttgtcaaacttatattcaaattatgaatgtcttaaattactgagttcaaattttgcaaatcttaaattactgagttacaatcacaccatacatgtttaggtcaaatcgtacaccatgactggctgctatattggctatgttacatattcggtaaggtagtatttaccaatacagatatagcattttataaaatgctataaaaattctttagtggtggaataggttaaaacagagagtggtcaaattcgatgggatcgtataattattattcatgtctatagaataacatgctacaaactatttacatacacatactcaagcagtttcatagagcaggccgtgcaacttgataatagctgcaaaccataggtatgaattgcacgcccatcttacatcagaggcccaaatgcattgtcactggacaaaagatacaacagtataagacaatcctgatatgttactcataacctgcgattaaaaactaatgcagtacaaactataagagagaagatcaaggcattacctcaatagcaatcctgacttatgattttctgagtatctgggctgacattcactgagcatgttatgagcccctggattagtaaaaatgttagcggtttaacacaaaatatatgcaaatgtataatgctacagttgtacaccaccactactaagaagttcatggtaaaacactctttgagaaaatgatgggatgacatatttttccattaaaaaaagagctagctcagtcctgctgtagtgctgtagagtgtaaaggattcagcatttaggttggtattctgacttatctaaccaattgagaattgaaatatgggcaatgctaagaggttattgcccattatttgacttgttatatctacactcttgcaaaacaaaaacaaaatcccgacccatccaaccatgaagattcaaaagcgaagacatctcagcacctactagtactgtatgatctatcatcaactgatacacgaaggaacaaattgtgaaggggtatgatgcactaattgtatatccaactgacagatcacagctccatctcccttcgtgtcgaacacaatactgttcaccaaacctaacaagcacaaattagatggcacacggcatcagccagaggatccggtcgctccttggccctttggcatcctagagccatccatcccatatgattcatgtttgcccacctcatctagtgcatgttggcatggtaggctagcatcagcctgccacagcactcactctcactgtgtggcactgccttagttaacaatttcagaaaaaataggaaaagctgttcatctacattagacaaagttcttaagtttaccttaattaacaaactagtgtattctttattcttgttttgagatcaacatctaatcctaattttgagtatagctgcttcaacaatacttttaagttagcagattaaccacttcatgtgatgttgaacatgaagggatacatatttgttcatgcaaaattagattccctaaacttatcaagacttgactatgcattgaaaattacacttacaataagaaagaactaaattgattggtttcttggaaaatggaggtattaatagtatggtttcttggaagatggaggtatcgatagtacctatgtgacaacaataaaacttggcccaaaaatctattttaggaattgaaaatgtgtacaagtgggtaattctcacattgtttaacaaaatatttaagtagatcaatcagaaaacaagataaataaagtatagtgaaagcattcttttatgaagcacatttttaaaacttaagttacttttgtttcagtgctaacattctgacaagttcttggccctttggtcgagttcagtctatgctgtctataccaaacattttatccacttaattcaaaatatgcagctctctgtcgtttattttctaaaaaaaataaaactaacatcatttctggcttaagtattcaaccaagggttagcgagatatttaactatttgccactcttacaagtggcgattaaggatttgccgctggaccaacatgtcataggacatgagggcccacatgtcataaactgtgagtggcaaatccttaattgccacatcttaaaagtggcaaaaagttaaatgccccgggttgaacaataaccgacaacttagtaaatgcttatgttctgcacctggaggggaaaaacctattgtgaaatgtggaactaatttgcagtattgcattttccaagcagattgaaactagggtcagtatctgcctatgctaagttatgcataaaatcctgagaagaaatttctaattatgttccttcaatgcttcaaacctgttccccttaagtatctcttcagcactgccctcatctattatgtcactcccactcctccattgcttattataccactcccactcttccattgtagggttagtctgataacaatttggtctcatgtgcttcagttaacctccactctgtatcgtccattctacaactcctcctgcccccttgctattacccctccaggggccactaactgaggctctgaaactataaaaaattctcactcaaccttgtggcaacaagtcatccagaaactcaaacatttggccattgtcctcacaattttgtcactctgtctaattcttctatagttagctttatgatattattatttcttacattttttttctcgaaaacgcaagagccatgcgtttcatttcattaagaataagaaagagtatgtacaatagggtgattcacaaggaacactctggagggaagagaaaaaaaaaggaagaaaaggtctcgccgaagcgatgtgcaacaactcccagaagagctagggtcctaagtgggaagtgaccgggtcatgagttcatggagagctcttgccccagcagtgcaccataacataatagcagtaatattttgcatgcttagtagttttttctggtcaatttatcttttgtgcttaagaaaatgtatccatgattgaaagaaaacgaaattcacttttttcctaaatgtcgttaatttgcaatttgggacaacatggttcaaggccagattcaagtagaaagccataattttctaggccttttcatctaaatctaaacttcttggttccaacaaatgctactcatataatgcagatgggcatgtcatcagcatatgcaacttatatatcattatcttagagacagcctatgaaatttgttagctcggttattgtaccactaatataagacagatattttacaatgcgctgtttgacaaatgaccacctcttatatatccttgtcttttctactaagatgctttgcattgccaccatgaaagaaaaggaggaaaaccatggccctttaacttcaccaacttcaaaatggaaatgttgacccaaaaaaaactcgaatgaaaacagagagcctcgtaacatagtagctgcaagcaaaatcctatcctatcactgatacaccaagcacaagaattctgtccatacaagtgctatagcatatcctaacaaataatggaactattccttaattaaccctaagaacatcgggagcatgtagattaaggagacaagttatcatattaatggtagcaaattttaataatttttataaactttctaaaccaatgtggaattacaggttcaagaagaatcagtttgacaaatgccctatagttacttaactatatcaactaccattcagcagccccagcccctcatatgaactgcaatttgtttaataagagaagaacagtttaactctgccgtgataaacctaataatacgatttagcctaacactctccctagctatattcaaaagccccaaacttctccaaacaatatccatcaccatgatatcaatcgatcgttggcaaatcaatgtaattcgtaaaatttatgacaagaaaatgaaaattaccttcacagggatgtcgaaacggaagaccctgacagcgccgaccacctcggtcacgatctccagcggcagggaccccgcggcgaggtccccgatgaggtcgatgacgtcatccacgaccctcccggcgtccacccacacctcggcgtcggcgtacgtcgtccctctggcaccgagctcgccggatccggggcgcgcggcggcggagccgaggaggtggccgcggtaggagacggcggcggacacggcgcggtatcggagcgggaggacgaggccggggttgcggacgcggaggcggagcgcgaggtggagatcgacggacgggagcgggggcgggttgacgcggaagcggtcgaggcggagcccctcgacgcgggcgacgggcgcggacgggtagaggaggaaggcgaggccggcgaggagcgcgaggaagaggaggagcgggagcgtgcgggcggagaacgcgcggaggcaggggacgcggcgcgggcggaggcggcggaggcggacg

SEQ ID NO: 33923 - DNA, 811 bp, Oryza sativa
acgccgccgatccgtacgacgccatcgccggagttgcggttgcgagacggtgacgagtcacaaagtggtgagatcaggaagagagagacgaggagggttgatgctcctgtcgtccaatgggagggcgccacgtgggtgacttagagtgggggagacgaagggaccaccggctacacatttgtcgacaaattttctcctaaaaatttgacaaatataattataatacaatcgttgtgtaattatactgtaacttgtatgtaattacactgtaatttgcatgtaactacagtgtaacttatatgtaagtttccgtaattttgaattgttagatctattacaagatttgttctggtgaagaagaaaaaaaatcatagcacacacatatgtaaaaggatttgttcccacgatctctattaattttaccgaaataacatgttacgaagagatttttaaaagttacatacaagttacattatagtcacagtgtaattacatgtaacttacaatgtaattacagtacgattctgttaaatttttggaggaaaatttgtcgacaaatatatagcaaaattgaagacgaaaccttagatgggccgggccgggcagacgttgacggcccatcaggcaaaaattctggctcgccgccggcgacatgcctcgtcgtcgttctgcgctccggcgatggatacggcgagagattaatgtactgttaattttttagaggaaatgtactgttaattataattatcctgctttagcaaggtatttaagctggtttgttggagcaagctactggctccaaagtggcctt

SEQ ID NO: 33924 - DNA, 11805 bp, Oryza sativa
  unsure (1)..(11805): unsure at all n locations
ttgctctaaagcagctttagccggtccagtacacgtgtcctcagttcctcactgttgtcttttctggcatcctgtatatatacatggcagcatcagcatcactctaatcaaattatcgaactgcatttttcattataaactctaaaccttaaacctcaaaaataatggagctcatggctagagtgttcctgcttcttctcctgcctctctcctcctccgcggccaccgccgttgccgcccctccgcctcctcgatctcaagctcaaaccgccgatggtaatggtgtgttgtcgaatctctcttcttgcaataaataattaacagtctcaacttttcgcttatacttatacttacaagtgaaaatttaaatttttaatataaatttggaattgattttgatgtctttttatcatagtttatttttcagcctttgtttgtaaattgttaaatacatatatatatatatatatatatatatatatatatatatatatatatatatatatatataaaagttttatttacaaattatttttcatttataaatatgccgaataagccaaacgatgcggctgtaaatctcatggctgtgatgtttgagaatgtaaggacaatggcattttcaggcgtgctggtgaacggcaacttcgcgatgagcccccggaagatgaacgccacggtgatcgtcgggagggactcgctgccggggtgggcgctgcgcggccgcgtcgagtacgtctccggcgggccgcagcccggcgggatgtacttcgccgccgcgccgggcgcccacgcgctccgcctgggagcgcgcgcgtcggcggcgcaggcggtggcggtgcgccccggcgcggcgtacgcgctcacgttcgcggccacgcgcgcctgcgcgcgcgacggcgagcgcgaggaggcgctgcgcgtcgccgtgtcgccgtcgttctccgctcccggcgacgtccccgtgcgcacgctctacggcgccggcgccgccgacgcctgggcgtgggggttccgcgccgccgagaggaacgcccaggtcgagttcagtaaccccgccgccgccgacgaccacgacggcgacgacggcctcaactgcggcccgctcctcgccgccgtcgccttcaaggagctcccggcgccaatgccatccaaaggtaaactaacccaacgccatggcatccatggaaggtgaccttcctcttcttggatttgacgacgccattgctggctgcagacaacctgatccggaacggcgacttcgaggccgggccggcggcgatcccgaactccaccgccggcgtgctgctgccgccgaagcggaaggacgcgacgtcgccgctgccggggtggatcgtcgagtcgctccgccccgtccgcctcgtcgacgcgccgcacttcgcggtgccgcaggggcagcgcgccgtggagctcgtcgccgggcgggagggcgcggtcgcgcaggtgatccgcaccgcaccgggccgctcgtacaacctctccttcgccgtcggcgacgccagggacggctgcgagggcgccatgctggtgcacgccgtcgtcgtcgccggcggcggcggcaacgcgacggcgaaggcggcggcggcggccgtgccctacgcgtcgcgcggcggcggcggcgccaggcaggccagcctgaggttcgtggcgagcgggcggcgcgccagggtgacgttctacagctcctactaccacaccagcgccggcgacggcgtgtcgccgtgcgggccggtgctggaccaggtgaaggtgcagccattgatgacgaaagcttagcttaagctgtcgtcagctcagctcagctcgtcgtaatcttgcatgccttgtgttggctaatgttaatctgtggtttttttttgtttttattattttttaggtaaaatttgcggttttttattgatgttgtcatgaattaaaatgagtgcaaatgtgcaacgtagcaggatgtggctactggtacgtgattagcgatctcgcgtgacatttgaaagctgttttcacgtttcatgaaatttggaagctgttttcatatttcagtatgaaatagttctgtaattcgttcaaaaaatatatacgtttgctggtaaatctatttcacgtactccatagattatactgggctagttttgggccttttttttgttggggccacatggatctgaacttgtgaaggaaattaaagaaaaaaattggccatagtagaaggtttaacaaacaaacggttcatgagaaaaatccaatctttcagtaccatatgagtgccaactggcaactgccaactgcgaacggtttaaggaggcacaaaactataaattttatcaaatttatcaccatactatatatttatggagtatcttgaaactacaaatttagcaatgaagttataaaatatatagattttagagttgagtttccttagcattgttgtcccgctggagttataaatcttgtaatattatggtaaaactagcatcaaacatgtattttctaattcgataccttaaatatgtagctgcgataaacacaacaatgaatttgttgttggatgatataacgacttatacatagttttatcataatttgttcaaaatatatatagttctatgaaatttacttatcagttcagttcctgcaaagctcctctgttccaaaggagcacgaattttggaaggatttaagcaatcttgaatacaattatctgtgctatggtttatagtctgaatttgaagttattgactccagcttatatcttctttttttttatttggtgtgttctacttgttttgaactacactcttttctagagtgatactttgtaataattggttgtagctctttttaacaaataccgggatattatattccattatctaaaaaatctaaccgaagctatggaaaataattttataataagaccttttatgtttgtactcttaaggtcgaaaggtaatgatgaatgaaaagactaaagaccaacgaaaaatccctaattttaattctaaaagtttaaaaacgattgtggccaaatcatcatgctgcatgcctactagacattcatttccaaccaaatccagatgaaatccccacatttcaaatcgaggagacgccctcaatcatcgttgccgcggaaagtcgcaatcgcttttgtcgcacccaatgggagaaggattgatcaaagataggaacccagcacgaatcattgaccgacgcgattttgacacgcagaatctgtcgttgctttcatggcccctcatcgtacactaggcaatttaggaggagtagagtggagtaccaattaggcaattaggacttcacttggttaaaaataaaactagagtttattactagttgctagtaattgttagtactaatattacagttatcaatctatgcattaagaaacatatatctgtctagtatattattagatggctttaaaaaaagacaccatgttcattttgaggctaaaaattttcatattaattgaagaaaaaaagacagtaatataatttagaaacaactaaaattcggaatataaaataaagaatattgagaatagaatccatataaaacccaacacgagattaattgagattcaaattaaaaaaataaattctaaaattggatttcaatatgagtttcaaataaacttaaattatcattaaaattatctaaattatcatccattaaaaccataaaaggagtccaatgacatcttaaactataaagcagaacaccaataacgattatggctgatttttaaaattgtaatgactataaaaaggagagatggcgggcaagccgtaaaagggttgagcggtgtcggttgacaggactttaaaaacaaacaaaagaaacctaacgatgatcaggtttaaattttaaaatttcaatgacaataaaaaggaggggtagcaggcatgttgcaaaggagtagtgtgacggcgttttatagaacttctaaaaatataaaaacggaatcggtgagacaatgaactctaaaaactaataaataaggtttgatttttgaaaggtttgaacgatagccatgacatgccgataaatcaagtaaatggacggcaaaggaataagaggtggtgactggcgtcacttttactataaatttagaaattcgatgatgatatgtttgtttttcaaaaaacttaggacaatgagatgagtatttattttaaaagaaaaccatatataaaatagttttaaatgagtgctagccacgtagttacgcgggatcaacatactagttgacctaatttcgtggctcatcagcctcccggaccaactcctgagcgatagcgtccgatcattgcctttgtaagctatctcaccaagtcaccaactatcatgccagaatgtctgcgaaacatggctgaatctcacaagtgcattgtcgtcagattttctccaatcaggcagcaacttgtccgtcattgtttcgtccaaaaggttcaagcccaagctgccacgaaagggaccattggattcagaagccgtacatacaaacacatagagatgagaccagatcactcatcaacaggtccacagccaaatgggccagggatcccctcaggcattgatagtgaagaaaaaactttacagaagaggagaccactctacactatctgtggaatgatagagagaaaagagaataggtcataggtgcacaagcacaagcacaaccacctcaaccaaaagctcagcatgtaatgggagcaacaggatgcctgaatttttcaaggtttccgaccagatttgtaatgtaccaaacattctccactctgcatgttgctagcagtacagcagccactgtgctcaaatctatgatacatactgtttggctgggacttgggataccccccccccccccctaatgaaggttatgtacaccgaagaagacggcatcgttggatttatataccaggatcgatcggtcaaccgatcgccaaaaaattaccgcacggggttgttgtttacgcttctcgtttcatgagcaatcttcacagctagaggatatgctgtccctgccctgggtcctcagctgttcttggcctcttgcagcatttccaccaccttcttcatcttgggccgcttcgctggggcgcgctcggtgcacagcatcgcgaccttgagcacagcaagcatctgcttgcgccacgcgaacgacacggtgctcagcttcggatccatgatctgctccggtgtctcacccctcgcgggggcagagtgcacccacttgacaaggtccataccctccccgaactcctcatccactggcagctttgacgttaggatctccagcagcaccaccccgaagctgtacacgttgcccggcacagtcacttgcattgtgtaggcatactctgaaatggaggaattgcaacagcaacatattgttatgtttgtgaacaaaaaggaacttgtttagtggtcagttgtggagcaaaattcagatttcagacctggaggtatgtaaccgaacgaaccggcaactgcactgatgctagcagtgcccttcaaagggtccagaagcttggagatttccacttcaccaagaagcgcattgtagtgcgagtcaaggaagacgttccccgaagagatgtccaggtgaatggtggcgacatgatggaggaatgccaacccttcggcgacatcgatggcaatcgacaacagccttggccagtcaggcttctggttgtcaccgtcagggttgtcgacattgtgcagcagctgaagcaaggttccattcggcatgtgatggtgcagcagcaacgcgacgtcctcgtagatgacatacccaatgggacgaacaaggtttgggtggttgatgtgcgaaagacactcgagctcccatatcatctttgtctggtgatggataaccgcacgatcaactgacttcagcttcttgacacagactaccataccggatggcatgacggccttgtaggttatgctgaatgtcccattgctcacaacattggcatccttgaatgttgccttgacacaactctggaagtcgatagcctgctgcaagctgtcgatgaacatgtttgaggccatgacctgcggcgctgccactacaacctcccccgcctcagccatcttcgcttcagcctccttctcctgcctctcacgccacatgaacaacgccaccaccaacgacaccacagagaagatgagcacgcaggaccccacaactgccaatgccaccctgtaagatatcttcctgtggtccattccatagctggatccataaattggcccgcagtctacaaccagcgggttgccacacagcttggtgttgccggaaaagctggacgccgcgctcttctggaatggagcaaacacggggatggcgccacttagccggttgttcgacaaattgacctcaatcaagctcagcatccctctcatatcacctggtatctccccggatatctcattgctcgacaagtccagcgcgacgagcttatcaagccgcccaagctcacggggcagcggcccgacaaggtggttgaagctaagattcagggcaatctgcaagctcttgaccctgccaatttcagccggtatctcaccagtaagattgttgtttccaagttgcagctcaagaagccggccacagccgccgatgccgaccgggatgccaccggagaactcgttgtgatcgagcaaaaggaattgcaacctcgacccgttgcagacgctctccggcaagccgccgcggaacgcgttgtagctcaggtcgagcttgctgaggttccggcacctcaggatcgacctcgggaactccccggagaggccgttgctggagacgatgagctcctggaggctcctgagctcgccgagcacgtcggggacctcgccggcgaggcggttgtaggccaggttgagcagcgtgaggttggcgcatcgcgcgagctgcgcggggatcccgccggtgagctcgttgctgtcggcctcgaagtaggtgaggctggtggcgtcgccgatggacgccgggatggcgccggcgaggcggttgttgccgatgcgcacgttggagagggcggagcagcggccgatggtgtccgggatggtgccattgaggcggttcacggtgaggatgagcacctggaggttgccgaggtcgaagaggctgctcgggatggcgccctcgagggcattggagtggaggttgagcacctggagcttggaggagaggccgaggccggaggggatcgggccggagagggagttctcgtaggcggagaggatgcggagggcggggagcgcggcgagccagggcgggatggcgccggtgaggttgttgccggaaatctggagctccgtgagagccctgagcgacctgagctcgtcggggatgccgccggagagcgcgttgttggagaggttgaggaacctgagcccgacggcgccggcgagggagggcgggacgccgccggagaggtggttcatcgacaggtcgaggaactcgaggccggggagcccgcccagcgcctcgccggggacgccgccccggagcgcgttgaacgacaggtccagccgcgccagcgcccggagccccgccaccgccgagaagtcccccctcagcccgcgccgcggcaggtcgatcgccaccaccgcgccgccgccgccgcccgcgcacgtgacgccccgccacgcgcagtagtagcttcccttgccgtcctccccagccgcgccccagtccggcggcgccagcgcgcgccgcagctcccgcattgcgtccccgtccccatccgccgccacggcggcggccacggccacggaggcgccaagaacgcaggccaagaacaagaacgcggcaggcggcggcatcaccggtggtttcttggctttcttggcgctgcagccgcagtcgacgtgctcgctccggcgactgaccaatcagccgctgccgccgccgagctcctcgcgtctccccttctctcgtgaggaggagacaggagctgtggctgcagcacagcagctgcctcctagctagctcacacacagcctcacactgtcactcactcaggtcacacacacacacacacacactctctctctttctttcatgggagtttttagagagagaaagtaggggaggggatgggagggaaaggtggttgaaagaagnaaaaaaggaagggggggggggggggttgaattccactgtgggtcctcaaacaggggggaggggcactgttttgtgggattgaggctatgtcaacacatgggattgtacactgaaactattgaagccccaacagtgtgttacgggtaggattgtgtctatatattggttcatggggcgtggtttgaggtcgggttttatggtttgttcatgcggacggtgacgataggttaacggtggtttagagctttttttatgtatattctgatttacgtactaggtataatacggctgagtgaatgcaaatggtgtaaaatggggtggttagtccgatcaatctattgagaagagactagtactttttaaaagagggtaattcatgatacggatatttcacgtttgtctcgtgaaagttatatgcttgttgtgaaatttggaatctaagtcgtggagggatttttattcaacttatctgttgtggaatgagattccctttacacatactaaagtgatagcgacaaacatgctaagctttgttggcttagtcgataaatcacatcaatgaccatcataacaaattgattcaagttaggaggctatcacttttcattccttatgtctccattgaaaaggggattctacatgaaatttaaaagaagtgactacattctaagaaaatcttgtataaaattctcgtgtcgaaatatccttaaataaatgcctccttgaaaggtcacatcaagtctcaatgttataataatattatttaagagagtatttttttgaaagaacaatttattaatttaccttatggtattaatattattcatggaaaagaaaaaaataacctcattttatcactatgaaacttgttagctacaatagtgcagctgcagtccgctgctattttcatgctttagaaactgttcttgctagctacagctgcaccacatttcaagtagcgaaaaaaacctatgagtttaaaatactactccgtaaaaaaaaaagaccaacctaatattagataatatataatctaatataataaatttagctgtaggctggctttttattgaggaaacacttaagcttgaatctttttttcaacaatcagtaggatagattatgctgagtctgaatggtcaaaaactcaaatatctgcggtagtccggtgcacatagcattttgtggacggacatagtgaatttctcggctgttgagccggtgaatctttgtgctctgttcctttccctaccttgatttgatccaaaacagtcacagccagacaattaattactccgattaaggcgtacggattgtcttaagtctactgacattaagggtgcctttgtcctcggcactgatgaaaggcttcccctggttagcatgatgctgatgtaatcatgctggttactctcttaattaaccaattctctttccattgctctctgtgattaagtgattggtagtaactacgtcctcataagccataatttgattcctctttttttttatcaacctttctggaccatttcatcagctttgcagatgaatcgattccctgggtgactaattatcccttgtgcttctaatgacagccactaaccatcatgattacaattattttttggcaagaccaattgagcaaactggttggctgaaaacatgatggcatcttttgcatgctagctctcaatacaaggagaagaaatcattctccctttctagaggttaggcctaacaataaaaaggttccttttgtgcatggaaattattagtgatgtcaatgcattttttttagataatagtgatgtcaatgcatatgaagactctagtactcaattcacaagtcattgatggtgtatgtgctctggcatgcatcatttggtcgtaatctgttcataatttgaggctacattttgaaaaaaaaaattctggaaggccaacttacaaaaatccctacatttttttaacattgattagggactaatttttttcacgtcgcctcttctttctttatttcttttagtatatatatgccttttcaacacaacccaaacgtattgtcttttgcatgtctctaactctttttcaagagaaattttaacaaatgtctctaactctttttaacacatgtttaagataatatacatggcatgagaaatatggaaaacctacttctttaattagctaatgactgattatctacatgccactgtagtcttgtagattgttccatgtagtgtgttaatgttgcacatactttgtactgtgtcccttctgttgcacaaccttagaggcagggaagcacttgaatactacttgatgctaggtttgttaaggtgcattgaatacagataggttattaattacatgccctgctccctttaattgcttttagtttgctcccattataattgtttttagttccatggagtggtagctagctggagctgcccaagtttgtcaccccttgaaacagggaatttttgtcctgtggagaccaagcaattctaaaagttaatacaaaatattatgagaagttaggccaaagaacaaaaggcttccttttgcattggattgtttttatggtattttgtcaaggtatatatacccttatgttgaccacttgtctatatcaaaacattgtctccacaagcttaaaagaattggagtgagtgttatgtaaactattgggttgacagctcgatagtccattcgtttaaaatatgaggtgttcatgcaacctatcaccttacatattacgtctcgtttggtacacttctatactatacagaaagcatttttttttacatatagctataatagatttttgcaggcggacaacgcaaccacttaccccgtatatgtacaaaataacattttgccatgcaagcaacacgaaaaatgattttcgcaagtggtgagttatgtcgtccgcctacaaaaaggatcgaaaaaaaaagaaaatctaaaagctgaaaccctagctcaaatccaccctagccacagtcgttgtcgagaccccaccgcacccaacgttactggcggcggacatgccactcccaagatcagggtcttttgatccgccaccaggcaagcttgccaccatcattttcatcgtcggattcatgagaagggggaggcctgcgacggtggatccgcgcctcccgctgccatcgctgctggatctgtgagggagggagagtctggcgacggcacaaccgcacctccccatgccgccgccgccgccggacccgtgagggagggggagtctagcgacggcagccacctgcccttgtagcccttgccagattcatgagggggaaagaattcggtgacggcggatccacgcctcctcgtacccccactgccagatgcatgagggaggggaaggtcggcgaccatcgatccgcccctccccctgccgccgtcgccggatccgtgagggaggggcaggccagcgacagtggatccgcgcctccccttgcagctattgccggatttgtgagggagggggaggccgacgatggtgggttcacgcccctccttgctgccttcgccatattagctcgaggccgatggccactgtcacaccctgcagttctcctctcaagcctaaaatttaattt

SEQ ID NO: 33925 - DNA, 5827 bp, Oryza sativa
aattttaaccaattaaaattgagcaagcaatattctaattccagggaaaatccttttcttcctttttctttttttttcccccttttcttttcgagtgggccgccggcccattctccttcctcctctcctcccgctgggccggctgaaggccaaggcccactaggccgcgcgggccggccgcccgcctcctctcacctgggtcgccgacaggtgggtcccacctgtcgggcccgtctcctacctcgcgcccgcgccgccgcgcccgcaacagtcaccgcgcgcacgcctccgcctcctccgggccacgtcggccacacccgcgcatgcgccgcacctcccgcgcccactcccctctctctcccgcccgcgcccgcgcccgagatggccgggattcgattttcgaatcccgcctctctctcctcccccactcccccacgttggccggcgattcccgcctccctcggccacgtccggccccctctctccctatttaagctgcgccgtcgtcccctctctctttttccccatttcgccgaactccctcgtgctccccatcgctcccgcgccgtgcacccacccgccgccacctttcccgccgctccggccaccgctagccgccgctaggctcgccgccgcaccgcgccgtcgccgccgtcgggttcgcaaggacgaactccaccccgtctgcccttcctccgccgggattcgtcgccggaattcgcatcccctcgcgctccggtgagttctacctctaccgccgcctttggccatggatgccggccgccgtggttcatctccctctctctaatctctctctcctccttccttagggcaccccgaagcccgtccgccggttgccgtcgtcctcccgtggcttgccgtcgccgttcgccgtcgtcttcctccgcgccggccaccctcggtgaggcttcctctcccctctattcccctccctctccttcctagccgccgcttagcgccgccgccttcgcgtcgcctttgcgccgtcgcctccgccgccggttgccgtcgccggcaacgcgttcgcgcgcgcgccgtcgccatcgccatggccggtcggccggccttgagccgagccgagccgggtcaccgccgcccgtccgatcaaccccgggggcgatctgggccgtcggtcccgtggaccggcggtggaccacccgcttggccccggtccacggtggactaccccccctttgagccgctgccaagtggggcccgcttgccggcgccccttttccctctctcccgagccgctgaccggtgggcccctcatgtcggcgccgcgccccctttggtgacgtcagccctgggaattattgcgcaataaatgatttaagtactttttgttatagtaataaacacagtgaatcttctaaaattcataactaatttatccgtgctccgtttaagcccattcaagtctcagtaaatcaagaaaaacgtgtaaaatccattaaaaatggttttgttctctgtttcagtagtcttatagcctgtttgcaatgtttgccttgtatgtcgctagattccggttcttccgacgctccggtgtacttcgaaatagtcgccgagtttcctccagcagcagagcaaggcaagtcatgcttgccacttgaacatgttgatcctatattgcaaatgctctattgtttttcttcaaatactgcatcgttttataatgttattatgggatgtttacctattgtcatagccatgctattgttgtaccatgtccctttgtcagcttggggttataacatgactagagattggactagggattgcttagccatgcttagttcaactagtgcacaatggggaaaatcctattaatgtttagactgttgttctaatggtattgttggattagtgccaccgcttgggtgttagttaattaaaataaatcacatggtgggctgtgggtgcatggttttgctagtcgcacccatggcagttaaggaccggttcgcgggatgccctggaagaacttatcgtacttaccacaagccagcgtgggcaacggctgggcttgtagtgtagctttcctctagctgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggtctctttccggtatgtcgtggtggcatgtcggcgcacggaaacatgtcgtggggctgtgtcttgtgggtacagttgtacacctctgatcagagtaaaactattcgaatagccaagcccgcggttatgggcggtcaaccagattcaccgtgattagtctcatcctagtgtaatcttttgaatttggatagtttaggtggatggttgggcctgttgcaacgtgggatagcgttggatagtggatagttaatattaattaattattacaactgtttaaatctttcaacttctgtttataaatgctcgctttatgcaaatgaaccactctagctctcctttgataattccctgcatcatacccctattccggtatgacttgctgagtacagtgggtagtactcagtcttgctctattttttttcccaaccccagagtacgagtatgtgtcagatggaggtttctccgaggagtaggcttcgtccgtaccgtcgaggatgcctgtggagtggtgttcccgctgcagttctagtcaaggcttagctcctgttgtctttcgcttttccgctgcatttatgtaagacttttatgatgtttgtaagacgtgggtctgaatgtcaacattgtcgtttgtgtaccccggtcggtcctggacggggattttaatgcacattctgcttggaattctattcgggaatttctgggcgtgacagccacccccgtcgtcgtccgcctaccacgcctctcctcatcattgtcgtcgtccgccggccaatcgtcgtcgttgctcactggatggcctctcccgttgggtgtgaaagtaagggggaggtgtgagagtgggaggaaaggtgaggagaataaactgagagaaaatgttaatatggagacagagagagaagggaaaattaagatgggtgaaaaaaattgcatacgggacctaggcccgtctgcgaaaattcattttcacacacggatatttattgaacaactctcaattccttttacatgcgggcttcttaggaattatttttagtctgcctgaacaaaggagatgtttttttagtggtataaaggaatatcacgagaattttgaggaaagttaactgaccaatgtgaaattctcatgtgttctaaaggatcccaccaacatatggtcaaagtgagacaatccttttgtatgaatacaacggactttggatgatacgttttgcctcttgggctcctttacagcaagggctaactataacaattaacacatcatgcacaaccacttttacagtttacccgtataataattaccaataaatatataaatatatatgtagaaccacttttacagatcccgtattatagttagcaataaatatatactaacactattagcatcttgttaaaacccatgttgtggcggattatatatatgtagcacacgcttctcttttaactctcatcttctgtttcctacaacttaacaccagtctattatggcaacgaataatatacttacattatcttattatatttcgtttgtatttaatgcatattcttttcttattcctatggagatgatttggttcctataaaataaaattcatgtgttcaaaaagcctttagaagagcggtgaaagataaccattagcttcattccatttgaagttcatcttgcatagggcttgtgatgtgggccccaatgcagccgagtagcatcattcccagttgcgctgcatggacaacttgcagaaggaaaaagtttacttgagatccctcatcttgtcctctagtttcaaattcgtccctgacccaaaatgcatagtcttgtaaaaccggatcacagtgggtcccaagacagtattaagaacagttttggctgatgtggcggctgagtcagcgtgagacccacgtaccagtggcccaatcttcttccacatctatctcccttctcttcccatctctctcctggcctccatgtggccggtgatgggcaatagtcgaacatgaaaggcgcaacgacaacttctcgcgcccgagtcctaagagcatgtcggtctggccgaatggtccggagttctggtcatcgcactcgaagatgaagccaggaacttgcttgatgccgatgtcattgtcggtgttaaacaccacagcgtattgcttcgttggtttctcgttcctgacggacaccttggaggcgcgagcgcccctccgctagggctgtcgacgagccgagctcgagcgagctcgtctgtctaggctcgagctcgatacaaactcgagctgagcctataaaatgttcgagctttctgacaggctcggctcgagctcgaccaagctcgagcttaactaccgagcttgatttttaagtaaaacaatatatatttcaaagataatctttaaaaaataattaatttctagttcatcatattagtagaagaggaaaaaaaaaataaatatataatgtcaatataaggcatacaaataacttattagatcttctaatttataaataacaacaaaaattatgtattactatgctcgttggaagctcgagctcggctcgacaaagctcgcgagcttagggaaaggatcaggctcggctcatctggagctcgagcctaggacgagccaagctcgagcagcttgcgagcctcgagcttttttgacagccctaccctccgccgactattaggcttcctccctgccaccgatgaacctaggcggcatcgaccactaggtgatgaccaacgtggaggggtcaaaggcagatgaagatggtgatgaggttggcgaggaaggccatgcagggtccttatgtagcattgttgccgatgtcaaggagccagaagctgatgaggtagacaatgatggcatcgaggcgggtagagcacagggtgatggagtcgccgaagattcgaacgaggtcagtggagaatctgacgatgagaacaatggcggcgataatgaaggggtgctgacgaccgaggctggcgaatgtgtacgggatgccaaggtcctagacatagggggtcggtagggagagttgcagcgccactcaaactgcacgccgcatgccaccgacaccgcacgtagaagcttccatatggagggcactagagatgggaagagaggagggggggaggtataataagaagattgggccactgacatgtaggtcccacgctgacttaaccgcacgttagccaaaactgttctcagtactaccttgggatctaatgtgactcggttttacaagattaggtatgcaagcattccggtccagggacggttttgaaactcgatgacaggatgagtgacctcaagtgaaccttttccacttgcagaacactagacatcacagcccaagtcttacccaccacaagcccaacacaccacactttaggctccttaggcccataaccatctacctatgagcccaaaaactacggcccaattaggcccacggcttggcccaacttctcagcgaaaaccctaaccccgtcgtctccacggccaccttatataaaaatccgccgccgccgccatcctccctcctcccctccgctctcccacccttcacgccgccg

SEQ ID NO: 33926 - DNA, 5705 bp, Oryza sativa
acgcgcgccgggcagcgcacgcggttcaaggcgttcgtcgtcgtcggcaacggcgacggccacgtcgggctcggcgtcaagtgcgccaaggaggtcgcaacggcgatccgcggcgccatcatcctcgccaagctctccgtcgtgcccgtgaggagggggtactgggggaacaagatcgggaagccgcacaccgtgccgtgcaaggtcaccggcaagtgcggctccgtcaccgtgcgcatggtgccggcgcccagggggtccgggatcgtggcggcgcacgtgcccaagaaggtgctccagttcgccggcatcgaggacgtcttcacctcgtcgcgcggctccaccaagaccctcggcaacttcgtcaaggtatcttgaattcctccctagaaatgctcgcttatcttagaattctttctctgtaaatgaaaaatgtttgctgatagtgctagatttgaatgtaacagaaatggcttgactgattgtgatggaggacatctgtgtagaatgacttgactgattgtgattgaggacatgtgtagctagatagtctcatttccaccattttgttatgcctgtattatcgtagtagtattttgacatgtccgaccttatcacacaattcagttgtgcttagtattgttgtttgacatccgtgctgttgtgcttagtgttgctatgcatttcgattgtaataatattgactacattgtcctgtttaagtactagtatacatcctttgttaagttctgttgactaggattttaggaatctagggttttgtcatagcatcgcttccctttcggatgttctgtattgttctgtatcagtagagaaatatggtttatcattgcatagtgtgcaaacagtaaactgctttgtttactgaggatcatttggatgattgttagtagtcatgaattgttctgcggctttaaatgttgtcgctgtttctattcatgtgtacatgctgtagcttgctgaaaatagctatcatacttgcagcaatcaaacatgatatgtttccatttacatttcaagcatttcaattggtgaacccatgagactcttagatagcattctaatttcatgtacaccattacatttcaaatgtttcggtttacatgtcaagaatagtgcctcaattgatataacctgaactttttgttcttgacaggccaccttcgattgtctcatgaagacctatgggttcctgactcctgacttctggagagagaccaggtttatcaagacgccgttccaggagtacacggacctcttggctaggccaaaggggctcgtgatcgaggcacctgctgagaagatagaagcttagaaattttgcagcaaagagctgagaaagaattttgcattatggcagcaagaactgctgtcttatcctcaacctcaacttatgtcttaaaaaatccaaattttgaattagcgaaccttaatttatgtgctctggaatgtttaggtttctcttcaccgtgtttacaattctcatatccatatgaacgcgtacagcattggtgcattttgcgagttttactctctgttatgctgaattgtgttaccaatcctcattgaaggccgttagaacaaattattattctggttgtatatcattacaatctgaaaatgttgagcagcctatacgggaatatttataaagtattaatctgcatcgttgtaacttgtattataatatgtggtaaatgtgctgactaacaagaacacaatgttattttttgctttcccaaaacttggtgttggtttatatatcaaacagtatgacaataaggtccctcgctgcagtaagatgaaatttcgccccccccctcccgggcaaatgattatctcagccgttttttttggggttttctcaattttttatgattttgataaaaaaattaatcaaatttagttaattttttttaaaaatccaaaaatgtattgaaatggccgagatcgaaattgaaaacctgctggctactgccaatgggatgaacacatcatctttgctatacaattatctccctctttcagggaaccattaactttctctgccatggttttgttactgatactgcattaataatatagcacaatatcattccatcttttatattgtactaacacattgaaactgcacaggctatattcaccagggataacatgctgtatacgcttgctttcgctgctttgtgcgccatcttcagtatcctaaaggagattcttcagtatcctaaaggagattgttgagcaatggaatgctatggtattcattttcagcgttctttcaggagtttagctcatgggctcaggaattatggataacacatcaacaatcacaaggaacaacagtttctcctctgttcctgctaggttatctgcgaggatagggtacggtctctttgagatactctctccgttttatataatataagtcgtttgactttttttcctagccaaaccttattaagtttgactaagtttctagaaaaattagtaatatctataatattaaaaaaaagataatggaataacattttggcctttgctcaatgagctacagccaattattacaaagtccacacataaataaattcagcacacactaatatgatataaataaaacaaaaactaaagacaccaacacaagataaaagagccctgaattattgaattatattcgagaatctccatccaaagttggcaaaacggtgcataatcatccactcaagtttacggcatgcattatttagagagaaagggaagaggagatgggggaagaagaagtggctactgacgtgtggctctaatttttatttttagttttatttgctgactagacttccacatcattgacacgtagatgaaaaccagctgaaaaaccacttaagggtgtaaagtgaacggtattgaaagttggagggggtgaaatatctggttttagagttttgggtgtattttagacaagacaaagagttggagggtgtaaaatggacttatcccttatttattagcttgatatcatcatcaagcctttgtagttgagcccaaccccgaagcaaatattttaccctgaaaagtacttacaaataaaattttgattgtgttttatcaaaaaccatatcatttctactaagccaaagagcctaacataccgtggaagctcttccaagaataagtttcttaacttttttattaacatgcaccagccaattcccaaacatatgagaaacactatgtggtgggtatagtccaaatgagaattgaattgatctccaaagaaatctagaaaaaatgacaatccaggaaaagatggtaaattgtttcatttttcataaaaaacaacatctcaaactaccattgcaattcttcttagggcatctctagtcctaagttcggcgagaaccatccatgtaagcgaagtttattttggttcgggtgctacaacgcagcatcgatttaccaggtccccctagaatcagccataacctttcctccctcacacaaacaacctttcctccctcacacaaacaaatgaagaaatatttttctaaacggctaaatcgactgcttggctgaggttgatttcctctctgacaaataacagctgcatctcacagtgtgttaggttcgatgtttttccctcacgcgttgattcaacccaacgctacagatgctcttagccaaattatcttttgttagcacaattcctttaaagagataccacataaaaatattaacctaaggggcatcttaagcttccaaatgatcttattccactctctatatccattattaattaaggctaaatacattgatctaacagaaaaatgaccattttgatgaaacttccatctaaatatatcatcatcctctgttaaattaatatgcacaattgaagcacacaaattgtgacagttgaccaaattatgaccaactaaagctctctagaaggaaacattaagcggaacaaaacccataacacttgcaattgaagaacttttccttctaactatagaagacaacgacgactatttgtcatttaaagaaaaatttcctaaccacttatcctcttagaatctgatttgctcaccattattaattatccaagaacccatacttattaaggaactcttaaccttcatcaggccagacaataatgggaatccccttgtttttctttcgacctgggttattgatttactcctaagatatttccacttcaataagtcttaccacacacattgttcatttatttatttaaacaaccatttgctcaataaacaccggttttggatttctaaattatgaacaccaactccaccctaatattttggctgacatataatgtcctatcttgttagtctaaatttccttttgtgtttatcaccttgccaaaagaagcgggatctataaaatcatttttttgaagaacccctttaggaatctcaaaaaaagatatcataaacagaactaaacttgataacacataattaatcaaaaccaaactccctccaacagacatatgtttacctttccaactaatgagttttttttcttaattctttgctcaattgttaaccaatcattattactaagctttctataatacatagggataccaagatatctaacaggaaactattatattttagatcaaaaaatatttgaatattgctcataacattgttttgcttgaccaaagcaaaataattcactcttgtgaaaatttatctttaggccagataattttttcaaaagcagttaataacaacttcatatgcttcactttctctaaatcatggtcaagaaaaatagtagtatcatcagcatattgtaaaatagataaaccatcgtccaccaaatgtgggacaactcctgaaatctaaccatcagcttttgctctcttaattaatatagctagcatatcaacaactatattaaaaagaattggagataacaggtccccttgccttaaaaccttataagtttgaaaatttgcccccacttgaatgaaagaagcaatccaattacaccatttttgcaaaaaaaaaccctttattctcaaagttttttttaacaaaagaccacttcactttatcatagggttcctcaaaatcaatcttaaaaattacaccattcatttttattttcgatttaattcatgaattgtttcatggaggataacaaccccttccataatgtttctcccaggtataaatgttgtttgtgtaggactaataactttctgagctactccagaaattctatttgtagcaactttagtaaaaattttaaaactgaccttaagtaagcaaatatgcctatatttttgaatcttaatagcctccttgcacttaggcaataaaataatagtaccaaagttgagcgaataaagatttagacttctgctatgaaaatccttaaataaatctaccaaatcagatttgataacattccaaaacacttgataaaactcataagaaaatccatctagactcggagcttattatgttccatttgaaaaattgcatctttaatttcattttccataaattcatctactaaagcattattttctaattgagacacttgggggatatcacttatctggctttcatccaaagttaaagagaagcttctagagaaataaaaaggactttataataagtggtaatatgcacctttaa

SEQ ID NO: 33927 - DNA, 2137 bp, Oryza sativa
atagtattaaaaagaaaaggccatatattatcaaaattatcattatttttttccgtaggtctatgtaatagataaaagtcaccaccaataataattggtaaggtttcatgactagacatatgaactaattcgtttcattaaatctaacattttatatttcgacaatatatctgttttgtgttaaaaatactaatatgttgtcaagtttaaaggagtttaacttggaaaaaagtcaaacgacttataatattaaatagatggagtatcatcaatctcctggttgctggaaagtatggatatgtcacgggaataggggccgtggctgttctctgatctgtatgtggaacaggtggaatgtttctattttgcccatctgaagctgttacagtattacaaagtcaatatacaaatcagaacaaaaatgtatggagactaagagaaagtgtatataattttatgtttacctcaaatacatattgtcatatgctactgtttatgtgagtatggagaacaagagaaagtgtatataattttttgcttacctcaaatacatgttgttctactatttctgtgacgctgtgaacatcttgttgctaacgcttggtagagtgttttcatttttagtgctggatgtgtgtggattgtagttaagtgaatgcttgcttttaactaatctgaatgtcaactgagaaaattttgataattttttattatgatcttttttggcaagagatgactattggtttgctgtgttcgctgatggtattgtttttgtcagggttaaaagataatgcataccctctatcctatgagtcttgagatatatgaatcaatatgtcttatcttatgatatacggaaaggattcgtgtgagttaaggaaatcagtcaattcgtatgggaaatatccttcacaagtagggccatatcaatatcctactatcctactcagagggagagaagactataatgtatcgtgcggggtccgatgtctccgagttctacctggaaatcaaggtgatctaggtataaatacataccccctaaggggtatagggcattgaatcctgagcgcaagacacccgcaaccacataagtaatccggaggacttgaagtctattcgccaatagatcttgtcgagtccctctcgacaaggatctcgtcagtaatctcggagtttagttattctcttttgtactctgtggtttcctctataatcccatataaactggattagagctattaccttacgaggggcttgaactagttaatccttgtctttttgtgtgcttgatgtcgtatcgcgtagatcctcataccaacgtacccaaatatccttagaatatagtctacgggtctcccccgtcgacagttttcaggtaactccatgctcaatggtcactctatgctctggtacaaatataatattattgcctatatatacatattgataacatagtactcaccctattgaatgtgaactagcaaaaccaagcgttgactacgaccaagttgtatcttttgcgatactcttgattcgcatcatcaaatgcgctgtatgtcatcacaaaaataactagccattggataacccacaccactagaaagaacaatgtctggatcaaggagaggtcgtcgtggattaccaggcaaacataggtgatcaccatggcaacagtaaatatgctaaacaagacctgcaaaaaaaccaatcgtttagcatgagcatgtggtgttagttacccccttcgtcccaaaatataagaacctaggatcagataagagatttactagtactacgaatctggacaggctgtctgacgactcctagacaccaccttgagaaaagaggctagactaacaccgagccgactgttgctatgcgggatcgatcacattgattgtctttcttagacacggtaaaaggaaaaggagagtggaattagttcgtatgtactcacatcttttagggttctacaagggcgagtagtcgtgaagccttgatgatctgcatctaatttgctagtagtagggtcatccagatcatacggggtctcctcaaccgtcacggtcattccaagaggcatcggagcgtcggcggccattgcgatcagatcttgcatttcaagtattgtcag

SEQ ID NO: 33928 - DNA, 16624 bp, Oryza sativa
  unsure (1)..(16624): unsure at all n locations
agcatgagttctcatagtccaaaattgggtggcatatgttagcgccaaaatttggtaagccccgaggtcatcatttgcttagaaaccatatcagcttcagagtcctggaattgaccgatgggaattgtcactcactagcagtcggattcttggttttggttaaggaaattaatcaattaaaggaagtttatttagaagagattgagtttaaggaggatacgacataacaatttatctattaattaagcagagttagttagttcccttttgtttttggaaagtgtgtttagtatccgatcaggacttgtgcttttccttttatctttagaaaagtttgagttgtgtccaataagggcttgtatttacccatgcgtataaatatatacacccggagtcattgtaatctatctctcgatcaatacaactttggcacatcgataccctttttattttcgtctttctcaacaagttcctgttttgagttaggctacatcggcttcgatctctgatgaggggtaaggcttattgtggctgtttgtatcggtgaggctagggcttcgacaccctaatcttgtcgatgtaaacatatatttatcatatatcttagttaatctaagtcgatgtctcaatttacctatatcggctagatcttttctagggttttttttatcagttaaattgtttcttacatctagattacctaatgtatgcaccaccctggaaatcaaggaaaggcttgattggttaaactttatgcttctttttcatactagcaaaatgcccatgcgttgcactgggtgaagacaaaaataaatagtaatgggtgtgtgggagcataatgccactaggttaattgagatccttatagttaaattgaatcttttcggtgcaagtaagacgctaacatgacataattatttgttgttctaaatccatttacatggattataagaaagctattaataccactttaaaatgaaattatgtattatacatactaaagtttgaaacccaaaaagtatttatttttttcatgtattattatgagtcggttgcaatgcatggttatatttttatacttgatattgataaaacacttttttttacatactgcaaagagtagcaatagtaaaagaaatgtttctcgctagctatcagatcaacctcactgcactctaattgcataattgctttcactcaaaaaatcaaaagaaatcgtgatgaatggaaagaaaaaaaaggtggtgtatcacataatagctctcactctaaaaaaacagaacaaaaacataccatgaatggaaaaaaaattgatgaggacgagggaaaaaatctggatgtaaatacgattcattttgttggtgactatatatttttttaaaaaagaaagacgcgtgattgttttctattttctaaaattaatttattttgtcggtaaataattcattttgttggtggttacattttttttaaaaaagaaagacatgtgattgtttttttacttttccaaaataatgaaattgttcccttttttatctaattcctggtagacatgggcccaaaatttatttagtgttaatagtcttaggcaagaatcctatttaggtggtattactcgtgctacagtgctcagttgctatagtatcacgcagaactgtgctgtgttgggctgctgcttctctgctacgtgggctgaactgtgctgtgctgggctgctgcttctctgctatgtgggctggttgctgggttgcgtttgctttttgttgggccagcctgctgccgtcttggctgggctgctcgctaggtttctcttttttttttcgtttctcttttatttgagaagcgtcagataggggtgggtggaaaaagaccgaacaacaaaactgagaccgagaaatttagtcatcaattcggtcctaggtagtgaaataccgaattttattcggtcaattcggttagtctcctcgggtaaccgaatagaccaaaaagatcgacttaccaaaaaatatctaaatgcaacctacaatccactatgtttaatagaattaaactctaattttcacatccctacttcttctaggcatgcaacctaataagagtctttacttataagtgcttacaaattttttttttgtgatttttatgttgaaaatttccattatttctttgcatatatgaaaatattgttgaatttcggtcaggaccgagaccgagaccaaaaagaccgagaccgaatttgtcagtcctgacatttttgcactgaaattcggtcttcacttttcaaagaccgaaaagaccgaaagaccgaagaccgagaccgaaattttcggttagaccgaatggccgcccctagcgtctgagatcgccgtaatgcatccagattcatggattagcggcgaaataatcacgtgggcccaccctttaatgatggacgaaaaaaatcaactggaagccttacttattttttaattaggtataggtatagatttagtgccgcatcaattggatttgattgccgataaaggtttcatcggggtttcagctgatgagttatctggacgttgcatcggctaacaaggattacatacaaattggttttagccgattgcattaaaggtttcactaattatctaatcttgtggatttaatgacatcggatcacaaaccgatgtatgcttaacctttggaacaagcaattattctatacgtattgatcaattggtttctacttaattatattattgttttattacattatcatcagccgattgttttatatcattatttactcaagtgtagaaatctacattgaacatatagccgattgctcaaaaccctattgacattggtcagtattggcatcggctagtataattatatcggtatgtcagttgcaggatcaaactgactgtcacacccgcatctcatcaatattttggacctgcactggagctaagcagatcttctatgccgttgtgttcatcgccttacataggtagtataatttgaacccgaagtaaagtaaggactcgatctaatcaatcctgaaggatgaatcataatattttttgaagctctatttctaatcataatgatatgaatcgaagaataaacaattcacaactattcgtaattacaactattttactcatgtgcacctctacatcacttttttttaagataataatagacctgtacataatgtggttctcctttcattctatacatacacctgtacataatctattcgagttcagatcatcctcctgttttattaactaggaaggtagcccgcgcattcgcgcgagcatgtaccgtatgtaggatgaatttgagaaacttatagggacagtataccagcgaaataatatctgcaatgtttcaaaattgtgattgtttttcatgagtctcttcattagcattacaaaatgaatttaattgttatttataaaattacctattgaagattggggttggtaacttatggtacctaagacatgactcttgaagtttcatatggaaagagaaaaaacttaggcctgtttggatcatttagtcctcagattaaaaagtttgtcccatactgtttggatcagggactaaaaaagactaaaggcatgtggactgagggagaaagaagaaagaggctgtcactttagcccctatataatccaatatgcacttttagtcaccttgtttggattcttaggaactaaaatggagggactaatgcattagccccattaaccaaatatggcctaagttataaaagacattacatatactaccatatataattaatggttctactgatttatatagaaaaaatatataataactttattatttgatggcagacatcgattggtcatagctatggataattcctcatagaaaattatgaatatgtgtacagtatagggatacaaattagaaaaaaaatagtagaagttatgagaaaaaaaacaaaatatatgactctcaatttttacttaattcggtagtccatcatttctaaccattggatatttagatgacctaacatattgtgtacagtccaactaactaaattattcgtcttacctcagttatggatgttggacatgatttacatatataaaattttaagtataataaaaaatacacactactctgccaatgtagcgaacgatgtgtgcgacaggttcgccacggctggcttcaacacgaacatgatcacgtacctgatgcagcagctgcacctgccgctggtgcacggtagattccttcgccggccgtctctggaccatcgccgccgctggcgttttttcccagctcggcatgctcggcctcgtcgggtccgcgctcgtccctgccctctgccccgcgccgtgctgcgctgccgccaccgcctcgtgacgacaatctatttagagtatgtatgtatacgtacgtacgcacgtatgagagggtgggcctatgggagaagaggtgggttgtgggatttttttctaaagataaatataatagttgaaaatagtaggtctagcgatttattattattatagaaatattgggtccaccggtttattagaacgccatgtggcggcttagaagcgtttgtaggagtctcacgtggcggcttgagagcgtttgtaggaagtttaatggacttttagtatataatagatagatagatagattactgaaagcacagggctatccctgatttcttccattttgcgtttccgcaagtgctcttggcatcactaccacctcccttgatagtgagcttgacgtccttcaaggttattccttgacaaggtacatttctgctacagtccagtttgatagcctccttggaagcacttgtgcccctgatgttcttgaagaccacattgctaacttgcaccgcagatgtctgatacaaaaccactaaattataagcatgcacattatttacacacatggataactgaataacagaaaagctatcactgagatttgtacctgttccttgcagggtgtagcagaatcacagtagttctggtcgataatgattgggttccaaacattttccatgatcatgttctggaacacgatgttcttcgcgtagccccaaccgccctgccatgtcttgatgcgagctccgttggttgtgccatatagcctgacggtgtcgacggtgacattgttgacatgagcttcagagttgtgatcgcctaagctcccgatgctgatgccgtgtcccggtccacacaccatgttcttgacatgtaagttctcagttccatcctcaatcgacatgcagtcatccccggtcttgattatgcagcctgtcacttgtacatttttacttcttgtgatatggatgcggtcggtgtttggactagtgcctggtgctgtgattgtcaggctagagatcctaacatcagtgcaatcctcaactgacatgtggatctgttggctgtttagtagcatcaagttcgccactttcatatttgaacaggagtagaatgtcaaggcctgtcacatgaaaaagaagtatggctttgtttgagcagaatagccaatgttttatgaactgcaatgtgctagaagtttagtatttgggaagaaatctcacctttggagtctcagcgcatggcagaaagtaatcattataataatatccacgtgagggattgttccccaataaaattcaggcagagtgtaataataaatgcctctataacttcagagcacttacaagttttgcattcgttttgcaggaattttgccaccaaatcttgccgttttcatcgacagtcccaccaccagcgacagtaaggccactcacaccattgaacataatccagtgcctaatagtttccttgctccaatctgacctctttggaggagccaccaacgtaccctctatctgaaaatgttcaggaacttaacatttttgagtaattgaatttcatatgaaagtaaatgcaagtgcacgagtgcatatttcttaccatgaacgtgatgcttgatttgcatggaccagatagtgtaatgtgcttggtgaggtatctcttgccctttgggatgagaacaatggaaggttgcgaagaggagcaagctgcagcccatgcctttgccaatgcctgcaacaacggtattagttaagttttgctatttgtcagtcgcctgaaaataaaacaaagacattatacggtgtcacattttaccttcgtgtcatcatgttgtccatctccgtaagcgccatgtttgcgcacatcgaacaccaccttctttgactcaagagacctgcctctgagactatcatctccactagttaaatggaatgatgcattcatgttgaccttggcatgaacactacacaagaagaacgacatgacgacgacatatgcagagaaaatgagcacattgcaagccatctttccaactgttaacatatgtcaacacagtttcggacgatgaacagtgcagaaattctagtgttgttgtgagttctggactttgtagaatgtgttgatggatgtggcgattgatggagaccaaggattcgatcagggggtctatttattcgcgccgaaaccggttggaaatctttggatgttctcaactcaaggttgcttgttgttgatcagctagataggttgggttcagatatttggatcctagtatcacaagattctgtcggcatgggaactgagataaatgtgcctgagtccctgactctttgttgcttcactacctagtctacttgtatggctaaattacttccagagaaactaatcctgctattgaaagaagttcagcactaaaagaaaaatcaaggagacctggatcacagttgagtacagacaatcatctaaaatcctatgcatttcatcagtgctgcactcttgagacccactctgaattaactttgacagatttacgagccacaggtctccttgtgtcattaaagtgtatgtattattgtaagcttaatcaattctaatgacaactcatcagtcatcaacgagaaagaaggcatgtgtgtgtgaattccaatgtggtattctctacagatgcagcctatgatgcacggatacgcgatactggtacggcgatacagatacgttgatacggcgatacgggattttaaaaaaaaacatcaatacgtcgatacggcgagtatatataaaaatatttttaaaaataaaatataggaaactacaaaagggtaaagcaataagattatcttaaaaaatattttatgtattgttgcctgttacaaaaaatatagtaaatatagccttgtattacaaatagagcaagtatattaaagttataaatatatcagaagtatagcattgggtctttaatgggctattacactgctaggtatcggagaagtatctgataagtatcgtgtgagtatcggtatttattttttctttttttttcgttgtttaatgaccgatactcctctgatactgtatcgacatagtatcggacgtatcgccgtatcggatacgtatcagataccggtacggcaagaaagtgaagtatcggtgcaacattcgcagcattataatgtttcacataggtttctgaatcttgtgaagttaaaaattcaggtgtaaagctagctcttagctgagaaaggaaaagtacgggctccaaggaagcctatgaagaggaaaccaatgcagatttcaggtgatttctcatagatatctcaatgaaagtatggacaattcatggagtaagcagatgaacaacctctgctgtttgtggcttacaagcatggtgaagaggtgcagaaaattctagagagcagcctctgttgtgggcttgtggcttccaagcacatatttcagtgctttaaaaaattaacaggtgctacatgattttatcagtcaaaacatttgtggttttgaaagtatgcaatgttgcttagcccagtttgtactgtcaattaatacgcaaatttgcctgacaactctgaaaatatccaaaaaaaaaaggaagaatgagggatgattctgaaactgttttggtctcaaaattgtatgcttattatgccaaccaatttcagaaagtaaagtcttgaaccagctgtaagcaatttatttttttttgcgcaccaccttttttttttcttttggcactcaacagccgagacgagctaatgtcaaacattttctgtaagattcttcatctgtttttttttaattttctaaaatatcgttgagaaaaagagagcataaaaccgtggctgaacttgaagtatttgctaaactctgaaaatagagggttcctatttacctagcatggtgtttgtgcatatgggtatttcacgtaatcgcaaacaaaatttgcaactaacttggacaatatgatatatttttcagatattaataaatttaatgctaataaaaataatcaaagcttgaatttgaatatgaatagttcccgataaaattatttgaaaagttacctcgatcaactgagctacaattggtatacccatgccacacgaatgaagaaaaaacaatttataggaaatagttttatatatgcattattagctgttcaacagccaagactaaaaacaaattaaaataacaaatcataaaattaattaattgagttctgcattcatattttcggaagggacattcagatccccttggttgccctaataagcaaaagccaaaactaaaatttgaattttcaaactaaattttgaggttgattttaaaattttttcaacatgattctttttcagtattaacttttaaatcactaagacatatataaaattttacttataaactaatactcctatttattttctaatataccattttaacttattagtagagaatatggacaacccagagggcctcaaattttgactcgctggtaagacggcaaagcacagtagcacacaatgcgaagaccaacggaacgaatccaacctccaacgtccctgagcaccccagccgtcggatgcgtcagatccggccgtccatttggctcccctcgtaaaacgcgctcccacccggcaacccaacgacatccgggcccacccaccagtctcctctccgtttgggaacacgggattcccagtcccggccccaccccccctactcccattcccattcccgtcggatcccattcccacgggggagattactcctcgggcttgggattccgcctcctctctctctctctctctctctctcctcctcgcgacttgtcggcggcgacggcgacggcgacctcggcggcgcacggcctcgctccctccaccgccgcctccttccttcgccgccgcaccgcgcgtccccgctccatctccggtatgcggtgccctcccccctacctgcgctccttctcctgattcctcctaattcctcctctcccctccctcacactgctctctctcactcggctagggttttctcttctagatctccgcgggcggagctcccgggcgcggaggaggctgcgccgcgcgcgcggggaaggcgcacgaggtagggggtttctccttcctccatcttctcactgtggagtgtggattttctggcttgcttgcttgggcgcgcgtgcgtgcgtgcgtgccactggttgcttcgttgggggggggggggtttgcttgccgtgtcctcctggatgattgggcgcggtctttctgactgatttctccttcgcgtggatccgtgatttgttctgtgtcgcatggggggagtgaatcccaaagtcgagcgccactgcttgaagtttttgaaatgcaaacaggaagagcgaaggggttttcgaaatcatgttcctggtaaaaaattgggggggtttttgaagtcatgttcccggtaaaaatttgggggttttggttctgtgggtaaatcgaaaaaaacaggataagagtgctagtactaaatctgaagtgtgcgtatgagctccatacacataactattgtgtccaaataagctccgtgccttcaccatatgatgcaacatattatgaagctttgttgcgttcatttaatctgtgtttttggggatctatttgaggtacattgatgtactaaactcttctgtaatttggtgatatcaaggttttgtcttcacatgactagatatggctcggcatctgattatgtgctttcttatgcaattgttgtcaactgttatcatctgaaatttgaaatttccaatgttagggcagtctagagttaagtttgaactgcattctttgcattccctgtgaacttattcctcacattcacttattttagctttgcagtgctattttcattctgaaggaaattgcacggttaatctgaatagattggtcagtggttgtctgcattctacatatgatccagatggtttggagatattcagtgtaatcaacaatgcagacacggaaaaagggtgctacgaaaaatgcacttggggatcctgccagtactaaaactagtaggcaacccagaagagcagctcaggcggcagcttctgaaaagaaagtgaatgatcttattacttcttctgccaagaagaagaagtctggtaaagttctatttttcaagtgtacatgatgtgtatgttaatgcaaaatcaatttcttctaaaccaaattattggtacaggcatgcttaatggttgtttgactttcatttattcaaataaactgacaaaacttactcatatgatgtataggataatttatagatgcttttctttaactactaagatgtattttcatggttcgaaacttgcaataacatattgtgaaatgatacatgcttctagaataaacaaatacattttgtccttgtttaagttgttgactattaatctattcctacacgtaaattgtttgtttaatttactatattggtgtagtgcccatgtgctggaacagttttgaaataaatttatgtcattttctaatcttgaaattccaaaacaaatatttaaatataaacgaaacaaaatctaccagccagctattgacatatatacatgtaaacatgatatatttttctgtaaaaaatatcctgcaaataatgcacacatgtctacatggatccatccacagaagataagcataaagcacaagatcactgtcaccaactctttcttttaaggagtagattttcaatttgagcttaattcttccacctcttatcgcgaaaagaaccaaacaacattctttatgtgcataaccgtttcttatttactatttaatgctgtatatctggtgaagttatgatactgattaggatgtagcaatggctgtatttggttctttgcattttaaaacatttgcttgccatgcagttggagccccttcaaagaaaaaccgagcttctaaaggtggaaggaagttgatatccgcatgtgatgcagctaattctgaaaatgaagtttctcaggtggtctctggtataccacacgatcagaaggtaaaatattttgactgaagtgaacttttttggctacttttctttttgaccactgtagagtaaatttcgtccaaaaagaatagagaaagggggaacagtacattaactacttaatgcctgttccggcacatgattattacacttttattattgagctaccaaattaacatctgaaaaatattgtactcttttggtttggttgttttagatcatctataatgtttagcctttttgtaacacctgataatcgtgcattggcatgtacggtgttgcttcactacaaagttttcacaacaaaatttggaacttatttttcctttattatttatattggtataattgctatgcgtacgtaactacttatgcatttatttttactacttgggcagcagtcagatgacaatgttgatgggaggccatgcaattccatattttcccctgcatatcaccttcagaaagaatgtggtgcgagtaacttcgccaaaggtatatataattgccatattttgaattcatcttttgatgccgtcattgttaagttttggactaggacgctttaaacatctgtgaaccataacatcgtataagtttcagggtataaagatttttctaactgctatcaacattcagcaatacatccttgcaaaaaaaaaaaacccaacaaaatgatcctgccctgatacatgctgcagtcaaattcttgaacgaaaaacttttactagttttgtgagtggaaaatatatcataacttttacactattgtgttgtcttgtttgcctgagaatgaaatggaatattcactcctgcattgtcttaggtgatgtccatgagaaattatgacttttaggggttattatataaatattatgagctccagcattagcactaggaattctgtactctgacagatttcaatgcaagttttgaatttaatttgctcacaggtggatatttcaatttaacgagatggtttatctgtcaacaaagggttcctttctgattatcaaaattagtttgttgtcatctattgttggaacctgtgccctagtaatagtacatgtctcatcgtgcatgctgtttctatgtgacttcattgtggctgtggtgctcattttgctctccataccatgttgctccagtagttgattcttgaagcgttaatcatgcaggcttagaacataaaggtgatacattgggttcggttagctcagtagaagaaaggacaacacatgctcaaggtagaaaagaagttaccaccagcagatctgaatccactagccatgcagttaagacttgtgttgggagcgatcaccatacactaaatgcacaatcagctttctgtaacacaccgcttgaagaggatgaattcagtgaactcggaaacctttcttcagaagtgtcagcaatatatcttgccatgcagcagtccaagttggagtgcattgatgaacatagtcaagattcaatctcaacagaaggttatgttgatcctgaggacactgaggaatatgatgattttgatccatatgcttttatcaaggatttgcctgatttatcactagtggtccccaagtttcgccctgtcctactccccaagcaaactcggagttgtcctacaactaccctggtacttgatctggatggtaatatatacttcctgtctgagcacttgtgttcactactacactaaggagccttctgttccatttctgtgattaactccaactactttcaagcaggagtctatttatgtaataatagttattagtgaatggatgaagttagctacatctgtttactgttattttaacttcatcattgtctcctgcatctatgaattggtgttaatggtacaaatttgaattcaaataactctagtactctacctaaaggctggaaactggtaaacaggagccactgatggactttcaaatgcatcatgattttattattaccaatttaccataccttcattggcatgaaatattaatagtcaacatacatttgatgttggtgtttgatttttgcctgctgcgtggcagtaatccttggacatagcagttggtaccgcccccacaaacaaaccttgatttagctttatcctagttttatcctattcttttttgttcatttttgtttgatctatgtgtgctcttttataaccagctagacatattttcgaaattgtcttttcctttctcctttgatgttcattttgtgtcactccaaacaatgcagaaacacttgtgcattcaactcttgaaccatgcgaggatgctgacttcgcatttccagtttattttaacttcagagaacacacaatatatgtccgatgccgtccctatctcaaagagttcttggagagggttgccaatttgtttgagacaatcattttcactgcaagtcaaagcatttatgcagaacagcttctcaatgttcttgatcctaaaagaaagttgttccgtcatcgtgtttaccgtgattcctgtgtttatgtggagggaaactacttaaaggatctaacagttcttggacgtgacttaactcgtataatgattgttgacaactctccacaggtatgcacttagctatctcaatttttgtgcgacaacatctgttcaatacttcaatctatgctaactttatcctggttttagtggtttgtattcacattgaaatgcctatttgtttcttggtggatataaattgtgttatagtggtggacgactacaaagataggtgtgcatcagttaccaggggttgtgaacttgtgattgaagctgtcaactttgctaggtgtctccagtaacttgctaattgttgtgacatatagtttccttactactttcagggtctcttaaagattatccgaaagttcactacctccagcaaaaaaaaaaatgttcttgtttacttttcaacctcaagagttaaccttggctacaatttaatatcatatattttgctcacggcattttcataatgaaactaacattttttagacaataaattggtcgaaattggtactatatttttgcaactagagttagttttgtagtaatataaattacaaagcaaaatcttgctattggctttcactggtagttcaaactctaattaagtaattatatttagcagtagcaggtaccttttagttctgaaattatgcattttattcagttccatatttgtagatccccatcaactattattgttatggttatggggacatgaataatgtactgatgtcctgcttacaggcttttggattccagttagacaatggcattcctattgaaagctggtttgatgatcccaatgatcaggagctgttgaaactgctcccattcttggaaagcctggttggcgttgaggatgttcgaccatatatagccaggaagttcaacctccgtgagaaggtagcaaccgcatcgtctctttcaatggacctgcaaatgtgatccacttttgctttggaatatgtctctgtgtaggtggtaatttcgataaatgcagaagggctggtatggtgattctgtagagtttaggctgtagtgtatcaggatcccccctgtactgcaaatcttgtatgtctttagaaccgccatgtacaatgttctccagatgtaagttcgtactggaagaatttggggatcccatgtatggctaatcaaggttactaggttcatggtggtgaactttccagcaatgcagataaaattgttcaaaaaatgtgttctattgtgattgtaaatgccagggactgcatgctcctaacatctggacgattggtcaggtagctgaaatagtccgttttttactttgacctatccttagtttaatttatgatttcctgtcatggttgttttgccaacttatgtatcttctgccctaacaaaattgaaaaacgggtgcgaaatctgatactactttcatgcctgtctccagaaattattacctatccagttgtggtgacggtctcattagtcatttcccaacaagatgtgtttacttaacgcaatggtactgtgaaggaatgctctggttgtaattgtataaatttcacgcaactctttgagttgccatcatgtgtgccctctgttattcagttgtgaagatgctgtgagcatctgagatgtcgtattgcttttgttgttctttcatatgatgggatgagacttactttgcatcgcttgtttgatttgatatccgaatgctgcacgagtcctttttgaagcagaccgattcgtgtggtttttcattttaacagatgtagtccaatttctcagtttggtgtcaatataagcattacagcaactctacaatgtttgatttaattacactagaggaaaagaggagaaaaatcttgcaaacagtaaattactgatgctcctcatctgatggtcaacattgatgattatattttgccatgatttagagtggtacgagttacaagaaataatctcaattgcaaattcctatacacttctgtacatgtcatgtattcctcctgtacatgttcttctgaatatatacacctgtctctctagctccacgatgtaaaatactcctacttctctacatcttccaaggtccaaggatgttcatgtttcagatcaattcctgaaaccacatggatgttcatgtttcatgtcagttcctgaaaccacatggctgtggactgacactcccggatttcttccattctgcgttctggcaggtgctcttggcattactgctacctcccttgacagtgagattgacattctccaaggttatgccatggcaaggtacactgctgctgcaatgcagcatgatggcctcctctgatgcacttgtgcccctgatgttcttgaacagcacattgctcacctccactgcagatttctgcaaccaaaattatatatatgaagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33929 - DNA, 397 bp, Oryza sativa
  unsure (1)..(397): unsure at all n locations
nnnnnnnnnnnnnnnnnnnnnnnnnnnnnnnnnnnnnnnnnnnnnnnnnnnnnnaactattttgcaacataacttctagattgatacattttgttcccaccatattttttttttcgtaaaactaatctgcaacagtatagtgctttattgctttactgtaaattatctttcacaataatgatgtaaatggatgctttgttctcttttttgtctactttatttcgcttcaaatgtatgcaccaactattctaaacatttataacttagcgaaccaaatatttttgacagtgattatatcatttagtttcttatgctgtgcagatttggttcatgggagagctctcacatatttcatcggaattcgataatgtaagttatatctgattagtagttcatt

SEQ ID NO: 33930 - DNA, 585 bp, Oryza sativa
ggtttgatatcaccatgaaaaatgcagcggcgggaatgcgagtgcatgtaggtaagagctttcgcagagccaatggcaatatccagccgtttcagcagcgggagagcgcaccgctctgccccatgaaggacgctctcgaggctaccattagggacgaactcgaagaccagcatagggacctccacctcgaggcaacaaccaatgaggcacaccaggttgtcgtggctgacttgaagttgcaccgtgatttccttcacgaactcatccttgccacgagtccgcgatatgctcttttcgatggagtacttgacggcgaccggctgatcgtcgtgggttcccttgtagaccacaccgaaggcgcctttccctatcttgttgcttttgttgttagttatcttgtccaattcctgctttgtaaagattttaacgctcgtcttctctagcatttggccaccattacggtcatagcaccctttaagcttccatttcttacgtaagcacacaaggaccaaaccaaatagcacaacaccggctatcactgcaaatgcaaacaaaccaattaaacatataagtaactaggtgatt

SEQ ID NO: 33931 - DNA, 599 bp, Oryza sativa
  unsure (1)..(599): unsure at all n locations
ccctacctaataatagtcactggcatgccagattttaacagatgcagctctgctgatataggcaaaagcaggaaatagaagaacttcgcaaaaagttgcaggttatttgtgtttattttaggtttctcttcaaacccaggtgtgataacattatttaacctttttgttttctgaatgcagggttctcattccgaagtgttggagcaggttatactaaagcagcgcaatgacatgcacaaggtaggtaaagattaaaggttctacaattcctgtagaacatgtatatctcatttaagaatgagcacccttttgtggatactgcatacaaccatctttttttacttaactcaaagtttcgtggattcttttcatgtagtctgaacttgagcgtgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33932 - DNA, 259 bp, Oryza sativa
aattggtgattcttttgccaggtacattcctgaatcctgattcctcccatgcacatcatttaactttcaaaattctagctcattccatctgttcggtacaatttgttttgtctctacaatgatcagtgattcagaattgccttctgtttgaaatattaacaacttggtaaaaaaaattgtccaggatgtgctgttggatacaagaattggctccgaatcaccttcgccatcgaaccgtcttctcttgaagatggtattg

SEQ ID NO: 33933 - DNA, 418 bp, Oryza sativa
tagcgcgaattcgagctcggtacccctgacttctgagcaactcaaggcgttctgccacttccgccattgttggcctttcatcttcttccgggctcacacacctcactgccatccttcccatctcctcaagtatggccatcctatcctcttgatctcctgtgatggacagatggaacattctctctccactatcttctgcctcataagcttggatgaattcagaaacaaagttgtgatctttaggcattctccctctgatgagtaccatcagaatgacaccaaagctgtacacgaaactttcgttctttgcaatcccggtttgcatgtaaaccgggtcattgcagcgagtcattctcaatacaagaacgatatgatccttggccttggtaatgcttctcgaggaaagaaagcatgaaaa

SEQ ID NO: 33934 - DNA, 409 bp, Oryza sativa
cgcgaattcgagctcggtacccatcatctggtatctcaactttactccaactatctatggacttgaaattggtggaataactaaaatattgagtattccataccattctgaaaatagtatgtgatctgctgctccgcacattcatatttgtctccccaaaatgcctatttgctataagaaaagccagaccatgtttcaagaataaaaaaagcttctaaactcgtgaaaacaggtagcttgaacaggtataatgttaacctgtcggaaatagtaccttctccaagctccaagagcttaaacacttgctcggcactgttcacaatttcctcccgtagcccagacacatagacaccacgctatggaaaaaaataacagaattgtataaatctatatcgcaattagacgaaaa

SEQ ID NO: 33935 - DNA, 692 bp, Oryza sativa
ccctttgaatcaaaggatttatataggaatttcataggattcaaatcctatagaaaattttcctatttggccctttgattcaaaggattgaagctttctaaatcctatgaaattcctatggaatggcacattgcatgtggattttggaggaaatttagcaagagctccaacctcttggaaaatttcctttgagtctatctctctcatctgattcctgcgtttttcctgcgctccaatcaaatgatcattcctgtgtttttcctgtgttttacaatcctctgttttacacttcaattcctgtcagaatcctgtgtttttcctattcctccgttttttctaccctgcgattcaaaggggccctaagtatattgttctgaactaattcctgtagcactattaacctaccgcttattaagtctcactatttataagatgtcttgtgtttgtttctttacgtctcttaaggatgaggtataacttgtataatatatttaataacagtcattgctctttcagtattcatccaaatattgccctctgtctatcttactacattaaatgactattttttttaagttcaaatttattagcatgtcaagcgttgagtacctaataatagtcactggcatgccagattttaacagatgcagctctgctgaagaggcaaaagcaggaaatagaagaacttcgca

SEQ ID NO: 33936 - DNA, 661 bp, Oryza sativa
attcgctggaatgctaaaacatgccatcccgttccaagcagtggaacaggatgcacccagctctccactgcatgtgacggtgtgagcgaaatgagctctcctccacgggcgctgcgccttcttccccacacgcactctgggataaagcaccgtcagctgctcatcattgtcgtcaacaaggcaaaggaggacaaagagattgagagtcaaaggagttagttgaatggcggccagaaagccaccattggattccttcacagcaccaccgacaaggccaccgcaaaaatctcccccatgacgttcatcgcggtgctttctcggtgccctcccgctccgctttcttttcctcctccgagaagataaacatgagaaggttcaatgcacggagcgaggctacatcgacgagcaagagctcggctggtgcaaaagacgacatctgagaggggatgccatgtcccccaaggtgtaagtgccccacgttggccgcattgaaaagggagcgtggggcgtgggctaccagtagagccaagctaaacaagctagaagcggcaacgacatcaggaccctagaccaagatgtgagggaatagagagtcggggttagagaagacagttagacatgagcaggcgttgaaggacggatctaaatgtatcaaacctag

SEQ ID NO: 33937 - DNA, 651 bp, Oryza sativa
ggttccctcgcgcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgaacttttcctcttactcgacttaaccagtaccaacccagcttctgaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagtcgtttttgctcacgaatatcagaccagtcaacaagtacaatgggcatcgtattgcccgaacagataaagctagcatgccaacggtatacagcgagtcgctctttgtggaggtgacgattacctaacaatcggtcgattcgttgatgttatgttttgctctcgctatggttggcaggttacgggccaagtttggtaagagtgagagttttacagtcaagtaatgcgttg

SEQ ID NO: 33938 - DNA, 984 bp, Oryza sativa
cgacgaagattacgcgaagcacacaagcaaagctacaagcctataaagaagcaataacaatacataaaaataaagcacaggattctttaggttataacaaacattaggagacttgaacggatcgattcggagctcgtatgaccaagatatgatcatccgaagtttaatgctgttacatgaagatttgcggattattataattaggttttgcaactataaaacatgtggaagcgctagcctgaaaaagacagaaaggctgcgctgttgacatgccgaccccacatgtcaacctaaaggaccacggtagaccgagtacacagagacggtccacgggtcgacggaagcggaccccgtgtgtcaaccgaggcgagtggccgacaaacggactccactagacaccacacggcctgcacacgtggaaaccacgcggctaccgagcgggcacactaacacggacactacctggtcaccacccgcacatgtgaacgactaccgacaccggtacacgggtaccggggtcgacaaccgcacaacgggtacggggcgacactgaaaggacgaggacgaggcagcgagaggagagatccttaccaccacgcgacgaggcgtgggaaagacaacgacgaacgggcgcggcggaaacggacggcgagggaacgacttcggcgaagatccttggacgaaggcgagacgcggccggcgcaacgattggcgacacggaggcgaggacgaagacgacgacggggctgcagcggcacacttgacggacgcggacgacggacaagaacggcttgacggagggacgaacgccacaacgaccgggaacgacgagaggacgacgacgacgacgaccgggaccggcgaggaggcgacgagggcagccggcagcggctgcacggagacgaggacggcgcggaccacgccgctgcgatgccgacgacgaaggcggcgccgcgagacgacgagccggcgagaatgaacggt

SEQ ID NO: 33939 - DNA, 641 bp, Oryza sativa
ttgccttgaattccttctttgaccttttccttgacattgtccaggcagaagattcagtatcttgtttttgttcatcatcactggagtgttcatcagctggtgaccttcggttttttccagacacaaactggtggctcaagcgtctctatacaagtaaagaaatatcatgagtggatcatgcgagttgacatataagctattgaaataacaatcatagagaaaccaatgcaggcaagtacaatagcaaaaatatgaagatgagcgaatagaacaatgtgtaattgactgctgaaacatgtattcaggtaactgtaaacaaaatatgtcatggctgcgcattcatggccaacaaacagttctctggcctctatgtgttttctttctttggctctaatcattacaacgatataagcttttcacattcctccaaggcatgcgatcccattttttcctgttaaatgcagctttctttttccccccttatcccatgtttagcatgattccattttttgtgttttttctgttgtttgaccatgggcccactgcgacaaattttaggtcattgtaggggaatatctctggttcctttttaggaaaaggaagcattttatttctggtagaaagttttagtattttaaaaa

SEQ ID NO: 33940 - DNA, 1237 bp, Oryza sativa
tggttgtgagacatgtgaattttggtgggatagtgatggtgaattgagaaataaactccctccttttcaatacctgggcaggggtggtaattgggagggaattcctcctttacttcgcataaacaaatctcagccatccattttcattaataatctaatctccaactaatctctctatcaatttccaccacctctaccaaacaagagactgggatgaaaaatcaaattcccatcttaatctcaccatcaattccttcgtgtaaactcccaatccccttccctcgagttgccaaacaagccgtccaaagctatcgagagatgagcaggagcgaaccacaatgacgcaacacatatatctattcgtgtcacaaactttacatttcataccacttaaaaaagtattaatatgattttttaagcaactttttatagaaagtttttttaaatatatacaatatttagcaattcgggaaacgtgtgtttagaaaataatattcttttttcttctctttgttcaactctcaaaccgcctaaaacttctctctccgtatcacgatcgccagatatatcacacgtcatgcgtggattctacacgtggagagccacgtcagcgctgatgcaagcgcttatgtcgtcgtacgtgctagctcttggcatatatcgatcgtcgtcaattaattatcatatgaattctggctctcgatcgatttagtggcaactactccaaagcgagctagtcaaataatcaagtcaaatctgccctctttgatgatgtaactccggattgtctctctgccattgcttgtcgatttgcaggttaatgaaacaaactattctaatttggctttgttcatgtttttgaacaaacaaagaaagtctgtctttgcttattgctggaagtatcactcgatccgttttcaaatatctatcgttgttgtatattattgtttcaattttgacggtaaattattcttaaatggttagattagactaacaggaattccatgcttacattaggaatccaatacgctgaaaatatgatacccattttacaagacgttttgatctctttatccttcatccttaaacacatatataaatccatgcatgaatttattcaaatcctaaagcgtatttgtaacttgaatcagagaaagtatctttttaggtgtttgcaaatcttttttttttttttaaaaaaagacgagcagttaaagtttaaagaggggatcctcta

SEQ ID NO: 33941 - DNA, 654 bp, Oryza sativa
ggttgttcaggcatgatataaaccactggtggcctcacactgtgtgaccactaactgacaacagaatcactatggagtaagcataacaaacctgacagattactgtggagtaagtgcatatggtccaccctaaatttcaactatgggttatataagacttaaaagtgatcatgtggtccactctgaaatttcagagtggctgaatttgtactcttaagtcttaacacacaatcctcaatcatgacatctgtgtctaggcagcaaatttaaagagtctgacaaaatttaggctcacatagtgttgatttcacaaagatcaatgtacctgttttactgttcacaatcctggcacatatcttcctcaccatagctagacataaaaatcctaaaactgaagttgaattccaggtctatcgcgcggtacttatcgcgagacttgccatatgagctatcagctgatgatgtgtacctgacaagtggctgtgctcaagcgattgagatcatctgctctgtcctagctcgccctggtgccaacatcttgtgcccaaggccagggtacctgttccacgaggcacgcgcagtgttcaatggcatggaggtcaggtactttgatcttctccaagagagtggctgggaggttgatcttgatggagt

SEQ ID NO: 33942 - DNA, 360 bp, Oryza sativa
ttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgttttcgcctgcacggctggcctttatgccgctgttgttgggcatctacgtcttcaccgaccggccgcctcgtccgccgccgactggtgcttccgcctgcacggctggcctttatgccgccgttgttgggc

SEQ ID NO: 33943 - DNA, 622 bp, Oryza sativa
aattctgatccgtgaaactttgttccattaatgacgaactcatgtcactcatatgcatgtttgggaagtgcctaggccgactcccgatgcttggtggttatgactagtcgggcagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccgaccggcttgcctcatccgccgccgactggtgttttcgcctgcacggctggcctttatgccgctgttgttgggcatctacgtctttaccgaccggccgccttgtccgccaccgactggtgcttccgcctgcacggttggcctttatgccgccgttattgggcgtttacgtcttcaccgaccggtttgccttccccgccgccgactggtgtttccgcctgcacggttggcctttatgcccctgttgttggccgtttacgttttaaccgaccgg

SEQ ID NO: 33944 - DNA, 683 bp, Oryza sativa
catcccactgtgcttgtgtttgtcgccaaaaagtttgactgtaaataacaaatttgtaaatagtgcgtattatttatagtcaaatttttttttcggtcgtatactaagttgaatatgaacttgtatgattgtggtgatatatcacatatttatccacttttttaagaaatacaattttcttttgcaaacgtgttaatatttcaaactgaaggcaactctgaatcacttatcattgtggaaataaaacatattgaaccaaacagatgaggtgagctagaattttacaagttaaatcatgtgtatgggaggaatcaggattgtactacctggcaaaagaaccacacattcttactttgccagcttgcagcagaaatccatgtcatctttgatgccatgcaggcaggacagatccagtttcaccttcaccaagccaaccaaacatcatccaccgtgagaaattcccttcgattctctgtattatgaagcagcatatttgacaaacatggaaccctcaggtttagcccagccttgggcgcaggatgttggcaccaggcagagctaggacagagcagatgatctcaattgcttgtgcacagccactttgtcaggtagacatcatcagcagatagctcatatggcaagttttgtgatgagtaccaattgacctgaaattcaacttgaat

SEQ ID NO: 33945 - DNA, 375 bp, Oryza sativa
attttaggaactaataacagcagatagctggcaaattttaggaagaaataagtacagagataggtagatcagattagcacagatagatggtctagaaataataggtcaggactgacacattcaacaggcagggttcctagtcttagataagcacccagcatacagtgcctaagttgggactcatcaggatggttactgactatcaattgctaagtgttgccgcagctcagcccggatgctgtcaaactgtcgtttagcatcaccgtgtgcttcctcagcattgttattctccgccttcagtcttgacagctctgcatcttcatcctcctttttctttgacatcttctggcctttccatcggagtttcccaagttc

SEQ ID NO: 33946 - DNA, 339 bp, Oryza sativa
catgtcgccggggtacacagaaagatatagttgcgcacctgcggctggcttccgccggcggcgcgttgatccggcgatatcctcaccggaattgatgatgaacgagagagaggcgcggcggatggatggattgggtagttcgtggaatggaacccagaccatggagaacggaaagggaggaacggaatattcttgggccggcccaacacaaaagcccaatgtacccaaaactagcttaaaaaggcccatgtggccctctgacatctactaggcccatatcggctttgaccccacctgtcaatgggatgggcgctgaacggacggaaaggtcggggactt

SEQ ID NO: 33947 - DNA, 19189 bp, Oryza sativa
  unsure (1)..(19189): unsure at all n locations
gagagagagtaatgagacacccctgtgtttttctctgcttcctctgctaggttcttctaccactctgcgctccagtggtttcctgcttatgggtattgaactgctgacgtgctccatatttgtttccgagaaatttagccttgttaaacgctagcttctgacattcagattgaggacaattgatgctgtgattattactcattctcatgcggatgcaatcggaggtttgcaaatacttttattgaagcaagcaactttattaatattgattgagacaacacaccatgctcgttttgctcttgagctttctaaaagaaataagaactcctttggtacaggccttgattgtcttcgcgattggacgaacaatgtccagcccaccatcccgatttatgtagcagaacgtgattatgaggttggtgctatgtttgtagttttgtttttgcttctctagaattgcagcctcagaaagtttcattcctaacgtagacaactgtcatgccaattgaaatgaaactcacaacttctctttatgtatgcaagattttaacaactgggccactggctcacttttctttctatgcttgtactatttgttcgctatcaggtgatgaagatgactcactactatttgattgacacaagtgtggttatacctggagctgcagtttcagcattgcaattcaacattattaaagaggaaccatttacagttcataaccttgaggtctgttgtctaaaataataatttatgtaagcaagaagtagacataaaccacacgctatcagcaataattagctcttcaatccgcaaagaaatttctttttctcaactcatttgactgcactgtaataatactttatactctatgtaggcaggtaataaaaggatacatttacttctatatccttatttttgtttactatcataacttaattaactgaccatgtctatactttgagttatttgaattccaatgttgttctgagttaaatgttagtaaatccgtcatgaacctattagttacatcctatgttctcaaaatatgttgttttggtcatgatctccggtagacacctgtgaccatcgatttgttggccaaaagtatgtaaactataaggtaagtaattttgaatgtgcctttttaaattgcatgtccaaacgaaattaatatgtttttaattatgtcagtttgcgctaagtgtactttcgagtgtaccctgtctaatttattttgctgaagatatgatttctgtatttttcaggtcattcctttgcctgtctggcatggtcagggttaccgctctcttggttttcgttttggtcgtgtatgctacataaggtagatcaaagtgcaaagctaattttttacaatatattctgttggttcaagttcaacacacatggtcttaatatctctgatgtacacagtgatgtcagtgatatacctaaagaaacctacaaacttctggaagactgtgaacttctaataatggtattgacgttataactttttctatatatatatgtgaattggtaaagcatgagattatgggattctcttgaagctgcatattttcttatgttacttagtgtttttattaactttttgtataactggatttaagcttgattttattataattatgtccaggatgctcttagacccgatcgttcttcttcaacacactttggattaccacgggtgggtagttagttctaatatatcaatcagctctagcttcttattgcttcactgtattccatggtgatatattcttcacttctgcaggcccttgaggaagttaggaaaatcaaaccaaagaaaacactgtttactggtaatcattttgagctcgtttaatgcctttactgaattaacgctgctagacttcttcagtttaaactctatgtgcactttaacttttcatgttaatttataaaaacattaatcactctggaacagaatgcacagtttactatgagaaaaggtacattgttctattgcatgtttgagaaagcttatctgcctttctattgattggcagaatttaatctcagaaaggaaaaaaggggcaatatactaaaaaaatgatctccttagttaactgttcaataatttggtacttcatgtgcacaataagcatgatgagggtgtcctacaatcactcacgccgagcttgctgtttgttttccaatggtgtgtttgatattttctcctattgcttgtcacataaaagaagaaaatatctgtatagtaacttagatctaaatattcatgttggtcacttttcagaacctttcaatgtcagaagttaactattactattcatgttactccagtttattcagaactaaagcatcaaagttcggctacttatttcttgtttatggacatgataagaaaaggtcgtttaatttgatcgaatttcacatgatgtagcttttattgtttacatgatgttgctcttgatgacttgactgaatgatatcttcaggaatgatgcatttaatggatcacgagaaagtaaacaatgaacttgccaagttgatggagacagaggggcttgacatccagctgagctatgatggtctcagggtacctgtatggctctaatactattaattcttttaaacacacacgacatttttttgtcttctaggcacagctaggatatgtttacagattttctaaggtttcagttagtaaaattattattacaagatgtaatctgttgaactccttgctttgagcctttgcttttcttttattctcccttctctatagagggagcttatgtagcaaatatacatcttataatttcccaatgcaataaaatttccaattgattgtttttgaaacaatactttcctatctttctgttgcccccttaaacagattttctttatggctattattgcttgggttggatacgggtgtgagggactgaggctagggatccagctgctggcagggcttattccaggcttccagctgtgaaagagaggctctgaggcctttggaaatgagaaggggaatactagcatgaacttgtatatttctgcttccgcaatgaagggtatgggtcctcacttatatagatgaggttaacccctaacaagagaatctaatcaaataaccaaagtaatctcgtctcctaaccaaaccaactaagattttaatctccaatctgctattttcttccctcacttggaggtggccttgctgattcttgcgtgtggggtgtctctacttgctgctggctgctgccccagagacactagagcccgtaacagttgtatggataactggactctaatgtaggattagggaccataaaaggaagtcatcaggacttccttgaaatccagctgaaggaacagaaaacactggtgggggggggggggtcaataaaccatttgatctgcaatatcacatgacacaaatgattactgggtacagatgaaactcctagcttgtctttcttcggtgaatcacactagatcccagcaataattagtaatttttcttctctaggtcacacataacaaaaggctggtgtccaggaatcgattacactccagctgctcgacctagtcttccccttaggatcatcactccaaaatatctgagtatgaaatatgagggaagcaatttagtctttaagagtttaaagttagaatatcattaggtaaagactaaagaagttaattttttactgtgtttatgtacctgcccatcatcatgaccgtggcttgagggttcgtccctggtgatctagaaaatgttgagccatcgactacacggacgcctgaaactccaagcacacggtgttgctgatcaaccaccttccctacatggcatccaccatggtagtgccagatggttattactgtatccctgcaaaattgctctagggattctgtgtcatttgtatgcttgggtatcaagttcacattagcctgcacactcatattgagcactctttccattgaatgtccatcagtgttggcagacagttcagagaaacggtttgtcttcagtattcgttcaatggtcttgataccatagacgcaacgagtgagatcctgtggatgactgaagtagttgaaggtaaccgcagggttcttcttgacatcagtgtctatcagggcaagatgtcccgtagacagtggaccatcaatcttctcgaggataaaaccaccatggaatatctctttgggtagattaagtttggtatttgcatacttctgtgctttttccaggcttctttccttcggaggaattgtggacagctgtccaatctgtaccataggaatataatatgtattagaccaacaaggccaagtagggaacaaattgagacaacaatggaaactatgatggcagttattggagttgttgcaatgtagacaacacttattttttttaatctccaagacaagaagttcaattctgagatctgattcctagaaaatctaagcataaaacaatgacttataaatcagataagtattatttcttagaatatactattatatgcatatgcatattcacctgtaattaatgaattggtctaagttgtgtttgcaatgttgcaaaatgtgagttttgatagtttagactttagaatctgttttcctttttgaagtctgcagatctaagcagcagctttttcctgatgtttgtgatactgctttagacctattttatgcacaaaaagcttctcatgatgcaagtaagattgatgacatacctcagcggacatgattccatggtggcaatggatgctttctggtgactggccaaaaccactactggcctcaatgaacacaccagcttcagttattccaacagtctcaatcagggactggcgaggggggcttttcgtcggtatgaatatggagttcatggggttatcagccatccctttacccacatacttgttatggagaactacaggaattttatggctcctaaggtcattcttgggtccaatcccactgagcaatagcagctgggggctgccaattgcgccagcagagacaatgatttcactatcacagttgctgttgaggaatgcctggtggagtcctccattctcatcggtgaactgaactccggttgcttttggcttaagttgccctgcatcagaaatggtgtatctgaaatatggtacgtgattactgaacttactctttctattcatggcatataattctatataactctattttagaagataatacaacttgtaggagctttggccacacatgtgtaattatttacctctctgcgagttaaagactatcctgttcacactagcatgaagcagcacccttaggttgttagggtctccagctgcaagtaagtcggctgctgtgtggcggtagccagtctcatcaaagatggtgccaccaactttggtcccagaaacatggtcatatgtgtagccattgaaaggagatacacctgcttggagtagcccatcccttagtgcagcctgccaaggtgcgatcttaggccactggacgatcttgtcctccacccaagggaaggactcattcaccaggtcttcatcccagcctacctcctggatgaagctgtttgtttcaagaacaaaaacacatggtatacaagttattagcaatttaacatgtagttcaccaataacaatttaacatgtagttcaccaatatgaatatcaatatagaagtaaaattccttcttgaagactacgggattaagcttatcaattattgataccttttaagtcacattggcgtttctggtaatgagcaggtatatcactagggatgactgatgagcacgggtgtgtggggcccacccattgacctattgtaattcgattctgtacaaataattcgaatgcatatgtactaattggcccaaacttgaagtagcctcgagtctactagggttttagttatttagtgtcctttgcctagacaacttagttaccatgactgcaaagaaacaattatagccccatgtgattttgttttgttgtctctctctttttttttttcatcaatgtctcttttcaatctagtctgtttcagtaacatgtagttcatgactgcaagaagagcaaggaagtctttttattcactgagaaaaccacagcatgtgctgctgccagcgtagttaattatttgcaataccagactgaagcactttaatgcaaaccacttttgcaatctgcttattttctttatgttatcaactttctcactagtgctcatttgtatgcaagcactcaaagtacaacctttgctaattttacagctggattttatttcgttatatattgcagagctgcattgtgataaatctcaaagaaagcctgcattttgataaccataaactagaagtctagaatcataccaaccaaaatatgtagtcctagtgaaccgataatcatgtccaaatgcagtgctgggtacgttctagagtgagtgctagtaatgcaggtggtggttttatgcatttgtgtcttttggctggctcattttagtcgattagaacctatttgagctacactaattagtgtttgtttgtttccccgttttcccttttccatttggacgctggagaaaagaaacaagaggttgtagccagagaatcctaattggcagaaactttggtttcatggtaattgaatgctactattgagaacagtgaataatatttagtgttctgctgcacgtttcagcagacagctattactccacttgaagggtgaacaaaggtggctgcagtatgctagggtggcagcagtcaagcagatcttaccagttaccattagtaatttctactggcactatcactgctctgcatttaccctagagctgatgtttgttcatgtgaaagtgataagccatgtgttgcatatactgagagactacttggtatatttaatctacttatgctaacttcattttaggctctcctatttgtgcttgccctcttatggtaaagaatataatagtaaattatatctgaagtcttgatcatgattgagaccattctgcacttcggcagtaaaaaaaaaggttaaatttgcatgtgtgaactgtgaattctcttgcatatgtttgtgtgtatatattaatgctgaccattctgcacttcggcagtaaaaaaaaggttaaatttgcatgtgtgaactgtgaactctcttggctggtcactcgtagacggaagagaacaatcataatcaggtaagaatactgatacacaagatagcatccatatctgtgcaatgcaattgcttactttgagctggcccggctgtagaagccggcattgatgcaggtgccacctcccaacaccctcgctcgggcattgatgacgccgtcagtggagatgaaggcctgagacgccgagtccggcgccatattgctcaggccaatgtggaagttctccatgtaggagacgttgcggttgccatacggagaccctcccctctccagcaggagcaccttgtacttgagcgacaatgtcgccgccagggggcaaccggcggtgcccccgccgacgacaatgtagtcgtatgtctcgtggcgcatcgctgggaagctgctcgccttctggagggtagggagattccttaagctgaattgctggttgcctgagaaaacaaagtgttccataatgttgtcattgcctgaaaaagttttgctttgttctgctgtaagtttctcatgctataaccccctttttttttttgcatgacttcaataaaagctttcattatctaaaaacataacctgtttttgcatgttgataaatgagtgtatcaatctaattgatgctatgattactagggtctggacctcttggcagttggcattgtacctcctaggactggatgagaggtacgtcttgtggcattgtgttgactatttatttcctatccttcaatctctaaatattgaactctgaatgattagatgttctgctactctcaaatactagtggtgaggccaatgtggcgataaacaatgataggaaccaaagtgtcagataatggaagtgcacgtgataatgatattcttgcgagaaagaagctaagcaaaaactagcatatataactgcatttcaccattgcaagttcttcaatgggaaggtggaacagaaatgtacagaataaaggaggaatgcctgagaaacatgagatgagacagaatacagaatagaggaggaatgcctgagaaacatgagatgagacagaaccacaagagatgcgcaccttgggataaactgaaggagcagaggcaaaccatggcctggaagatgaatagcattctcttgctcaaagccattgagcctgagaaccacctgccaagctaaactctttccccttcttaggaatttcctttccttccaaacaaccggggcaaaacctctctccctcccctgtttcctgatctccacccttaaagcttgctcactgcatttgagtaggtttatgtagaaggcttnggcattgggggattgatagcaataggctgctgtgtatatgcattaaaagagagctcaccagctctagtaagtgctattcaatgcagagggagcactggcctggtacaactgggatttatggacttcatcaaccaaccaaccgtagcaaggctgctctgaaggtacccaccaccctcattacaagaatgacagtcgtatatctctttcctctatctattcatagaaaaatattttccttttccaatctttttgccaattggttaagccaacgtgttattagtattctaatattctattcctggtctgttccctccatttttcaaatataggctgtgtttagttcgtgtgccaaaattttttttaagtacacggacacacatttgaaatattaaacgtagactaataacaaaacaaattacagattccgtctgtaaactgtgagacgaatttattaagcctaattaatccgtcattagcaaatgtttactgtagcatcacattgtcaaatcatggcgtaattaggctcaaaagattcgtctcgcaatttacagtcggactgtgcaattgggttttttttttcgtcgacatttgatgctccatatatgtgtccaaacattttatgtgacggaaaagttagaagtttgaagaaaaaagttgaaatctaaacatggccatagatacattcttgttatttagtgcagatgcttccatctttaaataccagttgcagacttgcaggaaacatatggtgccatttttttatagcaactgcagaaattgttttgtgctgccatcttcttggaacctatatgctgacaaacatgctccaaattataattagttagaaatgtctctgatgtagattatccagctctcacggcctgtttggttggagggagttggtgatggggaataggagtttatgatatctgggagtttaagtctgtagtttggttggaagacttgggaattcgagggggtttgggatggggaattaaaaggtcgaattctcaccaatatcttacctgggagagacctgttaattcgtgagacttggagggaattcgacgtgaaaccaaacaagggacgagaactaaaaatgtaactcccatgaccaatcccaccatcaactccctccttaaaactcccattcctcttcccttctcttaccaaacagaccgtcagtgtttttatttcatttcatctagaaaaattagccaccatccctgaatagacaagcatagcaaagtttactgtaatgcaccgctcaaagttaccgtcttaccattaagattacttcttttatctgcacactgttccttgttaatgcgatgtgtatagctagaaacaaagcagagagctaagccaagctgaggttgaattgactaattgtgtggcctaccttgtcctatctggtctgtagggatttatattgctatcgctcaaatatatcatttatgggttgatggccatactaaatacacttaacaataataaatgctatgtgctacctttagttatggagtacattacattacattgcttgagactcgtcatgatcaacatacagtgtgcaaaactgttctttgtttttttataagacctcttttaggacttacaaagctgttattgaacctttcatgtccattaggcggtactcacttgtgagcaccaggaaaagcaattagacctccatataaattttgaactggaaagcaagcgagcaaaatttattaccaccatcaactgcctgtgtatatttggcagaaaacaattgatgcacaagaaaagagtgaagtgttaactattacatctgccccaacattactaggctgtcctcttttcgttcccctgcaaccatggagcttgtgagtaaagaaaaataaaacactgagcgttcgtcaactacactatgatgcttttcttttcctgcatccctggaactcacaggtttactacaagagtgaaacctaaagcagaactatagctaatctcaagctgcaacgtgtcgcacacttttcatttccctcacaaggatataactcttttgttgcttatttgtctgcagattggaagaaagggacctatgcctctcaagcactttaaggagagggagagccaaggacaatatgacctgtgaagaaccagaaagagccttcacatcacacggttacatctggatcgaaaagagacgccctaacaacctactcgcaggcaacctgggattatttaaaggtaacacgagctagcgttaaatcagtttctacacacccgttttcacctgttgtcacagactcagtgtcacacaccaagcgtgtgtatgcatgtagatataacacaacttgcatgggtgaatcttttggtcgccatgcagcctacattgatgctgccggaaaattaggtgagtgggagatatatgatgacactgtgcatcatcttgatttgcagggctgtctgagctgccgaagcagagtggtgcacctaggggtcacaagactcacatccttgtccgggcagttcgctgatcgccggacggctccttaattttctcaacagaagcctttaatctgtattcaaatggctctaaatggatccgcagccaaacatttccaagatacaatcgtaactctattgggtggattctggaatctcgatgaaatggagttagatctgggagaagaatcagtactggaactatgtcaaatggggcaacctgaccagtgactagtgaccactgctacgagctggaacctgttaaatttccatgcccatccatccatatgatatatttcccactcaccaccagtttttctgaacctgatgcaattatgcaagtaatcaagcaatcaacccaccggtgaagatgttggtcaatgactgaaactaggaggctaaggttatgtcatcaagatgctccatctccctggaatcccagcattttcatcctctaccatttcaatacaaccacatggaaattgtgctagaatcatcatcatcaccatgaaacaaaggtacatttcctccttttgaaaagcagtgatactgaatttttcagcacttaaatacaccactttggatcctaagattggcgtcgacacccttaactcctgtggggtaaatcacaaccccctccctgccattggattgaatggttcatgcaacacaataggactacatgagtgctacaggtgaccccctcatccccaaagaaagttctagttctcgcaaggttccaagttcatcacctagccattgtgttcacccacttcccttgctccccttcatccggtccaaccttagtcgtgaatgcatgcacgtagttacatgtacgaacatctatgttatgaagatcgtagatgtcatcgtggcgccctaatccacttggcaggtgcggtttactacacccacatggcagtgactgttcacgacgattttcctagaatagttgcttgtactgtgaggagaacttgcaaatgtaaatactgctggcagcacacagttaggagagatgttagctgtgccatacggtgtgcgcttaaatgagaagggcagaaggtcacatggtagcgtatttaccagctgtgtcccagcactgtccgtctgctgctgcccattggtgatgcaaccatggccatgtttgtgtgatcccttgagctcaaatgcttcgtactgtgattatcaaaccatctaatactaatcaaagttgtttttgtagatgccactatatcgtctcacctctcttgtcctttcttttttgttgttaggaaaaatggggcgatcttgctactgtttcaagtttaaggcggcggcagatcagcgcagtcctcctgtctcttcacagatgattggctggaaaaacaaattctgcatctcatctggtggttgcgtctcaacggagctgacgtgatggtctgacaaagatgtttcaaaccataaattagtcactgacaaagcctgcttctgttgttcgccgaaattcttttagaagactcaggccctgtttagatgggactaaaacttttaagtccctattacatcggatgtttgaaaattaattataaatattaaacgtagactattaataaaacccatccataatcttggactaatttgcgagacgaatctaatgagcctaattaatccatgattagcctatgtgatgctacagtaaatattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccacctcagtttgattactgaatagtagtgattgattttggtcatttggggcgccgtctgcatgttccatcctgcctactggtaaagattagtgatggtaatacaaaggagtacatatgttcaatgttcatagcaatcctctacaattgtcctttcagatacacaaatttgaactgaatgtgattttgtgaaatgtgaaaaggagaatggtgaaaatacgaaacaatttcgaccaatcctaagggacgtatcactggtgaatgatgttcaaaatttatgttgggatgatccaccaccgcatgtgccttcctgcagaaactccatatctaatttagcgaagttttatgcaatacacccttactcccttaggtccatgaagtgaaatggccaagggggaaaggttttaacaagggagatgaaatggtggggatatgatggaggtttagatcatacttgcaatccagctagagcaaatgcaagtgatgatgttggcctagtctaagagggcactacagtgaagatctagctcaaggatcaatgttgtgggacatgttgggggatctagcctagatgtgtctcacaatgaaagtcatgagtgtatatatccttaaccaccacaatgtgtgttgcatggcatgggagcctttgtcctccctagtgccaacaccatcgttgcctccttcattttggtgatgatggggtagttgtagctcatggttacccgcctccgggtttggtcatgtggtacttccattccctacactcatttgatttgcccctcccctgccttttgtgagagaccaacactcagaacaaaacccagagatgcatgtattgtgcaatggtgtgcagaaggtagtaactgggaatcaataatgttgttacgcatcatcctcaccaaaactcaatggcatcgccaattcaccatcaccacaatccgacttcttagttttcttaatcctgtgtttaaaaggagcctttttggtcttattgtgacacattttcgtggtggagtcaggagagagctcctattgactgtcagtagttatgagagcatctccaagagctccctaatatcagcttcaaaagataaattttaggaatctagaaaacaggtctccaagagatgcccaaagatggtaccaatatttacccacacctaaaaccagaactaatctgaaccaattttgggcacctccatgcactcccaattgatgaaatcgccggaggtttttgccactcgtgccttttcttcccctgtcgtgcactgccgcgagatgcccgagccatgcctgcagacttgtcgatgccctcgtcatcccctaccgcagctgttaggcacgcgcaagatcaccctgctgcacaacatagctgagccgctagcgcgcaattggttggtagcgcctaacgccgatctcccttttatcagaaaaatggaaagacaaacggttgaagcagatctacttgagatgatgtggcatgttttaaaatgattggaaaccaaatttaggggcactcttggagtagaaggtgatatttgggcccaatttcttttgggatggtcccaatccaagaattttaggagttaaatttttggatgctcttggagatgctctcagtggtaaattttcggcaacaaagctgaggtattccatgatgaaacttatgatttttttttttgccacacgatcaaatccattttcatatcacaaatttaattagctaaagacttgcatgcatatttcaatgaccgaacttataactacataaactccaaactacaccaaacagaaacgatcacaataatgttccaatagtgcaattaattcagctcaccaaggatgtctttttctctctttgaggtcccaaccactaacttctccagggtgtacattaccgttttcaaggtgaaaactgatccctttcggtttaccgaaaaccaagcgaatactactttcgtaggctctatttgaaaaccggcttaaggctagtctcaacacaagacactaaatatagttttcataaacttctcatcatcaagaaactagtactagacactactcttttaatgcaaacactattttttcatacttaaatttaatgctacttatttcacatgatgttttggatgttgtgtagaaaccatgtcttagggcacccgcaatggttatctataggctctctacaagagatctatgtcagcatattttcctacttggaagagattaaatgaagagagagagcaaagctatctactaacctggagatagtctataaagaaaaacgaggcaatgaattagatagctatagatacccatgtagacataccattaaagtggtttactattaatctagtctattgctgatatgtacatggtagcaccttactttaccattgtgggtgctcttatgcaagacctggtttccttatctttcctcatttattcacttgtcacattattttttatactaggtagcagcttatttaatactatggacaccatactagtctttgggttggaaatggtctaaagcaatcggttttcaccttgaaaactgatccgtgtcggtttaccgaaaatcgagcgaataccacttttgtcagctttatttgaaaaccagctaaaagcgatcggttttcacaaaacagacccctaacattttgatgaaaaccggttagaatcgcgaattctgctcccaagctaatccattttgatcccccatcgcattgtcctcgctcgtacggaaaagagaatcaagatatgaaaagtttgaaacagaactggaaatttatttgctctttgatggccgattccgatgtgcaactgttcgtgcggtggatacatactgcatgccatgtcaaccacggaattcaattaaactcactcgtcgaatgatgttgaaattgaattgaattgaatgtcgatcggtcaacatcatgtgttaattggaacgcgtacgtacgtagatacatctcctactatcgcattattgttcttttgatcagaaccggacaatgccagtcatctgcacggctactatcagatgtataaagacaacgtatatgtacacacagtacatgtgtcgtcacgcaccgccttatggaattaattaaactaacttaattaaaagcagtccataataaaagatttagtatattcaaaattacttgtaagcatatgcatgggtggctagtaagttgcacatgtatggaggacttgtacagttgtataattgtatgtgtcttatgaaaaatttgacagattaacttgtagcctgatagactgccttctttttagttgaagaaaaaggtcacaaattgaaagatgtgaaggggctaaatgatctattgtatgtgtctatggcgtgtaaaatgtgaagacaatggtttttttttaaaaggagaattttgagtgggtcttgtgccaagtgaaacctttcttgcagtactttgcatatcacattttttttattatacaaaagatgcccataaacatatatacatataactcacatacctaaatgcgctgtctacacatacacatagtaaaaagacacaggtcacgagttggtcatataaggatgagttcaaacctacatgctgtgaaactttctttccggcaaaaaaaaatagcaatggattagcgcaagaataattatgtattggcttaaaaaactttaaaaataaattaatatgattgtttaaagccatttttctatatttttttaaacaacacagctttcagcagtaggaaatatgcgcgtgaaaaatgagagagtagaagttaggaaaatatagtcgagaacacacgctaagattgtttataaggccatttcccaatgaacgatgccatttttatgtttctaaagatgccacataaacaacaagacatttaattaataattgaaacagcgcccatactgcaatgcatggttttatttttgttgtttcatagctagcatagtagcatatgcaagagacaaactgtattggtaaaagtgtagaaattgtttcatctagataaaactcatttcatctctcacttcattaatttcttactacatcatcaaaaaatactggcatatgtcaccctgtttagaataaaaattctattgggaggggcccaaacctaaagtcgtgtacttctaaacataatatgggccgtactatgttttgggccactcacgaagcccagcaaaaagaacgcgtcctaccttgaggcccaacttagtaacgcagatccagaattccagaggcctcttcgcttcacccaaaaacccaaaccccacaatggccgcggcggctgcttcgcagtctccggcgacgccgccgcggatcctcctcgccggcgacgcgaacggccgcctccaccagctcttcaagcgcgtcacttcggtaacctcctcctccgccgccgccgcgtcctcccctcccatctcgtcgtatcctctcaccggctgccgtcggcacaggtgaaccagtcgacggggccgttccacgcgctgctctgcgtcgggcagttcttctcccccgatgccggcgacgggaatgncggcgccggcgggaaggtcacggactacctggaggaacgcgccgccgtgcccatcccgacctacttcaccggggactacggccccgcggcgcctcgccttctcgcgaaggccgcgtccagcgcccgaggcttctcccccggaggcatccagatatgccccaacctcttctggctcagaggcagcgcccgcttcaccctccatggtttctctcttcgtctttccatttctcaattgtgttggactaatttgtttcattaacttaggcgtaaatactgtgctcatagatgagtagctttacatctccaatgtctgaagtaaaatgttaaacctgttcaattgcagcatcttttcttttgaagctgataaaatattccatgcgagctattgtagaaatgggctggaaatgggatcatcgaaacaaatgcttgctttagcaattccatttattggattttctcacctttcgttaggtttatctgtcgtttacttgtcgggaaggaaagggccaggagggcctggctgctacagccaggatgatgttgatgcactacgggctcttgccgaagagccggggattgttgatttgtttttgacatatccttttttctttctatggcattattatttcttagctgcttgtgttaaactgaggtgttgtcgtacatgaattctcaaagtatcaagtttggtgctgagttcccttgacgataatgagattgcactaacgaatggcctgctggagtggtgaatggagttgatacttctaatgcaccttctcagatatcggatcctcatggatatgatcctgtagttgctgaattggttgctgagattaagccacggtttggtttctgaattcatattttctatatccctccttgaagaagaaagtagtgttggtggtagtaattcagattttagagttcaaatccattgcactgatgttctccgggagtaacgaaaactgtaattttgtgataaaactgctgctaaatctgtagttttgtgatactatgccttaactctatagttttgagataaatgtgatgctaaatctatagttttgttatacacctccttaaatttgtagttttgcagtagtttggtcaaggtatttgtagttttgtgaaattcacacgaagaaccttccatatgacgttttattctcttttaggcttttagccttctaacaacaaattcacgaattaacattaaaggccaaacatgactgaattgccatgtatatatgtggtgtgtgagttaattctgaaatcagtgtgtgtatcacagtcaaatgccccttgtaacacaaaaggtgaaggacttcaatgcagaaattacatttatttctttgaacaatatgaagacatgcataattttcttttatccaagcaaatacactagtattaagctagtagtttaaatgttgactagactaactgaaagcataatcacggaatatgtttacatttatataagtctataagatacaatgccaaccaaaagtataccgaatttgtaacaaaagtctgtttcctgcagatatcatattgcaggttctaaaggtgtattctatgcaagggaaccatatgtgagtgattccgctgcacatgttacccgttttattggacttgctaatgttggaaacaaagagaagcaggtacatctatatttggccaaatcaacttagttcttcaaacatagtttctggttataattctactacattttcttgtattttgttcataatttagtatacatattaagttctagtactccctccgtttcacaatgtaagacttt

SEQ ID NO: 33948 - DNA, 11658 bp, Oryza sativa
attgtgaaacggaggaagtattagttttcagttatatttatcattttcagaaatgaaaatcttcactgatttattagtgtatttcagaaacctgcaacttatatggttacaatatctgtttcctacatctttaagtcaggttttcagttagcaacaacttcaacaatcagtttccaggccttctggcaaagtgggtccacttatcatgcgcatggtcaagttgaccattacaatttaccatgtgtacaaactggactgcacatatggctccctattggggctagggagaggagataacaatatgggtcctaggatcaaggtttaactaaaatagagttagttatgcacttacttgatggtggctttaccctgcgtggcgcactctcttccaagaccacgtcataagagcaactccagtgtggggcttaaaatgattttaatgcaaaaagatcgaactgtgtacactgtggcagtcgacgcatgcatgtcagagcaaaaatcaaactccaaagtatattcaaactcaaccgagtaaatagttcgttgccctgggccattggcacatgcaggcagggcagaatgtagtgattggaggaacttttttcaacatgggtcccacgattcgattcaacactacagctatcgaacccaaacctttattcaacttcggtggattgtagcagtcgaatcagcagtggagctgctctaaggccactttgcattgtaaatgccctagcagtcctgagttggccgtttgagaaatacaactgaacctgccttgtcaaatggtttagatggtagcagaattgcagttctgtgaacaaaatttgtgcactgattttgtggtagcagaattgctgaaatcatcccctgaagttgtagataactgatagttatgttaaatttctgttatcacatttactcttgatttgttgctattattcttaattgtctactcattattgcatattctttttcagaaatttattcatgcaatttctcctactccagcatctaccatgtccagtgttgatattcacgcaaggcctccaaatactactttatccccatatatttctccagcaaagtcagttcctgttgaagaaactccaaagcgtcctgctgaggatgctgatttgcaatactggcgttacgatgtcaagaagcaaagacatggtgaagccggtgggaatcgtctatgtttcaaatttacatcatcaggatcctgtcctcgagggagtaaatgcaattataggcatgatgaggaggccagggagcattacaataggaatgtctgttttgatttcttaaacaaaggaaaatgtgagaagggtcctgagtgtaggtttgctcatagcctttctgatgagggtgctgttagggatacaaaaccacgtaggtgagaaaatattccaaatctctcactctgtctgaagcacacatgcacaatctgccaccccacctactcacattgcacttttacaaattaccccttaaacttcttagtattaaatatcaatcaaatcctaaatggatagacatataaagttaaattgagtagtagtattataatatattttatatttttttatctatagcaaagcacaagcattcggctagtatactaagaattctgattatctaattgtgggattcaccctgtatttttgtttactacagcgaacgaagacgtgttgagagcagttgctggttctgcttgtcaagtccagatgttgaatcacatcttgttatcagcattggagaaggttactactgtgcacttgcaaaagggccacttgttccaaaccatgttctagttataccagttgagcactgctctagtacactaaagatgcccgtggaagctgaggcagagcttgggagatataaggatgctctggccaagtattttgagaaacaaggaaagatagctatatacttcgagtgggtttctcagcagtcccgccatgcaaaccttcaggtgaggacatttttttcctgatatgttgctccatgcttccatttaaatgatgctgtcatttggaatttggatgcttgtatgcgatctcatttgttttttgttcatactggatggtaatccactaaatttctgcgcaggctgttccagtaccattgtctaaagcatcaagtgttaaaaagatattccatttagcagcacagagactgggatttgaattttctgtagtgaatccaggtgaagttgtacctaactttatctctcttagtcagctgaatagaaaggggatagacaaaaacaatcttaggctgcgatcgttcccctgggttcccctgggttgggaacgtaaccctccggcacggaaaacggaatggtccattagcacgtgattaattaagtatttactaaatcttttttcaaaaatgaatcaatatgatttttttaagcaacttttgtatagaaactttttgcaaaaatgcaccgtttagcagtttgaaaagcgtgcgcgcggaaaacgaaggagaggggttgggaaccttgagtatagaacacagcctaaatgggctattcacacatcaatgagcatactgtgatgccaatacatcttcatgatgttgcttctctaaggaagtcttcctaaaagtttcaacaattgtgtatcacgtggccaagttttatgttgcttataattcgatttgccctgagctctctctttgttttcagatggtgatgctaaccgcgccagggaattgttaagatcagagtgtgacagcaaatcaagcttgttttatgttgagctaccagaaggttcagtgcttttacatttggttgacagtaatgagaagttccctgctcagtttggccgtgaggtatatataccatatgataatcgttaaggcctttttttgtctgaaaaataacctacatggggatggaaagaaaataatgatatcgtcgaaacctaactgtcaatctacaggtgttggctgggttgctaagcatggcagatcgtgcagattggaggaactgtaaggtttctaaagaagaagaaatccagatggtggatgattttaaacaagggtttcgtgagtttgatccagctgaatgacaatgtgcttaagttgctaatttgtcaccggacaagaacgtgctgctaaacttgcattgtatttttgtagttgaaagtacttaggtaggccatatttgagaaatggaccgactttgaggtccattattgtaatttctattgattgattcgggaacaatttttttttcagttaagagttaaaatttggccgtagtgccacgtttgttcttcgagacttctcgtatacaatgtgatgatctgaggcgatgggcagtggtcgaaattcttatatatcttttttctttagacctgtgtcctaaagtaggaaataacacatttttcttgtgcttgtcgatgcagaacctgattgtttttttcgcacttaatgtgtagttggtttgaggaaaaaaaagggtccaattagaaaaaaaaaaagaaaacatgaattcccaaaaaaacgagaatggaacgtactagcgtttgtttgaacatatgacaaatttgaccgcgatatcttttatcgcttcctattttctaaaccttgacttttgaaggagaaaaattagaataaaataaaaaccatatttaaaatcatttctcgttgctcgagtaacaaaaaaatagaataaaaaaaatcatatttaaaattatttcttgttgctcgagtcacgttagcctacaagggataacaaaatcaaacatttgtcacgtgtcagcagccaaaaaaagctcgaccaaataactataaaatcgtgcataacctcattaaaatattgataaaatatattaatactatggatatcagttcacaaatgcatgttagaactattaggagcggccaaacatgcatcagcccatgcccaccctaccccatgtctaggcatcccacttctaccgttgtcggagtaaacgatttactcatatcacgcgcccctaccactcacctttattcgagtaaacgatctacttcaataataaaaacaacttccctgcttccgatcccaccctacatggcgcatcgtgctcccaccattaccagaataaatgatttacttcaataaaaacaacttctctgcttccggtatatattctatttttctcgtacccaaccaaccactctcgcccccatttctttttttttctttttttcggatctgaatcgatccaccatcccagcccacaaatcggcgacacaccatgaaggaggacaatgacaccttggcggttgatggcggtgatcggcggctgttgaggcgacgacactgcttggggcctcgctaccgaacgctgggcagcaccttaactagcaaggaggtgttcacctgggccaatagcaaaaaccagcggctgctccatgtcggcgacattgatagaacaaacaagtaaggaattgacactgattttcatctgcatactctccttcaacttcacgtatgaagccccaaattatttttttgcaaatcaaattaacttgcaatctgcaatattacctgatctcaattgatgggctacacaagtcctacatttgcacatcgtgctccatgtggctggctgcagaggatagggtggagtccgccggtgatggaggttgtttgctatttttcttttactcgtcatctctatcgacatgaacgagaatgtttttgtatttttttcgtgcttgctagatgatggatggctgctactgcgcaacgtcgagctcatctctagaccacaccgctacatccttccatgattccatcatcgactactgctcgccaactggttgccctctccactaccagtcacaagacacataccatcctcttcatccttatagcaagatccagcaaagccactagacggatttttgacagaatcatttttttcttttctagtttgattcacctgtgagtaattttatcgcttgtgtgtgattgagcctataattttttcattcgtatgactattttgtgatatagatcactagtttttactcttatactgtatattgaacacatcagtaaacatattactacacggtggctacgagatcatggctatatcgataggaaagtgtaattattttactcgcagaccatgaaatctcaatttttactcttatgtattgtgtattgaacacatcagtaaacatattactatacggtggctacgtgatcctgggctatatcgagagaaaggtagtaattgttttactcacagaccacgaactgtaaacaatatttataatattggtaaaataattactagcattgtaagctggtagtaattcttttataaccatctagatatgacgtcatacgatgttgagacattcatgtgagtaaatatgttacttttaaatgagtagttgtgagaggcattcgttacttccaaaatgcgcagagatactaggagaacaaactcagaaaaaaaaactagaagctaaatattttactaaaacgcgaaaacataataactacatagaagaaacgaaaaaacagaaaaaattactaaaacatgaaaacagaataactacaaagaaaaaacgcacggataaggtggaaaggagaaaaaaaacaaaaaaaaaagtaggatgcagagaaaaaggtggggtggtaaaaaaacaaaaaccggagagaatgttatacggcgctcgatctattattccgcactctagcgctaccgtaaacatttctcgagtttatctccgtttcttttctgtttttttccgttacaacgcacggaccgcaacttcgttcgtcgaacgattttcaaacgtgcaacggctactgcaaaattacgaaccgaattacgaaagaaatcgaaattctcccccgttaataatccacgttttccgatgcatccatgactcattcttcgtccgttcgaccgatcgacgcgtattgtttggatcaggtttgttcatcggccagctagctatacctgcaggtagctcgatccaaattaaccaaaaaaacaaaagaggttaccttaaatagcctaattgcgcaattagccaccactaatcacgcagcgaaacacggtcccctcctctcttctcctccactcaccaagtcaccatcgcaccgacctcgccggccgcggcggccgcggcggcggcggaggcggaggcggaggcggagccagcaatgacggcgtcttcctccaccaccaactcctcctcctccgtctccaccgccgacacctcctcctccaacccaccgccgcaacacgcgctccaccgccaacacatcgccagcagcagcgctagcagcggaggcggaggcgccgcggcgccgcttccgccgcgcgcgcccccgcgcgtaggcggcggcggcggcggcggcgtatggcagagccaggcgtgcgccgcgtgcaagtaccagcggcgcaagtgcaacgcggactgcccgctcgcgcgctactttcccgtcgacgagcagcggcgattcctcaacgcgcaccacctgttcggcgtcagcaagatccaaaagacgctgcgggacacgccgccggagctccacgccgacgccatgcaggcgctcacgttcgaggccaacgcgcgcgccagcgaccccgtcggcggcgcggcgcgcgtcgtcgtcgagctctgccgccagtacgagatgctgcacgccgagctcgccgccgtccagcaccacctcaagctctgccgccagcagcacgccgctgcggcggcggcggcagccaacgatccactcgtcgcgaacgtcgacccgctcgctgacccggcagcggaaatgctcttcgccggcgccgtcgtccctaaccagaacgacgacgccatggtcgacgcgttctacgccgaccaacaaaccgccggcgacggcgaccaagagcaatacctcgtcaaggacgaggcactagctgcgcaaccgccgccgcaacaaccctacgagtacttgaactacgggacggccggcgacgagggcagcagccacgcctggtacaccggcaacggcggcgacgccgacgcctcgccgccgatgggtttgagcgatcagctccagcagtgccagatcggggccgcgccgccgttcgatgtgaagcctgagctgccggcgacgatggaacacggcggtagcgtgttcgtcgaacagccggagcagaagattctgccggcggcagggtcgtcgtcgtcggcggcggcgcattgccagctggagcttgggtgctcttctaatgcttggaaagttggaacacacgttattaattaattaattaattagtttctcgatttgattgattcggatatgatgaaatgcttgttgcatttcaaattttggcttgttgagttaggagttaattacaaaaataatcactagactagcttataaatagtcaagttttaattaatagtagatgatgtatctatgaatgagagtgcaaataaaaggctctgtctattaatgaggttaatgaaattttctacctccaccaaggaacagaggaaatcaccttcactatcaccgtttgagtttcgccatctccctcaaatcattggcaagagatgaattctgatccagttatgtccatgcattattcgactgaaatttgaggaaatctgagaaacaaagtttttacatatagatcttttcaaggaaaaaaggagaataaataataatgttgtacaaatgtttttttaaatcaaatttactcctttgttcttgcgagagatatataagtatcaaattaatcataggtgatgacggaaaaaggctatgcgcctatgcgacgtggctcctctattggattgtgatgggctgcctattgggctgggaagccagggagacctgcggctgggccaaatgagtaaggctagactatgggggtttgaaaattctgaaaaatatataaatactagaccactatttttttttcactagtgctcagtcctaagctgcctcaggtccaattccacccatggtgagaagagcaccagaataatagtgagaatgattcatatttttgttcttttggtgaaaaaggaaagaaaacacatactatcttcatttttttaatatagacaaattttactacataacattttaatttcgtggttttaactgtagaacactgcacaaactcactttttttttgaaggggggacactctataatataccgtggtaatttttcagcagacaccgcaccgattaaaataatgtatccgtgttgacaacgtgttaggggggccgattttttatgtcgagtgaccgaaatgcccttgcaccttttggtgatattgaccaggtcggcggtgctatttgccgacaccgaaggcgaacagcggcgattcgcacgttgtggccaaaagaaaaaaaaatgtagaggaggtcaagacgaacacaacggtggtacatgcagacagaatggccacgggagtcaacgccggttgcgatgcaagcgggttggagtttcggcatgtgtgtgcatgttgtgctataggctcgatttggctaggggagtgcattcatgtggctctggggtctctaacggcagccccaacccttcatctagaattgtgtttatggcattaactatattgtcatatatgacttttagcttatgtggcactatattaattaagagagagagtgaaaaaaggaagaaactgggtctcatgcaagatacagcttcaacacaagaacctatgtactagacgctatcaagttttgcattgggagataatagtgtcttcataatagatgaagaataaatatgattggtagataagagagataatgtatttattaatggcccactttaagaaaccatgggttgtagagtgtagtttctattgtgatgtcttagggcagtcccaacccatagtgtctataagtagtgtctatgatgctatgtcaataagacccccgggggaaatagagatgtctcctacgttacccataatatgtagaagtatcgacgtaatttcatagagtcattcgatctgaatgttacatgaagaacataagccagatgacggaacgcggagacctaggatgtagaacatcataacatgagcgattcggcagatttggattcctttcctatatatccactcatgtggtacttcatcatgcgattcatataagatccatctgtctagagatcgtcatatacatctagaaagccgtatgctttggaagaagcttgtacagtttgggaagaggttttttgagagaaaagaagaatctacttcaaccgatatgcccttaggcacggccatacataacatagaaatcacacgtggaaggggtggctaattagctagagcagcaggtgttgtagcgaaactgattgcaaaagaaggtaaatcggccactttaagattaccatttggggaggtccgtttggtatcccaaaactgcttagcaacagttggacaagtgggtaatgttgaggtgaaccagaaaagtttgggtagagccgggtctaagtgttggctaggtaaacgccccgtagtaagaggggtagttatgaaccctgtggaccacctccatgggggcggtgaagggaaagcccccattggtagaaaaaacccacaaccccttggggttatcctgcgcttggaagaagaactaggaaaaggaaaaaatatagtgatagttttattcttcgtcgccgtaagtaaatacgtaactaggaatatggaaaattgcatttttggaatttgcaataatgggatgggcgaacgacgggaattgaacccgcgcatggtggattcacaatccactgccttgatccacttggctacatccgccccttatccagctaaaggattttctcttttttccattcatcattattctatttattctgacctccatacttcgatcaagatattggacatcgaatgccactctttaaaatggaaaaaaaaggagtaatcagctgtgacacgaaaaaaaatgaatccttttgtagctcatcatttattggcaaaaatagaaaaggtcaatatgaaggaggagaaagaaacaatagtaacgtggtcccgggcatctagcattctacccgcaatggttggccatacaatcgcgattcataatggaaaggaacatataccaatttacataacaaatcctatggtaggtcgcaaattgggggaattcgtaccaactcggcatttcacgagttatgaaagtgcaagaaaggatactaaatctcgtcgttaactgaattcagaatagaaagattcaaaataaaaaaaaagaaataggtaagcggggaataaccttatttataacaagtttcaaactggtaaagtatacccctgggataaagaagaagaagagtgggctaaggaaactcgcaagaaaagtaccaaccgatcatctacttaagttcgaacgggttttcaaagcacaaaaacgcatccacatgtccgttttcaaagtacaaagagttctggatgagattcgttggcgttactacgaagaaactgttatgatattgaacctcatgccttatcgagcatcttatcccatcttaaagttggtttattcggtagcagcaaatgctactcattatagggatttcgacaaagcaaatttattcatcactaaagccgaagtcagtagtactattatgaataaattcagacctcgggctcgaggacgtagttctcccataaaaaaaaaccatgtgtcatataacaattgtactaaatatagtaaagaaatcgaaataatctttagatccatctaagatttgattcccggtaaaaaaatagaatagaaaaatatgggacaaaaaataaatccacttggtttcagacttggtacaacccaaaatcaccattccttttggttcgcacaaccaaaaaattattctgaaggtctacaggaagataaaaaaatacggaattgtatcaagaactatatacaaaagaataggaaaaagggctcgaatagaaaaatagaagcagactcaagtttcgaagtaattacacataataaaaaaaatggactcaggctcaagttccgaagtaattacacatagaaattcaaaaagaaatcgatacaatccatgtcataatacatattggattccccaatttattaaagaaaaaaggagcaatcgaagaattagagaaagatctacaaaaagaagttaattctgtaaaccagagacttaatattgggatcgaaaaagtgaaagaaccttatagacaacctaacattcttgcagaatatatagctttccaattaaaaaatagagtttcattccaaaaggcaatgaaaaaagccattgaattaactaaaaaaaacagatataaagggagtaaaagtaaaaattgcaggccgtctcgcgggaaaagaaattgcgcgtgccgaatgcatcaaaaaagatagacttcccctccaaacaattcacgctaaaattgattattgctgctatccaattcgaactatctatggagtattaggagttaaaatttggatattcgtagacgaagaataaccaaccctgtcttcccattctgttcagtaatagaataaaaaatgacaagatacttattttccctaaaatccctgaaaaaaagaagaaattctacctctttctataagattggggatcctctagag

SEQ ID NO: 33949 - DNA, 7691 bp, Oryza sativa
  unsure (1)..(7691): unsure at all n locations
nnnnnnnnnnnnnnnnnnnnnnnnnnnnnnnnnnatcttttaataaaattgctatgcttagtgtgtgactcgttagttttttttagggttcaaaaaggggattaaaaaaatagaatgaaccctactatgtaattatataaaatgaactaataaccaacctattgcttcgtattgttgagatcctaactaagaaacagtcactatatgaataaatacatctatcataaatgagtaaatctatcatatacgtgtagcaactgcaattttttgtttttaaaaaaataggattctaagttgtgaagcaaaactaaaggggatgtagataaaaggaaggatgatagaaagaaggaagagaaataagaaagatataggattccaatatgtatggtctatgaattacatcataaaaagcaatgtgataaagcatcaatataataaaaataacaaagaattcgaaatcgtaatttgattgaaacaagaaatacaaatttcaaggaataacaaagagtgtcccgagttaataaaactgagaaattgacttggaaagaaattttttggaagctccattgtgagattaaaacctaaccattaaaggagaagccgtgggaacgacagaacctatgactggataggattttcttgaaaagaatcccaatacttcattgggtgggatggcggaacaaaccaaaaaaattgtcttatttgataacaaataagacaggaaagagtaaatattcgcccgcgaaatttttattgaattagaatactttaccgcgattcaataagagtaaaatacaaaaaggagattaaaaaaaagaattacattaaatatagaatatagataaataaacatacacatctagatatattctagatcctctttcttgactatatattttagtattttaataaattcaatattaaaaaccctaacctttcctattaatgtgtatctatccgtaatattttagaatattgtggaattagagaaatttgcacactttctcatttgattcgcgaggagctggatgagaagaaactctcatgtccagttttgcagtagagatggaactaagagagaaccattgactataaccccaaaagaaccagatttcgtaaacaacatagaggaagaatgaagggaaaatcctaccgaggcaattgtatttgttttggtagatatgctcttcaagcacttgaacccacttggattacggcgaggcagatagaagcaggacgaagagcaatgacacgatatgcacgtcgtggtggaaaaatctgggtacgtatatttcccgacaaaccggttacaataagaccgaccgaaacacatatgggttcgggaaagggatcccccgaatattgggtagccgttgttaaaccaggtcgaatactttataaaatgggcggagtatccgaaactgtagctagagcagctatttccatagctgctagcaaaatgcccatacgaagtcaatttcttcggttagaaatataacccccgccaaaaaagtagtattgaaaataaaaaaccaggttcttctttctggaaagacaatatttctttcatccttttgcattgaaataataaattgaaatcaaaataatatgattcaacctcagacccttttaaatgtagcagataacactggagctcgaaaattaatgtgtattcgagtcataggagctgctagtagtcagcgatatgctcgtattggtgatgttattgttgctgtaatcaaagacgtagtgccccaaatgcctctagaaagatccgaagtaattcgagctgtaattgtacgtacatgtaaagagttcaaatgcgaagacggtataataatacgctatgacgacaatgcagcggttatcattgatcaaaaaggaaatccaaaaggaactcgcgtttttggcgcgatcgccgaggaattgagagaattgaattttactaaaatagtttcattagctcctgaagtattataaatactagtagacaagatatagatcaaataaaaaattagtagattgtgtttcacgtatatgctttagaatccaaaacgaaaagaaaaaagagaacgtgttgattatagaaaaattaggaggaacctagaattagagtcttatgggcaaggacactattgctgatttactaacctctataagaaactcggacatgaataaaaaaggaactgttcgggtagtatctacaaatattaccgaaaacattgttaaaatacttctacgagagggttttattgaaagtgttcggaaacatcaggaaagtaacagatatttcttggtttcaactttgcgacatcaaaagagaaagactagaaagggaatatatagaactagaacctttttaaagtgtatcagccgacctggcttacgaatttatgccaactatcaaggaattcctaaggttttgggcggaatgggaattgctattctttctacttctcgaggtataatgacagatcaagaagctcgactaaacagaattgggggagaagtcttatgttatatatggtaatcgcctcgcccatagcggtaatcgccccacctatagttatagtacccaaattctatcttgaacttcctatttttcaaacaaaaatacaatgtttttttatttgaaaataaaaaaagaaaaataggagaaaaaaaagtagtgtctatgatgctatgtcaataagacatcacaatagaaattacactctacaacccatgatttcttaaagtgggccattaataaatacattatctctcttctctaccaatcatatttattcttcatctattatgaagacactattctctcccaatgcaaaacttgatagcgtctagtgcatagattctcgtgttgaagctgcgtcttgcatgagacccagtttcttcatctcttcactctctctcttaattaatatagtgccacataagctaaaagttctacatggcaatatagttaatgccatagacaccatcctaggtggagggttgggactgcccttattgacatgacactatagacactacttatgggcactatgggttgggactgccctaaggtgcttaccaaggtccaacaaggttggtcgcagtctgaacaatagcaagggcatccggaacggcttggcgacattgtggacaccgagcgaatggcgacggcgtgcttcggcaaacgatctggaaagccaacatatctaggtgatcagtgaattcctggggattctatggttgcgtggaatcgagatgcaactcaccggagagcgggggatcgacgttggaagccagtggccggagttggagaagaaaaccccgatctcctcatcgctgcatccccaaccaaggaagataggggcgttgtagagggcggttttcaggatggtgatggcgcaagggttcagccggatctgcactgaggcgaccggaacacagggtcgacgtcggcggtagcgtctgaagcgcgcccgcaagctccttaggtgtggtcagggttcactcttatcgtttgaggactttgtattggggtcaccgaaatcccgaaatttccgaaattttgagcaaaatttagttgaatttgaacaaatattatccaaattcatgaaaatattgaaaaatttaaaaatttcggccgccgaagtaatatcgtatcggaggtgaccgaaatgaccaaaatttcaaaaatttcggaaatttcggtccgaaatttccaaccctgggtttggtcacgttcccgttgatccactattcaaaatggattaggaccaaaataaaagttgtcaggcatggcacgtaaaagacaaaatggaaagagatcgagaagaagctattcagtggaggattgtaccatcgtctccttcgcggccgccgacagatcggaaggaggagaccttggaagctttctgtcttggtttcaactgctgagacatgaacgtggaagacgagaaatggttcagggagcttaggggatgtaggcaagttctccatagaggcgtcggtgggggtgaagtggaggccgggctggagctttgccgacgtggcatgaaggagcttccacgacgtcttccgcgtcaatgaccaggtcaatatgaccaaaaggcgcaaggtcatttcggtcactccgcataaaaaatggggccccctagtgccttgttagcacggttacattattttaattgacgtggtgtccgctggcaaattatcatgattataaaatgtcttccccaaaagtgagttcatgaggttggatgcacaggaggaatggagaaagaggaaaagcaagtgattggtgccatgtaacttatgatctatttgaaattatctggtagtttggatttcaatgtcttttagagaaaaaaggaagctagatggaatagacgcatatagtcataaatgcggcccactcaaataattataaatacgcacgcacatagatcataaatgtggtttctaaggcctactcaaatagacagaggccaataacaaatcctcgatcttaataaatacctactaaaaatgtatctgcatatgcgcaatatttgtggtcactgatgtttaaaccttgttagatgaaatcatcccataacttcaacaccacatcacttgcgctttaaagcaaatttaatcaatctgtcatatatatactccttttcttgcctagagctccccctccccccccaacaaaaaaaaaggccaaaaaagtggcatgggagagttttaacacattcaagggagggcaatattgtggagtagccagtggtggacacacccattaggcagggtgattcgaccggcccaactatagcctgtgtcgccccacacctctaaccctcatttctaatattgtttctagcacattagtcattagttcactatcaaataatcatataaattaagtattttaagtaaggataaaaacatttatgaaaattcgtgaccaaatgagtattatttctgtataagtagtaacattttggccatacataaaatttgattttttttctatttcttcatcacatattatagtctacagtaaatagttaaattggtaaatatatataaaaaatccactttactcccatgaactattttgacgaagcacttaaccggttaaccccccaaatgctttttcatctcgttttatacccccgaactattaaaagtggttccccttagtgcctcaatatttctcttttgtttttatatctctctacgtataagtcatatatataagttgtatttgaacataaatttggtaggactcatatatccattataacagtgtaacctacctcttaacattttgttaataattttatatcactattatatatgtttcgatgtacttattttgaaaatattttgatactttgataacggtgtaatttatggcttaaaaaatttctgcttaaaatacgcatcgtataaagagaaacaacaaagggaaatactattaagaagcaaaacaaactattttcaatagtttaggggtataatgagcaaaaaaatatattttatgggtttattgatacaatggaacaatccacaagtgtgaaatggcatttttaaatatgaatatttccaaaggcctataattttttttaaaaaaaataaatgattttgtgttcattcattttcatccctaattcctggcatgaggcacccatcgtctctcatcttcgtgactacgtctactgccctgtctatctgactctgatgtttgttcaactgctaattttcgttgttaaccaatgtttgtgtggtgtgctagcgcaccggtgctgtgagccgacgactatgatttatatgcgttgtgccattatcaaattagtaatagctctttgcaagataatgctgcgttcgccgatgctaatcaaattaacacgccctaatgttgatcgccgtggcaaccaagtcatgaggtaacgtagatacccccttcacatcaacttgcacgtgcatatctacacggctgcacccagtcagcaactcagccacgaagaaaacaaaaaggagacaagaagaattttcttagccattaagttgctatcatcaacttaatgcatcatcctaacaagaataactttctcatgacagtgagcgagttaacatgacttggctcattaataagctggtgatgatgatacgcaagcaagcaggcatcatcctggaaatttaatgcatccaaaaatccaggtcctaacgcaaacaccattgaagtacacatttttaatttaagttgtagcgtagtaccaattgtaatattatatccatcctagaagcatccgaacacaataagaaacaaacaaattaagagttgtcacgcgctaggattttgagcggccaagttagagccgtcacttagtgagtaaccttggcctaatcaactttctcgacacctaattaattcaaagagccatcatcttttgttaggctgcttgcgtaatcgagctagtcagcccaggaaatgttactgagttactctaacaaatgtaataccccaacaattttactctttctattctcaaataattaattactctcccctttttaatggataatgtcacgttttactattctccctatttaaaaaaattatttaaataccatttatttcgttgtgatatattttagtattatagaaactttaagtatgacttatactttaacatatttatactattttttaataaaacaaatggtcaaacattattttaaaagtcaacggcgtcatctatttaaaaaagaagatacgattatcattttactcttacaaaggtaacttctaatagttagattgtgatgaaattacaattatatgatcatatttcagatgcaacacacgtcgataatataatattttttttaattatatggtagacgcatacgcacacacctctacgcatgcaacaccactctcactctgtaaatgcgccccctaacgcatgttgtaagagacggaaaccggtgataaattcccaatctcactaaaatttctgttcaaagcgtgttttgagtatatgtaaacttattgcctaaagagaaatggttaaagtgtggatagtattcactaacacatttgtataaaaaatggagacagacaaatctttgcgaactctgcatgtacatttttactttatttgatgaatatatgaatacctttgcctttacaatccttggtttttcaatatttatccctttgaattcattttgtaagcctaatttcctgcacaatttattacagcagtctcccagtctcctctgtcaagccaccgccatactaaaccaaaacgtccaagccaaaccaaaaatagtgaaaatacacacatgcatagtagtaaaaaagtggattaacaacggaccaatttgcaggggaacaaaccggcgtacgaagctacgagcatggcaagctggcaatctggcaggcccggtcaaagtttgactattttgcccacaactcagacgcgccaaaatgagccatcgatttcttcgttataatttaatcttacttttcaacttaaaaaaacatagctaattacgtgcacttataaatatctatcttccgatcctcgcaaccatagcattatccagcagcaaaaagattcccctctttttgtgcaagcgagaccaacaaagtgatcgaaggcgcaaacgcaaggcaaagcagagagaggcgcgcgatggcggcgccg

SEQ ID NO: 33950 - DNA, 1899 bp, Oryza sativa
  unsure (1)..(1899): unsure at all n locations
nnnnnnnnnnnnnnnnnnnnnnnnnnnnnntcggaggtggacgcggaggcggaggagctcgtcgccgagctcccggacgagcagaggcggcgccgcctcgactccatcttcaactacacgcagatgctcaagcagcgcgcggcggccggccgccggccgcaaccagcaccggcggcggctcagctttgactcacgtggttcatatggtttaacttcatttgattctttgatcaaatcaggaattcaggattcatttgcaggagaagaattcggatcagatttgagtttgctcttgtgttttgtatatagtatttggtttacatgtgtgcttggcttgtcaagttttgtgcagattacttgcagtgttgttgctgcaggaaaatttccctttttcagttttgggcttgtgtgtatatacggtactgttctgttgtataattttgtacacacattttacatgtgattttggacatatataaattctttgatttatttatgaattcattcatgttttacgtaaattgatcaatattgtgtagcatcatatatgtattattttacggatggggattctctgttacatcctctggtcactaagactgtgttctctctccggcacacaaaacgatgttcgtattaatacgtaattaattaagaattagctatttttttaaaaaatagatcaatatgattttttaagcaactttcgtatataattttttttaaaaaaatacaccgtttagtagtttgaaaaacgtgcacgcagaaaatgagagtagggagttcggaactcccagcaaagaacgcagcctaagtgaagattgtggtatataggacaccaacgcagtgtccctaatgtaatttttttttgccaattgttgaatatttacagaacaaaacaaaaattcgagaaaaatctacatgttctgtattttctatgtatccaatctaattagttaagaagacattggtattcaaagtttaaaggtttgaccacatgtttacaaactacttcaaacgcattgcctttggtcggcaactaaaaaacaacacggcaaattctcaatacatattatagcatactctacaatttttttttgaatctctatattagtctattggtcaaaccaaaagctagtatttcattgttgcaccaaagcatgtgactaaatgaaattcatatgttcttttttatttgatggcttttaaattcgtactaggcattacggacagggcctcctctaattcaaagcccaacacttgtaatccgctcaagcccaaagggcccccagaagatttgccccctctagttgtctgctctatcgcgggctcggcctttcgtcgaacagctggtgcgcgtcctctcatgtcgagcacctgaccgccggtcacgtagcggcggcggcggcggcggcgcggcaagatgctctcccgcgcccggcgcctccaccccacccttcagcgaatcctccggccagtccccccttccgcccatcctcctcctccttcttccccacctcaccgccccgtcttctcccaaacccctaaacccttcttccccttcctccgccgccacctctcgaccaaaccgccgccgccgcaggcgccgccagagaagtcgctggctccggcgaaggtgagctccgatccacctgccgtcagcgcgaatggcctctgcccgggatgcggcatcgcgatgcagtcctcggacccgtcccttccgggcttcttctccctcccttcgccaaaatcccccgactaccgcgcgcgcctcgcccccgtcaccgccgacgacacccgcatctcggcctccctgaagtccggccacctccgggagggcgaggcggcggcggcggcgtcgtcgtcgtcggcggcggtgggggtgggggtggaggtgga

SEQ ID NO: 33951 - DNA, 9797 bp, Oryza sativa
ctgcgcctctccggggtgcacctagtcagcgcggcgcgcgggtggggcgtgctcgacttgctcgaccacgttcgccagctcgctgggtcgcgtggcaatgtgtgggcagtgggtgcgagaaatgttggcaagtctacactgctcaatgccattgcccggtgctccgggattgaaggcggaccgaccttgacggaggcgccggtgccaggaacgacccttgatgtgatccaggttgatggcgttcttggatcgcaggcgaagctgttcgacacaccgggcttgcttcatggtcaccagctgacatcgaggctgactcgcgaggagcagaagctggttcgagtgagcaaggagatgcggcccaggacatacagattaaaggtgatatatatttgcacatcacccactcaaccccagtcgtgtttgtgataatgcgcaattgacatagttgctgctcattttctaaatttcagcacaaatttcttgttaacgagtctagattttctgtagttctctgcaacagaattgaagatactttgcttaagctaaacttttgttcccgcattgaaagtagttcggtaaatcaattattgaggaaatgctgtggaattgaaacaagcgaacagacattgcatttacaatgttcttgtgacatactagtcacatagggaaaactattatcaactccatcaagttccacaaattgttgtgaacaattctagcttgttctagtcctttataacaaaattgaatctgcttttggttaaaagctattatcgattcgaccaagttccacaaattgttgctttccccctaaagacagtgcagtaattttgtaactgaacctgacaagcacatgatactggattggacagaaaatttgcaccttttgcacttatgaaattctaagtcttaaacttgtgacagtttcagttcttagacttatgactgggaatcatggctgactcaatctagatgtgatcctttggtttccaaacactcttctattgccacaggattcttcactcttattatgtgtcatatgagatgatgcatgcttatctaaaacttgttggtaacctatgcagccagggcagtctgtacatattggagggctggtgcgcctggacatcgaagagttaactgtaggatcagtttatgtaacggtatgggcatcaccacttgtcccacttcacatggggaagacggaaaatgctgccgctatggtaaaagaccactttggtttgcaactacaggtatatttattacctgaatgaactttattttctcctaattcatgtagtattgcttaagattataacacaaagttctacatggtgtctttcctgcagcctcctattggccaacaacgggtaaacgaactaggtaaatgggtgaggaagcagttcaaagtttctgggaacagttgggatgtgaattccaaggatattgcaattgctggtcttggctggtttggaataggtctgaaaggagaagcggtattaggactatggacatatgatggtgtcgatgtcgtctccagaaactcccttgtccatgagagggcaacaatatttgaggaagccgggttcacagtttcgaagattgtctctcaggcggatagcatggcaaataggctaaagaaccctaagaaaataaacaagaagaaggataacaaagccaattcatctccctccacagatccagaatcttcaaatccagttgaggctgtagatgcttaaatgatttctattcctttctaggacaggagttcccgaaggtgaattaagttctatgatgttggcatttggtcagttgaggattgatatacagagccataggttgcacaatttatacttgttcagacttagatagcatgctgctctccgcacaagtctttttttttttccctgggatcatggattttatgtagtcttgttgtgggcttgtaacattaacctatggcttttatgtactcaatgaacttctaccactatggctttggagtttggaccataagtacaattttgatagtcaacttgatgaggagtcagtactgaagaatactcgttgtaatgctgttatggctgaacttctgaaaccggcatctcacagctttgttatgcctgctttgaacacaggaattttacattgattttataggaataccacaggaatcaattgaatcctcatggtaaattcctgcacttcaaaggaggccatatctgaccatctcctaagttatttctgcttgaaatgaacatgagcctccagaccgaaactttaaccttaccctgtttggatgtatgaagtaatcaatcactctgctctgcatgctgaagctaatattagactttatgatgtattgcacaaaagtaagtaaagatgatctcaaatgccagatttgtttggcacataaagatggtgtactcttttcaacccaaatcatgggatgccatctttgacataaagtacaacctttatggattaatttaacgaaagcatctatatgaccacttcatattaataaggtcggttgttaatggtgtgcttaaccagaattgggaaagaggaagcattttggtctaaatgtgttttgtttgctcatgcattttggtctatcagtgccaaaccatgtattactccatataactacctctatctacttcaatcgaaggccaaatccgactacctacaataaaatgtttactaacccctgaactttgataatggtacaaataattccatgatggttttaaagcaatttcgccaagctaactgcacgtgtgacttcacaatcaggcaagttaaagtggcacccaataagacatggttagaagagaaatgtagatgagctaaatatataacttattacaagagaagaaaaaatatatatttccattgatatatgctaactctaaatcaagagtagtacaatcatcattagacaatattgctgttgccccactacacgctgcatgcattgcactatatataccaaagtaccaaacaaaaccaattaccaagaaaatcaaaatcagaattgaacaagttgtgcataccgaatctagtttaagttattcaggttgtcaggaacattcaattacacataaaacaattcaattcatgttaaaaaaaaagcactactccctccatcctaaaatatgtgctccttctaacattcaaaagctaaattatgaggtgagaaaaatgaccctggatgtcacttattaaatccctagattattggaagtggaagggtcgttgggataagacggggagaaatttgaatagtgattgatgtgataaataatacaaagagcattctttccgaacaaattttgaatccgaaaggagcaattattttgggatggagaataattgaattaatagtaaatttcactttgaactatctttaataacaaagtttctccatgaattaaggttgctatttgttactgtttggacctgtctgtgtccaaaatgtcaccagactaccacaatagtaatgatttagcccaacaaatttgagacaattagtggccgtccattattgcgctaaaagtttgcttgccaataaatggaagttgtcacttccagtaaaaatatactccaatagaagttgcatcgactgtgtcattaagccgacaaagcagcctctgggtggaggtggatgctactcctacaaagatggatatgtggcacccccttttgttggtctttggaaggaggaacaagttcatgtctcactagctaactagctagaatgagttccaattattgatcatgcatattgtaatgtggtcacaacctatagcttagactctaccaactaaatgcaccatgcttgagcgtggccaaatatatttctcaccagtcaccccagagggccagagacccaaacgtgtgatcggaatgtctttaagttaaacttttaaaacttttaagtaccaatatatttttaagtacaaatttgtattaatttatctcaaaagatagatttcataatgtttattaggttttgcaaatgaattgcaatagaagctagccgcaaacgctaattagcgactagtcccactctctttccaatttttttctctttttattgaatttttcttttcttttgggctccccctaaatttatggctcaatccgagatagctgatttcttgtgtatgattttttttctatacaaagtttcaacaccagtagaaagtttctatatgctagtacaaagtttccatattgtattgaacacggcctgtttgcctttttcatgtgctgttcaattttttctagatgcttatgtatatatacaaactctgtatattatgcgtacaaactttttatgtctaaaatgtatacgtgtacacaaactttgtatattatgcgtgcaaactttttaggtttaaaatgtgtatgtacacgtataattttatttgatattatataaaaataccccccccccaaaaaaaaaaaccaagcacggggagaccataatggggtgcacatgaaaatctttttttacgtccatgagtaacatgcatggcgtggagaacaattaattccattgaagaagtgtatcgatttttcacttttgctataaagtagtatatgataaaatccttatttatcatgaaagttgacttcttattcttaacatgaatcatgttttggaaaataaaaaattgcgtgaaaaattctacaatgacaaataaggaacaaaatatattgagaagcgcagcatgatggtaccctgcaattaattaatgatgcaaaatttcatctcatagtcgtagtacgttctagtattaaaagataataaagatgaattttacatgattgtatataccttgccctattgaacaaatatttttcccacaataaaaaagagagataatttaaatatactttttttgtgtatttgaagcacgggagtaccaatctttttggaacttaattgtatatactccatccgttccattttaagtgcaaccataaattttcgtgcctaactttgatcgtccgtcttatttaaaatttttttataattagtatttttattgttatgagatgataaaacatgaatagtactttactcgtgacttatgtttttaaatttttcaaaaacttttgaaataagacggatagtaacgcgaaaaaatcatagttgcacttgaaatgggacggagggagtatattagaagtgctctcccatgccgtggtgctagctagaggtagatctctctttatcacacctacctagcttagctgccttttatgtcttctctgccctgtcattttactgtcaataatcgaaatcgaaaccaatcacactcgcgaccgaccgacgccctagcctagccactgcacgctgtttccaaaaagaacggatgaactttttgatagatcatatcgatcgatcattaattggtccatcttttacgatctcgattgattgattgattattgatgatctggttcgttgccagatgatcattcatgcattatgcacgtacgtacattggcggagccagaaattttctaagcctagggcttgagtaaggctcaactaataagatattggctttctcaaaaacaatacaaggtgatttaaaaggatttaggcatgtttatggaggcaagcctagggcacacctctgcgtacgtatgttctgaagttgaagacaacttatgtatgcaaatatttaatttatgtattcttaattcttgcgatgtttcatttgtcacttcttaaaaatacattttcacatgcgcatggctataaagccattatttctaccggcgtttaattaccaacccgctgatggctccgctattttctttgagggaaccgtctatggaaataaaattttcccatttcaaaatatcatatttcacgtaaaaaaaaaaaactcctaacaccccatatgggttattatatgcccacgcagttgcaagccacgagtcatgcttcctgtagtcttcaacaattgaacccacgacctcaagtctagcatgattctatattaccatcgctctcatactcacaaatgaatatcaaaacgaatatttggacccaaaataatttgaaataaaaaaaattcaacttcaaagttgtagtcttatccagggctataatttttatataaagtttgtccagccttacatttttagatgcggtttcttaagataactgtatgcaaaaaaaacattttttcatgtgattttagaccacaagactacttgtcattatcacaagagaatttttctattattcacttttagaaatgaaaccagcttctttggaaaaatcgttttctaatagtgtttgcaaataccaatgcaaacacatgtatacatcatgctctttattaaagcagcagatcgacttggacatccattaattaattatctatatatctattatgcatgctctattaattccttattgactaagttttcgatcgcagcacacgtagatgaaccagttgacaagcaataggaagggaagggagattcgattttaggcgtgtgaagcttcggaatgagggaatctagctcgagcaattgtttatatgcacgcataagtgtataaatgtaacttaaatatatacttttttgtgccaaaagtaattgttggttttgtcttcggattaccaagatttgatcaacaattttgttataaataaatttaccatcgaagttgtttcacaattagatttatataatcaaaagtaatttacaaatatctaacaatcaaactaattccctttgatgttagcacttatataaaaatatgaagtttatcttctttcagtcaaactgagagggagtatcaactagctgaggaccaattactgatgtttgatgccaaactcatgactaagtgatgccgagatgtcaatgtcccttgatttgatctgcctgcatacacactactggtacagcttttgagagtgccaaagctccccaaaaatgatttttgaagctgactggtagtagcaactactcgcgccgtgcatgaatatgctctagggattagaagaaatagaattttgtggtgctaggcttattctattttactactttataattaattgtaacctcaattttttgtgtggctggcatgatcttcgaaattcacaagcatcacactaatatgtttttcttttcttaaataatttctgattgtcgaaacatgatttcggcaataataaaagggggtagcgcaaccaatgataatgacaaagacgctcatcagcatttgcatagtaggtcaaccgtcaaggtgaaataataagtcggcgaaaacataatcatccattagcaacagcggagatgtcagggccgatgaagcagaggtgctggtgacgatgtcagtgacaataatccatcaaattaatgttatggctattgtagatgcttcacttggaggagagttgatgttgttgtctaactcgtccaaaccgaaatatttgaagttgttgaagtagaatgtctgctccgaatcaaagatgaagataatgactcctggagttgactcgttggttgatgaattgatttcttcagcttgacataaaatttgtcaaattttgagccttgtatttgtgtagcccccgactctttgattagttgggaaacaactgaacatagagtcgagaactgtagcttcttgtcgtcgaatagtcattgcttgattgaagatatgtgttgaagatgtccaagtagaaatccggtggtgaagacgcgcagttgtgaagataaaagcaccagtcggcggcggcataaccagtcggcgacggaagacgatgatgtccatcagtagtggtagctgtataaccagacgtagaggtaagggcactagtcagcagcagacgagacgaccggcgatgaagatgtaggtgcccaacaacagcggcataataggccagccgtgtaggcggtgacaccagtcggcggcggatgaggcggccggtcggtgaagacgcagacgcccatcaacggtggcataataggccagccgtgcaggcggaagcaccagtcggcggcggacgaggcggccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaagcaccagtcggcggcggacgaggcggccggtcggtgaagacgtagatgcccaacaacagcggcataaaggccagccgtgcaggcgaaaacaccagtcggcggcggatgaggcaagccggtcggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgcccgactagtcataaccaccaagcatcgggagtcggcctaggcacttcccaaacatgcatatgagtgacatgagttcgtcattaatggaacaaagtttcacggatcagaatttactactcaggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcaacgaaggtgagccaacggtgaggacgtagacatccaacaacggcggcataataggccagccgtgtaggcggaggcaccactcggcggcgacggaggcaggccggcggtgaagtcgtagacgcccaacagcggcggcataataggctagccgtgtaggcagaaacaccagtcggcggcggcgaaggccagccggtcggcgaagacgtggacgcccatgaacggtggtgtgaccaaccaaccgtataggcgaggacaccagtcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataatagaccagccgtgtaggcggaggcaccactcggcggcgacggaggcaggccggcggtgaagtcg

SEQ ID NO: 33952 - DNA, 20512 bp, Oryza sativa
aagtcgtagacgcccaacagcgccggcataataggccagccgtgtaggcgaaggcaccactcgccggcgacggaggcaggccggcggtgaagtcgtagacgcccaacagcggcggcataatagaccagccgtgtaggcggaggcaccactcggcggcgacggaggcaggccggcggtgaagtcgtagacgcccaacagcggcggcataataggccagccgtgtaggcgagggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcagtgaagtcgtagacgcccaacagcggcggcataataggccagccgtgtaggcggaggcaccaatcggcggcgacggaggcaggccggcggtgaagtggtagacgcccaacagcggcggcataataggccagccgtgtaggcgaggacaccagtcggcggcaacggaggcaggccggcggtgaagtcgtagacgcccaacagcggcggcataataggccagccgtgtaggcggaggcaccaatcggcggcgacggaggcaggccggcggtgaagacgtagacgcccaacaacggtggtgtgaccaaccaaccatataggcgaagacaccagtcggcggcgacggaggcaagccggcggtgaagtcgtagacgcccaacagcggcggcataataggccagccgtgtaggcggaggcaccactcggcggcgacggaggcaagccggcggtgaagtcgtagacgcccaacagcggcggcataataggccagccatgtagacggaggcaccaatcggcggcgacggaggcaggccggcggtgaagacgtagacgcccaacaacggtggtgtgaccaaccaaccatacaggcgaagacaccagtcggcggcgacggaggcaggccggcggtgaagtcgtagacgcccaacagcggcggcataataggccagccgtgtagacggaggcaccaatcggcggcgacggaggcaggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaacaacaaaaaatagcaagagattaatctgagattaaaaatcaatatgataaataatgataaaaatcagattgagtttccccctgactgatttggatcaagtcagagaagaggagcttgaagaagtggtcgacgggaaggaagtgaaaactcccaaagcgaaaacgaagtcggcgactcatgaaattgattccatcgcgctcgttgataggaaactcgacgcaacccctacctggcgcgccaactatcgaaacatgatttcggcaataataaaagggggtagcgcacgagacctaaaagtggatggatgcagagacaaaggatttagacaggttcaggccctctcaatgagaggtaataccctactcctgtttggggatttgaatccgccgagtgtgtattgatctgacgatcaggttgtgtcatgcccctagagggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatattccatagatataagttatcccctatgactagtcggataaccatgccgtatgggtatggggtacccataatatccacactgatattgtcgaggctcgcaattcatgttgattcggaattccattggtcgtcttgatcgtgaaagtatgaatatatatgttccatttttttaaaatgtctgccattgcggagactatccattgattctaaattcaattggccggattgattgttaaaataattttcccactcttcctgtctagtatgatctatcatctttcttcagaaaaaaaaggatcaattcttcataaagtttttatttacatcgaataggaattagtgctactttgatcatgtgtcaatcacatgacatgactttgtttcatttaagttatctgtggattttatagatatatagtaattcctctaaactaacaagaatacggtcaagcatgcatgttaatagccattttgaaacttttctctgtttgtcacatatatatggttcaaacttatttaattatgtaattttgcatttgtatattcatgaaatgaaagttacctactggactactagttcagatatggctttcattgttgttgtgtgataagcatggtttgcaatttcattaattctttttttaaaaaaaaatgaagaaattttgattaaattcacaaaaaaaggaaatttttgaaaatttcagccaaaattgtgtcgtgccactggaggggaggcattctgttgacggtccttaagtaccaaatccgaccgtcaattcatgcataaaaacaaatgaaagaatataaagtggaataccaaacttagaggtagtggttattactaactattttcacaaatcttggtgaatatttgtatgcaggtgaattatggacgaaaaccatccgccatacgacgaaatacacctccggatagtcggacacgaatacacaaattagaggacccacatgtcaatcaaaaccaccaacaattgaacccaaccaagatacaatatgcaaagggcccaccaggcagccccccagtagaagggaggtcaagaggtgggccaaaggagtcggttgaaccactaggtcggccgaactgcctttccttcctctcgccatctgctgatatgtggagcaagatcctaaagtcccaatggaagttatgtgtggttcccaaatgttggttttctgtctgggatgttctacagatgttggcctatcttcaagagagtcctggaggagcgccggagttgttggccctctctcctcgtttgtacctcggctgatgcttcttcaatataagtaagtatttgagattcccttctggtatttaattaacttacttaagtgagatgtattgtcatcgttgtgggttcgtcgcttaatatttatattgagtgctctaatactaagactctggataaagaagaaatttttttggccgaggctagagtagtaatcgataacgtagacgtggtgtttaggttagaggttgccttcgtttgttgtgtgctccatagaaagtgaggtaggcgacaggtggtgacagttcagtccgtccttcgtatccctccacgtatgggtacatcatagagctacaggtcgaactcagctggatagacatagctgggagagctggtatccgaagcaatcgatagagttttacctttaacttaagtatactccctccgccccaaaatttaagcatttttggattctgaaacggtctccgagatgctactttgaccaacaatatctataaaagtaagatattttaaataaaaagagttatatattatgatagtttttttaatgataaatctagtaacatcaattttgcacgattgatcttttttattttcttgttattactccctccattccataatacaaggcataactactttttaaagttgtttcataatataaggcgtgcatgcatgcatgtcattaactagcacatattttccattcaaatattattatttaaattctccaccatcaagatctctaattttattgggtgcatgtattatatttattagggtaatccaaactatgaggtgataataattatttcttggtctttgggttaagagtggttgtgccttatattttgaaatggaggaagtaatagtcaaagttgaaaatatttgacttctcactattctaaaaatgcttatattttgggacggagagagtagttaattaactcataggaatcctctagcctaagcctaccatttattgttgtccttagttgaatcctttttctagatgtacatacatatttcttgtgatttgatatccttaaaatactccaaagtgaagttctataatagtatccgtgcaattgcggacttatctgtgaccataacaaataccagcacgctccgacattgctagtgagtaatcccactacccacacaaaaccccgctgctagtttcatttcctatatggtagtataaattttcgaagagaaaatgaactagaagtgagataagcgggtaaaaaaatcatgcttgcccatcctacttgcatccctaaccccaagatactcgagctccatagattaatcactctcagcaaattgatcatgagttgataattagcagggttacaataatatgatataaatcttgcttagcacaacctttagtgaagcagatattgtatttaagttcaaatcatgtagattttagctctaggctagctgctctgtgcaattgcacaattgatgtgtgcatataccttcaataattccatatcttagtgctactttatcaaattgtgttgaattggtgtccattaatttctgatcaaacaaattggtatccacttaaaagaataaaggcacactatttctccaaataaaatggaaacaaatttattaaaagaagactggccggctggggtctaaagaggttaggcaacaccttcaaagtgaagaaattactaccatgtttcacataagtggctagtccttttcacataccattttactttgcaaagtagtgtaaaaagttcacttttcaatgtaaggtaaaacagagtagctttcactagcttaaaaagattaattttgtccttgctttcggttaagttccaatgattagcgtggaaaacacacgagttagagacatgcacaatttatataatatatatggtggtatagcttttttttagtgctctattgcttaaaaaaaatcaaagtataaatatgttttatgatcttacaatagtgaactgattttgaaaaatatgcacggatcttataaagtgatcaagattatagtggcgtgtttaggtgaaaagggagtcttacttgtgtggttctcccggattcttcacacagatttcttcgactgataaaatcataacccatgccaaaaccatgcatatatttatgtgaattataatataatagtactttttaatacatgtaatgagtggactgcaagcaggatagcatgcaaatttatcacaaccagacaagatggaagaactgactgtatatttgtcttccataaacattgtcatttgccaatcaatcatcacctcctctggctgtatactccatgtgttgccaaacacagatttcttgcagaatctctgagtgttttcagggccagatgtaaggagcagagaggaactacaattcagagccaaatcacacaatattttgagacctgaaaactggggccttggctacccaatgagggagcaaaacgacagctcagcaatcaccatgaagcagttggcagcctctgattgggctgctccttgcttacctgtcccttagtagaaccccactatacctgtttctgtttgttcttcctgttgacagcttacttacaactgaagcacaaaggcaccaccatcattcacacccagcacacagcaaatgcatgaccccatgttttcagttgtgcagaattcatgcccaggttgtagtggcctttcagaaactgaaaccagttgagagtgggagccaatgcaatcatgaggatcgcgccaattttgcgcaatattcgcagtatttacctagtaaaattctctgaaaattaatcttgatatagtgttccgttcaaagaggtggatcaaatcctgaacaattttgttcggttcaataactcacgctgtttgcgcaaatattattcggcttatattttcttaactagtatcacaatatatcactattaaatttatattgcagattcagaaaggaaagaataatcaaattatgaaccaaaaaggtagcccagcacaaggaacacaagtacatcttcctttcctccctggtgtccctcctgcagtttccttttgcttagcacaggggggataaaacttttactgctgacaatggccggccacagcaaaagcctcttcatctgtggggttggctgatagctatcctgccctactacatacctttccatgtctaatatctgaagtcggttgagaggtgaattcagcagaaaggggttgttgcagggggcaaggtatctcaggggaaacttcttgcagcaaactgcacacggtttggcttagctgtgctgccacattttctcactggctgcaagcagcttagctagcttgtactcactactcccctatctatatatacaggcaccaactcttgtaaggttcagagttcaggtccattccaaagttgcaatcaatctgtctcgattattgcctctctgctctgagtgtgactgtcaatctgtgagcttagctagtgactggccattgcacgagaaaagaacaggttgatcgatcattagtaggtgaagtgttcttgccctgttcttttcttggtttcttgggtaaaccaactggttgggttcggtgagtttgagaacttcagaaactgtaacaacaatgggaggcaccatggattacctgtctgatcttctcggcggcggcgggagcagcagccgtcggaggtacaagaagaggaagcagttccagacggtggagctcaaggtgaggatggactgcgacggctgcgagctcaaagtcaggaacgccctctccagcatgaaaggtataaacacaaccaagatctctctcaactctcactagaaagatcaatttctacagttcttggaatcatttcattcatggctgaactgaaatgatgccattctgtgaacaattctggttaatacgcacaaacatacgaccaaaaatatctctgaaatcatgccagaaaaatcaaatttctactgcatgaaaggtataaacacaatcaaacacaccaccaaaatctccctgaattcatgccacaaacatcaatttctacagttcttggaaccattcatcatgcatggccgaactgaaatgatggcattacttaatctctgtgaaatgattttggttaatacacacaaacatacgaccaaaatctctctgaattcatgccagaaagttcagtttctacagttcttggaatcattcatgcatggctgcaatgatgtcgctacttaatatctgtgaagaatccttgttaatacaaacaaacatacgaccaaaatctctctgaattcatgccagaagcatcaaatttctgcagttcttggaacaattcatcgatcatgcatgactgacaactgaattcttgtttggatttggatggatgcaggggtgcagtcggtggagataaacaggaagcagtacaaggtgacggtgcaggggttcgtggagccgcacaaggtggtgaagcgggtgcaggcgacggggaagaaggcggagatctggccctacgtgccctacacccttgtcgcccacccctacgccgccccggcctacgacaagagggctccccccggccacgtccgccgcgtcgacgccgtcatgcccgtcgccagctacggctccgccgccgctgccgccgcgccggaggagcgcctcaccaccatgttcagcgacgagaaccccaacgcctgctccatcatgtgaattactgtaactgaatattagtgtaatctcttcagagttcagatgaatgtacgaaatgtatgtgcagatatgagagattgtactccctccatcccaaaatataaaagaatctagaatctggatagttgtctagattcatagtattagaaaatatcacatctagtcatagattcttatattttaagatgagagtagaaaggagggatttttctgcggttttggtctcttgtcgcatgtgcattggaatcttagcccatatagctttatttatactactccgtatatatagtttaattaggttggtagattagattacaatatacatatatatatggagttgtgtgctgttatgagacatatggttgagttaataaaatacatgatatgcttgtacttggtggtgcagctggatttcttctgtccggccattgccttttggtaatagcaattagaataagcaagttaattaaaggtacgtttgattggttggcggctacagttatcattctaaaccttagacgtgtcacgctttgttaaccggttagctcttataattatgatgatgtgccagtacttcactagttcttatgtgtacactccatttctcgccaaatcttgtcacacttgtgaccaagatagaaattgatcatcgcacatagcaacattagtccccagatttctctaggacaagagcaaacttcccgttgatttactgccactcatcccaggccgcctgtgcaaggtgcattttcagcccatccatgataagataaagggttgtctctcgggattggagccatcactgtttgtatgcatgcggggttgggggggggggaattatgatgaacaaagttgtaagtgccatcccgacatacattatcacaataatgaaacaacaaaaacaatcccttcaagaaattgacaaaacgaggcgacgcttcctatgggttggaaatgagaacatgcatggaggcaaatgcaaggtcaattggcccaaggtttgctctcctgttcattatgacggccttggattttccaatttagaaaaaaattggtagagccctatggctgaggtggctctggtatgaatgaagggcaccaaacaaaccttcaatagaaaccgaaacatcttgcgatgaactggataatgacatgtttgcagcatcaaccaaagtccttattggtgatggacgaaaggcgagcttctgggaatcaaattggattgctggccaaatcctaaaaagccaagtgccaaatctttacaggcactccaagagaaagaaccgcacagttcaggaagccatgcggcaaggaagatggatcagcgacatccgccacagcctcacgatcgcccttctcactgaattcttccacatttgggggttctagcacaagtacccccacaactgacagacggagtgcaagactcgatcgtttggcgatggacaaccaatggggagtttagtgcaaaatcctcttatcaattccaattcaacagaatggtaatctcgccatcaacaaagttgacctaggaagcgtgggccttggtaaaatgcaacgtctctagttggcttgtgctgcaaaatcggatgtggacagtcgaccaattgcaagctagggggtggccaaataattacttcggccagctatgcttatgaaacctagaaaccgtcaaccacttattgtttgaatgccgatctttaagcaaatctggtttggcgtactcatgtggttaggccaaggacatatcatctcgaggtggaacaacagtactaacctattggattgatagacacaaggaataagcaacccggaagcagcaaatcacaaagagctcaaattagtcttcttgctcattgcttgggaaatctggggggaaggaatgtgagaatctttagagggaaagaggcgtcagtgtaacaaagaatcaatcgcaggggctagccgacgcaaaacacattgagagaatgttgccgtgaggtgtaaggagagttgacttgcaagtttgtttgaactcaagtatgtacaattttccttttcttttggcctttggctgtgtatacttaaactcccttctattaataaaacgtcagttgattggctgttaaaaaaacattagtccccatatcaaataagcccttaagggcatgctcaattaatgttgactacttataatataggtcccactgaagtcatgtacaagagaggatattaaagggtattaaggtagacctcatgaacccaagactagccgttgagagatggagagaaagtcgcactattatgggagaggaaggcgtgatagattttttttattccttgtgagtggcctttatacatatggctagctcaaccaaatgtctcctatcataatgtataaggtttatttaaaaagcttaagacccccttatgtctacattgtcgctgcactaataccaactagtggcaagcacatacacttttacctccttatttccaatcatctgaacactcgtcacaactatccccaatattgggatttgttcggttaatccatttcccttagggattgaggaaggagataggaggattaattgtaaatatcaatatatgtaattgaaccccaccaaattttatagacaagggatcggtctaattctcccctctcatttcttacacggggaataatccacttttacaaaattggcggcccaaaatgatggattgcgttgtagtcttaagcttacttgtgccctaaactaagcctcttattagctctatggctgataagttgtgaaaaaggaacaatccccacaattaattatttatgagtgaaacttttattatatatgtttttaaattaagatttaaaagataatgatgaaaaatgaactacaatgaacaaaatcgttcaaatgaactctaaattaaaatttaaaattgaaagtttagttgcgactaacaaatcagcaaacaaacagatgattaattaagctttaaactactttctccattctaaaatatataaaataactactttttaaagttgtttcataatataatacgtgtatacattaatacaattaattagcaccttatcctccctaaattatgattttctatatcctgcactcccaagatctttaattttattgggtgcatgtattgagtgcatgtattgtattagtgttgatggaaaacacatggcctgaaagatttgctttacttcagtgcatgtctaattttttagtttaaaggcgtaaacaagacagataaatagcaaaaatcagtaaacggtagtctatcggccgatagggagtattaaaaagatccggtcaaataatcacagctctacaatgctttgaaaagcagaatttcctgtctctgcatgctttaatgcagttttaaagatggataattttaagctgaaactcttttccctcgctttctctaatttctgaaagaaaacaaaaagcttttcggacgaatgttggtgtcgacacgaatagaccgtgtttcacaaagcaaaagttatttttggcgaagcttccatggaataatcaaagcatgcatcacatgcttgcacattcgactagaagtgcagaattgatactccacaattgactgccggagatgaagtcgaatgagaagctgaaacaaatacttgcgccactaactaaacctgccacgttggtatggcctctgcgacgaaaactgaataattaattactacttaattataacagaggttttagctattggcaaaacctttattacgctttttactgtactattcatttgtttaagtttgtgtcagcaaggtgcttaaaccatgcattctactcactccgtttcacaacgtaagtcattctagtatttcccatattcatattgatattaatggatctagacatatatatatatctatctagattcattaacatcaatatgaacgtgggaaatgtaagaatgacttacattgtgaaacgtatatgtctagatccattaatatcaatatgaatgtaggaaatactagaatgacttacattgtgaaaccgaggaagtaatgaataaaatggcgggttaatgtgatacgcttcccaagtttataaacggcgcggttttcgtaaaacttttataaatatggttttctttaaaagcctattttcaactttatagtagttcatttatattctaattaaggagtgaacacaaaatcatttagctattctgccattcagctacactacaattatgacaaatcttattgtctttgtattggcttatgatctactagtacaaaacatacctcatctcagaaatagggatgaaaatagagctcatacagacagaaagtgctcatactatatttatttttttacctttagccggatataagacaaatacaaatagctcggatacataaacaaataacaattatttcgacaaatatagtcagacaggaatactgaaacaaatatttctcgcaataaaaaagacctaaacttctaatagagacaaatactatcacacacaattagctcgttttacacaaaaaagtttcattgtaaactaaaaacatatcaattaacttcaacatgtacatcattatactggtacaaaatgcatgtctagtcgatattataacatataacatacaatgtaatttataaaaatatttaaaagtttaaataatattaatagcgggaactatggttgtgatatggattactattaaaatctaaagaggtaggttgaaggtctagagttagaaagaaataggttgtgttttataccttcagctgatatccgaatagcattgttcataggatatttgtattattgttcgtatccgtcggaaactccaatataatattcgtattcatatccaggaaaaaaaatattcatatgcgtatccatatccgtattatccgagaactatctactccaaactatatacgtatttgtttttgtctagagtggatgaaaactatcagctctgtttttatccctactcagaaacttattaaaacaccacaagcaaaattatctaaaagtgaaaaatggacaccttattactactatatacgcaattctcaaataacagagatggttaataggtatgcatggaagtatataagtggagtgttaagcccatacttcaaacaccttaagacatttgaaatgggccggactgcatatctagatcattggacataagacttgtattgggaatttccttctattttgcatggtgattttttattggaattttcttggatggtctgctaatatttcttattcttttcctcttctacatacattcttttacaggatttcatctctacctcatgtctacttcctctgtctcaaaataactcaatctacaatgcaacaagtctttatccatatttattgtattatgatgagccatatccattcttggttgagttattttgaaagggatagagtatgaatggcaacatagctaccaattatttaagtagagattgtgtggttgctattggaacatgacaaattgataatcattgttggcaccgctatagaaaggcaagctcctaatctatctaaaaggtggaaagaatcgtggagccaccttcctaacttgcaagctcactcttttagagcaagattctcttctttaaaaaacagatttcatgttgcactctatgacactgacatgtgggactaaagaaaagtgccgtccacgtatcggttacacttaatacatactatataccgtagaggatgtgtattatatcccaccctttcaatttgaataattagactagcgcctataatactcactcttatctagaacaagtagtggtagaatgcttaagataaaaatctaaacagtaactcactagtaaatacggagtataaaagtatcaagacatggtatatgaaaaatgacgccaacagatattttttatgaaaatactttcatctagttatactttaattataaaacatcctcaaaagaaaccgatgtcatacactcataccttgttgtattagaacatcggctacatgcacgagagctagggaaaataacgagagaaccaaaggttgaccgcatagtgatagtgatgaagtgaaaagacatcgttgatcatgagtcagtgtcgataataccaaaagtaaaacccgtgaaaacaaaataaataaataaatatagtaatcactaaaaggtaatcgtttaccagttatgtcacttctttttctaccgtatttacactaaaatttctatacgaatattttattctaatcaatctatcaatcatcaatagttctaaagctggcactggaactgcaagcctatattggtccaagtgacagtgctatactttgtaagataaatctataaattataatccttccgtttcacaatgtaagtcattctagtatttcccatattcatattggtattaatgcatctagacatatatatctatctagattcattagcatcaatataaatatgagaaatgcttgaatgatttacattgtgaaacggaggaagtataagagataaaaattagagaaaagaaagcacctccagcttctcgattgggcagagtaatggacaccttgaaattagagaaatttgccctcttccaattgatgataattgtaatgattaaagaaaaaaaatttagagatgaaaaaaatattatatttaaaatttaaaatttatatgttgtaaattaactctaaatagaacacacgggttacgcaatgctcacaccaacagaaacaactttaaaaaataccgtgattgtgattacgtaccctttatttaattaattatgttcaaaacgacaacggttttatttagaaaaaagtcttgcatttcgactcaaaactaggtcacacattaggataataaatccaccaattatttagttggttagtcttctttattaaaaatgattttatctctctttgatgactaatattcaacatttgttattgtagtatcactttcttatattcattatttgatacgagaaaataaacttatttggccatctacaataccgaaatgtaaaaaattaattaaacaacataaacgggatataaaatataggcgtgccaattgacgcactgattttctaatgtttcaaataaatattgggtctatttggctgcaacaagccagctgttgcttagttcctgcaggtaaagaactagagtccggcttcgcggaacatgcctactaagattatgtactataaaacatctaagtataaacacctagatgatactcctacctaagcttgaatggtgaggtggaggagagaacagagaggatgagccacccctcatgcaagagagagggtgtgttcggactgttgatacagccaacagcagcccaacagctgtaatatgtagcttaatcgaacacagccatactcttttcacaaactttaaggaagaaatggaaaatagtgatgttgatcaaagttgtcagtatcctgatctatatcttagtattctgtgatactacaatcctatcaagctgaaacaatatcgatcctacgtagtatcctaattttcataatatctcaatcttattattcatttttatacgatcatacaaaattttaggtagcagcccgatactacgatccttgtgaacctaccaaatattatttaaaataagacagattgaaaataatactgaagtttacataaaaccaattaaatttatcagaattgatattatatgctttaatttatacaaaatattatatattttatataaaagttatgtatagtaataccgatactatgatactataaatcaaagaacaatcctacctactatcttgatacttattatcttgatgttgattggatgagagcgaataaaataaatacttatgtattggggttagtaaattagaggcaatgcgtagcataaattgctttccaattaattaattgataatgtgaataatattagatgtagcaatcacctctaccgtaaacttgcgctcttatgttgtgacttgcgagcttaactcatgctgagttcagcaggtggagttaggaactccatcttctcgcacaaaaacggtattacttattaataatacgtaattaattaagtattaactaaaaatacttaataaaagattaatacgattattttagcgatctttctataaaatatttttagaaaatataccgtttattaatttaaaaaatatacgtggttaaaaaaagagaggtgggtttgaaaagaaagagaagaacacagacttaacactaaccgaaaagcctcaccttacctgagcttaagcttaaataccactctttgtaataaacgacggtaaatcggatggaagtacccaagccacccccaattctcctcctcgtcgtcgttctccttcggcttcttaccacgcgcgacgcccgccgccaaccaggtgagctcaccactccccccggcggcggccggcggcggcattcattcttcctttctcccccccctcccatctccttctttccgcttcgcatccctcccgttcccagccgccgcggcttccgcccccttgggccttttgcggctccgcccgctgacaaaccctagatcgccgccccgccgccgtgctctcctcctcgtgcctcccctatggccgccgccggactccgccgcttcggtagtggtcgtcttctcatctgccgcccccccgaaccgaaccctagctctccgccgccctaccctaggtctccgcagcagcagctgctgctcctcctctaccagaaatccccgctatcggccgcccccatgccgcgcctccttccccctttgcctcgctcgccctgtgatttcgcctttcgaaatggagcctctgtgtgtgcggcaagctcacttttatctgttgatttttagttttggtcgcaggtggctgaggaagcagtcttcgggtggcctttgcgtggtttgcttcatcaatctctccatcctaaggtgagtgaaagactagtcccacctgattatttgtggcttttgatgatcaatctgggtagttgggaaatgtagctgctggaattgtagttactgagatggacatgagcagtttacttctgtgcggatttgcgtgtacttcaatttgctctgaaatgcttgaagaactatatgatttagcttattttagatctgtacctattattagatgctacactttacatggaaggaagactatctcgtgctatttttgtgcttgggatttatagttggctgtggtggagtacttgaatttttgaattatttgtgttcttatcatatacaaaatatatgactaaagtcaaagaaatgtacagatttaagacccaatttcctaacgataactgcatgtcacaactaaacctgtacatatttgtcaatatgctcacacacgccaattcaagggcccaatcccacacgtcacgtcgtaataaatgaattccatgcagtgatcccaccaaaatctttacccatagtccccaaactaaataacgtgttgccttacgttattatccatatcccgcaaacaaaatgacactttcctatattctgtcttcttccaacgcttaccagttacccctatacttggaagaaaggcatccctaaccgtaccaaagctctaacctctacttcatcactaaactccaaaactcaagattcagagcaagctaagcctcaagttcactccatattggcccatttttatgcaagaggcctatgcagctatcatgcacagccaaggatggtattgatgaattacgttcatggggtgccagcaaaaggaaacgaataaatggaagggcgcatttaataaacacatagcaaaaccagatttaccaaactagatcaaagtcaaatgaataaaaacaaattagggattccgtaccaataacagacatcagttttcggtatctcttcacactgatctcgcttaggagaggaggagagtagtttgagaaggcagattgttatggtataaggcaggcatgcactgctgtgaacattgatgattcaggcagcagtgttgaatttgagggaggggatatgatggaagagatataagaacatgttggggatcaccagatgaggttgattgaattcttgcttatttcctcctctgcattggaactggatcaatttacaagggaattttgtttatccttgatttcttaccatgtataggaaatgatttctctttatgaggcccctaacaatggaaaattaaaggattgtctaaatgctcccaacagatatgcttggatgcaactacacaacatagtcctttagcaatcatctacgctgctggccctgccatttatgcaccacctcatgggccatagcatgacattctgctactgactttttgtatagtcactgcatatgaagttttccttagtgcataaatttctatatattaatcaccacttaagaactgtggatcatgtaagctttattcaactacctccgtcccaaatataacaacttccggctatgaatctagacaagcacatgtccagattcatagctaaaaatgcttaaatttggggatggagggtaatacttaagcatggtacctggattttggattagtgggctcttacggtctaccatgatgatgtactgattactatgtctctgtttatccattaaagtttggttacttcatttcattttttttgtttcaaatacttgtatgtgctgataaggctttacttcaatttattatgtcattttttagcaacaaccagattttcatcttttgtctgtattagttcagtttaagtggtgactgttaattacagagcgagttgcttctcttggttatgtgtatttgaacgaaaaatttagctagtataatctttttctgagggagcagttttgggttgaaattggtcattgagaaaacattgcaactgtttgaaactttgaattcaattttactttctcctttctgatgacaccaaatgctgtagagctcttccgtactgaaggtgttgctagtgattcatatctctgacccatttggttcgaccaaacttccaaactgtcttttgcatggagtgaagacaggcattatgtaaatttgatgtgatgtttattagagagtatatgattcttataagaaattaatgtttgctcttaattttattttcaacttcccaagtgtacacatattattctgattctttactcacttgagtttttttttttcaaaccaggataggcaacagagtgctttgctaattgctatggaccggcaagtcaggggtgaccatgtaagatatattggaatgtgttcctatgttctttaaagaaagtcttgattgcattcattgttatgatggatttcaataatgtaggaagggatcaacgttgttgggtttgaagtgccaacatcaccagattcaagctacaacaaccctgttcctggaaatgaagatgaagctcgagagcccccattggttcctcctcatctgcagcatacattattgagcttcccaccaagccaagatgattcaagcagccttcctccacctcaaaacgtggtactcaaccacctctacatagagaaagagaactctagatccgtcgtcgccctggggattacccatcggttcagggcaaagtttgtgactgttgtgctgtacaagcccgtacaaaggcggtagggtgaaacattttgtgtacctgcattcctgcttccatttcctcgtgcagggactagacacccacgaggttgaactgccaaacaaatagaaaccctccttgttgtagtcctgaggaaacagaggaacaatctagctgcccatgaatctcaaatgattcaacccttgtacttaattggctgttggttgcggtgattggtggtggtccagttgaatgttggtttaatcttttcctgcgtcttgaacagttaaacccctattgtgatcttggcgtcattattcatgtgtgtgggggacaacagtgctggtgcttcttgctctcctctgatttcgtcttggcgtttggatctgcggcaactcaataaaagaccagatgccttttgtttcggcgattctgctagagatgtgataagaattggaggtgtccatcgcaaagccgaagtacatcattgcctgatttttattacagttggtacaaatcgtcagctcttgtcaattacagaacatacatatactcttggtaataacagaacatacatacatacatactcctacattacaaggggagactacagactcaaattgttttgtctagacaaaaacacgatccattggtacattgcagcagggttaacagcagtgtacatttacagacattttgggtcgtggcaacagcaggcagcagcagatgacagttcagttagcctctctgaaacggctgctccagctctctcagctttgggcaatgcctgatatcaacactctccaccctagcaatggattcttctcctccgatggagctcagctcctggcagcagaagatcttcagcctctggagagacggcatttcgctccatatctcaccgccgatgcactccaccccggagcaaaactgcaactccaagctcacgagcacagggagttcacgcaggccgcatcggagaactgaatggg

SEQ ID NO: 33953 - DNA, 534 bp, Oryza sativa
atgatggtggtctctatttcatggagctcacgcttgatgtccacgccaaggcacattgaaaggtcagtgaggagcttcatgaaggttggcgatgctgccaaatgtaagccagccagcaccacctttgccatggaacagcactagttcttttctgggtgttattttctttcttctttcaatactatattctcttttacatcaggcaaaagtggagctcattgaagcagtgtcagacgcaatgaagatcctgggtattcctggggatacctaaaaatttgtgtaataaaattaatatatataggtatatcacatttgtatatatttacatagatctaatacttcattcccaatcttttttctcaataaatccattttttttactcctagctcacaccactttcaacaatctcaaatgccctaactctatcccactacaacactagggacatgacacttgtaatggttgagtgaatacgccatcttaaaatcctgcttccatgtcacgacgtcggcatcaccatgcgatccagaagt

SEQ ID NO: 33954 - DNA, 800 bp, Oryza sativa
  unsure (1)..(800): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgattattgctgctatccaattcgaactatctatggagtattaggagttaaaatttggatattcgtagacgaagaataaccaaccctgtcttcccattctgttcagtaatagaataaaaaatgacaagatacttattttccctaaaatccctgaaaaaaagaagaaattctacctctttctataagatttaatgaaaattgagaaatcttttaataaaattgctatgcttagtgtgtgactcgttagttttttttagggttcaaaaaggggattaaaaaaatagaatgaaccctactatgtaattatataaaatgaactaataaccaacctattgcttcgtattgttgagatcctaactaagaaacagtcactatatgaataaatacatctatcataaatgagtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33955 - DNA, 1022 bp, Oryza sativa
aagttcgcgaaggtgtttgtgtgcctgatatatctcaaggaagggagaggattcccatacctgcgatcaacacaattgacgatacgcagccaacagcatttaagtacactacggaagtcatatatccacattcctatgcaaaagaacctctgaaaggctgtgattgcacgaatggttgctcaaactctaatagatgtgcctgtgcagtgaagaatggaggtgaaatccctttcaattccaatggtgctattgttgaggcaaaacctctcgtatatgagtgtggcccatcatgcaggtatgacgtgcaaaagcttagcaatccaaaataataacaataactaaataggagtaacatttgcatcatattctgataataccaaagtagattcacagaaccaggaaatatttctcattgcttctgaaatttttaccctttcaacaagggctgacatttggttgcagattcatttgtcagtgaaacaccctgcaacacacaaggaacataaaattgttggtggcatagtttaaaatttctcataaaaccaaccattttcaccttaagtctgtaggttttcacaccagaactattcatttacagcagatcattaggttgaagggaataataaaatatattctcaatcagagagctagacatattatcataacagcgaaattggttcattcaccttaaattggtaggtttgcatatcagactactcattcacattgcacaattaggttaatttgaaactacaagttctgttccgatgctttgagctaactaatgctaatatgcattgtttgcctgaagttaattgtttttcgcgccagaattattattagattaaacccaaattgtaaattctgtttgaaagctgtgaaataccaaatgctcaaaccaacatattgattacagaagcaaccaattcacgtcaagttaattagtttttacaatagaatttatttgtttgtattggaatatcaagttaaaccggaagtagaagttctgttctaaagcaggg

SEQ ID NO: 33956 - DNA, 6749 bp, Oryza sativa
ttctaaagcagggagctaatctagctaatctaatgttcaaaactatgtgcaggtgccctccaacatgccacaacagggtgagtcagcatggtatcaaaattccgctggaaatattcaagacggggaacaaaggttggggtgtaagatctctgagctctatctcttcaggcagtttcgtatgtgagtatgcaggtgaggtgctgcaagaaaatggagatgaacatgtagagactgatgagtacctttttgatattggtcatcactatcatgatgaagtttgggaggatcctaaatttgaaggcattttgggtctagaatcttctacgtccaagacaacggaggatactgaaggcagtaaaacaacggaggatactgaaggcagtactatcgatgcatcaaagtgcagcaatgttggaagattcatcaaccacagctgctcgcctaatctgtatgctcaaaatgttctctgggatcatgatgacatgaagaaaccgcacatcatgttctttgccaccgagaacataccgccgctgcaagagcttacttacgattacaattacggtaaagtcgaggataagaatggcaaggagaaggttaaaccttgcttctgtggttcgcctgattgctctcgcaggctgtactgagatgctgttggttgatgatgatgatggcgacaatggtgcccatttttcagtggaacactgttctgtcgtgctattgatactttgttttacctcctttatttttttactcgttcatcttgcacagttgcagtcatgggtagcatgtaatgttctcttctttgtctttatctcctgaattgaactcttaccgcatcttttggagcaccgactaaattgcaatggaattgatgttaggccattcccatcccaatgactaggatagtgtccatagtattaaataagttgcgacctaggataaaaaatgatatggcaagtgaataaatgaggaaagagaagaaaaccatgtcttgccacctaggatgaaaaatgatatggcaagtgaataaatgaggaaagagaaggaaaacatatcttgcatgagatatgatttctacacaacatcgaagacattatgtgagataagtagcactaaatttaagtatggaatagtgatgtttgcattggaagagtagtgactagtactagtttattgatttggagtttatggaaactatattagtgttttgggttgggaatggtcacaacccacaagttccttcactgctggcaaagaacggatataaatttatttcgtattattcgtctattatacagtacaatgcagactacccctatgagcatcttcgaagactggaccgattgacgaagtcaccacgactggaagagtagtgactagtaagtttacggaaactatatctagtgttttgggttgggaatggtcacaacccgcgtgactacccctatgagcatctctacccctatgagcatcttcgaagactggaccgattgacgaagtcaccacgactggaagagtagtgactagtaagtttatggaaactatatctaatgttttgggttgggaatggtcacaaccttcgaagactggaccgattgacgaagtcaccacgactggaagagtagtgactagtaagtttatggaaactatatctaatgttttgggttgggaatggtcacaacccatatctaatgttttgggttgggaatggtcacaacccgcaagttccttcactgctggcaaagaacggatgtactgtgactacccctatgagcatctcttcgctgtcgatgggtacgtcgtctaccactgaaagcacaacgccgttaaatcctggaaaattcgctcccatggggagtcgaagccaggacctcaggtactactgagcctcttgtaaccactaggttacaggccctttcgctcaatcactatatatttattcgtctgtcatattcaatctacagtttttttttcatttgaccaacattttctgtgttttgcaataggctagtcctgatttgataaaagcaatttatatatatctatatttttcacaaatgaatggtacgccatttataactgaccggatgaaaagacaaaaaaaaccaaaaaaaaaaagaagtaaactgtattcatgggacatcaacttgatatactgtgcaatttagttcacttacaaagtgagcgtgctaatgcaataattaacttagcaaatggatatcttgcaaggtgatatgaatgcaattcacgaatttactaagcgagtaacgaagcgagtaacgtactgggtgaatgacttgcaaggtgatatgtgagtgcaatttagtttaagaacttacaaagtgagcgtgctaatacaataacttagttcaagaacttacaaagtgagcgtgctaatataataacttagcatgtggatgacttgcaaggtgggtacaattttggtatattgatacaacaacatattgtgtcaacacacttgcgcagatttatataagcatacttattttttaaaatatagtcactaaaagtcaattagattttaccatgtagaaaattgtgtatttctgttgagatatgagaatgtgaagataaattctaaaccggtgatgcaaattgattcaattctttatagatttaatccaagattgtagggtaatatttgcatgattgttacgtcgcattgacaatttgacatcatgagaaaactcatctagcactcgttaaccaaacaacatgtaactagtcaagttgttacacacattttcttgtactggaatatactcactaacttattatacttagacattcaatttctaaatttttttaactaaattacacctacataccaagtttttttttaccaggagtgtactttttacttaaaaaaagaatgttataactttggactctcaactacgaaacctagctaactttgaaaaccactcacattttatcatgggtcttatgttattcgatgaactggcgtctacatggagtcaacgtgattgaagagtaacgacagcaaaatacaatgaataataaatgtcaatcttgttttttttcctttgtcttttcccctaaccctatatataatttatttaaaattgctaactatgatgccacatgctgccaagtcatccagagccatccaaatttaggtcgaagaagatatttttagaagttccttttatagtaacaacaattttaacttttaaggcccttcatttttttttagataatgttaaggcccttcatttgaaggaaaaacataaaaaaattgtagaattccaatcttatatgatttttcacatatatgaccgtttgaaacaaatgattgaaaattatagaatcctatgaaattcctaagtaatgttgctatagaacccctttgattccaagaaaagttgtaggaattttggaggatttcatttctaaaggatttcctagatagccctttgaatcaaatgaatagacacaattaaatcttaagaaatttatgtggaatgtctcatgttatgcaaatttttgaggagatttaacatagggtagaaattcatgaaaagtttcctttgaatctttatctcttctcaaattcctatatttttttcgcggtctaatcaaacggttattcatatggttatcttgtgttttgcaatcatatacttgcattcctgtcagatcttgtctttttcctatttctacgcttcaaaggaacacgtggcaagttttgggtgtttttaacatgagtccaacctactggaaagtttactttgaatgtatcttcgtcattcaattcaattcatacgggtttttccgcggtccatcaaacgttcatttatgtattttttccaatgttttacaattctctattttatatttgtattattgtctaaatcttatatttttcttatttctctgttttctcaatctaatatttaggaaatcacaagtggatgtcttaagaaaagaaactagcggccactagttagcaatatcagcaggctatatacatgccatgtcagatctttggatgagttggaagataaagaagaggagagagaatcagagtgggcgactaaattagcgtcgacagcaggcgcacagtacgatgcagggtggaccccacctgcattctctcccaatcaatacatgaaagaaggagatggtgggcccaatatggtaaataaaataaagttcatctctagtacatggctgtggattagagctaatctattgtacacgccgcgagcgaatctcgtgcaaccccatgctaagcctacgtaactagcaataatcctacttcttactgtttttactgattcttaatagtaaaataataataataatatacaaattgatttgaaaattctaaaatataggttgaaagtttttagtttggatttgaaagttttaaatttcaactgaaagatttacatgagttgaaagtttttaaaatggttgaaagtttttagtttggaataggatgtttcaaaatttgagttgagagttttcacatataagttgaaagttttaaatttgaaatagaaagttttaaaatttataagttgaatgttttaataaactagaaaaatgcccgtgcgctgcaatgggtgaatgctattttaatattattattgttattgggtttagttagggtaaaattcactgtgggaattcgcttggattttgtttttagaaaatcatgaggtggaattaggagtccgtcatctcaagttagcatgagagttttttaaaagtaatttcttatacgactcctttgtattttcaaaagcaaacgtgtttaaaatccaacttttatacgactcctgtatttccaaaagcaaaagagcttaaaatctaacttttatacgacttttttttatttccaaaagcaaacaagcttaaaatataactcaaacacggatatgtacttccaaaagcaatcaatcttaaaacctacttaaacacggacgacgtaccaaaataccggcaaaaacatatttaatatttataatagtagagaagagatgagttaaaagtttccaaaattatgataaagtgtaaaatttgaggggaaagttttaaattttgtgttaaaattttttaaatttgagttataaattttaaattaaaaatagaaacgtacacgtgcgccagcaacaagctagcgcatgcgcgaggtagcgatctcgaagaaacttgccgatgacatcatttcgtttgctgtgggcccaaggcgattgtgagccgaagccaaaagcccaaaaacaaccgtgggcacaaaagccgagcccatataaatatggaaaaagtacaccggaggtccctcatcttgtcactgaattacaaaatcatccctcaacccaaaatccagatatataacatctcttaacttacaaaaccgagtcactttaggtctttaggtgattttgaacccggttttatcttacgtggcaactgagtcagcgtgggacccacatgggtcccacatgtcaatgactactttctttcccctctctctacctctttcctctctctcttcttctaaacctctcttcctctctctcttcttggcaaccggccatgcgggaggactgaggagcgcggctgacgacggacggggagaggagcgaaggtgaagacggatgcggcggggcgccaccggcgatggcctcgccgtcgcctcgctctccgctctgcttgacgagaagcaactccagcgctcgcccaaacccaccctcgccgagtacgctgtccggcttgaagttcctcgtcgccgccctgagctctgcgaacatgaagattcagaggttggggacctccaggatcctcccctccggctccgggtagagcgccccggcgacgccgatgactgcgccgcctgctgctcccaggggcatattgttgctgctactgctgctgcttggtgatgctgctcatggacgagctcgaccttccgacgtgatgcccggtggcgctgcttatggaagcaaacacgttgtgtagtgccatgatgggactacgcctatttgctggagcggctgcttctgctgcgaggtttgaaatttgattagaatatgttgtcaagaaccaagggagaagaaatgccacaagcatttgaataccttgccagcgtccatggtggccttatgttggtgccctcacggtcgcagcagcttcagcctcctcggagccgaaacagtcccccatgggatcagctgggagcgaagctcgatcaaatcgagttgattattgttcgttacctcgctgcgtactgaaacttggcaagtaacacgcgagacgctagttgattctttcttgtcaatcagtagcagctctcgactcagcatcccgccaatgagagccgccgccgccgggttgggagcggtggagggcgcatcacccagggggacgcgtggccgagcgctggagtcgcctcccgtcaagcagagggagagcgaggcgacggcgagggcgaggccgtcgcctcgcccttgccggtggcaccgccgccgcgtccatctccccctccgctcctctccccgcccgtcgtcagccgcgctcctcagtccttccgcgcggccggttgccaagaagagagaggaagagaggtagagagagaaaaggaagtagtcattgacacgtgggtcccacgtgggccccacgctgactcatctgccacgtatgacaaaaccggggcaaaaaccgcctagggacctagagtggccaggttttataagttaagg

SEQ ID NO: 33957 - DNA, 9171 bp, Oryza sativa
  unsure (1)..(9171): unsure at all n locations
tccgccgcgccaccgccgccgccgccgccgccggggccggagtctcctcctcttccccctcgacctcctcgccggagaaggccccggcgctggacgtcgccagcgggaagaggggtggtaagaagaggaggtccctgaagccgagcttcgagaagcaggccatccgccgctggtccgcgagggcgccgtcccagcgcgcctccttcccctggcagcagcagcagcagcagcagcagccgggcgaaggtgagggtgaggccgcgggcgatcaggaatccggttggagtgggagctccacgctgcagtccatcgtggattacttcgacttcgactacgattcctcggatggtgatggcgatggcgatggcgatggcgtcgtggtcggcggcgaagcggccgaggcccaggaggatgggccgcgtcccgagccgagcttccttctcgggagccggccggtgtcagcgccgtggatgcacggggaagaagagcccatgacgaaccaattggtttctgacgaggaagggttggatggggatggtgcttccgaggatgagatgggtttagttgatggagacggagacgaagacgaagatttggggagtgaggaggagacgctaagtgagagctcagacggggaattctccgaggattatgcagcaccggccgcaaattcttcttctatgatggattcggtactggaccatgtttcttcaggtggtgggttttatagaggtactaggcggagtagcgtaaattcaattgttaacacaatgaggaattcgatggaggaaagtagtagaaatgctgcgattgagtgtcccgagaccgaggattttgtccagaagctcggtcctgtgctcctcccatgggagagggagggggatgtcgataggccgagaaagcgcagcaacacggagctggctgagaggactatcccagagcacgagctgcggaggcttagagatgtggcattgaggatgaaggagaggatgagggttggtccaggaggggtcactcagctcattgtggagagcattcatcagaaatggagggtggaagaggtggtcaagctgagatttgaaggacctccaagcctgaacatgaagagaactcatgatatactagaggtgcggttaccttttgctgtctcatgttttgttcattcacaattttttcgtggcgtgaaatctgatagttactttgttatcttgctcttatctatcaggagaggactggaggaattgtaatatggaggtcagggagatcagttgttttatataggggaatgaactacaaccttcgatgtgtgcagtcgtatacacaaactacagaggttaattttgataaaagagttagtagtaatagtgttgaacctatccatgttgaacataaatttcagaagtcaggtgcagatggactgaatcgctcagcatatattgtcaattcctctgaaaaacctacagagacatttgatatcgatagcttcttggatcagttgggaccgcggtataaagattggtctggtcgtggccctattcctgtggatgctgacttgctccctggtgttgttcctggttacaagacaccatttagactacttccttacatggttaaaagtacccttcggaataaggaaatgacggctctgcgtagacttgcaaggcaaactgctcctcattttgctctaggtatttcagtgaacttatctgagtagcttttcatctaccgcatagtattcaatttgtcaattaatttccttcttttcacacttcatgcgtaccgtgtggtttagggagaaacagggaacaccaaggattagctactgctatcgttaaattgtgggagaaaagttctattgcaaagattgccatcaagaggggggttccaaatacatgcaatgacagaatggcagaagaaatcagggtaaaagatcatgataactattatcagtagtttgcctgtttgcattcctgtctccacagtgttatgtatgtgttgaatcaaataaacatggcattgcttgataagtagctattttgctgccttaattagttcttttgcttaattcacactttttgaatccttgaaatgtcaaatttctgagaaagctgagagtaacaatctgacaaagaacgcttaagaaatccactaatggactttgctttcttctcctctgcacttccatactaatttacctcttcgcctgcttgttcttgtgacgtattgaatgccttcttttcttgattcgatgcatgactgatggttaaccttgaaatatgatcattgtattagtttctcttgcacactgcagcctatgcatgttttgaatctgtgtaacggaacacttgcagaaattaacaggaggagtgcttctatcgaggaacaaggagtacattgtcttctacaggggcaatgatttcataacacctaaagtaaggcaagtcttggtggagaagcaagagcaagcaatcacttggcaggatgaggaagaattggctcggcttaaagcatcagcctcgatcagtgtcaaacccaaagtatttaaaaatcccccagttgctggcactctcgcggaaactagagaggcaaaatctcgatggggagattccattaatgctgagctcaggaaaaaggagaagaatcacatgattcttacaaaacatacctctcttttgaggaacttgaagagaaaattgattttggtatgctcttcaaaatgcatctctagaaacaaaagtttagtattttaatttcattactcatttgtaagtagcattttagctactttttcctccattgcacaaagatatctttgtgattatttgtgtaatatctactcctgtgcaggcaaaaacaaaggtcataaaagcagaaaaggccttggctaaagttcaagaatttctctctccagcagagcttccaactgatttggaaactgttacagatgaggaacgcttcttacttcgcagaattggcctgaaaatgaaggcctttctaatgcttggtacaactggcacttctcacttaacagttgtgatataaaatgcatgtggtgttttatgacttgtctatatgcattaaaattttctcaggaagacgagaagtttttgatggaacagtacagaacatgcacttgcattggaagcatcgagaattagtcaaggttcttgtaaaggggaagagctttccacaagtaaaacatattgcaatatctctggaagctgaaagtggaggagtgctcatttcagttgataagacgacaaaaggatatgcaatcattttgtaccggggtaagaactacaagacgccccaaattttgaagcctcgaaacctattgtcaaggagaaaagcattggcacggtctatagagctccaaaggcgggaggtaattcaagtgcaaaatctgattttctttttccattattttattttttgaactctatgtaagttgtatatgtatttaatcaattacatggtctaaaataatctagggattaaatcatcatatctcaaatctgcgagacaagatctggaagctgaagtctcaacttgtaagtcatttatacacgagttctctatgacagtatgacttatattttcttatagtagtaaacatttcttgatgatgttctcttcctatgtcatgaccatcaggtacgaatgcaagttgctggggaaaaaccagatgcggagttacttcaaacagttgaggctgatttgtctaaagatgacgataaaatagaggtaatcatgcatgaaaaatgctgagttcaaaagcactgctgcaaattacattttgttaatacacacttatagctcgcggtgtttggtggtgttgtgatcaccttcaaatgccggcacatcgctagtggttgacaggtagcttctgttgttgcaggatgaaggagaggaggcctacctgcaaacttacatcagtgaggatgaagaggaacctgaggatgatcagaatgaatatctctgaatcttaactggcgaaacttcggtgagtccgggagaaaagtcagtagtaaagcattgcatgttcatattgtgaaatttctgcagtgttactcaagaggcaggcagttttaagattcatctatggattattgccaacacaaattgacctgcaacagcattagtggcctttgtccattgcgagatcaacgacaaaggatgtagcttgagtgtgtgtggattgtggtgcatggtctgcagttgctgccattcctttttttttttttttttaccttggctacttccatagctccatccatgcctgatgccctgatggccttctacatcctgcagatttgaaaaggtttctgtcaacacacgatcaagttgtctgctgtgcagaagtttgcaaagtggcagtgtataaatcaggctcgtgtgagttcgtttcattttgcagaagctgtaattatatcatgccattttagaagaatcctccggtccacgttagattcatatttacaacatgaacatgtgaacctttcgttgatacggaattttgaacggttttctgcggaatctctcaaagctgagagcgcgattgctaatccgcgcgcgcacgtttccggcccgccgccggcgcgcgcctcccactcttttttttttcgtttttctttacccattttttttcgctttttccttttttctgattatttttttaatttttagcatgttttgagtttgaaagttttaaattttgagttgaaaattttcaaatttgaacttgaaagtttttaaatcttaacttgaaagttttcaaatctcgatttgaaagttttaaaaattttcaaatctggacttgaaagtttttgaatctcgagttgaaagttttcaaatctcaatttgaaagttttcaaaatttcaaatctggactgaaagttttcgaatatcgagttgaaagttttcaaatctcgatttgaaaattttcaaatctggacttgaaagttttcgaatctcgagttaaaagttttcaaatctcaaattgaaagttttcaaaattttcaaatctgtacttgaaagttttcgaatctcgacttgaaagttttcgaatttgagttgaaagttttcaaatctgagttgaaagtttttaaaatttgactttaaaatttaaatcgaaaattttcaaatctaacttaaaatttttttaatctgttagtaaaaaaaatctccataatctttcctaattactattattagtgttaagtatattaattaatagagatagttaagtatattaactaatagtgttaacagaggtagttaataggggaggagtgctcgctagcagcgagcacgcgctagctaggagtccccagctgagagcacacgcagctaccaaaaccaagaatttttttcggttttagattttttttaaatatttacataaataatctatcggccaaaaaaattacaaaaataaaccctgtcgcccacctctggggcggcaagctaacgtggcaaacgggggaggaacaggcgttgatggagggagggttttttgcaggaaaacccttgccgccctctggtggggcagcaaggggcccgaatgcaaaaaagccagtcggggctggccattctgcaggcggtcccttgccgccctctagccgggtggcaggcctcgctgcctataaaaggcttgccgcccagcccccagccctcattcctcccccctcaaatccagtgaaaaaaaaaagaagagaggggaggagaagagaagaaggggcgaagccctgtcggattcagacgccgatttcaggtaatattcatagatcctatatgtgactattgagataaatagtgtgtattttttaaaaatttgtttgaataaatgcattatatttttagggttttagttgtactaatctagaagtgcgtattgtagatatcggtaactacgtagatctactagtttggaatcaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgatagaccggctgagaggagtgtaccttttataaaaggatggttaatgaggggcttgagagttgatccacagacaagtgacataacaatcaatgttatagtaagtcgggcaactgagggtttttattgggaattaatgccaattcaaaactctcgagtgtgangatggtatttggaaaatgcattgcaacgcgggtggcctctagctttggttctgtttgttcacccgaaggatccaggtgtgcagatgaacatggatgatggcgagggaccaagtgctgaagtaaatgagacttctgtggaggaggtcaatgcacgagaggacgggggcgtagtagctccactgggcattcaaccaggtggagtggccgacgagggggaggctgtcggtgccattgtggatgaaatggagagggaggattctgacaatgagcgtgtagagaaaggtgattcgtcagacgatgagacggatattaatccagcagaatgggctagtgaggatttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtcgaaccggtcgcaatatgaagttcggtgtgttaaggaaaaagatggttgtccctggagagtgcacgcgtataaggggaaatggaaggattattggacagtgtcagtcattaccaagcatacatgttttctacctggtgttcagaaataccacaggaacattacatgtgcatttgttgcatgtgagatgtatgtgcatgtcatcgataatctcacatatgaaccaaggtcaataatccgacacatcgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaagtgaagaaattcccctcaattgaacatcctggcaagagtgtgctgcatagggcgttcttagctctacatgcatgcaagatgacattcgtgaactgtcgtcctgttctctgcattgatgggacattcttgacaggaaagtatcggggccagatactaacagcaataggggtagatgggaacaatcaggtattgcccttggtatttgcttttgttgagagtgagaataccgacagctggtactggttcctgaaattggttaaaacaaaagttgttggtatgagggcaaatgtgtgcctgatacatgataggcacgctggcattctgcaagcgatagaagagttgcagtttgggagtatggaatgaggataccctggtgtttgggaagatgtacagagtaggtggtgcatgcgtcatatgggagctaatttcttcaagcaattcaagaacaaggagctcatgaacatgttcaagaggctgtgcaatcagaaccaggagaaaaaattcaatgagctttggaagagattagatgagttgacagccaaatgcagtgatcagcgtgcagcggctccatcgaccgccgttgctgaccctcctcaagctcttggacctctcccaatggatagtccaacattggttagaagaactggattggagattcggaaattttctcagtggattctgcatgaaccaaaagagaaatgggccaaggcgtatgacacaggtggtgctagatatggaataatgacaacaaatttggcagaagtttacaactgggtgatgcgcggtgtccatggactgccactagttggcatagtggagttcattttacatgggacatgcaggtattttagggatcggttctaggcagttcttccctctatgccgaacaacaacattttgtttggaactttcatgcagaaaaagctagaggagttgcgtaaaaaggccatgaaacatcgagctctagtgcaaagtacccaacagcacaggtttgagatactatgtcaagataaggcaggcaggggtatctaccgcaagagagtgaagcaggagtgtgttctcaaagccgacggcacatgtcattgctcttgtgcaaagccgaagctgctccacaggccatgcacccatgtcattgctgccgcagcagagtgtggcataccagatgcagtatatgtgtcacagtacttcagtaagcaagcaatatatcatacatggagcggcgagatttatgggttcggcatagctggggagttcacagagactaacgatgaagtactgtaacgccccgattttcgttcgggattaaaaatcattaaataatgcattttctaaaaattaaataaaagttaatcaatttaatcaagtgaattattgggaaaattaaaattttcccttaaaaatcattggccgagaatattttgtaatattctttttgccctaaaacactctccggatttttccatgaattttcggaactcaagaaataattttaaaagcacaaagttcattttaaccaattacataaaaagaaaaacaattaaaaatctcccctccttcactttgggccactttcggcccaaagccctccttctctcccttcctcggccggcctcccctctcctctcttgggccgtcggcccgtttccccttcccctcacgcaaagtttaaataaccccctaggttctcctccctctcttcctccccgacaggtgggcccggcgaccctacccgtcaggccctcctcctaccttcggcttcccaggccgaagccgccatggccggcggttgccgcccatgtcccgccaaattcggggccctcccgcttcgcgcccttgcgcccaaaccgagtaaaatcggttccccaccacctcctccaccaaatcccccacttttccccaatttttggcgtcaaatcgagccctactttgcccacgatgtcgcccacgttgccggccgttgccgcttcaaatccg

SEQ ID NO: 33958 - DNA, 5408 bp, Oryza sativa
  unsure (1)..(5408): unsure at all n locations
ccccaatctcgcaccgaaattccaccttcactgtccacccgagccgcctcaactataccacctccagccgccacctggtcgccgctctagccgtcgccgcgcagcgtcgccgcgctccaccgcaccctggctgccgctccactccgtccagaacctcacgggagccgcttttccaaaatcaaggtcttgccggccctcggccgcggcttcgttgtggtcgggcgtcgtcggaacgccgttcccgtcgcctcccgcgccgggcgtcgtcattcttttcgccgccggtcgcctccctgtggttgtctcgccgccgcagccctcggtgagctctccctccgccttctcctttttcccctcctccgccgctccgcgtgcccgctgtcgcgacgcgctgccgtcgccggcggtcgtttggccgcacgccgncacgcgccgttgttcgatcggggcggctttgtgtcgtgcccgtgttcccggctgcgcccgccttgtgggccgccgatccggtttggggccaatcgggcccgccggttcccttggcccggggtggaccacccttggtggtccgggtcacggtgggaccgacgcccttgtgtcgctgaccgatggggcccacatgtcggcgccagccgccccttgctgacgtcagcgatgatccttttcctttgtaaaaataaataataattacacaataattcgttaataattctagaaattcatttaaatggctcaaaacttctaaaattcatatctaattcattagaactccgaattgagccattcaacttgcaaaattcatctaaaattgagctctacatgtttgtttagtttttatgtactgttttcttggtttttattagagtttttcctcgttttgcgtgccagcgtgtagaatccgtcgtttcggaagtccgcggtcgcgaggaaaagagttcggaagatcaaagtgaagaagcaaggcaagtaacacattccccttgagcatgttgatcccaatttataaatgttttactgtttgcaaataaatatgcatgttttgctaattacatggggtcagggttttacctatctgctcgcttgtgccatgtttacttgatatctgtcctttgtcaagtttgggttataaatcgactagctcgtgttacttatgtgacctagctagaactatatgcttagccatgcttaattaccactagctcagatgatgggataattacagtattagacctttttagtatcagaatgagctgcgtgcttgagacatctggccatgcttcatggtcgtaattatccaactaaaatgcgagtgaatggtgggctgtgggtgcatggttttgctagtcgctcccatggcaattaaggaccggttcacgggaaaccctgaaagaattcctcgtacttaccacaagccagcgtgggcaacggctgggcttgtagtgtagcttttctctagccgacgtacccaggcgagggtgggcgtgatggagttgggtcggccggggtgtccggttgatcggcttccggattcactgcggcacgaaaggggggctgcccgttgcctgctggggacgggggcgaaccctaaggtgtggtgcgatctgttagagggggttatgcgaagggtcctgtcacggcctctttccggtatgtcgtggtggcatatcggcgcacggaaacatgtcgtggggctgtgtcttgtgggtacagttgtacacctctgatcagagtaaaactattcgaatagccgtgcccgcggttatgggcggtcgactagattcaccgtgattagtcctaccttaataaatcgacccagtacactgtagttcaggtgggttggttgggcctgttcaacgtggtgtagcgttgatcagtggagatttaatgttactttaattactcaacagttttactgttttgctcaataaaatgttttgcaaccgcctttatgcaaatagccacaaaccatccttgtatccccttgcacgtctgcatcgttggtgtggcttgctgagtacggtggttgtactcagctttgctattattcccccttttcagaagtgtagtgcttctgagctgaagacgaagttagaagaccaaggctcagaccccagttgagttttgcctgtggagtggagctgaagccccgctaggatcgtctttttccgctgctgctgctttcgtttcggtgcgaggactaagtgcttcttctgtaagtattttacgctttatttacgtttggaactgtatattacttgtcgttttgtgtaccctggctggtcatggacagggatttaatacacaaaatagtctagaaatttgggctaaatttatgggcgtgacaagtactcaatattcctgaccatcgaagctccgaggcaaggctggaaggaggaggactcgtcgcatccgcaacgatatggacgagtcggaggctggcagggtgaagcgttgcagcaaatgcgatgaacatgggcacacctacaagcattgtcctaaagacaaggagaaaccaagtgcggcggaggcaggactatcaggatcagcagcagatggagctcgccctacgggtgaaggcactacctccactcgaccacgtcctaggcgtcgtcgtgccacgtctagctatgtggtgtagttcttatgttctatgttggcatgtggctttgcttgtaattcgtttcgaacttatcgatgtgtttatgtttcgtcgtgtaatgtcagacttcggcatgtcatgtctttaggtctcgtgatgtaacatcagactaaggcgcctaacatctttaggtatgctgatgtatgttggacttcgacacgtaatgttatgttatattatcgaactctacatatatgttaaattgcacgtcatcgttatgtaccattagtaacgtttgctatatttaaatagcctgtactcttgttgtacataattattctcatgattttattaatatttcataattttgcaagttatcttttgttttatattactactttttgaattgttctaacacgaaacactatatttttcagagatggcacgtcaggatacacctcagttgttggacccggcgatagatcaccgacaccggtctcaccttactgcggtgcagggggctcagcttgggacgttccaggcactgcgcccaggacttcgctcgtgctgtgagtaccttgcatcgcatcattcctttatgttttcatgtctttctcttcgtgaaattttacgaatatgtacgaacaaattaaccatgcaggtcgacgacatcaaccgggtcgtcgttgacggttcaacgacaatccaacgtttaggcgcggggattccggtacccgtagtgcagttctggcagtacaccgggacttcgtcacaggcacccggcatgtcgagtcagggtccaccactggaccatgctaggaccttatcggaccgcttgctgccttccaccttgctcttcgacatcactgacttcgacttcgcttcaggctcgacagaggacgtcatcggcccctcacagctgggaggcgcaccgccggtgcatacgcaggaccaggcgcaggcctctcctccgccagacactcgtgctacccgtgctgtgccaccggatcgtttcacctactcccaggaccacgtgcgagcacaggcccggaggaccaagcgtggtcgcggcgcggggcagggccagtagagcagtcttctctttttttatttgcttcactttccagtactgtatacttgtgtaatgactacgttgttgttatatgtgcacgatacctttcggcgcatgcacgactactttctgccgcaccgatgcagcctcctttattcgcgtgcgatacgagtatttgcccgccatttggcgcatacgaccaatgtaactttcggcgccgatcaggctgtaactttcggcgccaatcaggcgtacccaccataccccaccatgttcacatgtcaggggtatcactcgattttttgcgcctatataagtcgccttaacgagtgaggcctcacaatctttcagaactcagtcacattcagtactctcttccccacttgcttcattacaaatcctaccggcttttgtcaatggctagacgtcggggtgttgaggatccaaactggcgtagcgatccttgtgtatacctactaccaccttggtgccagcgtcctctctgcctatgcggtgatcgatgccaactaatggcttcgaggaatcctgatattcgaggaaggcgcttttttaggtgccctaactatgaccgtgaggtattttattatctgcatatgcttattcattccgtatgggcaatcgctttattcttcgtaacactactctattcggcagacccgcactacggcttggcgcatacatcgagtgggtcgatacagaaaatcccattctcgacctaaccacttgtttacaagaaggtcgctggtatttcgcatccgaaaatactgagcaatacttacagagaaaagcggcttatgaacgacaatgtcgtgaacaacagagcgactggcgggtgctaactacggcactccctccatgggaagcccgtccaagatgcaggtgtggtgatcgttgtcaggttcttcgttccataaatcctacaacattgggtcgaaggttctttgtttgtctaaatattcttgacgacgatttcatggtaagaatattttgattacatgaatccttattttctcacaacatttactaactttgcttgctttacatctattctttcctcccaggaaccaccaaggagatgtcaatacagagaatggatagacaccagaagggttctaactccacctagccgtgttgtgcagcttgaattactagagcaatatagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatttaaccacaatgtaaatagttgtatcatgttcaaattgtactactatttcttcatgttacataattctccttgtttaagtccatataatgtttctacgacccagactgcgataggcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtactttttacatctgggtccctattggggcggcaagggatccagatgcaaaaagtacggccgcaagctctttatgggcggacaaaattg

SEQ ID NO: 33959 - DNA, 10835 bp, Oryza sativa
cgccccaattttggccgacggcggcagacggcgcgatcgacccaccgtctgccacgtcagcttgtcgcccaccattggggcggcagggtctattttagcaatttttttttgttgatagattatttctgtaaatattaaaaaaaatctaaaaacgaaaaaaactcccaaaaccaattcctgtgatttccgtatggcccacgatctagatgggcccagaattagtactgggccgggcttaccattccaggcccaaatcaagcccaataaatttcccctttgcagcttccctcttctctccattttcgaattctctccgcgaaaactcaattcccccacccatcgatcgagctcgccgtctccgatggcggcggaggcggaggcggagccgcggcggtgggcggcgacgtacacgaagcacgtgaagcagaagcgcaaggcgtaccaggacggcgccatcgtcctccaccgcgccttcgtcaacctcgtcctcctcgacgacgcgggcggcaccgtctagtgcaggacgctccgcaccggcgaggaggtgttccccggcgcctcgctcgcgttccagcgccacctcgtcgacgtcggcgagcccgagccccaccccgggtcggggtcctcctccgccgccgcatcccccgcttcccgaggcgtccaccgcggcggcgcaagcgccagggcgcgtcccagcgcggtgaactcgcggcctccccgtgcgttcgcggaccctaacacgaaggggggtggcggtggcggtggcaaggatgaagccgtgggttcgagtttccaaggtttgcgagccgcctgctctgcgtatgctcacaaggtgtttgatcgctgaacagaatgggcgtaatctgatgaatgaatcgggtgtgcttttgattgcagagtggaccgcactgtacaccacccagctgactcagaaggcgaagaagttccatgatggtgtcgtcaggctcgcgcaggtcagttcgcacgcgaagcaggtaagcagaatgcgcatttcgtagttggtaatttggtatacggcatattctgattgttgggtagctaatggatgatagattggtggtaggttacttgatcctcatgagaccagtttatcttagaatgctgtggtagtggactggggaaaaatgatgtgatatgttgttttggattactcgtccagataattttgctggatgaagagggcggagtgctagccaccaggtacctcaagtcaggggaatctttggaaactgggaagaaatgtcatttccctaactatcttattgagatttgtgaggcgaagagtgtaaacaaaggttggttttgtgcattttccaatatattgacgatttctgtatctaatctttggacctgtgcgttgtgagacgtcaacatttttgctgtgcctaattggagttccttttttcctttgcccacatattgaaaggttgttatttctgcattgccaatacgcaggtttacaaactaattcctcggaggaacctatggtgcaaacaagaccaaggagtggggagaatacaagtaacaaaacaggatcaggtccaacgagtaaaccactcaaatttaccagtccacagaaatttcatggtacatgggtataatgtttttttttaagattgatttaatgaattaatgttaaacatcagttagctatgattgtccttgtccaacatatcacagtgcgaaatgtttgtctctacaagtatagatcttgaggacagtaaatcatcaaatactgctggttcaagtaagccagaaacttcaaagattggagttgtggatgctggtagctcaggaagcattatgggttcaacagactctgaatttaaaggttcatgtgttctctctgtatatgtcagatatttgcgatatgtacaaattgtaaattattgatatatttcaaagctaatagtgaatgtacattctttgtagaatggagtgccttatataccacccaactaacacagaaggcaaagaagtaccatgatggtgtgataaagcttgtgcaagttggttcgcatgcaaagcaggttagcaattagcattcaatccgttagtttcatgcttattaatatcaacactgagaagtttctagtgcaaggtttggcaatatatgattgctgttttcgatgtcactgctagatgctatgtaatgaaatgctgtgatattttgctagttgtagaatggtgttatagttttttaataattggatgttcagattgttctgctggatgaagatggtggagtgcttggcagcagatatctcaagtcaggtgaatctgttgaaagcgggatgaaataccagttgcctaattatcttatcgaagtttgtgagataagaaaacaaaagaatggttagttttcatttgtgtccactctgtagcttacgatactctgaaaatattcaaatgtagtttttaaacatatattccttttttttctatatcacatcttattttactgcattaattggtgtgcagatgtagagtctaaacacccttcagaggtggttttgagtcaaactggatcagcgaatggacataatacaactgacaggacagatgggagaaacaaatctccaaaatttgtcagtccactgaagttcaatcgtatgtgatcacagagttccacacattagtactttgctgcttatgacatactttaatgtaataattcatttgtctctacaaattttcagattttcaaaagagtagattacaaggtagtaatggtttcaacaggccaacggttgccaaatcaatacatactaacatgattgatacactaaaatttcatggtaattgaacatgatatcataaacacttagttctatgtcctactactccctatgtatctttaggtagtaaggctgctgtttgcctgtttgcagatactcagaaggctaaaccagattttactgttggctacaagacagaccttggcaaatcaacatttagtaacttggatgatccacatcaatttaatggtaattgggtttaactttatgcacaatatctgtcttccagtagttatatttttatatagttaaagtgctggttctttccccagtttttgcagataataagcaagataaaacagaatatgctgcaagctataatccacaagaagttggcaaatcaagttatgatagagtggacagtcctctaggattctgtggtaaacagacttgatgtagcatacttgcacctattttttaccctcctgctgttgacatactctaatccagaaatgcccatgttttatttattttctgcagatcttcaggatggtaaatcaggatcttccactagttttttgaggagagaggctggcagaacaacttttggtaacacggatgattctttgagaactggtatgtatactttacctactttctagtttgaataggtttgaccacgcaacagaaaaattatgttgcatgtttccttcatgtatgtcaactacacgaacagtagataagtaatctatgcacccacctggctactattatccctatacccaagcaccgaaagtaagacaatccaatcagccattgttttaacaaatttgtaatgcttttatttattgtattaaatagataattggtttgatatatgtgcacttcagaaaataaaatacaagacaagtctgctcaagtgaaacttttactggcacattctatcagtgttctctcttctgttgtgcaatgctaaggttgttgtgaccaatattggctttgttcattaagactagtttcagttaaggttgattatttcagaaactccatgatatggatttcaaaatagctttctggtaggtgccttttagcagcgtactttcaggacattctttatggtcagattagatatgtctctgttgcatgcatcttgcagtaattatttcatagttgtattactgataaggaaaatggtcgtcccttattcctgcgaatgtgtagcttaattattcaggtttatttactggtaagtagctatttaaatatgtgattttacatattacaagggatatttgaggtattctttatgacttcatcaaatttaaataaaagctgaaacagttctgtatgcttctatagtggtcgttctgctttaccctttcttgtttatcatcaaatatttctctttggcaatctgaagagcataaaataaaaataaaatgcaaagagttcctgcattgtgctcatacaataacaattcacgcagtagagtactttcaagaaattcattcatttttacaagtgtatgttagtgatcctttgtggattgcatggctaacttgaatgacttacgctacttacttattgatcatgtgcttcatattaataacactgctatgcttttttagcatcccaaatactgtctatcatgaggcccccatcggaaattaaatactcccaaagtgttccagcttcacaagtacactcctcagcatcctttggatcaaatatagctcgtgatgcggatcatagcaagacagcttctaacatttcagtgatcaacagttcaaacagaactattggtgttaatatgaactctcgaatgtctcattgtgctacacaacttcgtgcatcagtgctggcttgtttaaatttagaaactctgcagccaaggaactcaatatgcactactcttcagagtgagttatcagggagtgcccatccaacttatgatcatcagacagtcatgtaagattttgtgtgcatatcttcagttatatcctagaagattgccttctggacaataaagtagtaatatctaacatgacaagtcgaataagaaaatgggtttactcgaattatgctttataggagaccaacaacttttgatagtctggaattggacatggtggataccccaacatctgatgtatccaatgcaaaagagcagagtcaaggttcaacaaggaaccatcaaactgaaagttctaaaggtactggaagctgtttcaattaatttcctttttgtggagttagagcaaaattgtgctttacttttagggttttttgccatccaagagtaaacgtacatatattggtctatacatggcagattctgcaccagctatgtgtactactagctcagaccctccatcgggtaaaggtgaaactgcagaccaggtttgcatcctatataacctttcttggaaaaagactgccgtttgtgaatttaaggtagtttcagattcatgagagcaatcaaattacttggtttttataactgtccacagctgcatattgttttgcatcataagatcatgctgtgagtactagcacctactgtttgattatactatgctaatcaatgactagttgactacatatgcatttgcagctcagttcagattacagagtggtggaagaaaaatgtggcagttacccctttttatctgcaggcgacctgacgttaacagatgatgattgcccttcgtttgatcttggcttctagcggaaggtacaactctattttatatcccatggtagcattggataacaataacttaacctaggttgttaaccacataacatcatctatcgctttgaagaatgtatttatttatgcaatataaattcacagcatcacatcggaaatacctgctgcctttttccccaacttataaagctataactataagtctataagctgggtcattgctgcttatggtggggaaagaggggcatgtcctagtcgtggaccaaccactgccggagttatatgtggtttagtcaaaccattggccagtttgcctgaatctaaacattggccagtttgcctgaacctcgaataggaagcaaccgcgcacacagctcaagacaacgattattttgtcaagttcactaaagatcaacgtgcagaagtttcaaaaagaaaaatgaaagcaattatatgcagagaaatcattgattcctgtgggtcactgggttttcctttgcttgcaaacattaacattacttaagattgcatcttaataagtttgctttgctttgctttgcatccagggtttcgttgagggattccttggccttcttaaactcaatctgttcactgcttaaggagaatggatggcgtgaaggcgcactctgcgttgtaagttgcaacaaaacaatgggcaggtaaaaaaagactaattcttgattagtggacaggatctggttcagcttaaggtagcagttttgggagtaaagtagtagttaagacgagttaggcagataaagattacaccgtacagtttatctttcctttaccttttctttttctttttctccttttttttttaaaaaaaagatatcgtttgcctttgtttggcacggtaacgtgtaaaaggtggttgctgtagtagtgtagtgtaaagagaacatcgagaattagattcttgtgtgggataaactacaaacaaagcatgttccatgctcttttttatgatttattgaagcctgaaggaccaggatgtacgctgaaaatcttcacttcaccaacaactggaactgggagtagaattgtaagttcgtgcatcatggcagcatccggattgctgaaaaagttgggcacttcaccgacgtagctgtctaacccatgtggccatattggattggacagctgaaagagatgtggggtcgttccgttgatagaaataatcgagaaagttcgaatgaatttactatgtgctctataaaagaatttacaagagatgaagagaaaaatggtctaggttagttcttgtgaaaatctacataggagtgtgatactaatttgatcctcaagttttctacaggttcacatctatctttggcgtttcgttttgtccaattggtcaattgggctcgctctcaagtttgcattcaattcaaaatgtagcacttggcaacatccaaaggtgctacttggccagccagccagccaacttcccaaatgcttaatcatggtatagaaaaggtctgttatgcgctcacctctcatgcataagcccaaaccacacacaataaagaaaaaaagaggaacgccacgtaaacgtaaacatgaggcatcgtagatttttatgacttttaataccgtgaagaaattattactatatatttttaatttttatgagttactccctctatgtctcaaccactttttttctctgtctcatgatataatgcgtgcatgcatgtatacattaactagcacctcgtactctaaatttgctcctcgtactccaaatttgctctgttttaaatcctctaacatcaacccccctcacattacttgcatgcatcaatgtgatctaaccgaggaagtgattaaattatttttttggtctttgtgttagtgatagttgtgcttcatattttggaatatagtactttcctagtagtgtagttgcctcttatatcattgagagttattctattttttatagttatttccctataacaatatcgttccttttaatatcgtgaaaagttacttcttatatcaagaaaaataatatagtgattacttcaaataagaaaatccatgtatataattatgaatattctctacattttacttatgaatttacttcatatagtttcttatttccaacttatccctatgtaattactttagcattattttatgaaaagttacttctcaactgagttacttttataatgtgagcaaattactattaaatatttaaaaataattaatattaaagtcgttttatcataccttttaagtagagtaagatggtttaaatggaatttataaataatacatggtttgaaatatataaaccatcaaaggtttgtattaagaaaaaatagattagtgatgttggttctatgtatcaaacctttaatttaactagtacaacccaattagccagtgacatatctggtcaacccactaacagattatactaacatttttggattggaaggagggcactagggttgtgccgtaagtttaaatagtgcacgcgaactaattaaatttcactataaatttgcaatatctcataaaattacttaatgtaaaattagtgtcccgattttaaaattatgacttatcactaacagacttatgatgtattggcaatgcatattacaatttgttttgggcttatttgatatccacctcttttaatgctggaacccaattaaactgttgtaactcaacttaaaaaaaaatggaatgggttaaaatgatttaaaatataactaaagagatggatcgagattcaagccgcttcataactttattctaaagttcactctcaaagttaaattgagaaatttgaataaccttatatagactcaaaccgtactcccccgcaaaaaaaaaaaaaaaaaaaactcaaaccgtactcttttggttcttactgtactctttaaaaaaaagttgactagtcactcagcacttcatcacagcatacagtactccctttctttttcctatgaaccatttgcttttcttcttagttcttacttccattgctttaagcggcagagagagaggggttcgagaaataaattccagtggctccctgctttgccacaacactcatcagtgggggttgaggtggctgcatcagcaaggaaacacctgtccccacctcaccagcgggagagaagcccacgtcactcccataaatggatgtggatatctcagattctcatcacccaaattgatccaggaagccacgggacggcacggatctttgccccctttcctggacaacctctccccctaaaaaaccaacaaaaaaaatgaaaaatgagtgagaaaatgagatgacacggcgaggagaagaacaaaaataaaaaatctgggagttgggagaggaagaaccggaccaaaaatccaatctttgtgggagaaaaaatggcgctttcaggggcggtgagcagcgcagaaacggcagcttaattggtctttcttgccaatttataaaaagttttgattttgggagtaattgaaatctttattactactattattattgctggatggattgtttcttctggtaggattgctgcttgctttgccttcacgtcattatccggagaggagcaaagatcccttctttattagctcctctcccttggcttcctctcttctccgtgttcttcttgtccgctttaggggttcgcttttctagattcagtctgtcagcggcgacggcgagggagctgcgagatccggccgtgagatggtggtgatccgaaggagtcatcgtcatcgtcgtcgggttggagcctcttcgtccaagaacctgccttgatcttgcagccttgttcaagcttccgagtcttttgctgatccaggtgaggtggcttttgccttcacctgtaaaattttagagaatcggatcatcgggaggagggagcgaggagaatcggagattcggaatctttcgattttgtctgacttgctcgagcatctcgggttcagttttcattttgcgtgcccatttggtccagtcaagtactttgaaatgttcctagttcgaagaattcgacctgtttctgtatttctgcatctgtgattcgtcccttacctcaaatcagtgaaatctgtcggagaattggataatcgtttaccgcctcaaatctggctgtaattagtagtgattgttttctttgccatgggcatttcatttcatttcatttatttcgacgttgcttgcatatctgagcatcatgtcttctcgttattgtgcttgtccgtattcattttatggttgtagattctttttgagcaaacagttcatgaatcttgatggatcggtcttcaaattttctagcgtggatgatgcatgcactttctgtcatgaaaacattgtaaaataggctgttaatactatcatttgttttctttagagcttctatggaagtagtgctgatgaacaactttttctgaggacattgacaaacaatttttctgatgtgcagggtgcagtttcttagcatgtgagtaatggcagctgctgaaacaagggctgcttggcagcgtgctgctaaccgctgccgggttcaagaggacgcaaagagagctccgaaactcggttgctgcccgccatctgggcaacagcatgagaccaacaatggaaatcaaacaaatccgcaagactgccatatccccaactttatgcctttaaactggaatgcaatgaactccaatctgccaaaagatacccaatggtggcttcagttgcagcccaattttgggtgccagaatgtgcttgctagcgaggacctgaattatatgtgtggggaagttgatgtaaagaaagtcgaaagtttcgcaccagtgtccaaacttgaggacatcaatcctaagaaaacagctgatccttttgagcccccatggatagtttcaacagcttttatgaaacaaacatatgagacaggttttgaagagctcaagagtcttcctgcctattctgaaatgaccctcaaatgcaggggaagtgccacctatcttcatgaggacaaagaacatatggacttcaaaacttttgatcctttgtatccaaagaaaccacagacggcatgctatgagatggatgcaccttggcaagaaaacaggaagtctcggccatggtggcaggtagctgaagcggatggtttggcttccgtagttgcagaaagtgaaatgcacaacgtaggcaaaaatgagctgccaagacccacccaacgtgctcatggttcaaaattgaacaaccatgaaaacaaggatgattatggaccttatactggcaaagaatcacctccagtgcagtatgacactatgctgtgcagctatagcatttcaagcaccaatga

SEQ ID NO: 33960 - DNA, 8631 bp, Oryza sativa
aggataaatcttatggcttattattttcacgtatcacattacgaactagttctgaaaatgaacaaacacaaatgttattccaattttgtatgtgtgaaactagttctgaaaatgagcaaacacaaattttattccgattttgtatgtatgaaattgtgtgaatcttttgattccttgttatgatccaaaattgaagtaatggtagtcatgcatgccttccatgtcgtgttatttctcatccctggaaagtcccagataccaatttgtttgtccaagcttcttcctggttatggtccatatattgacataatcgcattcggatgcaggggtacacaggattcttgtagttctgatgatcgcacaccaggcagcaagccgacatatcggagtgccgctgagaggacccagttgctggatgcactccgccattcacaaacacgcgcgagggaggctgagatggctgccaagaaagcttatgatgagaaagaccatgtcatcaagctattattccgtcaggcctctcatctctttgcgtgcaagcaatggctgaaaatgctgcagctggagaacatatgcctccagctcaggttgaaggaacaccagatagcagccatgttccctgaactcccctggatcatgctcaaagaaaaggtgacgccagggcaagaaaggaaggatggaacaaggaagaaaggaaggaagcagaacaaggacagccacttgcgcaaggctgtcgtgtttgcggtcggtgtaggcatcgttggtgctggactgcttctcggctggactctcgggtggctcttgcccaggttgtaagttccattatcatctaccaccatggctagattaacgcctagcgcgcacttcgatcgaataggtgatagataaagcttcaggtatgtgcttcatgatgttagaagaatgaagatcatattcttggagctcattcatatctgttctgttgttggtttggaagccttgctgatgatattttcatatcttcatgtacatataggatgaatttgctgtatatattttcagaaactgggtgcttctgtatgttgcatgcgtttgcccgaatgttgtacatatatggggtcagtggtggtggaactagggaaaaaaatccgtcgacatcaacaatgtattaagtataaaacttgtattttcagttgctggagtagccagctcttgtttgtataataaaaacttgtatttttagttgctggtttagacagctcttgtttgtattataaaggcctaggcacgcttgggacactatgaatttccatttgccaaattggtcttttttcttgtcaaatcttggtcagctttccaagtgctgtaatcagcaagaatgtgatctgttatcctttgggatagaagtcaatatgcccagctgtcagctcgtgcatttgctactgaattttgcagtccagatatctcagacataagataaactcattcttggtaactcctaaaagaatttgttattacaggcttacagcttcgaaggtgctatcaattatgcatcaaaacttctaaaggttactgtgatttttggcatagcttccgatctaagatgttttagagctagcataactttggatctaaggttttttttttttttggagttggatatttccacctccacaaatccatagatttttcaatcggcaattacattgattacttctgaatgaaatatttattccatttttggatgaaatataatttttaagtgattataatttactccctccgtctcctaatataagggatttagacattttgcttgcattgtttgaccattcgttttattaaaaaaaaaattggaattattatttattttatttgacttacattattatccaaagtactttaagcacaacttttcgttttttatatttgcacaaattttttgaataagacgagtggtcaaacgttaaaaaaaaaatagtgaatatcccttatattaggggacggaggtagtaacatataaattttaaatctagatatggagctgtgataaatattgcctaataaagagaaacaagtgccacgtgatgccaaaggaaagctgatgtactccttttgtcccataaaaagacaaacctgagtttggataggctatctaagaataatctgaagaatattaaaatgtgtcacatctcatcttaaaatcctatcctgagtttgtattttatgggatggagggagaaagtcagcaaagagagcagtgttgcagcaaccagcaggtaatccgtacaagggaattcattagggaaattgtaacagcaataaacttaagggatctagagtcatctctatcggagcagcaacggcacaactgtgaattacataagttagcacagagatgaactagtgttacagctgaacagctcccaagtgtatgattactagtagtagtacttaattagatcttggcagtgtttttccagttctttacactattaagagtgcttagctaattgttccaatagatcttacttatccaggctccggcagccaaaagtgcacaaatgactcccaaattgtgatattacatccacaaggcctccatatccagcaacagctgccatctgcacaacaaaggtagtaaactcaggacaaatcggccagactccagaagtagggtgaaacagatacccaagtcatttcaaaatgagaatcaagagacagacagacatacccctgaagaatgtatggagacagaaaatgctgagtgaggagcacacttgatttgtgaaagaagagtcccattgatagagaaacgagagagcagaggttcagcaccgactgctaagatctgaatggtgaaaatggagtataagaaaacaaacagttgataattcctaaaccacaagagttgggaaacaatgcatccttcgtgctgctctattgtctatcgccagactcaacattgctttggtaaatctctaatagatgtgagcagacaataataaaaagctttccttgcaggaataataactagttggctgaagagtcactcttatatttgtttggaagcaaaagcttttgattttattctgtttctctccaacaataacatcacaaagcttcaaattttggcaaccatgtcataaatcatcaggaaataatttattgcattttctgtgcatatctgagagattatctgataataatttcatatccacacaattatgcaaactttcatttggcaaacaattatgcataaaaaaatttagaaagggcattggttaaatagataaatcatgcacttgtggaactatcatatgacttgttaatggaaataattgactaggggaacactaatttactacaggtatagcatttgttaaactcacaaagactaaagaatggaatgatccgtcctaaattttttgccagcccatctttgaaatacaagatgagccatttctaaccatgggcaattttactggtttgctaaactctagcttgaacatgacgaatagatagacttacttggtttctgtcaaacagcaaatcttgaacaggagcatggcaatccacattaaagatgcactcatttgaaagaaggctccaaactgatataccactagaagtaccacaagcctgggaaaaataggaccaagataataataactgtaaaatacatgatgcataacacattgttatatcagcttgaagtgcatcctaccagccagctttcacttgcatcaatggcaacacaactgacccatgacccctcaaaaatcttgtttttcaccggacgtataacctgagtgcactttccacttctgcaatctgcagtgcacaaagagcagaaataagagaatgcctttttatggatttccatgtagtgccaaatctttctaaacctgtctgaaggtaaactcataagagagaggataaattttgtgaatatgatgtgacctgtgaccagatcaccagatgtgaattaaagagtacaaaaagacaaatagctagttggtgctttttctttgcttgaatcaacgagcagatatacaaaatgaccagttagaacaggatgaacatgagaaggcacacttcaagtacaagacaaaattatcctatcaaaagcactgctcaccccagatacgggctgtgccatcctctgatcctgtaactacctgaaaaaggaaaggctctattaactaaaagttactacaaaatgaaggcaagacatctatgggaaaatggtattggactacatcagtacaataataacaaaccaacctggcggttcgcttcgcggactgcaatgctgtgcaaatagtcagtatgtcccttgaaggtcattttacatttaccactctcctgaaagaacaagacattgtaaaacctactatcagatattttctcaagcaggcacacagaaaatagaaaattatggaagcctgtgccacatgaatcataagaaatctgtagttccttccatgtagctcaggacttctatatattgcatttacctcaagaaaatacataccacatcccagcaataagcacatgcatccccggccgctgcataaacagatccttcctgttgcgaagaagaatgatgagaaagaataactgaataagatatctttttttaagcaagtaacaatatgcatcatttctatataatatacacgatgaacaaaaatgcacacaagagattattttgcttctttggatgaagtgaaaatgcagactttctggtgttgacctgtttgttaatcgcaatggcgttgttttcaggtattggagagcgagcaccccaaggacccctacaaaatcgaaaacaaaagctctgaaaagatggaggatgagagtgcaagtgcatatttctctagaataaacgatatgtcaaatgattatcagatgtatgtcctttttcacagaatacttactcatgctgagggttcaccaaatcaagtactggctccaaatgatcccctggaaagaaaagcaatgacaaagtaacctattaaacaacatgcattagccccacaaaaaaaacatgcactagagcactagaaaaggaaatgggacttgcaaaatgttttacatctttgttaaaaatttagccttttctttgtggggtgtgcgcaagcaagtacaggtagaacttctaggtaaagcacacaccaaactaattaaccaagtcaatcctagtaagaagtgagggttcttttgcagcaccttgcagagatagcggcacaaggcagctctgcatctcgtgccatctccatccccgaaggcgcccgtcatccccgccgctgccacaaccaacggatcacgtcgccaaatgtcatgccatgtcacctgaacaaaaacggccaccgagaagacgagcagcagcacagcaattcacctgaagagcagcggctgctgcgaatccgggtagaacctgacgtcgtaggccgggccactgtgcgcttggacgatgcagacgggatcaaccagagagaccgcggcatccgggtgggtctgaatccaatcaaatcaaaacaaaagatcgaacaccttagctgcgcacgaggacgcggcacatggagcgggtgtggggaacgaacgaacctgtggggtgggatgggaggaggaggaggagatgcaggaggagagggagaaggaggcgagggagccgtcgctggaggcggcggcgaggagaacgtcggggtcgtcgtcgtggtggtcgaagaagacggcgcgaaagagggtgcggcaggagaggtcccgctcccgcaggatgccccgcctgtacgccgcctcgtcccacccccgcgcgtccatccccgccaacgccgccgccgccatctcgcctcgccgccgccgccgccgctgcttcggaagcgagagcgagtcgaggagtggggggaagagacagcggctggttgggctgggcctttagatcagaaaccaacggccagatctattcattattaaaaaatataatatgaaatccctatttgatttgggtttttgtagagtcgaccagtattgtaataattatttgagggtacagacaaataaaataactgttataaagttttaaaaaataggttaaaacaatattctaataaatttatatttattttttttgtgatgagaagccaacgacgagatcttattcattgataaaataatatgaaatatctatttgagttgttgcttcgcgtaatgttgcgataattattcgagggaacaaacaaattaaataaatgttactccctccgtattttaatgtatgacgccgctgactttttaaccaacgtttgaccattcatcttattcaaattttttatacgaatataaaaatacttatatcatgcttaaagaacatttgatgataaatcaagtcacaataaaataaatgataattacataaattttttgaataagacgataggtcaaacgtttgtcaaaaattcaacggcgtcatacattaaaatacggatggagtataaagttaaaaaaaaatattagaacagtattctaagaaatttatacaaaaagttttaagaaaatcacaccgtttagagtcttgagaaaggatccttcgaaatagttccctcaaatcttatggataggaaaataacaggaatgatcaattagatgaagcgtttgaaaccacacaaatcaaaagagaggaatttttttcaagactctatactactaggtgtagcaacaccaacatttaactcaaaattttatttttcaaagaacatggggtttgaggtatcatatcgttcatatctcgcgtttctgtcttgtttcactaaggaaatgctgttattttgtgaagcatgttgaacccaaaccacaggcttagcataaggttataaaattgtacagcaattgactctctctttatttatgcacctcaaaagatttttgcatgtatggtagcaagtaaaataccatatcatgcaaaggactaagttcaacatacactaaaatcaaacactgaagaacagtaatactttcatgtcacacatgatacacactctgctcatatatatatcagtggtacaatgaaccattcaacagttacaactccatagtttggcaataataagaccagccgatggatatctcacaactcatccatggatctattaataactcatgtcaatgttttcacatcaagtgcagacagaggcaacagaacatctcaatcttcacttgtcagatcccttctttgggtggaaggcttcaacaatagcttcaatctcttccttggcacgctcaaacacatttggacctttaactctctcaactggtgtattctcatttatatcatcgcttgtaccatgagtttcattcttgtgggtctctattttgttcattgacaccttgctttcatcctttgagtccttatgcaggtctacacaattttgtaatggtgtgtatcataatcattagacaggaagataaggttaatcaatgcataaaagaatctgaccatcatgcatgaatatcacacacaaagagctgacaagtcattgttgatttttttttgtgtgctgcaaattcttcgaaggaattcaagcaaagtatttgtattcaaactatttttagggcatacatatctaaacttttatgcctgaaaggatttccagaaagtttcatgatttagctgcatcatgttttaaagtcggttggtggcatcaaatttgacaaacaattactgaaaaggatgtttttgcaataaaagggagaaaaatgaagatgctaatattcttgaacttgtgtttgtgttatctcagaaaaatcttgttacagaaaaccagactttttcaacaaagagaaataaattctgatatatgcccaatgcatgattaatgacccatcatattatacaaggaactcaatacccaaggtaaaaaacatcaagctaaaatttagcaattgtcaattgagtatgctgtagcgcataattgctagatcagattttgtactccctccgtttcacaatgtaagtcattctagcatttcccacattcatattgatattaatgaatctagacatatatatctatccagattcattaacatcaacatgaatatagaaaatgctagaatgacttacattgtaaaacgaaggaagtaggacataattactgaagaactacgtgtcggcctattaggcattgaagagcttaagcttgtgcgtttatcttatatgagctttgtgttttttggtcctgttgttaagcagctaaggtcgtgacttaggtgatgaggcaaaggatcgtgcgatactgtgatggactgatggtaacattaagcttagatgtgaattgtctctctgggtgctttgggcctagccgatgctcctctatcctatccttttttccatcttttctgccagatagtttaaaatcctactcttctttctggggataataaaaggtgctcagcatcttcacagaaattaaattacggaaaacaccgttggttcaaacaaattaccagcattatttccatggggactggaattgtgctccatcttatcatgaacagctccaacgagagcctcaacctcttccttggctcgttcaaacagattgggggccttaaccttgtccacagatgttttatgacttatatcgttgc

SEQ ID NO: 33961 - DNA, 413 bp, Oryza sativa
cgaattcgagctcggtacccgtgttcaacatttgtttgcttggcctcgacttcgtgcttccattactcaatatgttcagtcctgcacagtttgtcaacaagccaagcctgaacatgttaaataccctggtatgctccaactactccctgtccctgcacatgcctggcagattgtctctctagatttcattgagggacttccccggtctgccactttcaattgcatacttgtggtggttgacaaattttcgaaatacaaccattttgttcccttgagtcatcctttcacagctttggatgtggctgaagcttacatgcaacatattcaccgacttcatggattacctcagtcgctcatctctgatcgtgatcgtatctttacaagcaccttgtggaccactctctttcgtttgg

SEQ ID NO: 33962 - DNA, 541 bp, Oryza sativa
  unsure (1)..(541): unsure at all n locations
tatttcaaacagaaggcaattctgaatcactgatcattgtagagacaaaacaaattgtaccgaacagatggaatgagctagaattttgaaagttaaatgatgtgcatgggaggaatcaggattcaggaatgtacctggcaaaagaatcaccaattcttcctttgctagctggcagcagaagtccatgtcatctttgatgccttgcaggcaggacagatccagtttcacctgcaccaagccaaccaaaacatcatacaccatcagaaattccctttgattctcttcattgtgaagcagaatatttgactgaccatgacaaacatggaaccctcaggtttgcttgggcaagtgatgcaactgatgcccttcagcttctcccaacaaatatctgcggtctgccttaggacatcgacggtcttttcgaagaattcttcctttgtgttctctatgagttgtggaattgctccctgaaaaaaaaattaatcaaggtagaatgtaaatcattatgttttgatattatgtatctncactgatcttttta

SEQ ID NO: 33963 - DNA, 532 bp, Oryza sativa
gaccctagaggatccccaatacgtagaaagaaagctgcagggcgactgaaaggatcttctgtggaggtatgaaacttgtcttgatcacatatttgcatcgactgccacattctcactctggtatcctgttcagagacagttggagggtgaaactcatattcagcagcagcttaataaggctttggaggataacctgaatgcaaatgaagtaacaaatcaagaactgttgccactaacacctccaggctttgaatcaattgtcaatggaaaacgtatgttctgggaactctatctttgctgtaaatgttcacttattttgttgcattcaatgtagcagttttctaatgatgttttttttggcaggttctcgtgattggaacactgatggtttctctgaagttaacttaaattctagtctgttcgatgaagagctgactgctacaatcagtagcatttgtcaagataatcataatagagatgcagaatctgacaatgtggctaccgaagtagctgaaatcagccatcttatgga

SEQ ID NO: 33964 - DNA, 353 bp, Oryza sativa
caaaatggcctgcagcgcctgatccggccgccgtcgccagcctcgccgtcagagccacccgccgtcgtcagcctcgccgccacctccatccccgccgccatctccatccccgccgccggcgccccctcaccatccccgacgccgtcgtcgccttccccgccgccagccgccaccaactaccgccgccacctcgccatcttcaatccccgccgccaccaccaccaactgccgccaccaccttaggccgaccctccgccggcggcctccccaccagatccggccgcggcggcccggatctgggtggccttcgctgtctcgcgcagccccccaccgccgacgggagaggcagacga

SEQ ID NO: 33965 - DNA, 605 bp, Oryza sativa
ctgcccccaccgccgttcgaaggtcctccgtcgccgacgcatagccgctacccgccgtcctcccgaccacctctagccgtcaccaacccagacggtcagcgcacgagcccggctgcctctggccaccatcgccgtgcctccgcctcccacctccccgtcgccgatgtcctagccgccgcgcagacgccggtcagctttggcggtggtagggccggatctagggggagaggaagagacacagttgataattgttggaagcgatgaaaatgaatgagtcgtccgacaactgaggagaaattccttggaagtgttcaaacaactgttaagtgcacattccaaatgcccctatgcatttagatctctaggtacggtaactgacggtaccaaatcgtttcacgatcggaaacgatttggtaccatgaggtactagtacctcgaggtaatttttggtggaccggagcaaatctcatgcatttaagttggctgaataataagtattccgagcagatacagagcatgttcaattcaaaatgtgtagtcacgtagaggaaagagaatcaaaatacagaaaaaaaactgaagaaaaatgagtttataaataggaa

SEQ ID NO: 33966 - DNA, 7332 bp, Oryza sativa
  unsure (1)..(7332): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaggcagtgtatagttttaaaactgagattgagaggagatctcctggtagtatagtggagatagagtatgatgtgattaatgagaagcataggttcattagaatgtttgttgctttgaagccttgtatagatggatttttgaatgggtgcaggccatatttaggcattgattcaactgtgttaacaggcaagtggagaggacaattggcttcagctattggtatagatggccacaattggatgttccctgtggcctatgctgtctttggatctgaaacaaaggaaaactgggaatggttcatggtttgtttgaataaggcaattggatctccagaaggcctagtactgtctactgatgcaggcaagggcatagatgctacagtgacaagggtgttcaacaatggagtagagcatagagagtgcatgaggcatttgtacaagaattttcagaaaaggttccatggagaagtatttgaaagaaatctgtggcctgcctcaagagcatctgaactctgcatgcagagttgtggttagggttgttgcttatgttgagtatatggataatggtagccaagattatcatgtttcatcttcacataagtgggttgtagataaagacaccataagcttgatagatttgatgaaggacttggatgatgaaatcatccgtggtagtgcgcaggagcttacagtgactttctgggacaagagagtgggaccatgtaatgtagtaatgagatgaattgtgatgaatcaaaatttgtgcatttaatgtaatgaagtagaactatgtaatgcagtattacaggaaatatttgtttttgcccaaaattgagatgtaatgcaggaaatatttgttgttgacatttcagaatcatatggcatatgaagtagcaattatctgaataataaccattcctccatttcagcagtaggactttcatagatagctgaagtcatgtcttgcaacatatacataggttgctaaagtaatggcttgcaaaataagggatatctttcagctggcaatttcacatatacacaaaagacaagtcttggtactacttcagctggaaatttcaacaaaatagcctactctaatagcattggattacagcttctttgcagtcctggtaaccacagccttccttttgttggctttaaatggacttgcatgtactggggatgcaacactcctgctccttgtaactggtccagggctgtcatccacctgcatagcaacttgtgcaggggcttgatcagcagcagcagtagcaccagcaagggcttgatcagcagcagcagcatgggcttgatcagcagcaggggcagcagtagatgtggcttgatcagcactatcagcaatagcagtaggaggcctgtgaaagagatattgaacaaatatttaaaaaacaaaatggcaactgaaattgttgatcaaaacatgacacacttacatagtgttgttaccacaagtaggcacttgttcaggcttagatttcttctttctaactctcttaggcttgggtggagctgggggagaggcatctggatcatatacaggttcattgcatgtcttttgtaggtggccaaagccatggcacctcttgcatctccttcttttctttcctgaaccaccttcttcaacaccaatgaacttccttgttctaggtcttccagctgatctcttcagtattggtggccacatcttgaatcctgtgtccactttgtcccataggctcttgtctggcattggaggcacagttgtggaacaggcagtcctgaacatggccactgaatagtaggggctgacatagtcttctagctccacttctctcagggatccaataaaagagatggcatgcctattttgtgggaaccttttttgtggtagcatctctggtaggaacattgtcagcctgacttgcttgtgtgggtaaaaccatactcagtggaaccactgtttcagcttcatccacacaagacacaatttgggaacaaggctcactcattgtcacatgcaatggaagcttcctaacatccctgtattggttaaatgcctctaataacacagcatcagaacaaatttctacatccctacccactctcttgtcccagaaagtcactgtaagctcctgcgcactaccacggatgatttcatcatccaagtccttcatcaaatctatcaagcttacggtgtctttatctacaacccacttatatgaagatgaaacatgataatcttggctaccattatccatatactcaacataagcaacaaccctaaccacaactctacatgcagagttcggatccatcctacaatgcgacggcaaatgaagagaaaaatgggatcccaaatcagatccaccaaaccatgcatctcaattgaatcaaagagagaaaaaacgaatcaaagataagaggaatccaaacttaccctttcggaatccatttcggcatcggcggcgctgccgccagcgcagattctaccgcctcctgtgacggtgaagctatcaccgccggtcaaacttgcatcccaccggcgacaatgcctgggcacaactagtatcgagggtgacagaatcggtggaatgggcactgtttcggtggaattgatagagctagggttctaccacccgtactgcttgcgaatggagccaaaacgagtggataagaggagtctccaccgtccatgtatatggggagtctcctttgaggtcattttcaaattaactgtacctagggatgtacttagcagctagctctacttaaacactcttaatgtctcaactaaaccaccacatctgacatcacacacgggaagatggcagcgtccctgcttttggagctcctgccccagcaatggcagctctcaatcaccagcctcatactcctcgccgtctccgtcgtcctcatcttctggagccggcgccgaaggaaccccagcagccgcctcaagctgccgcccggcccgacgaggctccccatcatcggcaacctgcaccagatcggccgtctgccgcaccggagcctggaggcgctggcggggtggcacggctgggcacggtgtcggtggtcgtgctgtcgtcaccgaaggccgcgcgggaggcgctgaaggtccatgaccccgagtgctgtagccggtccccgtcggcggggccacggatgctgtcgtacggatacaaggacgtggccttctccccctatagcaactacgtccgcaacatgcgcaagctcttcgtcgtcgagctgctcagcatgcgccgcgtccaggccgcttgttacgggcccttctaatgggcgatcgatcgccagcaatcgcactgggcgataagttggcgccccctcccccctttcctatactcctccctcttatcacatctttctcctcccctttttctcttcctattacagtataaaccacacaaaattttttaaaaaaacaaaaagttagaaaaatttatgtatagaaatactatatataaaaaatttgaattcaaattcaaatttgaattcgggtacgtaaacttttgacttataaactttgggtctataaactttaggtgtataaacttttagatgtatagaaatactatatatagaaaatatttgaattcaaattgaaatttgaatcgggtatgtaaacttttgacttataaactttgggtccataaactttaggtgtataaactttagatgtatagaaatactatatatagaaaatatttgaattcaaattcaaatttgaatcggatataattcaaattcaaatttgaaacgggtatgtaaacttttgacttataaactttaggtctataaactttaggtgtataaactttagatgtatagaaatattatataaaaaaaatatttgaattcaaattcaaatttaaatcggatatataaaattttgacttataaacttttgctatctaaactttagatgtgtaaacttgaggtgtataaactttaggcgtataaatttactaaaatagaaaagtaatgcggtgccaaaaaagaaaaccatgtggaggggtggagggagggagggggaggggatcgatcgctacctcatccccatagcgatcgatcgcccatcagcattcccggcctgttacgctagggaggcccaggtatttttatatgtgcatgcctttctgttttacctatctatcctagactcctagtgtatagctatatctatatatctattattatatctatacttaattaaaaaaatacgttatctatatctatatctatacctatatatacctaatatatataattaaaaaatacgtaaggtttccgtaaaaaaaatttcgtccgtcccttttttttcgattcagtttttccggtgatttttcgctgttttttttccgattcgtttttctttcgtgtttttttgtccttctctttttttttccgaatcagtttttcccgtgactgctcgctctgttttttccgctgtttttctttttttttctttccgattcgttttttttcgtgttttttttgttgtttttttcattcggtttttatctcatccaatctattgcacacttgcacttcaatctacttcctcttgtgttttctcctcccaaaaatcgataccctactccactcttgttatttttctcacgatttcctcaccccactctattcttattatttttctcatgatttcctcttttaattcactagatttaatctcatttgttgatgatggtcggccggccgtttttatcccaatcccaaattttatggatccgttcacctatcaaaaaagatttagatttgatggagaggatcggctccgcatacgggcaaggtactatgccaccggatctacatgcgggtagccgccagatacgccgccgccgtcgtagccggcgtgagaagccaccatcgccgccggatccgccgcgaggagccatcggcaccatcggatccgccgcagaaaggcgccgccaccaccggatcaagccgtaggaagcagtcggcgccgtcggttctgctggatctacccgcgggaagccaccacactccacccccctctctccttatccgcttgcgaatagagttgtgccctcgtcgtcttcacgccgcgccagcgtgataggagggagaggaggagagggactggcaacgctggtgaggagaggggaagggggagcaggagcggcagagagggggcggcgctgccggtcgggagagggaagggggaggaggtgctcgcgatggtgggatgggatggggaagtgtgattagggttagtgtttttggcaatgacggtttgatggatatagaatcgatccgacccgtccatcaaaatgaatggcacagatcgatcccacgtcgagccggcctccatctcgggccaccgcactgctgggccacgcacgcttcatgggcaaggtgcgcaatagcaggccgatagggtccaatgggccttttctttttcttttttagcacttttttatttctaaggaatatattttttgaaggctcgtatcatgataaactaaaccgtaatcatctaatatttttatatttattataatttcagtttacccattgcaacgcacaggtattttttctagtatatataatatgattgtttctagtgatacttagggtcgattcttttctccccgttactctctcatatatcatacacacgcttcccgaactttttaaatggtacgttttttaattttttctatagaaaagttgctttcaaaaatcatattaattatttttcaaagttgctttcaaaaatcatattaactcatttttcaagtattttaaaactagtacaatacttaattaatcatgtgttaatttgtcactccgttttacatgccgaggggaagagtttggtaggccatttggagtgggacttttccatagcacgtaaacgataaaatcattagcgcatgattggttgtattacaaacttaaaattatgtttatttgattatgtaaaaaaaaagtttctatataaaaagtttgaaaaaaaatattgtgtagccatgtgggaagtgtactctcgataaatgagtcagttgtaaaagccaaacacactaccgaacacagccttataatgcttggtttgtagtttgtactagtaaccggccataataatacctagccatgttgggatggtaataaaaatgtgtagtttgtacaagtcttcccacatttttggctcaaaaacagttgacttttcatctatccgatgacgtaagtcgagattcgtgtattccttggcctttagtacacggaagtctccatggtttgagttgtgtccacgctgatttctagtataactcctagtcacgagggagttttaactcctagtgacaagggagcttaagattatgagaaacaatggattagtaaccagcttcttataatttagaaaaactaggtttctaaaattatagtctctagtttatctctgaattctataactatatattttaaaaatttagatgagaatctacactgtttgaggagctggagatcctagaaaaaagttataactacgagaaaacccattatctcttttctacttcattaacgtgaactcacgtatttttttcactaccgtgacgggagccaagctgctttttcagtgccaaaatagtgaagttgtgtcactacaagaatccaagatttttttttggcggccaaataaacaaagccgccaatagtttatctctggattctataactatatattttaaaaatttagatgagaatctacactgtttgaggagctggatatcctaaaaaaaagttataactacgagaaaacccattatctcttttctacttcattaacgtgaactcacgtatttttttcactaccgcgacgggaaccaagctgctttttcagtgccaaaatagtaaagttgtgtcactacaagaatccaagatttttttttgcggccaaataaacaaagccgccaatagtttatctctggattctataactatatattttaaaaatttagatgagaatctacactgtttgaggagctg

SEQ ID NO: 33967 - DNA, 26135 bp, Oryza sativa
  unsure (1)..(26135): unsure at all n locations
ccaatagtttatctctggattctataactatatattttaaaaatttagatgagaatctacactgtttgaggagctggatatcctaaaaaaaagttataactacgagaaaacccattatctcttttctacttcattaacgtgaactcacgtatttttttcactaccgcgacgggaaccaagctgctttttcagtgccaaaatagtaaagttgtgtcactacaagaatccaagatttttttttgcggccaaataaacaaagccgccaatagtttatctctggattctataactatatattttaaaaatttagatgagaatctacactgtttgaggagctggatatcctagaaaaaagttataactacgagaaaacccactatctcttttctacttcattaacgtgaactcacgtatttttttcactaccgcgacgggaaccaagctgctttttcagtgccaaaatagtgaagttgtgtcactacaagaatccaagatttttttttggcggccaaataaacaaagccgccaatattatcttggcggtcataactagttgtgaaggatacactactggaggagcatctctcccggttcgcaaccccctttactcccgggtagcgaaccgggagagagaattcgggactcaagatgacagtctttagtctcggttcaaatacccaggagtaaatatccatctttagtcccagttggtaataacaaccgggactaaagttccccagccccccgacaggggactgacatgccctgtcagggggcgaaccctttagtcccggttagtatccctttgtcccgttgaagttaagaaccgggactaataaaccactttagtcccggttttttttggaaccgggactattgtggaaatcacccgaccttctaaagatcacttctccagtagtgatataattattttattgagggttatatatgttgaatcaccaaggtatatgaacatttccttgtgcgtcataggagatggaagaaagtaaaagcataaaatggtaaatagagaaattacatcatagctattatgatgatttgtttgtaatattaaatgcatttacactaacttttttagatttgcttgtgatattaggtgacaaatacattaggattatgttaatgatttttattgcttgatattctttttatgttacaatttgttgttaatcatgtacttcctccgtttcacaatgtaagtcattctagtattttccacatttatattgatgttaatgaatccagatagatatatatgtctagattcattagcatcaatatgaatatggaaaatgctagaatgacttacattgtgaaacggagggagtacgtaaaaattgactatttttgtctggaaaatatgccaaatcgcatataagcaggcccttatgataaagtcaactcagaacatttcccaaccttgatggaaataaattatatcaaagttgtagatgcagccattttgaaagggtcaggtgacatcgacatgcaggattagattaatcatcgagcaaaatagtgataattactagtatggagtagtagatgtgaactcataataattactgctccctccgtcagaaaaaaactcaacttagaaggtgtataatggaggggtacaatgaatatagacaagaggcctaattggcacagctccatccctcctggagctggagctcagccaaacagttccagctccacaaaaaatgggagtggagctgggtggagctctttcacaaaatgaactaaagttgtagagctgggtttaggcagctctacaactccactccagacctaactccttgagttaaatttaggagttggagctgtcccaaacagatctaaggttaggctttttgggacatagggagtatgtattaaaaataacctaagtactcatatgtgcagcaccctcacacaaacacatttatttttcctattctaggtaagtgtgtataaaaaattagaattgtacaaacttatcggatcggactatcactatcgatttgtgaaacagaatgtgatgattgtatgagttctgttttctcaacaggcagtgatgctccccgactattactgctgcatggttagtgccaattcaaaagtagacagtgatagtaaaaaaacatacaatgatattaaacaaaacagacagtgattttatattataaattgttttgacttttttataaattattttttaaaagtttatggagaaatatagtgactcttataacatctttcattaaatctaacattttcattaaatctaacattgaatatattcttataatatatttgttcggtgttaaaaatattattatatttttctataaattgagtcaaattaaaactcgatttaaaagaatcaagataatttataatacaaaaaggagggagcagcaatttcgaaccggtgcttagggtgtttttctgtagtaggaaatccatggaatgacatttggccatgtcatgttttaattaggtcgagaagctcatcgagaagctgacccgaaacgggcggaacgcggtggccatcaacgagcacatcttctccacggtggacggcatcatcggcacgttcgcgctcggggagacgtacgcggcggaggagttcaaggacatcagcgagaccatggacctgctgagcagctcctccgccgaggacttcttccccggcagcgtggccggccgcctcgtcgaccgcctcaccggcctcgccgcgcgccgcgaggccatattcaggaagctcgaccgcttcttcgagcggatcgtcgatcagcacgccgctgccgacgacgacggccccgccgcggctcgcagaaaggcggacgacaagggctcagcagggtcagacctcgtgcacgagctcatcgacctctggaagatggaaggaaacaccaagcagggcttcactaaggaccatgtcaaggccatgctcttggtaattaagtgttactgtaaacctccaagatcacggtggggtttccggtatctgtcaagttttcttgtttattcatctgatgaaacgtaactcaatttcaggacacattcgtcggtggcatcaccactacctcagtgaccttgcactgggcaatgtccgagctcatccgcaatccgagggtgatgaagaaggcacaagacgagattagagccgtcgtaggcgagaaggagcgggtgcagcaccacgacatgccaaagctaaagtacctgaagatggtggtgaaggagaccttccgcttgcatccccccgcgacgctactcgttcccagggagaccacacggcacttcaaggttggcgggtacgacatcccggagaagaccaaggtcatcgtgaacgcgtaggcaatcggcagggacccgaacatctggaaagatccagaggagtttatcccagagaggtttgaggagatggacattgacttcaacggggcacatttcgagctggtgccatttggctctggccgtcggatttgcccggggctggccatgggagtggccaacatcgagttcatcttggcaagcatgcttttttgcttcgattgggagcttccccatggggtgaggaaggaggatatcgacatggaagaggcagggaagctgacgttccacaagaagataccactcttactagtcccaactcccaacaaggcaccaaactagtgatcgaactgattaattagcaaggtgatcagaggcttgctgtgcaactgtgttgcactttttgccacagttaatttcagtattattccagtaacttttgtataagtgcttcgccatttctgtctttataaactgttgaatgctttcaagaaaaaaaaataaaaatgtaagggaaacaatgattgcacttcagtttatgaaaccatccttatagggcgacggcgtgacgtagttcctgcagcagagttgctggtggagatggggggcggtgcggaggaaaccggtaggaagggcaacgagcagcagagtggcgagtgaaggggcaattggcggggtgggagtgcgggttggggtgtggtttgcggtgcgtgacagaggggggagggggagcgattgcggtgctaggggaggggagcggagggatttcatgattgggaatcaggaagaaaagtgcaacgtgatttcagggatgctaggtgagagaaggtgatgcttgcacggaagctattccgaacgttagacctcaatgaaataatctggaccgttccatgaggaatgaaagaattattaatgagtgaaatcatttgttgaattataaggtagatatgagagagattaaccgaacaaaccggctttagtaaaggaaagcagcatggaaggataatgttgaatatgatggtggaaacaccatcaggtctaccattacatccatcaatggatatatatgtttggtatatagagattagggggaggaaggccagttaaaaagttcaggagtatatcattcatatacacgtaccgtaggaagttaaatatttaattcttttacattgttcagacatcagaagtgcactctaaagaattacaggcgaaaaatggctttgctgatcactggacttacaatgaaactccacaacacaaatctgtcgtagtcttagagtataacaaaacatgcttcacaagcaaagcctggttcactctttcttcggtgggatatggttgccaccagttgcaattttgaacaggtagaacgcagacatcaaagcactgcaataacgtaaaagttagcttcataatgcatacatattgtatttgcaagaggaatacaaatgaaatatctgcaaactcagaaagttttcagaatacagcgatggaagtgtatactagttcggagagggttttacctgaggccagcaacgacaccagctggcattatctttgaagtctcaaggtatctctgccccataacataagtcaaagctagtgcacatactgttcgacaaagcaaaattttacagttaataaagacaaaaggacaaagcaatgaggtaaagtgcaggaaaaggtggacgtaaggtaagaagacagaaatgaggtgaagtgcaggtctgcaggaaatggtggatacatttttcggacaaagttcattccgtggtatatttccttctcagttcctttcgtcaaaactgatttattaacttaaagcaagggtcattagcttaaatgaatcattttctaaaaaatagcttaaatgaatgatactgatgagatcttttcagctcctactagaagcaatactgcgataactaaatattgctaaaaggaagatctgaagatacagtcaaagcattaaacacaggcaacaatgctacaatttatattacagtccattgagttagcgaatctagatctgactgaaaggtggaatgtttcaataaaacatgtgcacattaattaaactgcacatacttttactgctttccattgtcaataaagatacgacaacatgcatagatgatctctctagcaacaaatttagaactgaaattaacaaaaacaaaagtatatacagtatacagttacaaactctaacagagatctaaatagtatatcattctttgcactaattggaggccttcctagaaaggccccatgttaatcctagattggtaactaagaggcaagaattcgtacattaataaaaattatctagttgataaaacgaaataaaaccagccatataatatatttaactattacatcctacagatgtccctaatcaatatgatgagtttgttcagattctatgcaagtgtcgagactcaaaagtcccaccaaacaagaaaataatcaaaccaccatgtgcacatacttaacggagtccgagttgatcacaaaagctatctggcatgcaaactaattttcatcagatatcaatctgcaaactaaatacaaacatcgtagaaaaaaattcaatatctaatatacctacactaaaacatgctttccatgccctggttgactagtactaataaaatttgcagagaatgaatgaaaaatgagctaccatgtaaattcaataaggcattgagaactactgcaaatctaaataccatactctgttagggaatatctgagagtgattagcaactattcaggcattgaggacaaatgtgttcaacattctccaatgctagattcactaatttggctatgatcaatgcctattgagcaaaatctgtaaatcttaacaatcgcaccaatgcaatcaattgccatcgttgtaagggagcaatttagatagcaatgaattcagtagctaccagcctttattatggtgtcccatgagatgaaatgcctccttgctggagactggggagtcattagtagcactagattatcagacaatgggtaattgaagctatgactaccggattcagaaaaggtgtttagttttgtcttcatacaaatgcaggactatcacatagagacagatttgctgccgcactgcctttggcagtatgagaggaggatcctggtatccatttccctgctgcccacaacaatctgaacgaaattgacaggaattcccaagtgcttaccactgagaacatccctcccttgaaaatgcagccaaagtgatattcctaaacacatctatacgtccataagtgccacagaatcctaaccttaacaaagtcaagttgctagactactagagacgccaccatcgccatctatcactccatttcaccactaaactgcacatcccgacatggtataacacccaaaatacatgcatagccttttttgggggcaaaattatgcagcgatccaccactgcgcaaattcaaaaaatgcgatctgtacttcacctccatccatagcacgattccaagaaggcaggatggagaagaaccaaccatggaacatttgcaccgagggcagcgaaaaaatggaggacgaggagggggcgtacgggtctcgagggcgagggcgaggtaggagttgcggcgcttctcgaaggtcttgaggctgacgaagcccgcgaggaggaggagcgcgccggcgcccgcgccgccggccagggaggcggtgctgccgcggcgggcgtagcccagcacgccgccggccaggacggcgaagccgtaggggatcgtgaagcagaagtcgtgcatctcgctctctcggcctccctccctccttctctcttaccagatctcgccccgcctcgccggtgagatctcgagagcagtttcttctctctctctctgactctctctctcaatctctctcgtactcgctctcgcttatttttggctaatccgtggtgcgccgcggagagaagtcgtcgatcggtggtcggtctggtctgcggcgggaggcgcactttcgtcatttcaggcggctaatcgatgaccgggagggagacggagagaagagaagtgtgccacccactcaccagccgccttcattgcaacgaataaaaaatgcggcgttcacatgcatttgcatttcttttttcaaaaaaaaaaaaggaaagagccactatatcaaagctgggcatgtgccatgggcagccagatttgagaaaagctagtttgaggcacattatctgtgcaattttcatgctcgtgtttaattacgccgtaaatttcaatactcactttgttcttttcaaaaaggtatattcagcttatacagattaagaataagatggaaatacaatcaaatgttgaatactccctccgtcccataatataatataatggattttgagattttgcttgcaatatttgaccactcgtcttattaaaaaaatttgtgcaaatataaaaaataaaaagttgtgtttaaaatactttggataataaagttagtcaaaaaaaattgaataagacgagtggtcaaacagtacaagcaaaaatttaaaatcccttatattatagaacagaggaagtattaaacaaaatgatagtattactcttgtttgaatactatgggagtatagtgatttgtaggaaaagaaaattttgtcaccatttttaattggtttgatgttcacgacgtcatagatcgtgagtcgtgacactactaattccatattacctcactcaactgccataatacctctgtaaactttaataccgaacacaaatgtacatatattaaaaacacattcgctttaacctggcttgtctaaatgaaaaaggttttcaccaacgcgtaaatgcataatgacagccagtcaaaaaaaatttaagaaatgagtactccgtttgttcgtattataactttgtgtttgttattggggttagaactaatcctctaacagaacaatagattaatatataattaaataaatattagtcaaaaaaagcttaaaaatatattagattaatatttaaaataacttttctatagaaaatatttaaaaaacatagtttatcagtgcgggaaacatacgcgtgaaaaataatatagtggaagttgggaaggggtcaatgttttaaatagcagactaagacatttagcggttagcttctcaaacagctatagcgggctaaatggagctatagcggctaaattgtacattagagcaaaaaaaactagaacccttctcaaacagctatagcgggagatttaaaaccctaaaaggggtatattcgaattcacctaagtcgctttgattgatttttaagttaaacttcgattaagtttatagaaaaatttagcaatatctaaaacaccattttagtttaattaaatgtaacattgagtatattttgataatatgtttgtgttgattggaaatattgcaatttttaaaaaatttaattaaactaaaaaaattaaccaggggaaacaaaatatcctaatcccattttattaccttggttcccgtcaaatccttggatgggaaccaatgttcccattttattaccagcacatcccatgataccaaaacgccctaaaaccctaaaatcgagcaaacaccctcgcccaagccggccgcccccaatcccctactacaggatacagattgcacaccgggtcggccggtccatccatggcggcgaaccagggcgaggcgcatcggcgggagcccgaccagcgccgccccatgtgcggcgtctgcaccaagcccctccgcctctgcctctgcggctgcctccgccgcccgccgctcgacaccgccgtcggcgtcaccgtcctgcagcacctcatggaggcgggccacccgctcaactccacccgcgtcgcccgcctcggcctccgcaacctcgccgtcgcgctcgtcggcgacgtcaaccaccgcgccagcttccacctcaggacgctcgacgccgccgccgccgccggcggtggaaatcatgaccgtcccgacgggcccggggagattcaggtgctggagggcgacggttttggcggcggaacgggaggccctgctggtcctgtgcaatgcgaaggtgaaacattagattctgcaatatgctctaatggaatttctggcgaatcgggtggagcagttagttgtgcaaggcgtgattatgtgacgaagggcatcaatgcttctagtgatttgggtgtgaaagctgcgaatattcgaggttctagcgatatcggtggtgaaatattggatcttgtggatatccctgataggattggctttgatttggatggagagatctgtagtgttaaaagcgacttaggtggaggtgaggaattggggtttcagagtatgaagaggaatggatattgctcagattctgaaagactgggctcctcagctaaccagacaggaaactcctttgttgatggtatccacggtgaaaatcatcacagtattggcgaggtaaatggtaatctccctcgtcatttagtagaaaacgcctcagaatttcaaatggcaactgcccaaaactgcaatggtatacctagagaaaatgttggaactgttgctgctattggtcaagactggactgtgaaaaacatggataagtgctctattacctatacggagaaggaactcaagattgaaattgagcgtggtgtgaagcccaaaatcagatggttgtcaagaggaccacttggtcagtcagctgtctccaacggttttactgtcacgaaaatacaaatgaagaagtcaaaacaaactggggaagtttcggtgtttgaggaattctcaatcaccataccaccaaagtcagctctgctattcccgtgccagcgggcaatcagcattgatgcttcagactgtcagttacaacatttgattgtgttggatggaacttgggcaaaggcgcaacgtatgtaccatgagaatccatggctacaacttctgccacatgtgaagctagaatcagatggtgttagcttgtatagtgaggtgaggcatgagccaagggctgggtgcttgtctaccattgagagcatagttgttgccatgaggaaacttggagaggatgcaaagggactggatgatctgctggatgttttcgagtcaatgattgcagatcaacggagatgcaaggatgagaattggaaacaaaaactcgagtccaagacataaggtggccctgtttttcttttgttgtctaattctattcatatgatttctggatgcatttttctgtccagatgtcatctatatcatgattttatactagggattttcgtttgctgaaagcaactgtctgagatattgtacttttgaactgtcaccattgctttcaatcatagtggcaaaagctgaccattaccctagtttacaaatattttgtgttggatacaaccttttccttgagtattgcaacactttctagtctacaatatactgaatgagttcgttagacatggtctaatcaagatttcttcatacctttgtttggtcatgatcgatcgaaatggtctgatctttttcttgaaatttggttgatatatcgtgtgtcctactcaacttttgctctccatgccatggcacatgtgttcttctgtctcgaagcaataaagcaactatgactagaattttggtttgtattgaacgtgtcttctactgaatttcaccttagagacattagcaaaatcagctgtaacatatatttcatatcatgactcgtccagttacataagctaaacattactgagaatgtcattcacttggcgataaccttgtcgcatacatacagaaatatcttgcacaagctacagtatcttcagattaggcaatactcaaatacggtaaaaagcttcttacatgcattcaacatcaaaatctggttataaaggctaaatatgttttataacataatagcttgattatttttcgttcagcattcacaaatgtatagaaaaacatggtctgagagtatgatccaagacttctaaatacattagaattaatctgatacagaaaaaagaatgtctaagagtagtaggataactgattggtcttcatgctactctatatgataactcaatgtctgagagtaggataagttaatacattaccttttgatttagaaaaaaaatggttttggatttagcctggataactgaatgggatggccccatcttttcgcttatacttatcagccttaaatttagagttgattttaaatttttttcatcgtagtttatttttcagcctttgcatttagatcgttaaaaacactacataaaaattttattcataattttttttatttgcaaatatgccgtttcgcttatgcttaaaatcagcgaatcgatggagctgttcaatgctactctatagggaactccgattgctttttagtttacattttatggtatcattcatttgagatccattgcaatgaagtatgatgaccaaagcttgacatcgctagctggtattggctcatcattgagaagctttagcaaactgatcatctacttaagaaataacttcgataagttcacgtttgcatgttggatggaacgtcacatgcaacaacattctggctgcacctgcacattaaacatgaagtcaggtatatcattcaaatatccaaatgcacatagcctttaggacgaggacttgtaaagaaaaggaacacacccactaccgccctgaaacttgtacagctgcattgctggtgcaatctgtacgaaaagtgaggctacaccttgatgctccatcgtctcacatgtgcatattgctttgatttctgtctcatgtcctgatgtctatcgaatgaaaccaaaccgttcagaaaagcaaaatgaactggtattgataattaccagatgatgtatatatctaattttgcggttaggtagaaaattcatactcgagttgagagaggtaagcagtagactttctcctttccaaacattttcgagcgtcgccttgtcaacatattccagcgggacggttttttatctcttttttttaattatttttaccaacacggtgtactttaataagattacattcgccattacaaattagtaaaacttctatttttctaatcaagacagtgatttcattataaacgccccacattttctactgctgtaccgtagagcaaaatttttgcccaaaagaatgctgaccaggtgatatttttcacgcaggtagtattagtattgcacactatcaaattatcggttgacattatttttcgaggtgacatggcccgtataaaaatctcccgtgaccactggacacgcttccgaaactactagacagtgtattttttttttaaaaaaaatatgtgcatgttgctttaagaaaatcatatcaaccaatttttcagaatagctaatacttaattaatcatgtgctaatgagtcactcctttttatgtgtgtgaaggattagtttccaacgtagaaaaaattacaaggccaccaccatgggaggcagtagacaggaaagaaaaaaaccaccaccacacactaacaacacctacatagaatctaggagaaggctagcactggaccagccgccgctagatcaacaaaaaaaaagagctatagctaaaccacccaaaaccaatacctaagagccgaacaacgcactcaactatatccacgtctttgggattggaggggagagggtgagagagaagaatggaaccgctctcccccacaagacccaccaatatggccagtttgcattagctagggcatcgtcacaagaggacaaatatctagagagagcacacacaaactgtctgagagaaattttggtcaggggcctcctagacgatatctctagggagaaaagcgtcaatgagcaccgacgccactgtccgttcgaggtttcaaagagaactaagacaagttttcactcggcaactccacaagagggagagggacggcttgataacgccacaagaaggaaaacggcacccaaaacatcattgttgttggcccggtaaaaccgagttaggttttacactagccgcatgccaaatgtcaatccacagccaacgctccattgctccaccacctagccaacctccgtcagcgcatggacatcgctatacaagcgccccccaccaacagcctctgcgtgcctccacgtggaaagcagcagacacgtcgtcccgggcctctcccttccccgtcgtgccggccttcttgccatcatcgcatggcctcctacactgttagctggccggcctccttgccgttgcccacgtcaacctctcacgctgccacccgctcaccgcttcggacttccacggtcccgtcgcctccgggcgtgccacctcacgccacgtcggcctaccaccgttggtcgcgtgcctctgtgcttcgccagcattccactgggagtagccatcccgcacgacagcaagcatgaggaatggagagaggacgccttctgctcccaggtagcgccacacgctttctctcatgcctgtcgccacttccacgttcctcctgacgttggcactgcacggccgtgcccgccgtcaacgcccgctccaccgcacccttcgacctcgctccacgtagttgcatccgccgcctcgtcacgctgccgactcgagtgcgtgcaggggagccggtctcccgcgccggggaggccagatccggacgggagggggctgaatctggttggggacaccatatccggcagtgctgcctcgccgtcgttgcacgggtcaacgcctcctcaccggtccttgctaccactctcctcttcgccaccagtagccagctccttgaggcgtcggctccagtctagcgtcatcctggatctagtcacggtcgtgggctccgaccccgctaccttgggaagaaagaaggtcccaccgtcactgtccttggagccacgcggtttgcagcggctcgctcgggcggagggtgcctgccctatgagcgacgcaaggccgtataattgagggagagagctctcttattaaattcaatcgtagaagtcgctcccgctgctgctatgttcctccactcgtccaagagaccaagtaaagtaagcgagaaacaaaaaaaaaagcaggggagaatctaaacagaagctgggaaagctccgcgacgttaaatcacacctcgtcttcttctcggcaaggcgaggtgcagtgttggaaaatggcacaggatcgcacacgcaaatcttgcctactgttgcaaatctgtcaagagctttgcaaggaaaacagaggaagaacagagcaaactcgcaaggaaaacattttggggggcaattttctacttcttttgttaggaatcaaacaccatgactcctttaatacatgttctagcttgtgctatatatagactgtgtttagttcacactaaaattggaagtttggttgaaattggaacgatgtgatggaaaagttgaaaatttgtgtaggaaagttttgatggggatagaaaagttagaagtttgatgaattattttgaaactaaacacggcgatagaccgatcgaatcaccacgtaaacgcgtacgctcagtcgctcaccatgtcagccgttcaccgtggtcaccacttagaagttactaggagaaacatgcggccaccattgcatgcaccaccggaacgcctcacagccgtagtcttcctttccggtcccgtgcatgcccaggacgccatgggccacaaccgagaatagcatcaaccttgccaccgctgctgcttcgccggcgccaatgccgatgtgagcccggcccggccgccgcacccccctccccctacggcgacgacgtcacgcgcgcgcgagatgccattgttgcttctgtgaggggggctcaccggaacgcgtcggcattgacgacgacccggacgaacgcgcggcagcatgatgccgcgcgtcctcatggcgtctacggaggacacggccacggcccctgccggtgggccgccggagcccccgccgcagtcgtcgtcggcctcgccgtcgccttcccctcctcctcctccaccgacaccgtcctcgcctcagcggcctcccccgccgccgccgccggccactccgcccccgcctcctccggcatctccaggcaaaaaccagagtcccgcgtcgccgtcccaagattcacctccgccagtggcgtccccgtcagtatcctcacctcctccggcaccgacgacaccgccctctccgcccccaccaagcaagtcccctccaccgccgtctccgcctcctactacgtcgtcgacaccgccatcgcatcaatcacctccggaagaaggaacctcgccgccaccttcgccatcatcaggggctacaacaccttcacctcccccaaatgcgcagtcgtcgtcgtcgtcttccacacctcctgccggcgcaggaacctcgccacctgcaccgcgcgaaatgccatcgcccgggacgccaccatcgccgccgacgacgcttattacgacacaggcgccgccgatccagccaccaccaccaccgggcggtaacagcatgatcatgccgagctccctaactacagccggcacgtctcagagcccgcctgacgccaccaccgccggcgcaccaccacctccggctccatcggtgggagcatggggcggcaacgtgccgagcgggttgctcatcggtgtcgccttcgccggtttcctcctggcggcggcgtgcatgtccttgaacttgtgcatcaagaaccggtggaagaggaggctgtggtcggcacacttgatgaacctggcgcccaggacaaccctcctcctgcccgagcgtaagtgtagtagtccatctgtccaatgtccatgcatggattgacgtcggctcgtgtcctggcatgacatggcatgagatgcaggtgtggcgtcgccggaagtgtaccagccgtcgaacggtccgacggcgtcgccgagcgggacgagctcgtacgagttctccgggacgacgtcgtggttcacgtacgatgagctggcggcggtgaccggcgggttcgcggaggagaaagtgatcggcgagggcgggttcgggaaggtgtacatgggggcgctgggcgacgggcggtgcgtggcggtgaagcagctcaaggtggggagcgggcagggggagaaggagttccgcgccgaggtggacaccatcagccgcgtccaccaccgccacctcgtcaccctcgtcggttactccgtcaccgagcaccaccacctcctcgtctacgagttcgtctccaacaagacgctcgaccatcacctgcacggaggaggcctccccgtcatggattggcccaagcggatgaagattgccatcggatcagcccgtggtttgacctacctgcacgaagactgtacgccacaccttttttctttctttcttttttaaacaaacgcaattacacttaatttggtcttcagcttaattttctgcattcatttaaccgttcaatcgactctattgtatttgcaggccatcctaggatcatacatagggacatcaagtcggccaacatcctcctggatgacgccttcgaagcaaaggtgcgaacacaacttgttcctcctcagcattccacacagaatgacaaactgacgacgattgaatttcttgccgatcggtgaccaaaaaaaaaaaaaaaaaacaggtcgcggatttcggtcttgccaaattcaccaacgattcggtgactcatgtctcgacgcgcgtgatgggcacattcgggtaattaagcacttcgtacgtccgtacgtcctaatgcagatcatcatatatatcatggtttaattcgatcgatcgaaatttctatgtaggatgcatggctttcgtatgttgttacatgacacggattgtatatttgtatgtaaccttggtcgttgttgcacaggtacctggcgccggagtacgcatcaagcgggaagctgacggacagatcggacgtgttttcgttcggggtggtgctgttggagctcatcaccgggcggaagcccgtggactcgtctcagcccctcggagaagagagcttagttgaatgggtaattaagtatatatgcatgcgatgattctcaagttaattacagacgccgacgcgaaagcttttgtcagtctgtcttgttacatggtcacatggctggtgatctgtgtccggtggatgcaggctcggcctctcctggtggacgcgttggagacggacgacttcagggagctcgctgaccccgcgctggagcgccgctactccaagtcggagatgcggaggatggtggaggccgcggccgcttgcattcgctactccgtcaccaagagaccaaggatggtgcaggtaattaaactgaaatcatccctcaagggccgtatctatcgtttctgacatgttatcttaaataatcattcaaagatttcaagatgtattagatgtatcactccgacgaacatacaagtcaacttctattagttataacaaaaatgatttgataaatataattgccaatgtatatatgtatctgtctgtcaatgcaaatagtgtattataaaaaaactatatattggatatataggtgtggcgatcgctggacgtggaggggagctcgccggacctgaccaacggagtgaagcttgggcagagcatggcgtacgactccaaccagtactcggcggacatcgagctcttccggcggatggcgtttgccaacgacctctccaccgctgagctcggctactccggcaaggacgacgtacgccgtccgccacgctagcagcagctccaggaccaggcccagctgagcactaacggcacatgcgctgttgttaaatttgttgtcgtaactaacacgcatgcatgtatgtaagacggggtggcagaattggtgtatatataaaaaggctttgaatagcaatcctgttgatttggggaacagatttcctttttcttcttcttctaagctcggttgtgacttcgtacggtgtgtgcattgacattggcgttcgctagccttcgcggcgcggcgacaacctcgtccatcgatttcgtacttactgccacccttttcaggcgtgacgtgtgaccgttgagagtgtgcaagaatcagttagtacgttgttgttgatgaaaaaatcgaacacaccgatctagaagatctgcttagctcctgtgtaggtccaaatcttgatgagatgcgagcgtgccagtcagtttgattctgcaactgacaagatatgcaaatagtagatcaaaacagccgatcagctgacaagccgacagagtagttccaaccaatagccgataatagccgatgccgataccagccgatagcgatagggtttaagcaatcggctatatgtctaatgtagatgatgatataaaggcaatcgggtgatgatgatgtaataaaataacaatataatccagtataaaccaatcggcaaataatgatatgataaataagcatcgatccgaaggttaaaacacacatcggctggaggtccgatgtcatgaaatccacaagattggattaaacagtgaaacttttgttgtcatcagctaaatccaacatatatgtatatgcaattcttatgagccgatgcaacgtccagataactcaccggctgaaaccccgatgaaacccttattggcaaataaaaagcaggctagagattatggttttaagcacgacttagtagatcaaacttaactgatgcaacactaagtatgaaaagaaacatagtatctagacaatcaagccgttgactgagttttcagggtggtagatgtctaagctaatctaatctagcaacgcgatttagccgatactagcagaaaccctaaaacgagaagcagcagatagagctaaattgatatgctaagactagattaacagagacatatgataaatttgtaggcaaatatatcatccaaaccagagcaatccaagaagtcgaatatactgatgcagccttgaacgacgccgacgtaaacgatacaattgcccgggccggcggaacattggacttaccccttagccggagatcgaacaccgatgcagccccgcgtcaggtgccaagtcccgccggacaataaaataaagtagaaaaggtaaaaggtggcaatacgccgaattgtattgattgtgaagatagattacaatgaccctgggtgtacatatttatacccatgaatagatactagtccttgtaggacaagaaagaaactttcctaaagataaaaggaaaacataaagtccttataggacactaaatacactttcctaaagataaaaaggaaactaacaaattattcctagttaatagatacaactgccttcttcggacttgatccatacgtggcaatcatcatgaagcacgtngatgctacttnnnnnnnnnntcccnanntcacctagccagaatcggnnacatnggnttgccttgtccgattcggtaactgccgatgcacactgtaccgatgcggttttttttccccgggagaaaaaaaaggccccccccggaaaaaatttttttcaaaaatatttaaaaaaaccccccccccccttgtggggggtttttttttttcccccccccgggttttttaaaattccgggaatttttttntctncccttncnccaaatccnngcttcggccttaactccaaatccgatgtaaatttaccaaatttggtcgttaacagttgtaacataacatatgtttcatatcatgactgtcgtccagttacacaaggtaagcattcctcagaatgccattcacttggctggctacaaacattgttgcatacatcaagagatatgtcgacaagctacagtggtatctccagattagccaagattcaaaatacagaaaaaaagagcttctgagattgtattttagcaagtcgtaaacatatatacaatatacatggcaggcacttagactatgctactaactgtagtctgtatgtctgttcagatgttcttaaggggacatcagaattttcctgtactcatgactaccgtcctggatgcacccggaaccagccagcgacgttatccacacatcatccgttctcactggttcttcgtcatcatttctgtgccaagtccagtgagcatgcgtggcatttactatttttagttcaccatgcccaaagcttgcttcccggaagactgaccaagctggtttcggattgcggtacctgaaaataccgaaaagttgtatataatgacaccaaagtgatttacattcagagctctaaccatggtattataatggtacctgtgggccaagccttccctgtttccaccatccccaattgttatgtgaacagccccacaaggatcaagtccccccttgtagactcgctccttcatgaacaatgaaatcatcaaatggaattgtcacaaccatggactaaaaggtcagaggccaaagttttgaacaataatattgtgcagctaagagatctgataagagccataccgcacgttcataagcatgcacatgacctgcgattaccatatccacatgagcagcatagagcaaaggctccattgcagccatcatactgtcaccttcgccttgatgagcccaattgctattataccatggtgcatgcaacaatacgatgagccatggcgtccttttcctgtcaaccttagctagatcagcctgaaaagcagccaagataatccaaggaaaaagtaatctgctgtcagtaagagtaaggtggatttcaaagttgagcgcatctttttttaaaagaaaaacatagagaaatatgccagctaggagtgactaattgagtaactgtaacaccccatcccaaaatccgcactagagcaggcccacataggcatagtacccgactgacacttttgtccttgtttcgtgtaaaagggttaacccgtaggtactattgttggagcatggatcccaaacctatctaaatttccaatgtgtgactaatcccaccatacaagaacacttgggccacacgggcccaaacaagatcccacatatggaccgaactagaacacactaatgggcctaaaccggaattaatgggctggggtatttcactagcaactaagtaccccacaaagaaaagtataatttgaaagaacttcaaatgtagatgcaattgtcaacaggggcacacatggtatttctgggtcctgtggaacttctatgatgaaattgcatatagagaagttagtgccaatacttccagcattccatctttaaacatcattaacattatggctgaagctaactttatgatttaggaacacatggtcgaaagggaaaaaagagaagaaaagaaaagaagagcaccccatattacttccacaattccgtctttaaaaggaagatttttaacaaccaaatataatgcagcatgtatggttgtatcatgtagcacccagtatgataaccaagcatgaagcacactaccatagcaatgatggtgttgcagaaaacatttatgagcaaatttgctcactaccatagcaatccgtgctgacgtgcaacatatcgtcacaattcacaaatataaaaggttgcaaaaataccattgcagaactacaaaattcttagagaagctaatgctgttgcatattccatctaacatagctgctgcaagcccttttggggggagagagaggttcgggcaagttaaataacacccctatggatcatcacgccttctggtcatcaaaacgtatcacacgaagtccaaaattttcagaagaaagtcagtgatgcacttttgtacaactagagctcaagaaaatatttatagatgttcaatagattttatttaatttacaaaaatcaattgctggatgctagatactatgaaatgtttttctagttgtcagctttttattagaacaatacccaaagattcggaagctgaattaaataaactcaaaatggacatgtcatatgatgaaaaatggtgatggtttgcaatggtagtgacacattcactcaaaatcaagaaggagataacatctcgtagctcgatatattgagaattaaggcataataaataactgacattagcataacaaattgggaattaagatagaaatagttagttttcgcatgagtagagacagatcagttgtctttgtgtaaaaataagtgtatgcaaagagcgaaaaaagaggacaagcgctaggttgcagatggattgcatgtttataccaaattaattgaccattgagcaaaacataaactgaagaaagaaggtcccttaattggtggggccctttatagttgatcactttgcacacccatgctctacaggcctggtcgtgaatggttatctaatataaaaatcttcttatcccaaataaatagaattgatgctgtcagaaacgagcagcataggcaaatcaaatgcgatatggagataagagatacgaagtaatataccttaagccaagcgtactgatctgaactttcatcataatctgtataagaacctaacattatagcatgcacccctgcaactttgaaggagtagtagagatttgatgtggattcgctctcttcataaggcatcttccatcgtgcattgtatgattgaaatccagacttaaaaaacggtatcctttccttctcatgatttccttctgtcaccatccagggcctggtgctagcaagtggctccaccaatgtaccaaaagaatcccacaaatgttgcatataatccgcataagagagatcaccagggagtaaaagcatatcatgtgcacactgcttaatgtgattaagtgtcgaagttgtccaactggtctgccccagatcacctacaacagccaatgacaagggaaattgggagggtggtgtcttaaactggaattccggaccatgtcctccacaacggtagtagtaaactgtgttgtcattaaggggcccaataacaacatgatggatctttcctgaactatacattaagtagctgtatgatgtgctttctccttgagacgttgatgtgtatgtgcctgcttcagttccatagtctacaactgaagggacggagttatcatcagtgacaaatgtaactctcatgtgcttttctccagctagtgaaatgtgcacctgtaaacatattgcgcattttagtcactggttatctattagaaaaatgttcaaaacaaatacaagaattgaattctcaaaaaagactccatatatactcaaggatggcatgaaggtttagttgcatagagactgcaaattttctcagatattttttacatgcatttgagtgcaattctgtgctagtaaaggacatgccccccccccccaacacacacacacacacaaagatctattcgccaaacaagtgaagacagctgtattagttctaataatctaagtatctaatatagtactgtcacatctgatactgtggaaaccagagcaagtattaccatttgagtccaactgatcacacacatcaacgtggcaagtatctctaggtaaccatagttcattcagtcattctaatgagtaatgagatgcagttaaaattcaaaccatggaatgaggttgaaatgttatcactggtcaacaacctcttcagtcctttgcataaatacacaacgctgcatgcgaatgagcaagtgtatgaaaaccatttgaattttgaattatgattgggtacacttgcaaaaccacaacaagcaagataaaaggggggttaatagtgcatctggtatctcagcttatgccgatggctcaatttaggcaaaatatgtaatgtaactttggccaaacttgtcccaaatatccaaacattggctcaattccaccaaattagcatgtggtctcagtgttttgcacatggacccatcacctcagaagcatgaaagtgagagaacgggcaaagttatgggattgatttgcctacttattgtcctttgtgaaatttgaggaaaaactcagatatcacaacagttaatagtacaaggacagaactgagccattgcggcaatagttgaaggatcaaacgttatagagtttcttggattcaacataatcatctgttataacatacaattcaaatagcaaaaatgcactgttatagagttagcatgtcacatctaatacagaacggacgagttcactcgcctgaagcaaattgcagaaccagactactagagcacaaataggcccataagctgaaattggtaattttcgaatttagacatatttctagctaagggaaatgagctacactaattgaacacaaaataaatcagctacaaccagttcaaaatttgagccaaaactgtacaaaacagggaagttggttaccaagcaatagccacaaactgattgatcgatccccgagccgattcatgtgttttctaatcgatcgcttcttggattctcagaacataaccagacccgacaaaacttgacttatactccaacctacctcggaacaaatcgggaggcaagccaagccaagccgacgccgcggaagaatcaaggatctcaagagagaggtttcacctgctgcggatcggaggcggaagaggagtccttcttcttgctccacgggaagaggctgaggagggccttccggtggtggaggccgcagcgccgcgccgccgcgggcggccggacgtagtcctcgcccacgggagccccggaagcggcggcggcacaggaggagaacgaggagagcagcaggaggaagaggagaagcggaggcacggccatgggaggcctcctgcgcgctccggctcgctcctccattggacgctggacggcgtgtgcaaagctctcgatctgttgctgctgatgggggtcaggtcaacacaagtacacaacactgctttctagatcgggaacacctatacatttatccgtcgataaatttttttctaaaaatttgacatatataattatattataaacatagtgtaattatactgtaacttatatataattacactataatttgcatgtaactacaatataacttatatataagtttcacataattttaaatcgttaaatctattacaagatttattttgttgagaaaaaaaatcacagcacacacatatgtgtaaggatttgttcccacaacctccattttaccgaaataatatattacagaaagatttttgaaagttacatacaagttacactatagttacagttacagtgtaattacatgcaagttacagtgtaattacactatgattgtactataattacatctgtcaaatttttagaagaaaatttgtcgataaatatatagcaaaatcgttctagatcagcccctctaacctgctagtgtattttatcactgacatgtgggcttgatgagctcttaggttcaccgataaaggtatggtgtcattaaaggtataatcttaatccctgctttctagggtcctaacatttcaggcgttctgggcgatatataaccgtgaagttcctataaaacattttcttttttcattataacgtaaagtagatatttaattaatcggaaataaattaaactaggatgtgtggcaaattacattactacatccgttttagtttacttgtcgttgtagcacatctcatagcagtaataaaccaggatgtgtggcaaattacattagtacacgttaattacatcataaatatcaaaatttaggctgtgttcttggtggggttgggaaccctcacctcctgaaaaaaaaagagaatggattagcgtacgaattaattaagcattagcttaaaaaaaatttaaaaat

SEQ ID NO: 33968 - DNA, 6455 bp, Oryza sativa
taatgaagggtagtaagtgaaaaacttgtctaaagtgaatcgtaagaacaagaagtattttgaaaaaaaaaaagttgattgctagaatgttgaaacagggagcaattattatgaggatcatattaattaagaagtcctctcgtaaacagacttatcttctaacataagcggatgaacagactattcttgtgcggttattccatgtgccaaagggcctttcctgcaacatgtcgtctagctttttttttttttacaaaataaatattgcatcatgcatgtatgaacagggtattccattagtagcacttgatcaatcaaagccattggcaatttgacaaaatggctgtgtcacggcctcacgggcattggagctagctggccatgttttttttttcaccatgtcattgttacgtgggctgcagttaattaagtcttcaaattgaaaatagagcagcagtctaatgcttcgattaccatatagtatggcatatatacaattatagatgccccaaacgtccggggcgacctgactgacctgctctaggactgggcctgagtcgtacacttagttcggagcagagttcacaattttgataccagttactatgccgacactagcggaacattggttttcgtgaaatccaatcgaaaatcgatagattccaaacaaattttgtgggaaaaaaattgaattcatttatctcgaaatttcgatcggcaatcgaaagtgcaaacgaagtgaaaaaaacgtttggtttgtatcgagaactgatcaattttgttgacaaactggtaaggaatttcaaatttatttttgtttcctaaaaatgtagaaaatagtgaaaaaaaatgattaaacatttggggggaaatctaaaacttttggcattccctctcctataaatttgataacttgacattaagctacagacgatatacaatacatactcataaaaggcgataatttagagcacatatgacatatcacgcacaattcaatatgcatctcggcatcaatcaccaaacattaggcaaatagaatgcacgccacctaaattgaagtccattagtacaagtttagagtccagtacataaggtctaaaggttaaaactaggttttattctagcttctagcatgcggacacctccatataatttattgaacaaagtaaacatatgtggaattcaactttttaaaaaaattatataccaacaggttatattaatatcatactatttataggattttttaaaaatcctttttctcaaattaaatttgaatttggatggaaaccatggaaattttagagaactattgccgagccatgtcgagacgttgatttttcgcgaaatccaatcggatttcatcgttttgtgaatcctggttctctatattaatttagttgaatagagtgacaaaagatttgccacttgatgagaggagattttacgagagggattaaacttttttatacgaagtggcaaatgttaagagttaaatgccccttattgttagcctcgataacatcactcactaaagccctctttgtttaggcgtatacaccaacttatgagtcaaaaaaagtctgaacctaaacaaattaacgatactttcatttcacttttcatattattaagctaaaaactaggttgaacgtagactccaccattacacttagcacttcaaattcattggtttataaatcatactctccgtcccaaaatataataatttttagcactcatgattcgtccaaaaatatatcttcactaacattcaatttccaaccaataacaaccctccatcacttactttttcccacttacctctacttctcaaccatcacaacgtctccctatttaattctatctacttttttaataattatgtccaactataaaacttcttatattctgggacgaaggtaatataagccaaaagcaatctaagccaataaacctaagcataaacaaaaaggccaccggttcaaaaattagcttatcacattagttataaactagtactatgttagattcattgtgttagaatatgtctaatccggttttaggtggctatattttgaaatggagggatataaagataataaatatagaagaaagctatttaagtaatactaatatagaagaaagttttggagtagtatattttctgaagcatagctacgataatctatacctctatattagcatgaaatatcatggtgataagcgcgttgatggtatagttaagaaataatgtcaccttggcgaagaaaaaaaatattattatgaatagtcaaacttgcttaactcaagtctaatgaagtttagaaataaaacaaatgacgtgatcgtttttaccattctcgtgcttatcatcctggtgtgtccagtgtcccgagtctcctggcccatcaatgatatccattatccaccagttaatatgttagtatatcccgtttgcaatatggcaatttgttttttaatcttcgaagcagtttgccgagtacccccagttctccatattttactgacactttcacactgttttcatgagtaatcattatcaaccccatcgtttcggtatatttgtaaatgaaaaataatttataaagaaaacttgtgtgagagagagagaaagcaaaaacgaaaaaataaactttaatgaaaaaaaaatctcaaaatcatctttaaatttaagactgaaagttcaaatattggttgacaagaataagcataggtgaaaagatgaggtcctataatttcactcattataccaatatgtttactagaggtttaggagctgttcaagcaaaaataaaccttaccaaatttttgcaataccaaaattttgacaggagtttttatgcatttattaaagtttggtaagaaactaaatggattcacatatttagcaactctaaaaaaaatgatatggtttaaaatgacaaattccatcggttggcttattcataagcttattctatgaataagccaaacagcatattcacaaacgaaaattaatttgtgaataaaacttttatatacatgttcttagcgacctaaaagcaaatgctgaaaaataaacttcgatgaaaaaacatctaaatcaactccaaatttaaagttgaaaattaaattttagctgataagtttaagcataattgaaaaaataaggctagacatcaatctaaacaagccctcagtaagaatctagaacagcaaaagccgcactctggattatggaacctgccagatagaaattctttaagaatacaattgatcgacaactgcggaaataacgcaccaccagaaaagtaggttcaggggttgtttggttcgtgaccacatgttgccacactttgccacacctcaagttaggcagctttgagtaagttagccagacgtttggttcattgccacacttgtggcaagattctttttctagcactttggtcccacatgtcattgtctcagaaaagtatggcaatgttatagattgctagccaaagtgtggtgccaaatttgtttgtctaaccttatgcaaggttggcaagaaaactatggcaaccctaggcaatgttagtatataaaccaaacaacccctcaatctgcaccatcacaacacaaagtccactttgcagtttccctttctttttccatagcggaaaaccgaaagcatgcattactggagccatcgtttcgctgaataaccgaaacagcatatttgtaaacgaaaaataatttatgaataaaatttttatatacatattcttagcgatctaaaagcaaaggcagaaaaataaacttcgataaaaaaacctcaaaatcagctttaaatttaaggttgaaaattcaaattttagctgatatgcataagcgaaaagatgaggtggttaatgatactacttcacattgctgaaaagaaagtgcgccatcattcacccaccaaaagctggtgcgtcacatttacagaattagtacaacatagcattatgcacttcatagattagatattgatatgtttagcaggtgcatggaagtgggaactagaagcaaggaataagatagggtgttcaaaaatgccccatatgagaagggatagaagatttgtcacttgatctttcctttcaccgatctaaactgaaaaaaaaaagttgcttcctactgtacttgttagcttcctgcagaaacaagagagtttgtttgatcagcaatgaaaactgacgattgaaattaatatcagcacaagggctcaaatatttactgtgatttgcaggactgatccagaattatcggtcgtgcttctttttaagaacttcccttcccacgtataaatctaagtaaccctgcaacacaaaattatagctcattgtaaaatgcacctaaattaccagtcatggccatggaacagaagatatcaaataaaaacagggagagcattggcataatacctgaacgagtttctctagattctgagattcttctaacaaaaatctacaggcatctatctctgtcagagggacctttgagcccaacacggtggtcactttttccacagccttcctcactataattttgtggacttcccgggataacagcccatcttcccacaatggctttatgatattttttatgaattcacagaggttacacttgaatacatcaatggacatgctactttcttcaactatgctttgctgagatggtccactatgtgaattaggtgactggaacctatttccatctttcctttcgcaaattcctccagtaagttcaattggctcaggttgcttagactgttctttctgcagagtgggcttacaagaggaagctgaaagactcttgatattattctggggatttgtaccatcctcatttacctgaaaagtcacattctcaactggctctagctcatcatctgtattcatattaggcaagcaatttaagtctggtatcgaggaacatgaatcccaatcagcttgtctagtagtacaaggattatctctgtcagaatcaaactgatggggtatttgttggtttgatgccactttgagagcttgtgatggttccccactctctttatgatgtgtatcctgttcagagtctgcatgttgtgaattctcttgtttgattctcacaatgttgcaatccacggcgccccattggatgactctaaagttacttcctgtggaaagattgacaggcttctctaggaacttgtttgcagttcctttatccaattttgtcacaccgcacggagtagtgtcactgtcctgatttgaacacgctgacacatttactaccttcacactatcatcatccattgagcaaagaacagcagcttttttgtccagcaattccggaacagttgattgctcacctgatttggcaccatcagcttccagtgtattttcaatgtcacagccaacaaccaattcatgtctgctccttgcgttggaatgaccttcaattgctccctgctgagaaaacttctgatgcacactactttccggatgagaatcagcaactggtttcgtgctagtatcagaacagccattccaacaacatgaaaggtcatcttgttctttctgctgcataacttcactaggatttgtttctggtggaacatcctgataaaacattagtcctttctcagctattgtattttgtgggcttttcatgcgattgtcgccactaagggatttgaagggttcctctgactctctctcagttcttcctttgctacacttttgtgcttcactggatgacattacacctctacattgtttggagtcctcagatggactattactttcatcatcgctttctgagctaacagaagcactccctgatgtgctgctgttttcatcatcaaatcctgagctaggtcttccatttctcaatctttcgctcacagataccttgcttgtttgcactgtccgatttgtattggttttttttacattttcagcttcagcacaattatctttcttcaatcttctccatataatcaaacaatcacgaagtagttcagacggagaagcattatctgattctttcacaccattctccacataggtgactggagcatcttgtagtttaccattcgaaacctcatcactcttcatgtcttctgttttttttgtgcaaacaaccaaactaggcttcttatcagactctaacttaatgttctcacttccttcactttgttttggtccatttgatgacataatggttttacttctacacttaggacttaacaaacctgaattctcattagactttgagccactacatacaacagttggaatattgttgtttcgatgatagttccctttttctccattttgacctcctttcttgatttttttggtatttccctcctgattatcaccactctggcgtacatcaccatgagaatatgattgccaatccttcatgttcggatagca

SEQ ID NO: 33969 - DNA, 1809 bp, Oryza sativa
aaattatcacgtggagattggtgaagttgctcatgatggaatgcatgaaattcatcaaatgccttactggtgtgagctctccctacttcaaacctatgacatgttcgaccaaccaaggagtgatcagaaatattaaacatcaaatcttttgaacaggtgccctgatgcttcttgcaagtctggaacttttccatgtaagatcgatgccttgctttatctatcgctgagaaatgggcatttgggaagttaacttcagttggcagacgttgaacttcttgataacttctattttgtgtgcaactcccctgattagatgaaaagaagtccccaagtctttctgttgtacgcatatgtccatctgcaccttttgcatactcagacacacgattgagggaaggaacttctccctcagtcctagattaaggaacaaacaattgaatcagataatagtaatacacataaacaggtgcatgctgccaccgaaaaatctagatctgcacctaaaaaatattaccttagacaacttgtcggagcatgatcaggagaaagactatggttgccccattttgatgaatcgcgaggacaagcacgaccttcaccatgatatccatcaatcttatttccaaagggataactgtaataacagaagatagatcataacatggtgcacatatttattttgttaggaaggaaatctttaaggaatgcacagatcataaaatgcagaatattgaccaatacaacatgcgagaacatcaaagtgggaaataaaagagtaaatttcacaaaatcacatataattatggcaaaactagatttagagaaactatattgcaaaactagagtacttctctaccgcaaaactacaaattttagactttacaatctccatcgctagcagtgataacataacaagagggccccacctgcagcctcatgtctttacacaaatggaagcagaaaagaacaaagctccaaaagtctttcttcaaagcaggcttgcagtggcaagagcaataacagttacagtcatgaccctagaaaatggcttgcatgtcacggggcaatctagccagtggtagcaccttggcaggagatagtcagtcgcttggacagtaagtggcaacgtatgcaactcatgttttgcttccattggtgaaacatgctgcgtgatgctttgtgaggctacaagttgagccctcttgtcaggtcatacttcaaagtggtagggatggatattctaattcctaaatacggtcatctctcttaaatctatattttttgctataattttatcgactcaacaaaaaatatggcaggattaaccaaatttatgaatgtcaatagtttggtaacatatacacacctcttcatacaatatctaggggaggagctgcgcctgtgtcgctttgactccaggagtccagttcgatcaagaggttggtcccatatagcaaaattcttctcagtttcagcatcatcatgtgaggaggacacaagatccttagtttcttcctccctaaaagaatggctacaacttctatcattcaaagttttgccatgactatgcagcaaatcatgtcctctaaactgatgtggaatttctgtagcagcaacagaatcttctatcctgtctctgcatcataaattgcattagtgaaactactactggatagagaaactaacaacatgacgaccataaattggagaaaattgcatatgtaccatcacataagattggattcgctagaataccatcacataaattggcttcactagaatatcattctcaaccagggcatatttgcc

SEQ ID NO: 33970 - DNA, 2756 bp, Oryza sativa
attttcatagcaaacagtaatgtagtttgatttgctcaggctctaaaaaaaaatttggtaaacggccactggaagcgcccaaataatattccttccatttttaaataatggacagcaggcactattcactttctcactaggaccaatccaattcacaagatatctacaaacactaaaaatgatgtcatgttcttaaaatgtattatatccaaaatataagcatgaaattttcattcactttagtctaaccatttatgagtaattagtggtcaaagtttaaatagtaaagtcaaagatgtcaattaattaaaatgagaggaagtaactatcaagtgagggaagcacccatacaccataggccccaggcccgatacgcatccaagcaattaaaccaagcgtttcacgagggaagcacccatacgccataggccccaggcccgatacacatccaagcaattaaaccaagcgtttcacgagtgaaaaggctaattggcggttggctgcgcgcgccctctcccgcgcggcacaaccacgtggcttgccgcagagatggggcagctgaaccgcgcggtgggaaggggccacgtgcccttttttggttttttcccggttttctcagtttctttccggttttccattttttttatttttctctcgttttttagtatgtacgtatacaaacttgtatacatgttttttcgtttctctcgtgtttttttttcagttttttaatatgtaggtatacaaactttatatgtattgtatacatatgtatacaaagtttgtatatgtgtatatttttttaaacataaaaaatgtaatatgtatacataaattatatatatacatattttatatatacgtatgcatatactttatacgtaaaaagagggaaaaggaaagaggaagagactaaagggtcgaaagccacgcgtgcgggcgcatccccacgcagccacatgcgcattaaagctccccttacacgagcacaaaaaatagtgtttggtgtgcccattggcgtcaaatgcgcaatggaatttcgacgttgtcatagagattaataatacttcctccgtttcacaatgtaagactttctagcattgcccatattcatatagaagttaatgaatctagacacatatatgcctagattcattaacatctatatgaatatgagcaatgctagaaagtcttacaatatgaaacagagggagtagtgttttttcatagcaaacacacttaatatgtagttcgatttgtccgggctctaaaatttcttttgggtcaatggccactgaatgtgtccaaataataactgccaagtgatggaatcacccatacgtcacaggtaccaaccccaaacacgtcagctaagcaacagaactatggtggaccttgcaaaaagcgaagcattcgtccatgtgtaaagtcaaattcgaaatcgagcccaaataaggccttgtttagttcccaaaatttttttcccaaaaacatcccatcgaatctttggacacatgtatagagcattaaatatagataaaaaaactaattgcacagtttgcatagaaatcacgagacggatcttttgagcctaattagtccatgattatccataagtgctgcagtaacccacatgtgctaataacggattaattaggcttaataaattcgtctcacggttttcaggtgagttatgaaattagttttttcattaatgtcgatatccggtcaaacgtctgacgtaacacccaaaaattttcttttcacgaactaaacacaccctaagttacaagaccaatttcttctctcttttttttcgatgacagacttttttttcccaatgaagaggacctaatttagagagaaataaattaggggaggtgcatggcgagaaaagcgttgcttgctcttaccctcagccagcagatgatctgctggtaagttttcgttgatccaagtcttcacgcgtcacagattaattaacctggaattcatatgacatcagaacatcaaaatgatcaaacccccatggattattcgagtaggagaaatccagacaagataattattaaagagaaaagggaaaatggacagcaatgacacgatgatgcacaacctttagaaataaatgaggaagggaaatctcgaaataataaagaaaaatagaatgcgaaaaaaaaaataaaaaaactaggcttaaaaggaaacaagaaatcaatttgaaattgggggcgggggggacagaagaaagaatgtcaataaccaaaatcaaataccttattaatgaaagaataaacagaagaagttagcaataaaataaccggaacgatcggatgccaagaaacggtcaaaagaggccctacgagtacgagggcgtcctggctacgtgcggctgcgaataaaccctcaaaaccctagccgccaccggccaaaatcagtcaagactacgagagagagcccaagaagcgacatgatcgatcggaggagattactagattagggcgcgttaccgggcgggcaccgtcgacccaatgcgagaggaaagtcccgaacgagcgagcggcggcggagcggggagacggagacacggccgatcgagggcggagcgaggaggaggagaggagagcagcgagcggcgtagtagtaggctagaggagaaggagacggcggaaggaaggaggacgagaaaagaagaacacgggggtttttccgcggaaactgcggtagaaatcggagagagaatccgcggcggagat

SEQ ID NO: 33971 - DNA, 32608 bp, Oryza sativa
ccacgtagcaaggcctgtacagttcgcgaaaaagatttagaagctacatgggatatttgacgggatgatagaaggatttttcagacacgaatgaaaaaaactaatttcatgacacgcttggacacggcaagacaaatcttttgagcctaattaatccatcattagtacatgtaggttactgtagtacttatggctaatcatagactaattaaactcaaaagatttatctcgcgttttacctctaactgtgcaattggtttttttaatatatatttaagagtaaagtgcaccagcggtccctaaacttgtgcgggtgtgtcatctaggtccttaaactctcaaaatgcatttttggtccccgaacttgtcttcggtatcatatacgtccaaacgggctccgatccgctccatccgctgacgtggcatccacggtagcgcctacgggtcagtggggacccacatgtcagctctctagtagccatatttccaccgccctgggagctgagagagagagagagagcaggaaagagggacgccggcggtgctcgacgcgtcacgcgtggccgggacgtggcaacgctaagctcctcccttttcttcctcagacgtgtcgccttctcttctacattcttctggagccaaactactcggacgagagagagccctatgcctctccgtcgcccacattctcgtcgtcgatcgcgaagaagatgacgcttgctgttgccgacgagtcgtctccatcgtcaaatctttcccgttccaaacttcccacatcatgccgagcaaatctcattttgaccccatctcgttttatccactgcagcaacggaaatgcgaccttgcccacgagagctccggaactcgcaccaggcgccgccgccatgatgtcgtcgctgttccgaccgacatggtccatctcaagccaagccatcgcgccaaagtcatcgcctcaccatcatggccaaaagccctcaagaaattttaagaatcgtgcacagacgagggatatcgctgtcatcttctccaactccggtcgccgagtgccatcgccaatccctctctccccggtgagccacggactaattaatcgtgcatgcaactctttagggacctcactaaccacccatgcaccttctctaagcattccaccgctcaagcgagccgtcgccgtgaagccgacgttatccaccaccgcagggctgtcttttccattgccgctgttacccagacctcgccatgccgcaatcaagttccagtgagcacccagggacctgctagactcgcatgcatgcatctttttgcactaaatcgggctgggactctacatgcacaggcgtactgaagaccaccaccgctcgcgacaccactggcatcgattccggccacctccggcgacgagaccaccttcaacaggatcgcaaggaagtcctcagcatttcttcttgtggttgtgtcggccgaagaatcgccgttcgccaacggcatcgtcgtgaaggaacgccggccggcgaactctgcggctgctgctgctttctccctgtgcctatgacaggtgggctccgctccattagcacgtacaggatttgattagagtaagtttaaaacatgtaaggttctttctgtaaatattgttatcatatcatatatttatttttataaatatgactgacatgtgagtccccactgacacgtagacgctaccatggcatgccacgtcagcggatggagcaggtcggtgcccgtttagacctatatgacacctaagacaagtttagggataaaaaaatgcattttgagagtttagggacctagatgacacatccgcacaagtttagggaccgctgatgcacttcactctatatttaatgctctatacatgtgtccaaagatttgatgtgatgtttttgggaactaaaccaggcctaatattggtaaccatctttactagatttagctcttagaaaaaattttagagagttataagggcctttttagatcacctggcaaaattttttaccctgtcacatcgaatgtttgaacacatgtataaagtattaaatataaatgaaaaaataactaattacacagattgcgtgtaaattgcaagacgaatcttttaagcctaattgctccatgatctgacaatgtagtgctacaataaacatttgctaatgatagattaattaggcttaataaagtcttctcgcagtttacaggcggattctgtaatttattttgttattagtctacgtttaatacttcaaatgtgtgtccgtatattcgatgtgtgttgacgaaaaacacgaggcctaggagatctacttaactccagtgcaggtccaaactcgcctttgggtatgttagcgtgccaattgatttgattctacaatcaacaagaaataaagacaaagaaaccgcgattaaacctataaacgatagccgatcggctaagtgccgatggcatatcatttatctttgagccgatgtcatatatgtatcgatcggcagtcatgaataagtaagaaagaactaaatctactcgatcggctgtagatgttaacgatatataccccttatatcgatatatacttaaatcaagtgattgggatagatcggtcgccatgccgagacagtataaatcacttagatcgaaatatatgttaataacaggactatatatattcatatcatagccgatcagataggtctagcatatatcggctaatactccgaaaccactctatactaagatattaaagcaagtaaaatatatcaaacaaaagcctaatatacttaaattcaacaagatcttaacgtagagggcagatttaacatatcaatgaagcatatagagtaaatatagttaaatcagataagatcggctgaaaccctgatactaccctaatcggcaaccagaaggcaggctagagattgatattccaagcacgacttaatagatcaaactcaactgatgcagcattaagtatgaaaagaagaacaatatctagacaatcaagccggtagtagtttcatagagtggtagatatcttatatagtctaaatcaacatcgatatttaacctaattggctgccttctaccgacagatgttagccgattgtaggttaaatagcgatattgctaaagattatgtaagatatatgataactcgatgaattacataaacaagattagagtatcataaagatggaagcactaatcccgagaacacaagccgtcataacaagttttacctcttgttgaagatcgaaaccgatgcagctcaacccgaaagcaagaactcgtcgaaataaaactaaagcaaaaagggtggcgatgcgccgagattgtattgaacgtgtgtgttaattgattacatggggtttggggtctatttatacccgaaaattacaaactatgtccatatcggacacaactcttatctctaacaaactctaatataccataagtctttacagcagacttttgcccaaacatatctctagggaaattatataaaatatcctaattaatagatacaattgccttctcaggactctatccatacgcggcaatcatcttgaagcatatcaacccaacccgatgttgtacaccaagtcgtattgtcggaatcggctgcaccacttaaccaagtctgactcgaacttagccgatccaatcatagccgatccggactccagccgattcttactctgtttccgcgataatccttatctttgattccgcttcgatctaatcttcctttccgatgctgatattaccaaatttggtcattaacacatgccccccaagtccggaacatttgataatgtttcggatttgccatatatcaactccgagcaagattcgcactctaccgtttcccgaccgttattccagtgctttaaatactaaccgttacccccgagaaatctcacaccgtcttcttccgttttcaccgctgaagcaaattttgccctctgtctctccggcgattccttcgacgcaaaaggcgatcccaaggcaatttcatctccggccagagtatgctgaggtgagttctcatcggctagatctccttttttttcgcatcggattgatttcccctttcctcatcttgttttcttcttctcggttcttttggattcgcagcatctttccaatcagatcgcaattccaagcctatctcacgagaatcattattttctcggtccaattggcaaccttgatcccaccgagttcattattggtgaaacaaataggatttctttcagattagtcaacccagatctaggtcactggaagaacacctttaaatcttggccatcacttgagaaaaccccacccgagaagagctggattacatggtacaagcgcgtatcggctagtaagaaagttcactaggacgagatcggaatcggccaaacgcttgccctcaccatagccaattcggctaaggatgaacctctgatggccgccgccacctatttctggtccaacaccatcaatgcctttctgttcaaccaaaggccgatgactccaactttaatcgacatcaccatgatcaccggattagatgtgacctcatcggctaaccctatgagtatgaacaccaagaaccaatttgactttaggaccaaaagcatagggggttggtctggatatgtagcagcatatatgggtaaagtgtctgtcactcctcgagaacatgtagctttcttgctaatgtggctagaaaagttcctcttctgtggatccagctgtggtcccacaactaattggcaatttgtagccgaagccctagaatcgaagaaacagtttcctttaggcaaaatcctcctcggctatctataccaaatgctgaataatacatcggccaagatagctgtcggctcagtagttggagcaggtggaccgtggtggctgctgcagacttggctaaatctgatggtcatgaaagttgtcaatcggccatctatgacagaagctgaatttccaaggttggagccgattgtggacgacgatggagaagaacgcactcattgtagatgcatgtcatatggagaatatgcatctacgccagccaatgctggggcaaaactatcggctgaactgctcaaggattggttctgcagcttttatgaaggcttccaaaaagacgcccgggtttggtttccttatgaagactcagaagaccttgagctcccatcggactttagatttgaagatatcaatcatgagagatatcaaaagtctagggaagttttctcagctgcaatcagcccatgcattcttcctgtcggcattcatcagggaagaaacattcaagtctcttatgaactttatcacccgatgagctcagctagacaacttggagtgggccaactcccaatcggcctattcttcgccgataaaatccaatgccgaggggaaatttcatcgaccttaatgatggattggctgctcaatctccaaggacctcctctgggtagtattgaaaatatcgagttggcgggttttaagagcaaaaactttgacagatggtggggcgagtggaaactgcatctattccaccaatcggcttctatgtatatgacagatctctttcccgatgttatacctcaggtaaactctgatctcattaattctgtttgaacaattattagccgattcataattcaactaacctgttcttctattttgcagacaacagaatcttcccctccacatcagagcaacagtggtaaagatatccaatatgccctaggtttaattccaaatggaggtggaccatctcctcctgtcatcggctacaatgcccccaagacctcaacccttcttcaagggctcatcagagaaccagccgatgcaggcaagaagagaagaaccaggtcatcagctgcagacacattagctctagccccaaagaagaaggctaaactcaagaagcctaaaccaactgatgatctacctgtcctggacccatctattgagcaagctctggacgaagaagacatcgaagacgatgttgatcaagctgcagccgaagtgagtgatacagaaaaaacaccatcggctttacccaagcagatccctccaactccttctgctccaactcatttttcaagggtaagcggctctctctgatcctttttgcaatcactttatttttcggtcgattaatcacagattttatagttgcagaagaagaaaactgttgtaaagaagaaatcgacagcaacaattctcaaaccagctccaccagtaagatattcttaatttttaccagttgatttcagccaattttgtctaacacttatctcttttacagcctcatcatcctccttctcctcctgtacaacaatcatcaagtgaccgaactccatcggctatgggaagtcaccatattaaggaagaaatacaaccaactgctcctgctatcctagtaaatttccttttgatgcaagaaattaaatcggctatatctactttgctctcaatattcctaaaattgtttctgcaggttttagccgatctcttctcttttgacattagagattatgttgatgaggcagaggaagatacttcgagcaaagccctagcccccttatccgatgatgtgaagaaaacgcttgaagatatttctcatcggctagaggcctcctctttagatagcttggtggtcgactgtggatcgattaggacacggttgcatgaagttcaagctctgcttcccgaagaattggccaacgtccttactccagctgcttatctcgaacaacatcaattcaagttagagaaagccaagcaaagactagccgaatgtcgggagcgcaaggagattgaagccataatccaagttaattgacagcttgtgcatgaagagaagtccaagcttgatcagctatctgagggcccgatcaaatctaacattgaccggctcgaggctcgcaagattgaactcttggcacaacttgaagaatgcaacgccgagctagacatagaacataaaaagctgaccgatctcccaaaatctgttgaagaacaaaaggctagattgagatcggccatcaagaatgtcgttgacatgaccaagtccctaaaggttatttttggaaccgatgctcaagacgctcaagccattgaagaagtagaacaaattaggcaaagagctattttggctatccagcgatatttgtctccgtgacatcctatgtaataggtcttagaaattttttgtaatcggctaaagataccctggtactttcttatcttgacaatcctttgtgccgacgcaatataactccatattttgctcaaaaatttgtaatttttcatatatgtgcccccctaatttttcaatgtcaaaagcattgataaaattataaaaacgactaagggcgatataacaatatcggccattgtacatcggcaaaccacaaccgattacaatagaaaagcaactaagggcgatataaccatatcggccattgtacatcggcaaaccacaaccgattacaatagaaaagcaactaagggcgatataaccatattggccattgtacatcggcaaaccataaccgattacaatagaaaagcaactaagggcgatataaccatatcagccattgtacatcggcaagccacaaccgattacaatacgaaaacaactaagggcgatataaccatatcggccatctcaaggcgatgtaatcatgcattaacccaaacacttggataatatttcttcaaatacttgccatttagtgctcttccataaactcctccatcaagtccttgcaacatgtaagcacccttagatacaactttgtggatttggaacggtcctttccaattcggcgatcacttgccgaatttgctatcccgagtcccaattagcaaaatcaacttccatacaagttcaccttccgaaaaatctttaagtactaccttcttgttgtaatgccgagcaactcgttctttatccttggtaacctttgcaagggctcttaatctagactgaaccaagtcttccctttcatcagccataaggttataatactcatcgattgttaaattatcttgtaactcagttctccttgagccgattctaacctcccatggcaaaacagcttcatgcccataaacaagcttataaggtgggacttggatcgatccatgacaagccatcctataagaccacaacgcttcggctaaccgagtatgccattgccgaggataataagaaatcttccttttaatcaatttgatcaagctcttgttagatgcctcggcttgcccattaacttgtgcataatatggcgaagaattcaacaatttgatacccatgttgtcagcaaactgaacaaactcatcggacacaaaaattgaaccttgatcggttgtaatggtttgagggataccaaatcggtagattaaatgttcttgaacaaactgtttcgcatccccagaatcaaccttcttcaagggaatcgcctctacccatttggtgaaataatcggtcgccaccaatataaacttatgtcctttactcgatggtggattaatcatgctgatcatatcaattccccaacctctaaatggccatggtttaatgataggattcattgccgacgccgggtgctcgctgaattgctccaaatttctggcaatcttgacaccctttgtaatatttgaaacaatcctccagcattgtcagccaaaaataccctgcacgccgaagtaaccatttcatcttatgagccgattgatgagtaccacaaatcccttcatgaacttcgccgattgcaacctaagcctgatcggcactcaaacacttaagcaacaccccatcaatcgtccgataatagagctcatcatccaataaagtatacttcaatgccttatatcttaatttctgagaagccgattgggatggattctgtaaatattgatgcacatcatacctccaatcatcggctgttattgctgcgacctcgaccttaacatctttgatcatcggcctataccccgatgccccttgggccaaatcattagcttcaatattttgctctcgagatacatgcttcaaagtaaccagccgaaattcctttattagttcttggcacttctcgttataaatcatcagtgtatcattcttgcactcatattctcctgccaattgactgattactagcaaagaatctcccataatttcaacagcatcggcttcaacctccttgagtaactgcaatcctttaagcactgcttcatactcagcttgattattggttgcatatgatttgatagtataagcaaactcaaaacttgcccccctaggggaaataataaccaagccgatgccacaaccatgagtgcacactgacccatcaaagaataaagtccacggtaagatctcaactgagccaattgaatcatcacgatgttctacaataaaatcggctatagcttgtcctttaatcgccttcggcgactcatacggaagatcaaactcagttaaggaaaaaatccactttccaaccattcctttcaaaattggggctgataacatgtatttgacaatatcggccttgcatatgacagtgcattcattggacaatagataatgccttaaccttgtacatgaaaaatataagcacaagcataacttctccacaggggaatacctagtttctgcatccaagagccgacgacttagataaaacacaactctcattttcccttcaaactcctaaatcaaaaccgagccgattgatttctcactggctgacaaatataaccgaaaaggtaccctcttctgtggaggaatcaaaactggaggagagctaagatattccttaatatcgtccaacgctttatgttgctctgccctccaagtaaactgttgatcggctttcaatctcaacaatggtgtaaaaggctccaatcttccagataaattagaaataaatcttctaacaaattttatcttgccgatcatctcttgcagttctgtcttgttctccggaggctgaatcttcttgattgcattaacactcctttgagttacctcgattcccctctcgtgaacaagaaatcccaaaaactggccagtcgatacaccgaaagcacactttgtcgggttcatcttcaagccatatttcctggttctctcaaaaaccttcctcaaatcggctatatgatcctctatctctttagatttaacaaccacatcatcaatatagacttcaaccaaccaaccgatcagatcatggtatatataattcatggctctttgatatgtagctccagcactcttcaagccgaaagtcatcacaacccactcaaacaagccgattgcaccaggacacctaaaagctgttttatggatgtcttcttcagccataaagatctgattgtatcccgcattatcatccataaaactcaaaatcttgtgtcccgaggcagcatcaactagctgatcggctactggcattggatattcgtctttcggggtagccttattcaagtttcggaaatcaatacataccctgaccttgccgtttgcttgataacaggaactatactagaaacccactcagcatatcggcaaggacgaataaaaccagcatcatctaatcgcttaatctcagcctttacgggttcaagcatatcggctttgcatcttctcggaggttgttgatgtggtcttacccctggtttgataggtagctgatgttcaacaatcgattgactgagtccaggcatctcataatactcccaagcgaagcaatctctgaattctttcaatagctctatcaacttggttctaaactccgaagataaattcttactaataaatgtcggccgtggtcgatcacctggacctatgtcaatttcttccaaatcatcagccgacataaaaccctgtccttgcttgtcatcgagatcatctactgtgtccttggtgtagacattcgaaccctccatgacgccctcaaaataatagcttgggttctccatcttcaattggctgtatatcagaatcggacacttttagaaaatctccatcccaaacttttcccgataaacaatcaagaccatccatctcccaaagagctaaatcggcactggcaacattgactgacctgtcggctggcacaatttcaatcttgtcgccttgccactgaattaagcactgatgcatagttgaaggaatacaacaattggtatgaatccaatcccttccgagcaacaagctgtaagaacccttcccatcgatgacaaataacgttgtagggatggttttgttgccgactgtcagctccacattcaaaactcctttggtttctgatggattgccgccaaagtctttaagcaccaagtttgtcttgatgagatcttcggcgtttctacccagctttctgaacgtagtgtaaggcatcaagtttactgcagccccaccatcgaccatcatcttggacatcggcttcccattaacataaccatttatatacaatggcttaagatgccgatgctctgtaccctctggcttctcgaaaactgtctgatctggtgacaaagttaatttagccgattcttcttcaacttcatcaacatcggcttgcttgaccccaaactcggcaggcaacgtgaaaaccatgttaaccgatgcagtcacaacactttttcccttagccaatcttcttgcttcatcggctgtggcttcatcggctacaggaacttgattcttaacacgccactcctgccttggctttgttttctttagtcaatgattgatttcctgctcgacttcctgaaagccctccctattccttaatctttgaacccttctcttctgattctttgtaaagataccagaaggacaccattgagttttcatgttttcattgtcctcctggccatgatcttggtttactggacccaatctttgatgaacaggaacccttgtctgccttagccgattgcccctactatacgatcggcttgagttttccgcaatgtcacagcacccaggacagtcctcaatagatggcagcttcatagcttcattccaacaaaatctaaagaactcgcaaccccaatgaggatcaaagccatcatcatcttcctcataatgcttctcctgctgtttgtcatacttcctctgatacttgttgataatcttagccgaatttacctgaaatcctcttgcacgaccttcatcggctgttcggccagctgtatgtaccatattgacaggaaaaggattgccatcaaccttcatcggcctcttagaattatcaaacttgattttgcctccttcaatagccgcttggatctgctacctgaagactttgcaatcattagtagtatgggacccagaattatgccacttgcaataccttttcttgcccaattctttagccgatggaatcgtgtgaccagcaggaagttgaatatgcttttctcggagtagcaagtcaaaaatcttgttaggcttggtgatatcaaaatcatacctctcatcttttctagaattcttcacccattggcatggtataacctttttgctccttacccattcggccgcagctatctcggaatcatcatcctcatcatccgatccatatatataaggacagacatgattaacctttctagaattcttcctagcctctgcaaacctctgttcatgcaaggttaccttctgtgtaagatgcgacaagctttcgaagtcttcagatgagaatttctccctgattggagcaatcataccctgaaaagccaaatcggctaactaggcatcagtcagatttaagctgtagcacttattcctcatttctctgaacctctgaatatattcatgcacaggctcatcatgtctctgcttgattgctgtcaaatcagacaatttcatctgatgtaccccactatagaaatagctgtgaaaatgcttctccaaatcggcccaacttttaatcgacccatatggcaaagaagaaaaccaagtgaaagccgatccagacaaagacaaccggaacaacctaaccctcaaggcatccacagccgatgcttcaccacactgagctaaaaatcggctaacatgttcataagttgatgtgctatcctgccctaagaattttgaaaaatctggaactttgaacagattaggtagaggaactctctcaaaccattcggggtaaggttgtcggtacaaatttgcagcatctttcggcctaagcccaaactgctccttcatgacatccgtaatcatatcggcccatggtcattgctgaggtgttccttgaggttgctgtggcatgggctcgaattgattgtattgaggaacaaactggggttgagtcgatcctgcctgctggtattgaacttgcggtgatagcggctgatactgataattcaaattgcccctggtaattctgaagattcggctgaatattgcgcaccaaatgttcgggaatagcttgaggtatcatcgtgccatctggttgcacgtgatgaaccaagtgctctaggacaactttatttgcagcatgctgcacaggctgaccaccaggtgtcgcaaacctagccgatgcattcattaagctttgctgctgaatcggctgaacaacctgttgccttaatggcgtctgctgaattggctgcaaaacctgccgtctctgaggcgtctgctggactggttgtacaccctgttggattgggggtgtttgttgggtcggctgcacaacctgctgccttggcggcgtttgttgaatcggctgctgctgggttggatcaccggtgtgttggggagataagaacatagacgccatctggtcttgcgttagccgattcacattttgtccgatgtgctgtggttgttctctcaccagcaaccggggattaactaattggcttggcgccgatgacggtgcagcaggtgtaggagccggtactggtgccatcggctgagccgatgtattggttaatattccagatttattgatcaaagcatggtgtacagcatagtcaacctgatcttggaagttgttgaactgcaactgtgctgtattgctgtcttgatcaacacctccaccttgaactccctgagtaccatcaccttgaactccctgtactccttgagagttgtcaccttgatttccttgagaaccatctgtagcacctttgtcactcggttcagccgagccatctggagcttgttttgcctctccatccttagaagaaccagtcccaggaacgtcagcaactacctttacatatacttctgcaccactgttcccttgcgtgtttgcataaatgaacttaagaactagttctgtgcttgctgcatcattgcttcaaaatccttcttttgatcaggtgtcagcttgtctggagtgatattcacgatgttgccttcattaacctcagataggcctagctgctagatcttctctttaacagaactggggctagccgaggacggtgatgctggtggcttctcctccgtagagaaaaactgttcttgcggttctgacttcttatcgggtcccaccgggcgtgccaaaagcgtgttgacgaaaaacacgaggcctgggagatctgcttaactccagtgcaggtccaaacttgcctttgggtatgttagcgtgccagttgatttgatcctgcaatcaacaagaaataaagacaaagaaattgcgattaaacctataaacgatagccgatcggctaagtgccgatgacataccatttatttttgagccgatgtcatatatgtatcgatcggcagtcatgaataagtaagaaagaactaaatctactcgatcggctgtagatgttaacgatatataccccttatatcgatatatacttaaatcaagtgattgggatagatcggtcgccatgccgagacagtataaatcacttagatcgaaatatatgttaataacaggactatatatattcatatcatggccgattagatagatctagcatatatcggctaatactctgataccactctatactaagatatggaagcactaatcccgagaacgcaagacgtcataacaagttttacctcttgttgaagatcgaaaccgatgcagctcaacccgaaagcaagaactcgtcgaaataaaactaaagcaaaaagggtggcgatgcgccgagattgtattgaacgtatgtgttaattgattacatggggttcggggtctatttatacccaaaaattacaaactatgtccatatcggacacgactcttatctctaacaaactctaagaaaccataagtctttacggccgacttttgcccaaacatatctctagggaaattacataaaatatcctaattaatagatacaattgccttctcaggactctatccatgcgcggcaatcatcttgaagcatatcaacccaacccgatgttgtacaccaagtcgtattgtcggaatcggctgcaccacttaaccaagtctgactcgaacttagccaatccggactatagctgattcttactctgtttccgcgataatcctcatctttgattccgcttcgatctaatcttcctttccgatgctgatattaccaagtttggttgttaacaatgtggcacgtcaaaacttgacatcgctgaatctaaacacggcctaaattatctttggcttcaagagtatagaaccaatacatcattctccctctctttcttcatctccttctctgcccaactagtttgaaagctgtcacgtcctgataaattcatcccgaaataaaaatcattctctaaaaggaataatagaattaattaaaattcgaaaagaaattggcaaacactaaaatacgtacaagaaaaattcaaatgtggcccggagaatttttgttaaattctccttggtctaaaaagagccctcaaattttagtggaattttcagagcacaaataataattattaagaaataaacaaagttaaaatgagtttataaaaagaaaaaccctaaaaagtctttttcgcccccttcccctcttgggccggctcggcccacctccctccctctctctcctctcccccgcggcccaatcggcctcctccccgcgcgcgtgccgctgacgggtaggcccgcccgccaccctcgctgacgggtggggcccacctgtcatccctgtcctcgcgccgcacccgccgcctcgtccgtgccctagcgccgccgccgccgcggattccgccgcatcccgccgtccccgcgcgcaataaagagggggaaatcactccccgtgattccctctccctttccccccacttttccctctctctctccctcggatttgttcggaaacgtttccccctaaacctcgccggcgcatcaatggcggccggatcttccgcggccgattccccgtcatccggccgttctctccccctcccaacgctatataaacgctccccgtgcctccctcctccgtttccgccgctcgccgctctctctccccgtcggaatcgagctcgcgccgtcgtgctctctctccgccgtcgccgccgagcttcggtccgccgccgtcgtcgccccggacctcctcccgcttcggcatcgtctccttcggcttcgacgcgtcctcgccgacctcgtccaccccttcgtttcgcccgccgaccgccggaacgccgccgtcctcgtcgacccgagccgcgccgccgcctctctccgcttcggtcgccgtttccgtcgtcgccgtcgacccggggtgagccgtggaccgcccatttcgcttcccccttccctcccctctctcgggcgccgctccgtcgcgccggtggtcgccggcggcgaccatcggggcgcgggcgcgtcgcctcccgtcggctgtgccggcgaggccgccttcgggcgcaccccgcggctgccatgtggggcccggccgtcagccgcccgcgccctcgagtgcggctgacgcgtgggacccacggcgtcggccggcgcaagccgcgtgcacccggtccaccgtggaccgtgaggctgccgcgtgggccccactcccgtggacccggtccgcgcgcccctcccctcggctgacgcaataaatccgattttaaattaaaatttaaatgaagaaattcgcaaatatccatttaaagagcatataaacttcaaatggccataacttggccatttgaactcggaattggaccgttcaagtctctaatttttccttaagaagtcaagaacccatttttttgctttgtttctgcttgttatatggagtttagtagagtaaaagccgtttcttttccgttggtcgtgtagacgctgcagcttcggaagatccgctcttcgtggaagttgaagccgacgtttgggaaagcgagcaaggcaagtcacatcatccttgaacatattgaatcccagtttacaaaattatgttgatttaaattattgcattatcgctttatttaaattcccgcgttatcactgttttatttagccatgcctatttacctttgttatgaccttattattgttattgttattatttccttgttcaccctagaataaacaaaaccccaactagtggacactctactcctggtatcactagtatgattttaggtagatgctacgctgtttaattaggtaacattaggtggttttacaactctagactttgggatattcatatcacctggacactttggaattgttggtttattgtggaattggattcacaccgccccctctattcaaaatccccaaaatggttttaggctgggctcggggtgcatggttttgatagtagcacctcggccatataaggaccggtcttcgggcctctgttgcaaagcactatcgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctgcctacctgtcccggaggttccggccgtaggtggggttgggtcggtactcttgtctatggctaggatgggttggaaactatgtcacgtcttccgtccgtataccgtggtggtatgtggcacgtggttacacgtgaggaagatgtgtcttgcgggtaaagatgtacacctctgatcagagtataacctattcgaatagctgcgccctcggttatgggcaagccgagcaatgtacccaagttagtgttttaattcttaaaatttgctcaacaactaaaatgtggaatggttggcctgggttggcttgggacgagctgggacccagggtcaggttgccagttcggtctgaatcatcgtaggccttgggttaaggcaggttcgtgagggttcacggccttgattaataatattgtatagctctaggatcatgtttacaaaatagctttgggcaactaagtgacttttaaatgctgtttactgcaaaacttaacccctatattattatccccttgtacccccttgcattaattatgcatctccggtgtggcttgctgagtactgtggttgtactcattcttgctctatctttctccccccttcagtaagagaagctttggagaagaagtcttaggtggagtcttggcttataccccagttgagcgcctatgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaatgcaattttctcggtcgcgacaaaagcgtgccacgaaaatcttaatcttcatccaactcttgttggagaaaagaacgagatcttaggtccattggataataatatagtaccaggttgcgttcttttcacttcctcgtttcctcggttttcgcgtacacacttttcgaactgctaattggtatgcttttgtttaaaaaattattagaaagttcctttaaaaatcatatcaatttattcttcagttatttatacgcttcttgaactgctatgtggtatgtttttgtggtatgtttttgtttaaaaaattataagaaagttgctttaaaaatcatatcaatttattcttcattttttttatactactaccatccaggatgtaacaacttttagctatatatatacataacaaagccaaaagctgttatatttggagacgaaggtagtagctaatcccttctttttataaagctaatatccactaaacatctaaaactcaacgtgcaagcatagtatttattagcactcctaaaacctacatgtaagcatgccacatcaactcattaagcactcaaagctcaacatgcaagcatatagtaattatatctagtacaatttatttcattctaaaaccaaacatatacatgctaaatcattattctcaaattattttaataatatttcaatccaaatcatttcatcatttcttcaatatctaacatatatctcgtaggaaagtgcggtgcatcatctaatagttactaatgagccacctcattttgcatgcgttggagccaaccttctccgttggaccaagtgagtaagatatttcaaagtaaatttttccggtgataaattatgtgccaaaagaatatagagctggagtatacaaaaggtgtgtttaagaggagagtaaagaaaaagatcgagaacataaaaaaaatgaggttaaccattattgcatgagcattattagtacgttagtttaaacttgaaaacagattaatatattttttttaaaaaaaaactcgtttaatagtttaaaaagcatgtagcgtttaaaaactcgtttaatagtttaaaaagcatgtagcatttaaaaactcatttaatagtttaaaaagcggaaaatgaggaactttctctgatttgttgtctaaacaaccacaaggttagtacacttttattagcttaatggggtccctctcacccaaacaccctctaaaactatttcttatcgtgagcacacttcccaaataactacggtgtgttgtgtaaaatagtttaaaattaattaaaagtatttaaaaaattaaaatatttaatacataattaatcatccactaatgaacatttgcatcagtgaagtaactgtgtggaatgcagccaaagtatagttgtggttgtgttaagtggtaaatttgctactaccctcatcactaaggtggtgtttcaatcttctaaatatgaaaataaagttaaagatacagataaagataaaaattaagatttcgtgtttcatgtaaaacgagatggtaataacgtgtgattaattgagttttagttattacaaacttgaaaaatggattaatctgatattttagaacaactttcatatataaagttttcatacgaaaacaccgtttaaccgtttgaaaagcgtgtcatgagtattatctaaaagtttatccaacttttgttggagaaaagaacatggcctaactccctattttcaaaacaaatactgagactgtgggactagagagctcaaatatcaaccacccttcttaccagctccatactttttgcgcaaaggaaaaaaaaaggtagaatcatatactctctccatcctataaaagctaagatgaaatgtgatgtttatagtataataatgaatctaaacaaatgcatgtccagatttattatggtaggaaatatcatatactatcataggttgatttttttataggatagaaggaatatgttagtaacaaatacgtgcatgaattaagagatggtactaatgggtcaatgataatttttttctaaaagtaaattttactttgtatcatcatatttcaatttagacctttttaaccaatgtttttaatcttgcttctggccgagtttagttctaaacttttttttcaatcttctaatttttctatcacatcaaaacttttctacatacataaacttttaactttttcgtcacattgtttcaattttaaccaaacttctaattttaacgtaaactaaatacacccgctgttgcagtttaaaaagtaaaaaagttggttaaaaatggttaccggctcaggatatgaacgttgtatttagtaagattagaaaacattggttaaaaatggtcatgatatcgactagtccttggagtcgcggattcccgacgaaaagggtcatttatctactccgtactactgtgctccctagtagcctactcgtacagtactagtacctgtgagtacctgtaccagcagactgtactagcaggctagcagcttactccctccgtccaaaaaaaaagataaactctggtttccgtgtacaacgtttgactgtccgtcttatttgaaaaaattataaaaaaaattaaaaaaacaagccacgcataaaatattaatcatgttttatcatctaacaacaatgaaaatacgaattataaaaaaatttcatataagacggacagttaaagttggacacgcaaattcagggtttgctttttttttaacggagggaatagctgagggccatttctctaccgagcactcttgacaagtttgggtgtaatcatcaactatgcttgactaccattaatgcaacgcgtccattcgacgattttacatctcctctagggcaagtcttaggcgatgtttaaatctagttacttagctttagtctttagtctttggattagtctatgtatttagacactaatctagagtattaaatatagactacttacaaaactaattatataaatgaaagctaattcatgagataaattttttaagcctaattaatctataattagagaatatttactttatcatcacataagctaatcatggattaattaagctcaatagattcgtctcgcgaattagtctaagattatagatgggttttattaatagcctacgtttaatatttataactagtgtccaaacatccgatgtgatagggacttaaatgttttagtcatatctaaaaaggtcttaagggcaagtaatataaggggcctgtttagatgaggcttaaactttttactcccccgttatatcggatgtttggacgctaatttggagtattaaatatagactaataaaaaactaatttcataaatgagagctaatccgtgagacgaattttttaagtctaattaattcataattatcgaaagtttactgtagcatcacattgttaaatcatggcgtaattagactcaaaagattcgtctcgcgaattagtctaaggttatggaatgggttttataattagtctatatttaatactccaaattagtgtccaaacatccgatgtgacggggacttggaataagtccctgtttcctaaatagcccctaacggcccatttggttggagggagtttttaggagggaatgggagtttacagggataaggctattaagtgttttatttgattaggagacatgggaattttggtggaatggggatgaggaattgaggaaggaactccctccttttcaatacctcaataggggcaggtaattgggagggaattcctcctttactttgtctaagcaaatctcagccattcgtttttattaatgatctaatctctaactaaactccctaataatttccatcacctctaccaaacaagatattgggattaaaaatcaaattcccatcttaatctcatcatcaattcccttgtgtaaacttccaatccccttacctcgagttaccaaacaagccgtaagggcttttacagtgtgtttatgtggcatttagtctcaagcttacacataggagattctcagtcatgtctgtgtttcccatgaccaaaccaagaacgtgtgaccaaactgaggccctgtttagttcgcgaaaaagaaaatttttgggtgtcacatcggatgtttgaccggatatcagaagggcttttcggacacgaatgaaaaaaaaaatttcataactcaccgtcattagcatatgtgggttactgtagcacttatggctaatcatgtactaattaggctcaaaagattcgtctcgcgattttccccctaactgtgcaattagttttttcatttatctatatttaatgcttcatgcatgtgtccaaagattcgatgtgatgtttttgggaaaaatttttggggaactaaacggggcctgagacacacgacgttcttcatcaactttttgtcagcgtcgttaggcactcaagcaagcccacattcgaggctaacgctgaccatggccatggatgatatagatgagtcggcgccgatgccgcttcggtggagaagcgccattgatctcgtcgtccatcgtccctcgctcccacgccgccgacctcgccgtccccgctctcacgccaccggcctcaccgcggggaatcgggggacgagaggaggggtggatcaggccgcttttcaactgctcccactctgccgacctcatcgtcccccaccgccactccgcccggcaccgacgccgacgccgcttgggccaccccaccactgctccgctacgagttcgtcgccgctcagtgagtcgaggtggggttggtggaggaaggagagagggggagggagccgcctccgccggttggggatgagataggtgtggggagggagaggaggaggcgagagagtcgccgccttgtgtcgccggagacgagctcgcaaacctgcaccatcgttggggtgggggagggagaggagggaacatgggggagtcgagttgccgccgtgcgcgtgggagccgagggagaggaagagagaggggggaaggagaagaaaaggtggtggggccagcctgaaaagaaaaggtggtgagcccacctaaagctacaagtacgctgtggaaaggggagcttcaactgcttttcttccaatgtggacatttgggctcctctataaggcgggacgcattgctactgtcctaattctccatatgctgcccctaagagtaccacattggattgagtgatgaggtggaggagagaagtaaggagagagatgatgatccactcctccacacaaactttaaaaaagatgtgagagtattagatgtattggtatttgtgtactagaggtgacatattgtaagggttgcctcttagtttataagtgaatgatatgaataagggcaagttttatagtagggctattgtcatatctaattttatctatgtaagataagaggtgatacatacaatacaccatatctacactacctctaacatagtaacccaaatgatattttatattatttgtttgtccaatcccctctttctttcatcccctttttcttggggtttgtgtggaggttaccccttgcattaggggtggctcatcttctctttcctcacttgtttcttccacctcatcatccaatcctatgtggtattttaggggcagtagattttccctattacacttgcacttagagcatcctcaatgtatttggcatactagtctatagaagtgggacccaagctcgaagtctatagttttagaaaccaccacaatgtgagttattaaggtgggtcccacagtggtaaaaaaatcatattgagttacaggagttaatggaaaatatgtgtttcaaatggatgtttgttgctttcaaaccatgtgtagatgacttttcaatggttgtagatgcataggtgtagaagcatctagtttaattggtaaatacactcgtcaactggtctcagacacatctattgatggacacaactggcaagaggcagacacaatgcataatgctctcccttttcatagcatgcaaccatttcctcaacacatcggttaaggaaatcctcttgtatccataaggagcaagaggggtgatgcaaatgtaacacagctcaactcaactcaaccaaaaccaagatgaataaggtatctcttgtggtataggatgtgagcaccgccgcgagtttacggcaagcaaatcttaacttcggaatagaagttgggtgttgggagccatgaaggctagagccactcaaagctggtgtatggttcgagcttacacagtcgtgctatttgccaccttgggttagggatgtagaggaaagtggatgcgtcgggctgggtctgtcccctccttcaaccgaaggccgttgaggggggggggaggggtagaattctagtatacacaaaaatatgaagatgcacttaaacccccaagtgggttttggtgattaatgacaaggtggttaaaggggactaacgtgtttatcaagtttattcacaggagtttagtcccaaagcgagttgtgatggctaagaatgcaaggagaccccccaattcaaatgttcctaagtgcaaaaatcatcgaaggtgattagactaggtttttcctttcgaaattgagtttaggaaaagccgtactattaagaggggtttcaagtgtggttctagggtatacaaagtgctcttagtcttatccatgagtcaaaagatttttggaatcatttttgaaaaatgattttctccccgggacagagagggctacccggaggttatggccagaacttccgggcaccgtttatttgcaaaaatttcctaagtgctgcccagaagttcctggcacttttgcccggaacctcctggcaggtttccagttcaaacttgtgagtaacggctagatgacgtcacctagccgttatatatatggatttcatccccaggtcactttttggccattccacttctgttcattcatgttctagggttttctagccactcccaagcttcctttgcttcctccactcaaatctagagcctatcttgtgagattgtgagattagatgagagtgtatgagtgttttggagatggcttaaagattaggtttgattgagcactttggatatcttgtgggctgtcacttaggcttattactcttggagatcttctcctagacgattaggtgtcgcctgtgagcttccaaagatcttgtagatgtcttggaaaagtttgtgaaggttttcctcacctccgcaaggaaacgaggtaagtgagtaaagattcttgtgctgagtttttagaggttgtcctaggtagagcaacttgcacttgtggtcttttctagaagaaattttgagttggatcttggtggtcactcaattctagaaaatgacctagaagtgttgagttgaaggctgtggacctcttctgggatctttgcataagtgaggcaaggggttaatcgagacccggctctttggagcacctcaacggagagtaggattcgtctgatccgaacttcgggaaaaaatcgtctttgtctctcttgtgcatgatctttgtgtgaatctgctgatattctgcgatcttcatcttattcctctgtgtgcctaaacttctcttgctaggacctatttttcatctcagttttaatttatctcagctgcccggaagttcctggctcaagaactccggaagttcctggctactcatcatgcccggaagttctggtgttcatcaccaggaggttccgggccctgttaatttaaccgctgcaattgttgagaaaatttcaggaaagccaattcacccccctctaggctacatctctgcacgttcaattggtatcggagcgaggtactcttgattcaagcttcaccgctttgagtgatccacgatgtcggacttagggggaaagaacggggaaaatggaaatgaagatgaagcaagcagcaagggaactccaccacccaagggagctactataccttttgattatagcaaacttaccattccttctcacaacttcgtctccgtgccttccgggcgtgctcctcaatttgatgggacatattatgccgcttggaagcacaagatgaagttgcatctaatctctttgcatccaaatatttggaaagttgtttgtacaggtattgatataccccatgatgacatggagctcacttcggagcaagaacaacttatccaccgcaatgctcaagcttctaatgcaattctcttcgccttgagtccggaggagttcaacaagattgatggactagtggaggccaaggagatatgggataccttgcaattggctcatgagggatcacccgccgttcgtgaggccaagattgaattattggaagaaaggcttggaagatttgtgatggatgacaaggagacaccacaagagatatatgataggatgatgattcttgtcaacaagattaaaggacttgggagtgaggacatgacaaatcactttgtggtcaagaaacttctccgtgcatttggtccaagaaatcccactcttgtatcaatgatacgggaaaggaaagacttcaagagactcaccccaagtgacattcttggaagaattgtgtctcatgagatgcaagaagaggaagctcgtgaagtgagacaaatggtgaagaatgccgccatgattaaaaatcaagaagttgctttgaaggcaaaacaagaagaaatggcttttattgtcaagatattcaagcactttcttcgcaagagtggctatggcaaagggaggaaggatgatgacaagggaaagaggcaatcaaggagagcgtgcttcaattgtggcgaatatggccacttcattgccgattgtcccaagtcaaatgaagctaaggctaagggaggcaagaagaagccggagcatgctcatgtggcggaggcacacatggcggaagtgtggtactctggagatgaagaagatcccgaggtcaagcccaagcccaggtcaaaagacaaggttgaaggagaaggtggtgttgctaccgttgccttcaagtcatcctcttcaagcaaggagcgtctcttcaacaacttgagtgatgacgacgacgactcctaccactactcttgcttcatggcccaaggctgtaaggtgatgacacaaaagccctctcaaacttctcttgatgttgattctagtgatgaggaaagtgataatgaattagatgatgtgcttaagagctttagcaaacccgctatgcaacatttggctaagttaatgagagctttggatagtaaagaacaatcactcgaaaggcaagaagaattgcttattcttgagaagaaaagaaaccttaccttagaggagagcttagctaaaaaatgtgctaaaaatgaacaacttgctaatgagcttaatttggctaatggttcttcagctagccttagggatgtcaatgaaactcttcaagaaaaatttgctaatttagacaaaagtcataaagatcttgaagttcgatttgacactcgttggaatagcacctctcaaccaaatgtggtttctaattcttctaacccttctactagcaatggttgtgctaggtgtttcaatattgatttgaactcttatgctactaatattgatgctatgcaagctcttaagaaagagaatgaaaggttgggcacattggtgaaatatggatgtatgaagacataccattcaaaagatgccctttacaaaaccatcaccgctcatcctaacaaggatggacacgggctcgggttttcgggtggaagtcctgtgtctaagcgtgtgatggtaaatgggaaagaatgcttgatgtttgtgagagaaggtaaagcaccacaagcaagtgaggtgactagtcttgtgagctgccagggacccggaacatccggacaaaccgggagaaacttccgggtgggagtctctgtctctcaaaaattcccaccaggaagttccggccagtttgccaagaagttccgggccaatggccgtgcacaagacatgaccggaagttccgggcacaatgccaggaggttccggccagagggtctttactatgattcatatgtaatttccaaaaaattcaaagggcaaagtggttgcctattttaatgggaattacaatgatgagtaccgcacttgtgtgtaggtgccaaaggctttggtaactaacatcaagggacccaaacttagacaagtttgggttcctaaatcccaagcttgattttcttgtgtaggcatactcctccggtggttcaagttgggttgtggacagtggttgcaccaatcatatgactggagagatgagtatatttaccagtcttgatgaggaaaacggaactcgtgagaatattgtgtttggagatgatggtaaaggaaagataattggtctaggtaaaattgccatctccaataatcaatctctctctaatgttcttcttgtcaattcattaagctacaatttatttatccgtttctcaattgtgtaagttgggttacaattgcttgtttaccgatgaggatgtgaccgtctttagaagggatgactcctccgttgcattgaaaggcaagttgaagggtgatctctatcttgtcgatttcgatgtggatagagtgaatccggaagcttgtttaattgctaaatcctccatgggttgactatggcatcgtagactagcccatattggaatgcagaatttggcaactcttctaaagggggaacacatcctcgggctcactagtgtcacatttgagaaaggtcgtgtgtgtagtgcttgccaagccgggaaataagttgggaatccgcatcctatcatgaacatcatgactacaacacgccctcttgagcttctacatatggatttattcgggcccgtagccttcataagtattggaggtaacaagtatggttttgtcattgttgataatttttcccgcttcacttgggtgtattttctccatgacaagagtgaggctcaagatgtcttcaagcgcttcgccaagcaagcccaaaacctctatgatctcaccatcaagagggtacgaagtgacaatggaggagaattcaagaacacgcaagtggaggaattccttgatgaagagggaatcaagcatgagttctccgccccctatgatcctcctcaaaatggcattgttgagaagaagaaccgaactcttattgaagccgcaagagaaatgcttgatgagtacaagacttcggatagcttttggacggaggccgtgagcaccacatgccatgccatcaatcgcctctacctccataagattctaaagaaaacttcatatgagctcttgagtggtaagaaacctaatgtttcatattttcatgtctttgcgagcaaatgctttattttgagtaagaggcctcgctcatctaagttctcacctaaggtggatgagggattcttacttggctatgagtcaaatgcacatgcctaccgtgtcttcaacaaaacctccggtattgttgaagttacaagggatgtgacatttgacgaatctaatggctcccaaggagagcaagttgttgtacatgttatagatgatgcggatcctagagaagcaattggttctaaggctattggagacatacgaccagtcgagacgcaggatgaccaagaagatagggatcaaccttcgtcatcgacatccaatagccctacaacaagtcaagagtcagttgacccggaagttccgggaccagatgatcggaacctccagacctccccaggccaggaagttccgggtccatctgccaggaagtttcgggcagaggacagtcaaggcttgcctacgacacaagtggatgggattgatgccgtgggcactgtagagcatcctgatcaggctcaggtctcctcagtgcaccatccaagaatacatcacactgtccaaagagatcatcccgtcgacaacatacttggtgacataagaaagggggtaactactcgttctcgtgtcgctaacttttgtcaacactattcgttcgtttcttctttggaaccaaccagggttgaagatgcacttggtgatccggattgggtgatggctatgcaagaggagttgaataacttcactcgcaaccaagtatggacattggtggagagacccgaccaaaatgtcatcggcaccaagtggatcttcccaacaagcaagatgaacatggagtggttgtaaggaacaaagcccggttaattgtgcaagggttcacccaagtcgagggtctcgattttggtgaaaccttagcagcggttgcttgtcttgagtcaatccgaatgcttttagcctatgccgctcaccatgatttcaggttatatcaaatggatgtcaagagcgcctttcttaatggacccatctcggagttggtctatgtggagcaaccaccggggttcgaggatccaaagttgccaaaccatgtgtacaagctccacaaagcgctctacgggctcaaacaagcccctagagtttggtatgaatgtctccgagattttcttttgaaaaatggttttgaaattgggaatacgtacactactctcttcaccaaaaagtttgaaaatgatttattcatttgccaaatttatgtcgatgacataatatttggttctactaatgcctctttttgtgaagaatttagtagcatcatggctaaaaggttcgagatgtctataatgggtgagctaaccttcttcctcgggctacaagtcaagcaagcacaagaaggtactttcatctctcaaaccaagtacgtgaaggacattctcaagaagtttgaaatggaagatgccaaacccatcaagactcccatgcctaccaatggtcaccttgatcttgatgaaaatggtaaatgtgtggaccaaaaggtatatcgctccatgataggatccttgctttacttatgtgcatctcgtcccgatatcttgcttagtgtttgcatgtgtgctcgctttcaagcggagcctaaagagtgccatttgattgccgtcaagagaattctaagatatttagttcatactcctaatcttggcttgtggtatcctaagggttgtgactttgagcttttgggctattccgattcggattacgccgggtgtaaggttgatagaaaaagcacaaccgggacttgccaatttcttgggcggtcccttgtttcttggtcctccaagaagcaaaattccattgcgttatccaccaccgaagccgaatatgtcgccgccggttcttgttgtgcccaactcctttggatgaaacaaactctaaaagactttggctacaacttcaccaagatcccactcctatgtgacaatgagagtgccatcaaaatagccaataatcccgttcaacactctcgaaccaaacacatagatattcgccaccactttttgagagatcatgaaaccaaaggagacatattccttacccatgtaagaaccgagagccaattagccgacattttcaccaagcctttagatgagaaaagattttgcgagcttaggagtgagctcaatatcttagattctcgcaacattaagtgatgggtagttggctaatttatagccaaacatgtatcactaaaatgtaaattaaaaaaatgagcttttgtgtcttgagatcacttcttggttgaagatggtcttgctaccaggaataaaactcaaacattcccccctttatccaaaaaccccatttgtaaaaatttg

SEQ ID NO: 33972 - DNA, 2066 bp, Oryza sativa
attgttatataatgttgattgttggctggtcatatgcatcataagtctctgcaggtccatagttctctatttcccctcattgaattctcatcttctccttgtttttgggcctgactgccctttatctgtcaggccggaagttccgggcctccctgtccgtaacctccgggtgtcggggagtatatattctcagggggagttagaaaccctagtctctctcctcattcttctccctccccgacaccagccctagccgccgctacagtgccccgagtggtgattttctcttccctccaatcaaattcgattattctctgtggatttatctacattggtggctaggaggttctttctgtgatcgattcgcagtttcctctctcaatttagcacttttgatcttctcttttggttcgtcatgtttttgccccgatctctaaatctgtgaacctagggagaaaaccacttggatagtcttgtttctgctaccttgtagatcaccgatctataggatttgttcacatgcactggctatttttgaaacctctgttcctcttttttgccggccggaagttccggtgttcttgcacccggaaccttcgggtgctgtccagccagtctgccattcttgattctctcaaattttgcctaactactgcactccaatttgttgattcctgttgcagtaagcactctgcctcgtgagaaaagacagaaagcctctcaggatgtgtccggtgatgagagtccccctattcggtttcctcgtggtcgtttgggtaaagagaaagtgattgagggtggcagtggcagcggcactcgtacttctcctaggtttaccaggcaatccagcaatcgtccagttcagattcgggatgttgacagtggtcaaggaagtgatgctcctaatacaagaggtcgtgggagaggtggtggtcgcagttctggggctggaagggcatctcatgatttccctattggatctcgtgagaatcccgttcagctctacaagactcttggatttgacaccactcctatgcaccacattggaagacccaagtccaactaccttcatcagcttgccaagtgcagaagggaccgtttgattgatttagagactcagcctgaggagtcacaggatcctcgtttcaggactttcactcaattggattgatataattcagtgattacggctagagaaaatccaatggttaagatgaagtggattgattggacttacatgaggaagaagaacaatgaagtgttcaaccaagtgatgcaagtgtgccacaacaagaatcttggagatattcttgccttggagtatgattggaatgaggaggtcattgcacagttctatgcgacagcattctttggtactacaaggaagggaattgtcacgccctgaagtttcccctttcttctttctttaaaaattggttaaataaattgcccgaagaaattgtttaattaacctagagctaatcctcaattaataaatgcatttaataatcgaattcagcgtggtggaatttttcttgagttccccatgctccaatgcattaacaagatttttagtggaattttcagagccttggaaataattttaaccaattaaaaatcaccaaagtgcaattttaaatcccaggaaaaatcctttcttcttttttcttttttctttttcctcctttttcctcttcttgggccgtcggcccagtccaccccgccgcccgcgcccccttcccctcccttcgggacgccgacaggtgggccccacctgtcgggttgtccccaacctccagctgtgcgcccacgccggcaaccgccgctgccgccccacctcctccgctcctcccgtgcccacgccgcgccgttccccgtcctccccacgacgccgcccacgccccgtcactgccgccccgcgcgcgcgcttgagagggcgggattcgatttcggatcccaccccactctctctctctctccaccccacgtcgctggcgaaatcggagactttcccggccaagtccgcctccctctctacctataaattgctcccccgagcatcctct

SEQ ID NO: 33973 - DNA, 19228 bp, Oryza sativa
ccgctagcttcgtcgccgcgagagctacctcggccgccgctcactttccgtgcgccaccgccgtgccgctctccccacgccacacccgagctccgctgccgctgcccatctccggtcgcgcgtcgccgccactagagccaccgccgcgccgcgcagtcgccgccgtcgcgctcaccgagcccgcccgcacctcggccaccatttggttgtcgccaatcgtcgccgaagcgccgcttctctcgcacgccggtgagctctccatttccacccaactccggccggccgctctagtcgccgtggtcatcctccccttcccctaacccgttcatcgcctttcccaggttgtgcccgaccctgtccgccattgtcgaaagcgccgccgccgctcgtctcttcccacgccggtcgccgtcatcgcctcggtgaggaatcccctctcctccttcctttcctctctcccgtgagcgccgccgccctccgcgcgtgcgccgtcgtctttggccgccgccgccgccttcgcgccggccgccaccgtctccccgcgccaccggtcatcgccggcggtcgtgcgccgtcgtcgcctcgccatggccagccgacttgagccgtgctgagccagcagccacgcccctctcccgccatgtgccgctgcccggtggggcccaccagccgatagaccaccccctcccttttagctgctgccaatggggcccgcatgccggcgcccctccctctctcttgagccgctgacatgcggggcccgcctgtcggcgccgccccccctcgctgacgtcagccctgggattatattgcgcaataaataattaaggactttttctttattagtaaaaacatagtttatcttctaaaattcataagtaattcatccgagctccgtttaagtccattcaagtctcagtaaattcataaaaatccctagaatccattaaaaatggtttggttttctgtttcagtagtcttatatcatgttttgcttgtgtgctttgtttgtcgcgtagatttcggccgtttcgtcgatccgcggtttctcgaagacgttgctaaggtctcatcagtgcgagagcaaggcaagtcatgcattacaattgatcatattgtacccaatttacaaatatcccgcatttctatcaaatgttgcattcttttacaatgtcatgtgggatgggtcctattactcggccatatattgtttaccttacgccattgataacttgggtatcaaaatgattagatgttggtttaggaaatgcttagccatgcttagttcaactaggacacaaatggagatcacatttttacatatactttgactattagcatagctttggactggtgccaccgcaagggtgtcagttaattaaaatatactgaatggcgggctgtgggtgcatggttttgctggttgcacccatggcagttaaggaccggttcacaggaaaccctgggagacttaccatgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccacccattgccttttgaggggtgggggtgaaacctagcgtggtgtggagtaaaactattcgaatagccgtgcccgcggttatgggcgatcaaccggattcaccgtgattagtctcacccctagtttagcttaatgaactggtgtagtttaggtggttggttgggcctgttgcaacgtggtgtagcgttggacagtgattggttaatattgattaatttagtacaattgttttactgctttcaactactgcttttaaatgctagctttatgcaaaagaacccctagcctcctttggttatatcctgcaccatacctcctcttccggtatgacttgctgagtacagtgggtagtactcagtcttgctctcttttcccccacaccagagctaaagatctttctagttggagctgtcttgttgaagttggttttgtcgctgccgtcaaggattgcctatggagtggcgtcgccccgctgctgaagtcaagcttcccggtttaactcgtttttatcttttccgctgcatttgtaatattttctatttttgtaagacgtggatctgtatgtcaacaattgtcatttgtgtaccctggctggtcctggacagggatttaatgcacatttagcttagaaattctggttcgtgaatttctaggcgtgataggaaccccttatgtgaagtggttgactgagggtgttaggcacaagatttccatggcacagtttgctgagatgttggggttagatgatgaggatctcaataggcccaacattcatagtgaagcacccctccccatgatcaagaccaaattcatgtatgcaaaggatgctcctaggacttgcatgggatcaactcatggattgcatcccaactacaaggtgttgtactccatctttcattggtctttgcttccaaaggttggagatgctactgctctgccatccaagcatgctcatcttctcagtcgcatgcgctacaatcagcctcccttcagtgtgatgaaattgatttggtatgagatcgccaacaccattcttgagcctaagcggggttgcatctatgctcctttcattatgaagatgattgagacaatcaccggggtattctacatcaaagatgggcaccataattcttttcgccatcgtgctccaccttcctcttctccagtggtcccttgatctgttccttctacttcagctggtccttctactagtgccccaccaagttcctcgagttcttctctcttcaagaagacacttcaggcaattttctgtatgtgtgctaagactgccaagaaagtgaagaagatcgaaaggcgtcagaaggaagatagaagagaggctgggaaagaagtgtcagatgattctgaggatgaggtctatgttgatccatttgaggcttatgaggcagcccgcaacgttgccggtgaaggtccatccaccttcttcaatgaaaattcttcccattctaatgatgatgatgatgatgatggtgatgagggtgacaccgaggcagctgctgaggatgctcccactgatgttgatgagggtgacaccgctgctcagtccgatgagtctcatctctccggcgataccgagattgttccctctgatggagatgagtgatcctcttcttctcttcatagtttctcgcctttttggtgccttgatgccaaagggggagaagttgtgaattgaagggggccatttaaatcctttttgctgccttgactgttgtctggtcatttgaccggaagttccgggtcctgtgatccggaggttccggctaggcagatttcctctctattatctctctctatatggacatgtaatcgtattctattatggttggatgtaatgactgttagatgctttattatcctttttgtcagtaagttagaccatatggatgttgcattttgatgtgatgatgtgttcttttcatctttttgagtgattaccatgtcatctagtctttctttttgcatcactcatcattcgagcactttcatctgcatctcttctttgataagggtagtgtgaggtttcttttgagctttccttcatcttatgcatattgttttcatttccagttctttatatgcatatctttagggggagcttcacacttctctcatcattcaaattttaaattctatcatctttttatttgctttaaccatgttgtcatcaatcaccaaaagaggggagattgaagatgcacttaaaccccctagtgggttttggtgattaatgacaaggtggttaaaggggactaacgtgtttatcaagtttattcacaggagtttagtcccaaagcgagttgtgatggctaagaatgcaaggagaccccccaattcgaatgttcctaagtgcaaaaatcatcgaaggtgattagactaggtttttcactttcgaaattgagtttaggaaaaaccgtactattaagaggggtttcaagtgtggttctagggtatacaaagtgctcttagtcttatccatgagtcaaaagatttttggaatcatttttgaaaaatgattttctccccgggacagaaaaggctaccccgaggttatggccagaacttccgggcaccgtttatttgcaaaaatttcctaagtgctgcccagaagttcctggcacttttgcccggaacctcctggcaggtttccagttcaaacttgtgagtaacggctagatgacgtcacctagccgttatatatatggatttcatccccaggtcactttttggccattccacttctgttcattcatgttctagggttttctagccactcccaagcttcctttgcttcctccactcaaatctagagcctatcttgtgagattgtgagattagatgagagtgtatgagtgttttggagatggcttaaagattaggtttgattgagcactttggatatcttgtgggctgtcacttaggcttattactcttggagatcttctcctagacgattaggtgtcgcccgtgagcttccaaagatcttgtggatgtcccggaaaagtttgtgaaggttttcctcacctccgcaaggaaacgaggtaagtgagtaaagattcttgtactgagttttcagaggttgtcctaggtagagcaacttgcacttgtagtcttttctaaaagaaattttgagttggatcttggtggtcactcaattctagaaaatgacctagaagtgttgagttgaaggctgtggacctcttctgggatctttgcataagtgaggcaaggggttaatcgagacctggctctttggagcacctcaacggagagtaggattcgtgtgatctgaacttcgggaaaaaatcgtctttgtctctcttgtgcatgatctttgtgtgaatctgctgatattctgctatcttcatcttgttcttctgtgtgtctaaacttctcttgctaggacctgtttttcatctcagttttaatttatctcagctgcccggaagttcctggctcaagaactctagtagttcttggctactcatcctgcccggaagttccggtgttcatcaccaggaggttccgggccctgttaatttaaccgctgcaattgtagagaaaatttcaggaaagcctattcacccccccccctctaggcgacatctctgcacattcaaaatacagtacacaaaaaaacacgtataaacgtgattatgacgtagaaaatgttgtggaagtaatttcacttaaattgtaatggcatttttccaaatagttaaatagtggtatttttccaagcctacaattttcagtgacatgtatcaagctattctctttctagtgacatgtatcaaactattatcttctttcctttttttttttttgccaggagaggagattattatttctttattgggggaatgggcttaggccggattttaattcaaaatagaggccatttaagcatgtttttacaccgaataaaaaaatgttacggtccggaattttacactattttttcccccaaaacaaggcttgcaagaaggcccaaagtattttcctcagtgaggccattaagcctgctaatggtgcaaaatccaccccatatccaatccaatccacagcagctagcaatacacctccaaatcatcccaatccactagccatcctataaaatccaaaccaaccaaatccatttccctcgtgagtctaaaccgaaccaacccattcctcttttatgggcacaatccattctccgaaccattcaaacccacttcaaatccactttggtccttgcggtgggtgtcggcgacgccgacgccgccaacgtctgggacactgagggtcgcactgcaaagcatgagacgcatcgtgtgaatcctcttggagcaaggaaggacggcggggagagaggcgctcatggtcctcgacagcgctggtgtgatgtccaggggaagggggaggttgttgcgccaccggtcatcgtgctgtaggcgtattaggtgtcgcaggggcggatgagtttgttgccgccatcagagcggtagacgaagttgatctccaggtccttctcgtcaggtccggcgaggcagcaaccgtctcatcgagccggcctaacgtgaccatggctacaattgataaaaccattgctcacatcatggatcaacaagaagtcatcaaggccaagtcctccaagtgttggaatccaattcggccacttgatgcactgacgacttcaaactaccgccaaatctacatacgacctccgttttcagtccgtgagtacttgatggaaagctctcggagtcttctttccaacggatctagcctcatcaccaaactccatctcagttggcctcaatcaaagaaacaaagtgttgcgtccccaatagtgggcctatgggcatgtaacttcgtctgggaccctggcccaagtggggcccatctggggtgcgccccaatctattggagcacgaccctagggtagccttggtcgtcttcccttctctataaatagttaggtaccactccagggtttctagggttttgttagattaaagtttcgcgcgtgccggttagaccgcctgtctgcttgttcttcggaaccccaacttattgtgtgtattcattcctatttgcagttcagattgctgcttttatcttgttcttacttgtttcatcgatttgctcgcaggaatagggttgatctacaccagcaagatcaacaacccatgaagaggtgtatcgatcgctaaggcgcaacgcaacgtcatgtacggttgtagtcgggtcgtcaacgtttctctcaaatcgtagttatctcaactcgccgaaagatcgggccaatcctagccttgagtttcgagtggaactcagggttcatcacatccagcggcagagcgcggagcggaggtgcgcaccatgtctctcgccgccggcaagaagctaaggattattagcagcaagtcttcggtgaggttactgatcgtatcgtcgactactgccaccgccgttgaagtcgtctccggcatgtttttggagtctgtggaagtgtacacgtatgcgcacgccgacgccctctttctcttcctcttcctcatcctaaaaaattttccgccggtggagatgcaacaacacatgttcctgctctaccaggaggtgttcctcttcggctgcctcggtctcagctccggcggatgcgatggtgcggtggtgatgtgaccatgactactattgatacaaccgtcactcacatcaatatcaagttgaccaagtgctggaatctgattcggccatgtgcgacattgctaaattcaaatggccgccaaatctgtatacgagcttcgttttttacctgtgagtacttgatggaaagctctcggagtcctctttataacggatcctgcctcatctccgaattccatctcgtttggatgcaatcacagaaacaaagtattgtgtcacctgtaatgggcttatgggcttgtaacttcgtctgggaccccagcccatgtggggtgtgccccaatcatgtggagcacgaccctagggacccctaaatcatcctcccgtctccataaatagcttggtaccccttcagggtttcttgggttttgttagattaaagtttagcctttgctacttgcttgtagcgcgcgtgtcggctagaccgcctgtctgcttgttcttcggaaccccaacttattagttgtattcaattcctatttgcaatatcagattgcttttatcttgttcttacttgtttcttcgatttgcttgtaggaatagggttaatttgcactggcaagacaaacaacccacggagaggtgtatcgatcgctaaggcgcaacgcaacgtcttgtacggttgtagtcgggtcgtcaacgtttctcccaaatcatagttatctccactcaccaaaagatcgggccaacaacagccttgagtgtcccgagtggaactcagtgttcatcaggtggcgccatgcatggcctctccgccactgtcaccgccgctgccaagttcaggtcatgcgcgggcagtgcggcctctgacgagatgaagagaacgggagaaaagtgggaaaagcaatcggattcggtccactaaaggaatccattcagcctacatggattgaatccattttcaacccgaaatcaccaaaccaaatccagtccacaccaatccacttctttgtgtcatccaaaccaatccagtccatttgaagcagcaacccattttcgtccaaccaaaggcaatccaaattagaaaggaaaaagtacatcgaaggtccctcaacttgtcatcgagttacaaaatcgtccctcaaccacaaaatcagatatatgacatacctcaaattataaaaccgttcactttaagtccttcggtggtttgaccctggttttgtccaacatggtggctgagtcagcataggacccaagcgggccccacatgtcaggatgccacgtatcacactctccctttcccctcctctcccttcctcctcctccctctctctctctctgtcactttctatctcacttttctcctcttgcacaggctggtcgccgggtagggaggactgaggaggtcgaaacaagatttcgacaataataaagggggtggctgtcaagctaggaaagtggatgggtttggagacaaggaattttatacaggttcaggccttcttattaaagaagtaataccctactcctgtccggggatgattccgccaagtgtgttattgattgtatgattgaagaaaaaagaatcgtgccccaagaggcacacggaccctccttatataggggaagggatccgtaatacaaggtacagtctatatcctaacggaatatgggattacagataaaatacaatcgtaaccgactaggatcctgggtattttcttgacatacaagtttagaatctaacccgaatcctcataaagatattctatctatatttggtaccatatatctgactaaagtataactgtcatgcagatatggggtatccataatctccacagtagcccccgagaccttcgcagttgacgaaacaaccttctcgaaacaaaaaccagtagtccgagtgctttaattcaacttgctccagcttgtcgagtactaaaaatcaaaaactgtgaaggacgaaaataaaacatggtgcatcgagtagatgcacctaattaggtgtagcccctgactatgtgattagttgaaaaactaaacatatagtcaagaaccgagtggttttatagcgaagcacgcatggtacttagtaagatacccagccgactgcttctcaacttgaatatatcaaggacaaaaaatacaagaagggccgagtgacaaacactcaaaaggcccaaaaatagatatatttggtaggaatccgagcaagaaactcttaaaatgatccaccaaacataacagaaaatcatggtaattaatgagtctaacagcctaggctgtgacccttaccataaccaaaataagcatataacatgctaggagaatgactactgataaaccagtcatcttaaattaacccaacagctcttgtagcctaaaaaagcttacaaaaatggtataacacctttctgttgggcaccttttcatgtgcatcataataattccaaagaattattgaatcgcgttaaaaaggattttaacagcatcgggccacatcattgtgagcacatattgccaaagcaaaaagcgcctaagtccctagggatcacaatgggccgcgctgaaaacataattgggctgaagtactgtacagacccaggcccattagtactcccgataccctaataataccgaagtgaaaaacgtctcttcgtcttccccgccgagactctcgccattttccccatttcctgctacaatgcaaaactgcgccggacaaactagggttcatcaatccgctccaatccaccctcaaaaacttcacaagatttctccccgcatccaccgctccgattccccatccctttccagccatatctcgaactaaatcaatccatccagttcacattcatggcggaagaaagagaaagcttcgagagtcagtgggcgccctccgatgtgacggaagacaatctgaaggagatggtggcacacggcgttcttccagcaaaatagatcatcgggtggcgaccggcatttggtgaggctttcccgacccccgatacacatgaaatcgtggtatttgctcatttcttctatggcggattttctcttccaacttcgagatttttccggggcattctgaacttctacgggattagcttgcatcacttgaatccaaactccatagtacatattgccaattttatccacgcttgcgaagcttttctgggcattaggcctcatttcgccttgttccgccgcatattcttcctcaagccccagccaaacaaaaacaagtcgtgcgttgttgggggagctggtttccaactcagaggaaccttgagccaaaaatatttctccatgcccttcaaaacctcgaacaaaggctggcatgcgaactggttctatgttcagaatcctgagcccgcacttcccgagtactgttgtcttcctccggtttaccaggacacatggaactcattgcctatgggagatgaagctgctcaggcagtagaactgatggagaggatgataaagctgaaagaacagggtcttcaaggagagcagatcacccggcactttatcaagtgtcggttagctccaatcaaagaaagatcacgcacagcttttgagtttgatggcaagcatgatccaaatcgggaagatccagattctcttgactttaaggtcatgaaagaaagaatgtacaaaatcttttcaaacgctattgttgtcagctattcacatctgctgcccgttgtgccattcaacgcattcaaccctcctccaccggtatgcactcaaacatttcacccttcctcaaaatatgatcttgctttcctgttgaatcaattaacaatgaaagatattacacccaggaatttgctttgatgaagtcggatcccccaatcgctcaacgtcgatctccccgccaccaaactgggcaagggagcggaggaccaagaattcggtctgaacctcaaccaagtgcttctgatccagtcggccagtcagactctcgaaagaggaagctggttttaagtaacgacgaagccgatgatactaccaggcggcctagagaccgagagacaaccaagaaactaccaaaacaggctactctaaggaagaaaaccaccagtcgccctgcgccaaagatcaggaaatcttctaggtacaactcatataacgatctctcttgcattaatgtgcatccattgcggcaataacactgataatcaaatttgcaggaaaccatctgatatagatctgtctgggaaagattctgacccgactagcgtggacgcaagttcttccaaagaaaccgggccaactgccgaggaccgtccgagtgacaatcagacggcaaccgataacgtaggatccggtgatcaacccccgactggaaaccagtcggccgaagccgaagccggagttaattaggagcccccgactggaaaccagtcggatgcagggccaagccaagagattccagaagtcggagctcaagcaaacagccttcgcggtcaagacgccagcaataaccagagatctggatctcctttaaaggcatccaaatccactcgtcctcgtccagaaatcattacgggtaaaacactttgtctgaaaccatgtcgacccaaataactctgaccaattgtctaacctctgtcagtggatacattagggccaatgatcagtgatgaagaagaagttccccgcatacaagcagctgagggttcacgccctccgattctggtcaagtggtgggatgacaacatgcagcctcatgggatcgtgataaataagcaaaaagaggacgaagagttatgcctactgaagaaggcacttggtcaggcaacccgtatggaaaatgtaagccctctggtacctgatcttgaccatcttgtttgccatttaatccatgcgctaattaaactgtcttgcagaggattcatcttaggaacgaagctaaaacggcaaccttagagaggctagtccctcatctcgggaccctcgaagccaccaggagtctgctgcacgaaacaaaagagcttgccaggaaaaatgagcatgatctgaggaatcgaattgccgagctccaggaatccaattttgaactgagtggcttatcaaaaggttcgcacaaactctgcccaactgattcatactgttatctttgtgatcttgatttacagtaatcaatgtagtgcaagctgccaagatatctcagttcgagaagcaaattcaaactctggaaaacgacaaggcagaactggcaagacaaaaagacctggctttaaaggaagttgaaggtatcaacaatcaatacctcaaaagccattatcttccatatgctgacttattaatttgagtctgtcgatgcagaccgcaagatcaaatctcaagctcaattcgacgtcctagttggcaagatcaaaaaacttgaaggagcccgggatgaggttgctaacgctgctgccccaatagttcaagcgatgttcctcaataacaacggccctagtgcacttgatgcttctgaaattttcgacaagctgagagttgctccggatatatatttcaagaacatcaaagaagctggaagtatgggagcaagcatggcattggcgatgactaaatccctttatccgagagttgatattgacgccattgatggctttgcagacgggacgagcgaagaagctgctcttgacctcatcagtaatgcgcagaaagcggctgacaaaattgctgctgatgtagttgagagatttcaggacaccgatcttcgaccgactggtcttgatatttctgatgatgaaaagactgatactgattaatgtactgataatcttgatgattaataatgatggaggcacaatttgtacaatactgatgaatttatgctgtgcttgatatcttaacttagctcctgatttcttaaaagtttttgtcaaaccttgttgagcctaaaacccgcaaaagttgttaaaaaactttcagtcctcattgactaagccgagaaatcgaacagggcaatgatacatcaagtaagcaaattgaattcataaaaatcacactccattattattatagtagccccctgactgaaaacttcgaggaaaaacttgaagttagcagtcaaagaggaaagatacaaacgaaatgcctaagtgtaaaatcgacgaaggtgttcaatattccaagaattgttgatgatagtaccatcttcgcgcttgagtcgataagaacctggccgagtgacttcagcaattatgaacggtccttcccataagggagataatttatgccgatcctgtgttgtttgaattttccttagaaccaggtcaccgactaaaaaggctcgcgatcaaacatttcgattatgataacgacgcaacccttgcaggtatcgagtcgattgaattaaagctgcttctcgggcttcttctagtcggttgatgtcgtctactcggccctcttcatagccctcctcgttgaagttccgaaatcgtagtgattcaaattccacttcactcggcaacattgcttctgcgccataaaccaaaaagaatggcgactggccggtagcccgactaggagtagtgcgtaaagaccaaagtacggacggcagctgatctacccacttgccagcataggggcgtagtcggtcgaaaactcgtgctttgatcccttgcagtatcatgctgttagcgcgctcaacttgtccgttactcatggggtgtgccatggaggcataacaaattttaatgccgaagtcttcacaaaagtctttaaatgttccgccagtgaattgagtgccattatcagtgatgatccgattaggtaccccaaactgatgcacaatgttgatgaaaaaatctctagctttatctgctgtgatcgtgataaccggtttagcctcaatccatttggagaatttgtcgatagccacgaagagatgtgtgtaaccgccgactgcccttttaaatgggccgaccatgtcaagcccccagatcgcaaacggccaggacaacgggatggtttgcaactcttgggctggtaaatgagtttgtctggcaaaaaattgacaaccttcgcatgtccgcacaatcttatctacatcggacacagctgtaggccaaaaaaaaccttgccggtaagctttgccgacaatggtccgtgcagcagcatgattaccacaaataccagagtgtatatccttcaacaattgtttcccttcctccaaagatacatagcactgcagtattcctgatggacttttcttgtacagctcagtctcatgaataatgtaaagtctgctgcgcctggaaatccgctcgacttcatttttgtcttgagggagttcttgtttgctcaaaaactttataaacggttctctccaatcggcttcaagcatgcctacgccttgagtatccatggcttcagttatctcctttctgggtacggtcggttcgtaaagatgttcgacgaacacatctgaaggagctgcttccagttttgaaccaaaattggccagtctgtcggctgcctcattattatgtcggaggacatgggtgagctcgagtccgtcgaatttatcttccagcttacgtacctcttgtcggtaagcggtcatattaacatctagacatgaccactctttcgtgacttgattaacacccaactgagagtctccacggacgattagtcggcgaatacctagagatattgcaatccttagtccatggagtagggcttcgtattccgctacgttatgggacgcagaaaaatgtatccacaatacgtagcttaatctttctccagtcggggaaatcaagacgaccccagctccagtgcctgtaagcctcttcgacccatcaaaatgcatagtccaatattccatcttttcctctggcatgtcttcttggcactcggtccactcggcaaggaaatcagctagagcttgtgacttgatcgaagttcgtggtttgaaagatatatccaaagacatcaattctaaggcccacttcgcaatccgcccgtttgcttcgcgattatgaagtatatccccgagtggaaacgatgtgaccaccgtgaccgagtgactttgaaaatagtgagataatttcctgacggtaattaagacaccatataataacttttgaacctgaggataccttgtcttggagtcggctaaaacctcgctgacaaaatagattggtcattggactttttgaatatggccttcctcttcacgctcgacaaccaggaccgtactcacaacttgggaggtcgccgacacatataacagtagcggttcttgtggatgcggtgaagccaatactggtggagtggtgaggagtttcttgaagtcttcaaaggctttttgtgtttcgggtccccactggaaatcgtcagttttcttcagcagcttgaagaagggcatcccccgctcgccgagtcgtgagacgaaccggctgagcgccgccatgcaaccagtcaacttttggacgtctttttgggagctcggcggtttcatgttgaggatggcgttgattttctccgggttggcctgtatgcctctctgagataccataaatccgagcaacttccctgatggtactccgaagatgcacttttccgggtttagtttcatcttgaaagcacgaatacttgtgaaagtttcttctaaatccgcaatcaggtcatccctctacttggtcttgacgactacattatcaacataggcttcaacattgcgaccgatctaagttgaaaaacacctttgaatcatgcgttgataggttgctcctgcgttcttcaatccaaagggcatggtgatgtagcagtaggccccaaagggtgtaataaacgaggtcttcaagtagtcggattcttttagtcggatctgatgatatcccgagtaacaatccaagaagctgagtagctcgcagccggccgttgagtcaaccacctggtcaatgcgatgtaacccaaaagggtctttgggacaagattttttgaggtcggtataatcgacacacattcgccattgccccgtctttttccgaaccaggactgggttagccagccagtcgggatgaaggacttcctttatgaaacctgctgctaacagcttggttaattcctccttgatcgcatccttcctgtcttgtgcaaaacggcggagtcgttgcttgatgggtttggcgtcttccttaacatgtaaagagtgctcaatcacctctctggggataccaggcatatcggatggtttccacgcaaaaatatctttattattctgaagaaaggtgatgagcgcgctttcctatttacaatctaactcagcgcctattacagcagtcttatcaggatcggagggatctaggggaatctttttcgccttggcatcactttcttcggtctttgtcagcttggttgcaggcacttctccctcgcctgccgtggttgcagacagtcggatctcttcgcgagcaagagtagtctcgtgggtttgggccatctcgtagctttctttgtcgcatgtgacggcctgcttgatgtcgctccgtagtgatatgacccctcgaggaccaggcatcttcatcatcatgtaggtgtagtgtgggacggccataaatttggctaaagccggtcgtccaagtatagcatgatatgctgtctcgaaatcggcaacttcgaaacaaacattttctgtgcgaaaattttcccgagtgccgaaggtaactggaagagtgatctggccgagtggtgtagctgacaatcctgggataacaccgtggaagggtgcattactcggctttaattccgtgcgaggaatctgcatatcgtccagggtcttagcgaaaaggatgttgagtgcgctgccaccatcgatgagagtccgtcggagcttgacattgcgaaccactgggtctagtaccagggggtaccgccccgggtggaccactcggtcgggatgatccgagcggtcgaacttaattgctgtttctgaccaccgaagatactggggcgtgttaggctgaaccgcattgatctcccgttctgttagcttctgttttctcttggactcataagccaggggtccgccgaagatgtgattaagttctttgcgatgatcttgaaaaccagtcggggcatcatcttcatcatctttcttctttgatgtgccctgatctccgtctgcaggtttgcgtgcgttcttgacgtattgctccgcgaactgtttgtagacgaagcaatctttggccacgtggttggaattgggatgatgcggacattgagagttcattatcttgtcgaaggtgttgacgcggggacgttgtcgggaagatggagaggtggtcgccacaagttcttcgggcttacgcttgcgatccttgtggttgttatttccactccctcctgcagtcagcgtgtccttctttggcttccaagtggtgcccgactatttggacgcggtgatagcatcttcggcttcggcatactcgttggctttttcgaacatctgcttaaccgtcctgggaggtttacgtccgaacttactgactaggtcctcgtggcgaatgcctttagtgaaggtggcgatgatgacgtcgtcggtgatgtcggagatcttgttgcgttgctcggagaagcgtcggatgtaatctcgaagggattctccagacttctgaatgacgttgtagagatcaaactgtgtgccggggcgttcaaaggtgccctggaagttggcgatgaagtgatcacgaagtttcgcccatgatccgatcatgccacggggtagtccgtggagccaggatcgggcggagtccgctagggccacaggtagatagtttgccatggccttgctgtctccacctgctgcgcggattgcgagtccgtagacggtgagccaagactccagattggtggtgccgtcatacttctcgattccagtcggtttgaagccgactggccaatccactcgacgcaggtcattagtgaaggcagctactccatccacgtcgtcgtcgtagcgatttggtgaatgacggtgacctcgtgctgcacggcgctggttgatcgtgtcacgaaggtcgacgggacgctggcgaggtggagaacgaggccgttcagctcggcgctccctgtgacgttcgggaagcgagtgaacagatcgttcgtcgtgacccctgctcctgcgactagatcctgtgccggtgatgctgaggcttggctgatgatgagggactcggctaccagtcggggtgcgggtgcttgcggagttggctggaaccgaggtagcgatcatggtcttcgtctggttcaagatgttgacaacatgatcggcttggttgagggcgtcttccttgaggagggtgtcgaggagagtgattgctgcaaccacgttctgctggggggtgcgaaagaccgctgtcccgtcgacgtcttgttgcccaatgagctctctcgctcggcgcccagataccaaggcgcggtgccgtcgatcttcagcttcctttgcaatccgttcgcgatcttgttgttcacgctatagtcgttctcgctcctgtcgctgtcgctcctcctccagtcggcgacgttcagcttcttgccgtgcgcgatcttgttctgcttctcgggctcggcgctgttcttccgtttcgttgtcagccatgaatacgccgaagaagaggggcgtgtagttatcctcgtagctgtcgtcgaagttgtcgaagtcgccatggtcgtagtggtagccgaagtcgtcatagtcgaggatctcagttggtcgggaactgacgccgggggagctgaggtagccatccaactcttccgtcgagactgtcccaagaggttggagtataacgccaacctccctggatgtagactggatcggggccggtgccggagctcgcctagatctccgagtgggagatgttttggctgtgaagacggcggccaagtcatcaggaagtttcatcaagattg

SEQ ID NO: 33974 - DNA, 2518 bp, Oryza sativa
  unsure (1)..(2518): unsure at all n locations
ctgctgaatcggaacgcctgcccgggaggaaggcgaagttgttgatgccagaaacgaaacccatcgtacttagtcggcgagacgcctcccctacctggcgcgccaactgtcgaaacaagatttcggcaataataaagggggtggctgtcaagctaggaaagtggatgggtttggagacaaggaattttatacaggttcaggccttcttattaaagaagtaataccctacttctgtccagggatgattccgccgagtgtgttattgattgtatgattgaagaaaaaagaatcgtgccccaagaggcacacggaccctccttatataggggaagggatccgtaatacaaggtacagtccatatcctaacagaatatgggattacagataaaatacaatcgtaaccgactaggatcccgggtattttcttgacatacaagtttagaatctaacccgagtcctcgtaaagatattctatctatatttggtaccatatatccgactaaagtataactgtcatgcagatatggggtatccataatctccacaggaggactgaggaggtcgccagggtgagacgagagaggaggtccgacggagccagcgagttggttgggggcgagccacccacctgaggacgagctcccgttggttggggaaggcggcggcggggagctcccatgcgccagttgcttaggctatggacgtccacgaattggactgcgtcgttgacgttcttgccgccgccgctgtcgtagaggcactacccttgaatccaatctatgtatagcccggccggactaatctcctcaagccgtatacccacgtcgtcgatcaaccatggcgtcgtcgatggcggcagccgctgctgcaggcttgtctcttgcgccgaccgcgcgcgtctgcgcggcggcgccgtggtcctcgcgcgccactccctccggctagccgtcgtgcggcactggccgtgtcgctgtcctcgccaccggccgcatggcggcgccgcatcgtcgtctccagctgctacgatcatcgtcgacaaccatgcgcacgcgcgtgccatcctgcatcgctagcaatgaccacaaccactccagcagctccaacgtggaagcggatgagaggttggcgttgtgggcggggatgagcgtcgatgagctcgcggaggtcaggaacgcgacgccgccgtggttcccgagcatggaggagatcatggagttatcatggtagttattctcgtcaaggacatccacaaaaataatacttggtatgcgccgtcgaagtagtcagaccacctgagctcgtccagcacgccggcatagtggtccatcatcgcgaaggggttggcgtgtcctaggtccagccacggcaggttagtcgcagcgacattggcgctctgctcggcgtcggtcgtggcggggctgaggctggccatggatgatggatgtgagcgtgctggaactagacgccgaggggacgacgaccgccagtggttcgccgcatccggccgtggcctgctcatgctcaggcgtggtggtaggcccgagagcgtcgtcgtcgtcgtcgtcaatgagggcgctgtcgccatcccgttcccggcgaccgccaccgccaccgccgcaggccagtagtcgtcgagcggcatcttggcatcttgatgccgtccaccagctacattgcacccacgagcggcgcctgctgctgcacggccgccgttgccgtagccgtcggtatcagcctggcgtcgccttcaggaatcaggagcgcgcgggcctggctctgtcgttgccccttctcccgcgtcatcactgccgagcggcggttccctcgctctaagaggagaaaagtgagatagaggaggaagggagaggaggggaaagagagacccagatgacgtggcatccttacatgtggggtccacgtgggttccacgctgactcacccgccacgtcggataaaaccggggtcaaacccacgaataacctaaagtaaacgattttgtaagttacatctggttttgtgctcgggggacgattttgtaactcgattacaagttgagggacctttggtgtactttttccaattagaaaccagtccatttagccctttcccatccagcccattagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33975 - DNA, 477 bp, Oryza sativa
caggcccacaatggttattgcggaagacatgcgtacatggtcaatggctagttttgaaagtggctggcgatgttcttttttcgtcagcgagttgattgctatgtcgagcagaaacgtcccgacaaaccataatgcgtatatctttaagcccaactccaaatcactcataaatcctcttggccttatcgcggcgaacggaacggttaatacaagacttcaacgcatttattcagtgtttcaatggtcggtggatggccgccggttgtcataacttgagccactcgtaaatgactccaggtatgaaaaagccgctggttaggcggctattgaggttcgcgcggcttgtggtcgaatcggtgccacccgtcagttaattcaaatggagcataactttcccggcgctcagcgaacccaagctcaacagacagagcgtgcagctcatgccgacgcttaatctgttccatcgcaatccagtca

SEQ ID NO: 33976 - DNA, 1606 bp, Oryza sativa
  unsure (1)..(1606): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccacagtccaccactaagctatctagagaagaggcctctagccgacgcgagatgtcttaaagtgttttctttgcattatcagataagggagctagagctttgcttgaagtatctttttctgcctcatcaagataatctctgatatcaaaatagaagagatcggctagaacctataggtataagttcagaaagtttgagagctaagccaatatagccgatctaaattcttgcatcaaaggaaaacttactgggatagcaggagcagctggttgttcttcttccacaatatgatgactccctacagccgatggagttcggtcactcaatgattgttgtacaggggaagaaggaggaggaggaagctgtaaaaagacaagtgttagacaaaatcggctagaattgactagtaaaattgagagtgtcttactagtggagctggtttgagaattggtgctgccgatgttttctttatagcagttttcttcttctataatcacaaagcctatgagtagtcggctgaaaaataataattataaaaagggtttgcaaggaaagatgttttactctgaagaagtgagtgggggcagaaggagttggaggtatctgcttaggcgaagccgatggtgttttttcagtatcacttacttcggctgcagcctgatcaacatcatcctcaatattttcttcatccagagctttttcgatggatggatctagagcagacagatcatcagctggtgcggtcttctttgtcttagtcttcttcttggagctggggctgaaatatttacagccgatgatctggtctttcttttcttgccggcatcggctggttctctaataagcccttggagaagagctaaagtcttgggggcattatagccgatgacggggggagatggcccacctctgttggggatcagtcctggggcatactcgatatccctgccgctgttgctttggtgagggggagaggattctgttgtctgcaaatcaggaggaaagttagctaaggactaatcaaccaagtagttattcaaataaaatcaagtgagttaggatttacttgaggaagaatatctggaaagagatctgtcatatacatggaagccgattgatggaataagtgtagcttccattcagtccaccatctgtcaaatgctttgctcctaaaggttgccagctttgtggtgtcaatgctgcctagaggaggtccttggagattgagcagccgatccatcattaaagatgatgagatttctcctcggcattggatcttatcggcaaagaataacccgattaggaggtgcccattccaaattgttggcagaactcatggatgataaaactcgaaagaaacctggatgtttctcccttgatga

SEQ ID NO: 33977 - DNA, 1431 bp, Oryza sativa
  unsure (1)..(1431): unsure at all n locations
atctggtctttcttttcttgccggcatcggctggttctctaataagcccttggagaagagctaaagtcttgggggcattatagccgatgacggggggagatggcccacctctgttggggatcagtcctggggcatactcgatatccctgccgctgttgctttggtgagggggagaggattctgttgtctgcaaatcaggaggaaagttagctaaggactaatcaaccaagtagttattcaaataaaatcaagtgagttaggatttacttgaggaagaatatctggaaagagatctgtcatatacatggaagccgattgatggaataagtgtagcttccattcagtccaccatctgtcaaatgctttgctcctaaaggttgccagctttgtggtgtcaatgctgcctagaggaggtccttggagattgagcagccgatccatcattaaagatgatgagatttctcctcggcattggatcttatcggcaaagaataagccgattaggaggttgcccattccaaattgtctggcagaactcattggatgataaaactcgtaggaaacttggatgtttctcccttgatgaatgccgactggaaggatgcatggggtgattgcagataagaagatttttctgggcttttgatatctgtcattgttgatgtcttcaaatctgaagtcccatggattttccagaagtgttgagtctccatagagaaaccaaactcgagcatccttttggaacccctcataaaagttgcaaaaccagtctttgagcagctcagccgatagttttgctcctgcatcagttggtgtagaggcgtactctccatatgatgtgcatctccgatgagtgagttcttctccgtcatcgttgacagtcggctctaatcttgggaattcagtttctgttatagatggccgattgacgaacctcatgactaccaagtttagccaggattgcagcagccaccatggtccacccgctccgactactgagctgacaattagcttagccgatgcattattcagcatttggtacaagtagctgaggagtattttgcctaaaggaaattgtccttttgtctccaaagcttcggctatgaactaccaattggttgtaggaccgcagctagacccacaaaagagaaacttttctaaccacattaacaggaaagccacatgttctcggggggtaactggaccctagcccatatatgctgctacatagcctaaccagctgcctatgctcttggtcttgaagtcatattggttctttgtattcaaactcatagggttggccgatgaggtgacatccagacccgtgatcatgctgatatctatgagagttggggtcatcagcccttgattaaacaaaaatgcattgatggtgtttgnnnnnnnnnnnnnnnnnnnnnnnnnnnnnnnnnn

SEQ ID NO: 33978 - DNA, 10927 bp, Oryza sativa
cggcccgcctccaccatggcctccacagagcgccgcccctcctcgacgcgcgcccactccgcgtcgagctccgccctctccgcctgcacggcctccatatgggcacttaacccgtccagcaccatgctgttcacggcggccaaggcctgcaggaggggctccacgctcagtggggcagcggaaggccgaggggagagccgcctcggtgtgggtgccacgcggctcggcccaccgatcgacgtgccggactcgggggcgtcccccgaagctggctcgtcccaagcgtcgcccgaggggtcgggcccgagcggcgcgcccgcggcctcatcgtgggtggcctcggaagtcgtcgtcgcctcgggcggagtcgggtcgggggtttggcaggccgcctgacgtgcgcgcgccgcctctgcctcccggacggactccccggcccagcggagtctggcctcctcccgagcggcctcctcagcctggcgaacccggacggcctcctgggtagcctcctcggcttcccggaggcggtccgcggcttctcgccggtcagcttcccgcctccgggcctccgcggtcgccgtctcctcggcctcagaccggccggacttggaatgtccagggggttggggggggggggcgcgacgggatctcgctgaggcagaagaaaaaccagaagacaaaaagaaacgggtgagtgaaaactcgccttgggagatgggagaatgaatacggccgcggtgggcgcggggacgaacctgcggggaagtcggctaaacgaccacctcgggggcgagatgaggttcccccggcatggcacgatccaccccgtcttgcggggccgtttcttctttcgctccccctcgggctgcggcgtcggcacggcaccctccgggcgcctgctgctggcatgcaccgccccgccccctcggggaggagatgggagaggggtaccctcctgcttcctcttcccccgggcgtcggcagggcggctgccccccgggcccccgtcgcggggcccagaagcacgaccccctcccggggtagattgttcccccctgcggctcccgcccacgccatcgtggcctcggggggcccgctcccccgacgccccgaccacctgcatgatggccaggatcttggcgcgctctggatcgtagcagagggggaggaccccttgggggatgagggatgcctccacggagctgagattcagcacccgttggaccaccatcctgaagtcctcagggtcccagtcccatttgcgcccctggtgggtcctcacgtagtcctcgggcccggtgtactcctaggcgccccgggcgcgccgctggagcggcgcgattcggcgacgaaggtagtcgccgaacaccatggaccccgtgagcccctgggatcgcagacccgccaggcggtcaagaacggcgttgtagccgtctcccagatctaccgccgcccgccagctggaggcctgcgccgggggctggctcagaagtcggaggcgcgcttcgtcggcgaggggggtgtagaaccaatcgctcttccagtcgtcccactttttgcggaggacgcagggaatgtagcggttcagcacctgcccccgcggctggaagttgcagccaccgactaccgtcggcggcgacaccggctgtacggtgaagcaccacccgaccagccggagagatgggcgcaccccgataaacatctcgcacaggtgcgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgtggcgccgggcgtccctcgcccagcgcgaccacctcccggccggtggcagattccggcatgaatcggcgcggtagcccggcctgcctctcgctcacgatgcgggaaggcggcagcacgctaccatcgagcggtgcggagccccgtgccatgacgccggcggaggaggagcttgagagcgagcgagtgcggcaagggtagggcacaggaaacgaagagttagagcgcaagtggcgaaggcaaggggaagagtggcgagaggaaagaaacgaatcccttcctcggcgtctttacacccttgccaacgctatgcccggctcctcgcttcccgcgcccactacctcgccccctcgtttctcgcgcccacgcctccactaaccccactcgcccgtttgcggcgcacgcggcagatgtgcggccatggcggttgagatggggcagatcgtgcgcgcattaactacgctcgctaaccgtgaaaagcgccatcatcatgtctccaggcgaaacgaaccggctcgtcccgattcgcgcgctgctcgagtaatgtagcggtcttaaagaggccgctcattatcgtcggtcgtttttcccttgccgatgcgcgcgatttgtgactgctgggtttctgcccgcctgtagggaccggccccacctgtcaccgggcctaaggagtggcgtcacgcccgagcgcttccctcgagggggcgatcgccctggcgtaacgccgggggctactgtcggtgacatggggccgggggtatcgtgactagaggcttgggtagccgcggtcacccacgtggcctgaccccctcgggggtagggggggtcggtcccgagggtgacgtggccacccctccctctgtctccccgaggggtcgggccactcccgtttcggccccgagggctggggcgcccctgtttcggccccgagggctggggcgccccgaccccctgtggttttggcgccacgtgtgtgggttaggtgagcacagcggggctcacctaaccgcatttatagcaggttggacgagcgcgccacgccgcatttaatgcggcgcagcgcacgcttatccggtccgtgaccggtcgcggtgtgtgaccggtcacagaccggtcagatcgcgtgttaggtggcaacaggcggcctgtcacacgcctcgccccgtcccgtcggaatgatgagagcttcctggctctcgtccctagccggagccggcgtgctaactcctggagttggtatgtcagtcccggtcagatccattccaggcttcagcgcaagtatggcaaggaagtcgctggccattaaatgaaggttgaaatgggcgtccaccgggaaagcgggcgagcggggcaggaggcgtgtgctctgcttgtcagaggtcacttccggctgtagactagccctcattgtaaaaagcatgtttcccttcttaggcagctagaggcccatgtggtgacccctgaccagataaaaaggaggcccaggcctaggagaaagggggttgggactctggggaaggggttctagagcctgaactcactctcgctctccgggtctctgtattccttcacgcacagatccaccagaacacaggagtagggtgttacgcttctcagcggcccgaacctgtctatgtcgcccgtgtcttgtgcacttcctctcccgctgacgttcctcagatcgagggcgaagaacctcacttagcgcctccggccgaaccggcaaaggggggcctgcgcggtctcccggtgaggagccccacgctccgtcatctggcgcgccaggtacggggcgcgcgtgtcttcctaagccctcgtcctctttcgtgtgcgccaagcttctcccgctcagcccaatggccgaacgggcagtggcgcacagcctctctccgaacgctagcggtgacgacggggagcagaacccgcgccgtcgggctcgcaccccaccgtccccctctcgccgaaatcttgggcggggggaggcgctcggggaggtcgaacgatccgcgacttcgccgcccgcgggcgacgggggaggacggcgagacggggcgcgtcgccgcctcgcctacggcgatggcggcacgccccagggcacgctccaggctgcgggcgcgctcttgcgtcacccgcccgtcgtccccgatccagagactccagcccgacgttggctggatgacgtggccgacttggtcatgacggcacagcagcgcctaggcgccggcgggcggtcctccgccaccgaggcctctggcgctgccgccgccggctccatgtcgtcgaggcggaggacgcggcgagcggcggccgttacccgccgttcgtccgccattccctcgtcaacgcctccgacccaagaagatgtgcgtgggggaacggatgcccgcctcgatatcgagcgccggtgcgacgctcgtcgcgccgcccacgcaacggagggcgcttcctcgtccggagcgccacttcggtccgggcacgggggccggccccccgtgtccccggttggcggtgccggctgtcgagcctttgtggcgagccttcggaacgtccgttggctcccaaggttccggcccaccatcaccgaaaaatacgacggaagcgtcaaccccgccaagtttctccagatctacacgaccgggatcgaggctgccgggggtgacgacagggtcatggcgaatttcttccccatggccctgaagggtcaggcgcggggttggctaatgaacttgccacccgcgtcggtccactcttgggaggatttgtgccagcagttcaccacgaacttccagggcatatatccgcgcccaggcgaagaggcggacttgcatgcggtacagcgaagggacgatgagtctcttcgctcgtacattcagcggttctgtcaagtccgcaacaccataccgtgcatccccgcacacgcggtgatctacgcgttcagggggggcgtgcggtacaaccgcatgctcgagaagatcgcctacaaggagccctagaccaccgcgcaactttttgagctcgcggaacgtgtggctctcaaggaggaggcctggacctggaacttctccggttctggtgtggcagctccggccgcccctgggtccgccgctcagtcagggcggcgggacaggaggaggaagaaggggtcggcccgttccgacgacgagggtcatggcctgcaggtcgactctagaggatccccccccccgaaaggggaggcctgcgagcgacaaaaagaaggaggccggcgctcccagcagggagcgcccgaccggcaagtggtgtaccgtgcacaacacccctctccacgacctcgctgactgccgcgcggtcaaaagtttggctgagcggacgaggaagtgggaggaggagaagaggcaggagcgctgtgagggcaagaccccggcggctcccgccggcaaccggcgaggtgaggccaagcagaaggccaccgccgaggacatcgacgatggcgacgatgacctggggttccaggagcctgaggccaccgtcgccaccgtcgatgggggagcgtgcgctcacgcttctcgccggagcctcaaggccatgaagcgagagcttctggccgcggcccctacccatgaggcgacgcggcgggcgcggtggtcggaggttgccctcacctttgaccagaccgaccacccgccgtgcgttgcccggggaggacagatcgcgatggtggtttcccccaccgtttgcaatgtgaagttgggtcgtgtcctcatagacgggggtgcagccctcaacatcctttcccctctagcctttgacgccatcaaggccccggggatggtgctccggccgtcccagccgatcatcggtgtgacgccggggaacacctggccgctgggtcatatcgacctcccggtcaccttcggtggttccgccaacttccgcatggagtgggtggacttcgatgtggcggacctcagtctgccctacaacgcggtcctggggaggcccgcgttggtgaagttcatggcggcggtccactacgcctatctccagatgaagatgccgggccccggtggccccatcaccgtccatggcgacctcaaagtcgcgcttgcttgtatggagcagcgcgcggaccacctcgccgcggcgtccaagcccacgggtggcgacgagaggctcagcacctccgtcccggccgccccaaggcagcggatggtcacgtgcgacgaggtcccggtcaaggaggttgccctgggcgacggcccgccaagaccacacgaatcggtggtcttctggacgacaaataggaagacgcgctcgtctccttcctgcgggcaaacgccgacgtcttcgcttggagaccggcggacatgcccggggtccccagggaggtgattgagcatcgtctcgccgtgcggccgggcgcaaggccggtccggcagaaagtgcggcggcaggccccggaacgtcaagccttcatccgcgagaaggtggcgcaactttcggaggccggattcatccgtgaggtcatccatccggagtggctggcgaacccggtcgtcgttcccaaggcgaacggcaagcttcggatgtgcatcgactacaccgaccttaacaaggcatgtcctaaggacccttaccccctgccacgtatagatcagattgtcgactccaccgcggggtgcgaccttttgtgttttctagatgcatactctggttatcatcagattcgcatggctagggaggatgaggaaaaaactgcattcattacccccataggaatttattgttatacgacaatgcctttcgggttaaagaatgcaggtcctacttttcaacgtactactcgaatttctttgggtagccagataggacgcaatgttgaggcctatgttgatgaattggttgtgaagacgcgcaaccaagagaccttactctcggatctagcggaaactttcgaaagtctccgctccgcctgcataaagctgaaccccgataagtgcgtgttcggcgtgcctgcgggcaagcttcccgggttcttggtctctgcccgaggcatcgaggccaaccccgagaagatacgagctatagagcggatgcgcccccctagcaagcttagggatgtgcagtgcgtcaccggctgcatggccgccctaagtcggttcatatcgaggctaggagagaaggcactacccctatttaagctcctcaaacgctccgggccgtttacctggacggaggaggctgagcgggccttcactcagttgaaggcgtacctcagttctcccccagtcctggtcgccccggagccagatgagccgttgctactctacctggcggcaaccccgcaggtggtcagcgcggcgttggtcgtggagcgcgacgaggacaaccctcactccgcgcatccccaccctgtgtcgactcgacccgggagagagcagggaggagaggcccccgagccgaacggcggcccgaggcccccgacggccggagctggccctccgcctgcttgtccgacggtgccaggcgcccccgacccccaggatggccccggggccactgcgggaaggctgtgcctgtcgccctctgaccccgaggtcgtcggcacagaagccgagtgtgccccgcgtggcctctcggacgaagagcgccctggagatgcggcccctggcgaagaggatcggccccgccgaaaggtgcagcggcccgtctacttcgttagcgaggccctccgggacgtcaagacccgataccttcaggcccagaagatgctttacgctattctgatggcttcgaggaagttgcgccattatttctaggcgcatcgggtcacggtggttacgtcttaccccctcggccaaatcttgcataaccgaaagggtactggacgggtggtgagatgggcaatcgaactctctgaattcgatttgcgctttgaaccacgccacgcgatcaagagccaggccctcgccgactttgtggcggagtggaccccagctcccgagcctgtctccgcccccgaggccagctcgggcccctcgcagctgcctcacaccgcctactgggtgatgcagttcgacggctccctgtctcttcagggcgccggtgcgggggtcacgttgacctcgccgagcggagacgtccttagatacctggtccgccttgactttcgggcgaccaataatatggcggagtacgagggactccttgcgggactcagagtggcagctggactggggatccgccgcctcctggtgttaggcgactcccagttggtcgctaaccaggtctgtaaggagtaccagtgctctgacccgcagatggacgcttacgtgcgccaggtgcggcgtatggagcgccatttcgacgggatagagcttcggcacgtgcccagacgggataacgcggtcgccgacgaactctcaaggctcgcttcctcgcgagcccagaccccaccgggcgcctttgaagaaaggcttgcccagccgtcggcgcgacccgaccccctaggggagacggacgcgcctggacggcccccgaggcccgtcggagtcctggcctcgggacccgaggggagcgctcccagctcccctagattgattgcttggatcactgagatccaggcgtacctcgcagataagactctacccgaggaccgcgaagggagtgaacgcgtccggcgcatctccaagcgctacgtgttggtggaagggaccctctatcggcacgcggctaacggagtcctcctgaagtgcattcctcgggaacaaggcgtcgagcttctcgccgatgtccatgaaggcgagtgcggagcccactccgcctcacgcaccttggttggcaaggcctttcgccagggtttctattggccgacggctgtcaacaatgcggtcgacctggtccggcggtgcagggcgtgccagttccacgccaggcaaacccatcagctggcccaggccctgcagaccatacctctttcgtggctgtttgctgtctgggggctcaatatcctgggtccgttcaggcgggccccgggcgggttcgagtatctgtatgtcgctgtcgacaagttcactaagtggcccgaggcttatccggtcatcaagatcgataagcactccgcgcttaaattcatcaggggcatcactgctcggtttggggtgcctaaccgtatcattacggataacggcacccagttcactagtgagctcttcggtgactactgcgaagacatgggcatcaagctctgcttcgcctcccccgcccaccccagaagcaatggccaagtggagcgcgccaacgcggaaatcctcaagggcctcaaaaccaagaccttcaacatcctcaagaagcacggcgacttgtggatcgaggagctgccagcggtgctctgggcgaaccgaaccacgccaagccgagcaaccggggaaacgcctttcttcctcgtctacggcgcggaggcggtcctcccatctgagctcaccctgaggtcccctcgggtcagcatgtattgcgaggctgatcaagatcagcttcgccgagacgacctcgactatttggaagagcgaaggcggcgcgcggccctccgagccgcgcgctaccagcagagcctgcggtgctaccatcagcgccacgtccgggcccgatcactctgcgtcgacgacctcgtcctacgccgcgtccaaatgcgtgctggactgagcaagctctcaccaatgtgggagggtccgtatcgagtgatcggcgtcccccggccgggctccgttcggctggtcacgggcgacggcacagagctgcctaacccgtggaacatcgagcaccttcgtcgcttctacccctagtgggggtcgagtgtcatgtctcgggctcgggccaaccccgcacccccccgggcgtgcagggttggccgggggctaccatatgcatatacttaccttttttctcttccgtatctcaataaaagcattttcgatttcctgaggactgtgtctgtaccatcgtttccttttgtagaatcttggcttgaattagcacgctcgtgcttgaccctgccctcggtggcccgggccggctaaaatcgccaaacggggcccagaaccgagccgtgccccggggcgtggtgaactccgggggggaatcggcaaaggcccacaatcgggtcatccataaccctcggtcaccgcgctcccggcctggccagtctcgacacgaggatctccccaggcactagccccgacccacgccgtttgaggctgggacctgggcacgagcccttgttcaagccaagacacagaaggaccgcggcacagaccatcctcatctcatacacacaacaaacagaactgacgtagaaatttcctctttacttgattgcagattaaatcagtctatacaagaagggggcccgaaaggcctcggaagaagaaggaaaagttattaagattggcgggagcctgggggctcactccgacgcgcccgggttgccggcctcatcgtcgctgtcatccgcaccgtcgtcaccgccctcctcgtcggagtcgagcgcgaacgcgagccgaggggccgtaccctcgaagctgtggacgatgtggtcggcggcgtcccggacctgcgcacgcgcgccgtcctcggttccgggagggaactcttccagcgctgcccacggggagaagtcagggtccctggcctggtagcttgccagtacgagctccaccgccccccgggcgaggtccctcgaggatgacttgatcgtctcctcgagctcctcggggagccgctcgagggccccggccatctctgagaggcgctgggcgaggcccccctggttggcggcgtacttcgcgtaccgcccgcccagaggcccgcctgccgcccggcgcggtctagacgggagacggcgtcccgaagcatgccagaccctacctcgctcgccaagcggagggcctcgacctccccggcggacgagtccagcgcgccctgcagctcggcgatggtgtgttcggtggctgcgaggcgggcggctaggtcgccgtggcccgcggccgccctgccgctgtgcgctctcgcgtccagctccttcgccc

SEQ ID NO: 33979 - DNA, 1350 bp, Oryza sativa
  unsure (1)..(1350): unsure at all n locations
nnnnnnnnnnnnnnnnnnnnnnnnnnnnnnnnnnnnnnnnnnnnnnnnnnnnnnnnncttcaggtagctcaagctgataagccacttcgccacgtctggccgttatgaggtaggggccgatgtagcggggtgctaacttgccggacatcccaaaccttctcataccacggaggggtgatacccgcaggtacacatgatctcctttttcgaactcaaggtcacgcctccgattgtcagcgtaattcttctaacggttctgtgctgtcttcaaacgttctcgtatcagcttaacttgttcttctgctgacttgagtatgtcaggaccgaataccagtgcttcgcccacctcattccagcacaagggggtgcggcactttcttccgaacattgcctcattcggcgacatctgaatgctggcctgataactgttgttgtatgagaactcggcatacggcaaacaacgatcccaagtgccttcgaaatccaaggcacacgcacgtagcatgtcttctaggatttggtttaccctttcggtctgaccatcggtctacggatggtaggctgtactaaaattcagatcagttccgagggcttcatgcaactgcttccagaaccttgaggtgaactgagtgcctcggtctgacacaattttcttgggacagccaaatctacatgacatgggtcatgtagagttctgctagtttctttccatcataggtggttttcactggcacgaaatgagctgatttcgtgagtcggtccacgattacccaaatggagtcgtacccgttgggggttcttggcaaaccggtgatgaaatccattccgatctcttcccatttccactcgggaatcggtaggggttgcagcataccagctggcctctgatgctctgccttgactctttggcaaatgtcacacaaggctacatattctgcgacatctcgcttcattccagcccaccaaaagtatgccttgatatcttggtacatcttcgtacttcctggatgaatggagtaagcggactcatgagcttcctttaggatgagatctcttaactccttcttggccggtacacagatgcgtggaccgcaccaaactgtgccttgatcgtctatggagaaattggtgtctttcttctcctgtattctttttattaactcttttatcccttcgtcatctttctgagcctcccggatttgcgattctagggtaggctgtactgtcaagctggcagggactcctgactgtaccacggtcagccttaacttctccaattctctgcacaaatgctcttggtcaggccgtatttgagctacattgcaataggccttgcgacttagcgcatca

SEQ ID NO: 33980 - DNA, 2652 bp, Oryza sativa
  unsure (1)..(2652): unsure at all n locations
ccacgttggctttaccaggatgatagtggattccaagatcgtaatccttgattagttccaaccatcttctctgcctcatatttaactcggtctgtgtgaagatatatttaagacttttgtgatcggtgtatacttcacatctgttcccgattaaataatgcctccagatcttaagagcatgaaccacggctgccaattcgagatcatgggtgggataattgacttcatgaggcctgagctgcctggatgcataggccacaacctttcgttcttgcattaggacacatcctaagccttgtcttgatgcgtcacagaagatctcgaaatcttttcggatatctggcaaggtgagaactggtgcagtggtcaaccttttcttcatttcttgaaagctgtcttcacaggctgcagaccattgaaatttcttttccttctttaacagttcggtcataggtctggctagcttagagaatccttcaatgaatcttcgataatatcccgctaagccaaggaagctgcggatttctgacacgttcttgggcgggttccaagcaagtacagcttcaaccttgctgggatctacttcgacaccgttggaggaaatcacgtgtccaagaaatgctactcggtccaaccagaattcgcatttcgagaatttagcgaatagttgatgatctctgagcttttccattatcagcctcaggtgttcagtatgttcttcctcgttcttggagtatatcaggatgtcatcgatgaacaccacgacaaactggtccaggtattccaagaagatttggttcattaagttcatgaagaatgctggagcattggtgagtccgaaggacataactgtgaactcatatagaccataacgcgttgagaaagcggtcttcgggatatcttcagatctgattttcagttggtggtaacctgacctcaagtcaatttttgagaaaactcttgctcctttaagttgatcgaataaatcgtcaatccgtggcaacgggtacttgttctttatagttacttcattcagggctctatagtcgattaccattctctcagagccatcctttttcttaaccagaagcactagggctccccaaggagatgagctaggtcgcacataacctttactctccaactcttcgatttgtcttttgacttctgctaactcattagctgccattcggtagggtctttttgcaattggagctgtgcctggtgccagttctatggcgaactcaatctctcggtctggtggcatactcgttaattcttctggaaatacgtcgggatattcacagactatgggcaccgactccaaggaggtgacttgtaaacaggttaggatagaccgacttgcggtaggggtgttaggggtaaagcggacttgctttcctccaggtccttgcaaagtgatggacttttcggcacaatctatctgtcctttgtgcttagccaaccaatccatccctaggatgatgtccaagctttgcgagtctaggattatcggtttggctagaaagtcaacttcctcaattctaaggttaacttccgggcatatttgagttgcccttatattcctcccaggggaatgtactatcattggtacacgcaaattttgggttttccaaccatttcttttcacaaaagcttgtgatatgaaagaatgggaagctcctgaatcaaatagaactattgcgggtacggagttgacagagaacatacccatcacaacgtctggagcatcctgagcggtttcagcttgaatgtgattcacacgtcctcgaccaaagtggttggaagcacgagaaccttatccacttgcctgagagctaggacgagactgagctgccgctggagtaggagttctggcggtgctgccattagcatgccctgagttggtgttggtaggattctgagggcactgtctagcatagtgacccatctggttgcaccggaaacactgaactgctgacggtccctgtggtgacttgaaggaggtaacactgtttggcgcagtgttgccactaggggcacgctgctgtggcggaggtgccggacggttcatctgagggcgaggtgtcacatcctgatttttgtttcaggattcataaattatttaataaattattattagaatttatattaaatgttcattaatttacaagtgaagttaaatgtgggaaataaaatttcctaaatataaagcatggatggatttaatttttattaaattctccatggttaattatactctctggaattttctcggatttttcggagctcaattcctaattttaatcatacaaagagcatttcagtaattacccacatattaaattaatcattaaatggtctaattataattttgttaagtactttgagtgtccaagtattttcaagatttttcttggaattatttgagcattggaagtatttttaacaattcaaagatcatttccgtgattaatttagttggaaaagtatttaaaatccccttctccttttcgggccgaaataggaaaagttcagcttcactcctccgcccattctcccttcctttcggctggccttatccctcctccaaagtnnnnnnnnnnnnnnnnnnnnnnnnnnnnnnnnnnnnnnnnnnnnnnnnnnnnnnnn

SEQ ID NO: 33981 - DNA, 11527 bp, Oryza sativa
  unsure (1)..(11527): unsure at all n locations
nnnnnnnnnnnnnnnnnnnnnnnnnnnnnnnnnnnnnnnnnnnnnnnnnnnnnnntccctccttcaatcgggcctagcataggaaaccacacagaaaagtctaattcgcgtccccgcgttactgttcttcttcaagctccagccgcccgtgctgagctctgtgctggcattcctccgttgaatccgccgcatcccgtgcttcgtttgcaaaattagttgaggggaaatattcctcttatcctcctctatcctttcccccaagaatcggagcaaatggttgagtatcttatccgaatcgaactcgtttttgagtttatctccaaaaccgagtttttgatttcccggatcgatttctagcgggaggagtccgatctcttcaatccaaggctataaataggaccccctagtcctcctctttcgtttgccccctttcccgtcctctcccgtgcaccgtagctcgccgtcgacgccgcatagtccgccgccgccgccggccgggttgcagccgcgccgagccgccgcctccgccgtcgctgccgcttgccgccatcgcctttagatgcgccaagccgtggggaagctcggccacccgtcccctttcgtcgccggccaccggagctccatctccggcgaggtccgagccgccgccgccgttcatctcgtcgccggccgtcgtcgttcgtcgtttggttcgagggtgagtaccgttgggttcgtctcgtcgtcctctacgtgtacatgtcctccaaagtcgcagccgaccatccaatctccggcgaggtcgtcatgttggttcggccgccattgatgacgtcatcatgacatcatcggtttttctttttcccgtttttctaatagattaaatcttcggaaaatcataactaaataaccgtagatccgtttcaggtggttcaagttgctaaatttttctaaaatcaagatctacatgttaaaaatattcacatgtactgtttatgcttgtttttgtactgttttgttgatttttgttctttcgctttagtttccgacgttccggaggagagcgttctcgttgagcaaggttcggaagtgtttgcggaagctcaaggcaagtcacacagatcccaaataaccctttgagcatgttgaacccgtttaaagctattattttatttcaactatgcattattttcgaatgtcatcgggtggtgaacctttcccaattaattaatggccgaagatgatcttattttcctatgggttataatttgattagcgtgaaccttatatattggattggttcagctaaatgctatatgtaagtttgcttagccatgcttagaaacattagctaactaaagggattaattataaactatgttacattattatttttatggttacattaaatggtagctcacgatggttaatcgtgtggtgttaattaattgataattaaaacctggttaaggtgggttgtgagcatatggttttgatggttgtgctcatgacaattaaggaccggttcgcgagctactgttgtgaaacatttatcatgccaaccacaagccagcgtgggcaacggctttatcttttgtatagcgtgattcattatagtgcgccagactgagaagtggcgagaagttcacgggggtcgctggggagtccatgccttatttataagggggtgattatgatccaggaaaggtgcgctgtaatgggttatgttgtgcaaggggtattgtcacaactcctttccgaggtaccgtggtggtattgaggcacatcgtgacatgatgtggggttgtgtcttgtgggtacagtggtacacctctgatcagagtttaatctattcgaatagccgtgcccgcggttatgggcgagttgagcaatgtttttcgtgattagtctcacacctctcacaataattatggatgttaatatctggtaataatttgcttagctcctggtttggagttagatctgtacagccgggtatggttgttcaggatggttgggcctgtacagcatgggtgtgctgttcagtgttgattaaaatttctgattaattactctactgttttactactcttaactctttgctaaatgctgctttcgcaaatgagcctatattatgccatcctttggtatccttgtgtacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagctgaagccatcgttagaccgttaattccgctgctgtttttcttttcttttgtaagtatgtaacgttattattatgatgggtttgtatattaaaattgtcagtttgtgtacctcggctgattcctggacgaggattttatgcacaaataagttcggaaattactagtgaatttccgggcgtgacacgaggggcgtagcctggctgtcggttagcctgagtgaccgactggtggtattgcatgggttgaccgtagcgagggcgaggtgcgcctcgggaagaatttccctgatggttagacttgcgacttgcgtttcttgtattcttcggtagcctcttttctggcatcctcaagcagaagtgccttgttgatcatatgttgaaaagtggggaagtcatgagcaagcaactggagtctcattccaactgcgattcccttcaagaatttcctgatcttcttcttatctgtgtctacttcctcaggggcgtaccgagccaacttgttgaactgacttaggtactcattgacactgctgttgccttgcttaagtctgttgaattcttctttcttcatgtcaatagtgctttcaggcacatgagctgcatggaaagccatagcaaactcatcccaagcaatgttagtgggttcaggatgtgcattgcagtaattctcccaccaatctgcagcaggtcctcttagctggtgagaggcgtagagcgtcttctcaacaggagtacactggagtctcattccaactggagtctcattccaactggattgaactgacttggagtctcattccaagtggggaagtcatgagcaagcaactggagtctcattccaactgcgattcccttcaagaatttcctgatcttcttcttatctgtgtctacttcctcaggaggcgtaccgagccaacttgttgaactgacttaggtactcattgacactgctgttgccttgcttaagtctgttgaattcttctttcttcatgtcaatagtgctttcaggcacatgagctgcatggaaagccatagcaaactcatcccaagcaatgttagtgggttcaggatgtgcattgcagtaattctcccaccaatctgcagcaggtcctcttagctggtgagaggcgtagagcgtcttctcaacaggagtacactgcactaagttgagttttctatcaacatctttcaaccaatcgtcagcctcgacgggctcgacggtctgagagaactctggcggacgtgacctcagaaagtctgtgagcttggatctattgttgcccacgtgagggtggccatttccatgcgcattatgctgaaaaccggctatggctgtggttattccttgcaagatttgtgtctgaactgccattatgtgttgcatgttgttttccacatgaggtggggaagggaggcgttcttctccagaattgtgactggcagtgtggtgagagcggtgagactgttccatctctgcattacggaaaactatgcgatgcgagcggttgctgcggcggggttgctcaacctctgcgttgcgggaaacagtacggtgcgaacggttgctgtggtgagactgctcattagctgattcatgatttgcttctgcttcaactctaccatcttcaaaaccaaagcgggctggtgcacgagctgcacggcgggggcggctagccatctaaactcccagaaaagggcggggtaagagtcagataagcacttaggagggcaaggagcaaagcaaatagcaacacagatagcacacactaggcataaactggatttttcaaatcataaaaacacctgatacaacgggtgtggacaagtcacagagctacgccgagcttgactgtgcgcacaccacctaggagaaccagactaccaaacaacacccacaacaaacccacgcacgcactacctcgccacgactccaaaagagttggcggcggaacaaaagagcctatcacacggacggctgctgaagactgcctcctctactcctcgtcggcctggctgcctcctgtagtcggctcctcagtcgaagaaacgtcgatcggctgacgcgaagggaccggcggaacctgtcgagggccggcagcagcacgggccgctggcggtgggggagctgggtagtggaaacggaacacggtggaagaaccaacaacacgcttccgcgcggtgcggataaagcgtgggccacggcgggaggaagcaactggggtgtgtccaggggtgtaggaagggctaactgggtgtgggtagggggagtacactggtgagtacggcgcacgcgagctgggggagcgcgggccactgggagtgcgagcagagccgcgggagctgtgggaggacaggtggctggcgtggcaaaggcggcctgagtcccaagagatagtgtcaactaaggtgacaccctcctcggccagacgggcctccaaagcggcgtagcggcgggcaagggagcggtaagcctcaaggagtatgtcgtgctgagtggcctgagcctccgaaagctcaaccatgcgagtcagcactggctgagactcgctgtacggacaagggtacctggcgtctgagtggccagaaggaaggcgtggaagctgccggaaggcggaacctccgagacggtggttgtagtcgtgggccaggcgacgaagtgcagtccaggagaggtcctggtacgcgatctggagagtgggcctggccacagtgaagtggtgggggcgaaggccagctccgtgtatacctccacgggggtaaaggtacacagagagctcacagtgagggggaacacggtccacggagtaccccgtgtactcaggacacgagaagccaaggaaacgggcgaggtcacgaagctgagcgacgtggtgaccctcactaaaaccgtgggaactgaagctggcgttcactgccatctacaattttgaaagagggagaaagatcagtaaccattttagaaacaaactattgaaaataaagaaaacaaaagagaccttagcttttcgcaagtagttttgaacttagtatccttagggtcgtcctaagcgtcgggtttcgccctagggccaagcctgtgctatgataccatctcttgtcacgccccgagctagccccgactggaactagcccgtgacactccaaattaacctgttaatcgataccagtcccaggaaacagtgctggtatcacaggaagacagaatatcacagcaacagaagtctctttattatagagtaggagtacagtcatgttgggctgcggacagatcccgagctcacaactgcattacaaaaggaaaacggaagccaggacttggaccaatcaacacaggcgcgacttgggaactaggccgaaaccctaaaactcatcgtagccggcttgctcctggaagaactcctcatcagcaggatccgcttcatcttcttcagcaactggggaggagttatttatatagagcaagggtgagtatgggagtactcagcaagccaggggaaataagtgtttaatgcaggcttcaaggaaaggctgttgttttagcaattgattttatttgaactcttttctaaaagcaactaagtgagtgcttctcaaacgacacggatgagacagtgcgtctcgtccggtcggagtatgtgcaatgtgtcagtctttagatcttgaaacaaggttggcacccgaccaacagctttttaaacggccacccgagccaacaacttttcaaacggccacccgggccaacaactttccaaacggccacccgggcctagctgatcccgtcagctgctgatttttcaaacatcgaacccattttcacaacagcaatttcacgagcagtagtcaaacaaaactacgctaggaatcacctcacatccgcccatgaccgtgggcacggctgttcgaacagtttgttaacctctgcagagggggtacactttacccacatgacattactaacccggatcatccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaagggtgtcccattccacccatgtggtcatacttgtcttatgttcggatgaaattccaaggaaacggtccttaggtgcaagagcgggtaatcgtacacccggtacgttccccggtccgcggttttgggaattcatttagttcacaagcaccgacccaggtgtcgggttttttccaagtcttttgtaaaactccagttttacccaagttgttactcagattttaagtttgaaggcgaccgtcgattctcgcacagagtgcacgattatcgaggcgcaactgggtggttacaaagggacatagtatagcaattaacaatggaaggatcaaatgcaacaagtctggtaggtccgccaatctgccttgcagatgggacaaaagattaagtgcgatcctatcaatgcataatattttgcaagcaatataattaaatttcaaatataggctcaagatgttcaaaggtggcttgccttgctcgagatctggagcttgatcctcgaaatcctcgcactgcgggtcttcgggcttcgaaactacacgcgaaacgggacaactcaacaaacggcgaaaataaagccctattaatgacctctaagcgtgccattagatagatctcgagatttggggaattttggaagttgaacggagtcaaacggatttacggttgggaagatattgaatttctaagattattggatttttggtctaaagttaaaaggattaaattaaatcctttttgagaaagaaaaggaagagggaggagaagtagacttctctcaggcggctagggcgcggcccaagggaaatggagcggaccggccgatcttaacgggccggccggcccaagacggcccaagcgcgcgcgcgcgcgggagggaggacagagagtccggtggaccgggctcaccacacgcggtcccgggtgggacctgcttgtcagcggctcggctcaccgtgcggaaggagcacgcgacgcacgcgcgcgggcggagaagggacgcggtgcatgcgcgcggtccgcggtggacgcaggtgcggcgggcccacgcgcagcctcacggctcgcggtggatcgcgcgcacgcggagggaccgaccggggtcggcccgacccggtctggctgagctggcgccgacgtggcgcctacgtggctgccacgcgggccggcgggaggtagacgacgacccggccgcgaatggacggcgggcggcggcggcgagcggcggagcgaaccacggcgatacgggcaacagcgagcacaccgggcggttgcacgtgacaaggggaggcgagccaacggctcggattcgccggaggttgctcgacggcggaggattgcggcggtggcaaccggtggcgggagaagagggaaacggcgacgaggtcacgagaggtcgattcccggcggtgagagcatctacgcggcttcgggaactcgacgctagcgtcggattgggcggaactacgccgagcgaggccggcgacgagcgggtgctacggagctcgggcggcgacggcggcgagcacacggcgagcgacggcaacggtcggggcggcgccggctaactatggggaggctactcaagctactaccgaaagctagggggaggagatggagcgaggaggaggaacggagagaggcactaccgtggtgaggaggggcgctgtgacgagaggccgacggcgcgggagtgatctctccggcctcgggcagaggaagaggaagaagagggcgcgcccggagcccccttccgcgtccacgaacgcaccggctctcccggcgcttggcgatggacggcggaggcgaggcagagcacgggagtggcggcaacggtgaggaggcgaatgggagaggaaaggaagggagggggaagacgggtttaaatgggcggcaatgtcggtttgagagaggggaaccgacatgggcggtcaagccggcgagctggcgctccggctagcgtccaaagcggcgacaggaggtgacgccggcgagaggggaaaaaggggagaaaaagaggaaaaggagggagagaaagggggctcgcccctttgccgattcgggaaaaggaggagggagcggggcgactcggcagagggagaggggctctctgcctccgccccttggacgctagcgcgcggagtggcgggggccgagcgatgacgacggcgatgacggtgggatggtttggagcggctcgacgacacgggcgacaggcgcgggctggcgcggcagagggtgagggcggcggcgaccaggcggtcggccactcggcacgcgcgcgcgggaagcaacgggcggcgcggctgggcagcggggccgggcgacgcggatggcgcagacgacgcggctcgggcgggaaaccacgcgggcgcgcgcgcgagcaacggcgcgcggggccggctttgcgagcggggagctcgcgcgagaggagggggcgctcggtgcggctctcgcacgcgcgagcagcgagcgtgggggggggaaacgccccggggtggggagggagcgagagagagagagagagagagagagacagagagggagacgcccgggagagagagggccggggaagagatgggccgagcggaattcggcccatcgaacccgggggaggcaaactagacttttgcggagggattcgatttggaaggaattggattcggaaaagaactcgatgatagatcggggattgagatcttgagatggcacggacactagacaacaatcaaagaaacaaatttcgcaattagggtttttcggagataattttcccgctaggtgccacgacggaacgggcgctacagtaggctgcggcgccctccggtgaaggcggcagcagcgaccgcacgctcccctccaccagatcccggggggaggggaggcggtgacccggcggcggcggccgtgggtagccgtgtcggcagtggtggtggagactggcgcaggcgaggtggcggccaatggcagccgccggatccggcgacaacggtggcgctacttgtggaggaggctggcccgggcgaggcggcgaccggtcgacaagagacttgttgagttatttctttcttttctcctcctccatttccaacctgttgagttcttgagttgtttgatacttagttttggatggggatgatgtgatctgggatggtggtggtggagaagacggaaaaaatttggggtggtgatctaggatggggatgatgtgatagatgtgttcttggatttggggtgttgatgaatgtgttcttaggtgattgggagctcctcggtgcatcggctcgaatcgagccgatgcgtctagctgtttctatttggctcgtgaaaacatcttaggtaccggttgggaacccctcaacctgcacctatatttgttataggtgtccgtttacaaccggcactgatgagttccctgatctgtgccgccttcatggtgccggttgggaaaaccggcaccgaaggaggtttcccaaccgacgctatttaggtattctgtagtagtgttttctccttccctaattctgttttcctggtagataagtgcttgtcttgccaaatgtaaaattatatattgcatataggaactatataatgcccgctatgactgctaagtacaattggaagatgtttttttggccatgataattgtgaagacatatttacacaattgcactggtgatacacttgagggattgtgttatttgctatatttgagaaaaaataattgatgaaaattaccaacaatgcagtattttgtcagttagagaccttaaagaccatcttgaaatgtaaattttcaaaatcttattgtagatacatatttacgtgacctttttactaagtgatttgcaatcttttctaagaaaatcaatttaggcaagatgtggttttggaggttaattttggcctttctagtttatattttgataaacatttcattggcacatctttataactaggcaaaatttgctaatggacatttaaaaaagtgtaattggctgggaaatatcgtaaaaacatgacacggctgatggtcattacaaaaattatataattggctatagggcaccagtcacattattttagatgtgagaatttttcaaaataacgagattgtccctggcgccatcttccctcacccgaaatcacagaagttttgtagctattggcaaggtagctggcgcagaagcggacctggttggggagggacaggaggtggaggagcacgagctagcgactgctcgaagctccaccgtaggcggctccttgtcacaagctcccgtcgtggccgtcgcctgcttgcctccacgtccggtccctgctcgcgcgctgccgtgtggagcagccgcctgcacgtgcgctgcactgcgacaccgcctccttctcccaatctcgcatgctgccgcccgagtcgctacatactccgctccgccgtacaccacctccgcctgctgctgctcgatgggcgctcctctctgcctcgcgcagcgcaggcgtcggttgcttgctgctcgccatgctggcctgcctcgccccaccgcgcctccgaggtcgccgtgccattcccggcgaagtcaatgggaaggggaaaagaaataaagagaaggagaaaaagaagcaaagagaagggacaatccggacatttagaaaaatatctcaccttttttatccggaaataataaaataatacaattggtgtcctatggccaattatacgttttttagagtccatcagtcgtgttacgtttttgcggtgtctcccagccaattacatattttttgcgtgtcctgtggcaaagtttgcattataactatttttattatgtggcatattagatactcactccgtctcataatataatcatttttttatttcaacacaatttttgatatgatactttacctaacaatatctataaacttaatatgctttaaataaaaatatatgcatatcatgatagtttgtttcatgataaatatagtaacataatnnnnnnnnnnnnnnnnnnnnnnnnnnnnnnnnnnnnnnnnnnnnnnnnnnnnnnnnnnnn

SEQ ID NO: 33982 - DNA, 3738 bp, Oryza sativa
  unsure (1)..(3738): unsure at all n locations
nnnnnnnnnnnnnnnnnnnnnnnnnnnnnnnnnnnnnnnagatcgataccttgaagccctagccactgctactcttgcgcccctgccgccgctgctgccgttactatcactgtcgccgccgcttctgcgtcaccaccaccgccccgactgttgccggttgctgcagccatcatcctccttcgttatcggtggtttcttactattctgctcctttccggtgagttcttgctgctgtcaatctgatctgttgccgctgtgtgatttgctcgctactgctgctatcaacgttcctagctgctgctgctgctactgggtggtctgttgctgctgctgctacaacgatcagcgaggaaatggttcagagggcagagaaagcaggaggggaaaagaaggaaaaagggaagagaggcaaagttggggatttttctgggattccataaattcacctcaaatatgatttttatcctctgcaagggtaacttctcttagtccatggaagttcaatttttatcctctgcaagggtaacttctcttagcctgttgtgtgtttttttagttgttgtttatgggtcgaaagtaatattttccaatctggtattaaacaatcgggattcaagttagttgtcctaaataaagtttgtagtcatcgtcaagatctttttaacgccactggtttctctcgattccgataaacggtttaggagaaacaacagaaacagaggcttaattagttttttatggaggcttaatctgggacaacaatttgttttccttaatctgggattcacagaggcttaatctgattttgctcccaacatgaaaattgtagaaaattttgtttggatgtcctgagttctattacttgcaaaattttgttatgcggttggtgagttacgcataaaacaataatgaaactgctatagattgtttaatattaatcgataaaatatatattttaggtgtttattttagtaaatgtcctttgtaactatagttagtcaaatatagatgtttagttgtagctttactccacatgtgtgtagagatctggtgtggagagtgttgcctcgagttaccgtcaaggttaaaggcaagtgcacgacaaactaattatgtgattcatggattgtttgctctatctatttattttcattattttctatgtgatatgtgactcttatgttcatgcgattgttcatgccatttagatttcaagtttatctaatgtttacaacgttattcttgttttcaatatttcagattctgattctggttaaataatttaagttccatgcttgctgttggcggctgttaaatgtcgattctataccgccaacatatgcataaagttcagataataaaacaaccaacatagtgataggtgcttaatctcacatatttcacaagtgttggtgtatatttgtatgcagatgataaaccctgacgttgggaggaaatctagactaaagtgaggagaattatgtatccatacaaggaggggttgtgaacttcataaaaacatcagcgaatcaatccaaaactccgagaaatggatagaggagagcctagggagtccgcagtccgaaggccaggccaggagagcccatcataggttcgcccgaaccccctggatcggccgaacccccctggtcgctgttgatcctggggtttggcgtggacgctccagatgctctcccaatgatggttgcggggcagttcggacatttccccttctcacaaccgtcataactgccctataaaaggacatcactccctcacttcacacacacagttccaagcttgagctgaattataagagactctattgtactatattgtatactagaataggaagagagtagagtagaaggagttggaagaattctggagttgttggtaatcttctcctatttcttttattctgtttattactctgaattcaatataatattcttcttgagtaatttagatttatcttgtgagaattaactcttggttagttcctaagtagcatacaggattattgttcactataatcaactaaaatatagtggttgctttgttgagttataaacactaaagtagatagtaattgcttagacgtggtgttttggtgattattatccagtaattgctgtgtagcccacagtacgtttgaggtgggtgtagaggtggtgacagccctcgagatcactgaagtcctccctgtccgggtacgtagtagggagacactgtttctcactagtaaatcctctctatcctggcctatcatttgcttggtgtccttggataaactggaggaagatctgatcacacacgttcccttggattcgatacccttggaatactccgtattggaagtgctacctcggtatatccgtgcgcttgcagattttatctgtgaccgtaagaaataccaacacttgccatggatgtgcaatatgatttcaatttggttctttgtttcctaattattcatgttccatgcgagtcatggatatgctgtctgttttttcattcatgttcctgtatgtaagcgctgatcacgcttactctgctttgccgggaaatgctaggatgtatttacaattgtctgggacggaaaactactatgtcaattcatgtttgcccaggatgggaactactattttctttaacttggtgtttgaaaatgtttttcttttcaaagaaagaaagttatctatttaggctttattgccaatgatgtgtatatgtgttttcttgttccatattgtagttgctgagtatttctgtactcactcttgtgtttatttggttttagatacacattgagatcaacatgtatgggcaggaagtaggacccttatttacacatctatctgcacactatcaaactatatcaaactatattgcttaggaggaccacttcaagaaatatgaccttctgtgacgaattcctcgtgatgttggagcaattcgtcactagcacattccattttatgacgattagtatgagatggggtggcttagtgacgaaaaaaaggtgttcatcgttaataccaactagaaatcgtaataaagtatttcaatgggacatcgtgacgaatattaatttatcataaggggcacaaagcaaacgtcataaatttatataatgcatttatagaaaaatatattaaaacttaaagcaatttcatcaagtgaattaatgaggaaactaaaattttcctttataaatcatggccggaaatatttttgtaatattctacgtggtctaaataattcttgtgaattttcggtgctcaagaactaattttaataccacaaagtttatttaacctattaaaataaatggaaaataaattaaaattcctctctctgtctttgggctttttcgacccaagtattactctatcccttcctcagcccgcagcttgtctttgggcctatgctgattcatgatgagatggttgtagtgttttggttggtgcgactttgacatgtgacttgttcaggttagtgaatttgaatgattatttggacatgtgactttgttttggacggtgattgagttgtgactcgattagtacannnnnnnnnnnnnnnnnnnnattttgctattcaggacctgatgtaactggacatgtgatgtaatttttggtcagtgaagctgtcatgtaattgaacttgtttagataatgagcctatgatgtattttaatttggtcagcgattgtggttgtatttggacatgtgg

SEQ ID NO: 33983 - DNA, 3034 bp, Oryza sativa
  unsure (1)..(3034): unsure at all n locations
cttgtgaattttcggtgctcaagaactaattttaataccacaaagtttatttaacctattaaaataaatggaaaataaattaaaattcctctctctgtctttgggcttttccgacccaagtattactctatcccttcctcagcccgcagcttgtctttgggcctatgctgattcatgatgagatggttgtagtgttttggttggtgcgactttgacatgtgacttgttcaggttagtgaatttgaatgattatttggacatgtgactttgttttggacggtgattgagttgtgactcgattagtacnnnnnnnnnnnnnnnnnnnnnattttgctattcaggacctgatgtaactggacatgtgatgtaatttttggtcagtgaagctgtcatgtaattgaacttgtttagataatgagcctatgatgtattttaatttggtcagcgattgtggttgtatttggacatgtggctgggttggcccacgtgttaattcatactgctgtagatgtcagatgtgtggatgttaattgggttttatattggattttaacttggaatctgtttgatatatgggcctcttgagtatgcatggcccagatgcaatttcattgtaatgcttgagcttactgggccatttgaatatatagagcccactcaatatttaattcaatatagatggatatagtataattgggctgaatttattaaaatctaattagacttccaataggcctagcccataaatagatttctcactacatgggccttaacaaggcctagcccaaaaataggttgctcactacatgggccttaaaaggcacatgatattttatgacattttttagctagataatgacgaatatgtgcgtcacaaagttataacgacagaaggatcatcactagattaatgacgaaaaattaaggtttcgtgatagaacgcccttagagatgcatgataggtgacgaatgaattttcgccacacgagcgtcacagattacgaaacgtgacgaaaaattcaacgattgtgacgtaaatggagcgtcatctattataagatctcttgtagtgccataatgacacttgaattatatcctagtttggtcttgtaataatcttttagctgtctattagtttctttcgatggattatatggatggatagcactgtgggaattatattatcattagtttaatcctataactgtatattgtagatgtccatatttataggggatactctgccaaaatttctaataattttgagagttaatggttttgagtatatttaggtgtggcattctaagtacatgtttacctggcgtgttacaatctgtgacgtgtggcaattacgacctgtgatagatacgggatcacatcaccacttatgtgtgacggttcataccactacactcatcatagatggcatgcaatttatgaagggacatggttgtgaccctgttgacgtgaaattcgtcatctacacgaaggccaaggagatttgcttagctctagtataggtactatcaatcaggctttggttgggccagttagtttgatcttgcaactaacaaggacgacagaaagaattgaaccaacgaaccaatcggcctgatatagtgtggaggatgtagatctgatggttaaagcatacatcgtctattaatccgacgcaagtagattcacgtgtatatcggctagttagccgatacatctgatagctaaagctcataataatgatagctcatcagctagaactccaataaaacattacataaaaacatatcgcttactagaattaaacttattagtagcaatctaatgaatgggaccttaccgagacattataagattgaagataataagaaaaacttacttagctgatagatctacgcaaacatgtttgatataataaatctatctaaaattgcaatatgattagattagaaagataccatcctagttagaatatcagacttaaatgataaagtcctaacttaagctgatacgattctaaatagtgatgcagttaaagataaattcaatatatctgataggcaacacttgcatcaacctaaatagaatatcagacctaactaagaaagttctagctatgccgatacaagcgaagttgatagaacttactttcttgccggagatcaaaaccgatgcagtctaattcgaaactaggaactcgctagaataaaagggggtgatgcacagaaagtaattgtattaatctatgaaagatagtttacaaagactgcaggtgtacataaatataccctcaggttggtacaagtcttgatcaaacacgagataagactccaaacaagaaaatgagaatatataactaatcctacctatttaagatttatactaaaaatatgaaactgcctctgccgtggtcttcgcgatttctctttaaattcagcttgatctggataaaacatctatctactaattggcttctttccttaaccgaattcaccaaagaatcgtaccaaattttagcattaacagaccttcatatttgtaataggttacaattacaacccgttacagataacctcacatctatgacaagtcgtgctgacccgtcagagatgatttgtggttggatctgtagtacatatatagtgatagatcaacaaatggtagatgatcgatagggctgcgataatttggaaaagaaacaaaaggggtgatcaaactagctatgttaaggagtagaagatcctaatgaatgtactaacatcttttaggccactcatgaataacaaaacaaaaaatatactacctccgttttttaatagatgacgccgttgactttttatcacatgtttgaccattcgtcttattcaaaaattttatgcaaatgtataagatataaatcacacttaaagtactatgagtgataaaacaactcataacaaaataaattataattacgtaaattttttgaataagacgnnnnnnnnnnnnnnnnnnnnnnnnnnnnnnnnnnnnnnnnnnnnnnnnnnnnnnnnnnnnn

SEQ ID NO: 33984 - DNA, 12518 bp, Oryza sativa
catctattaaaaaacggaggtagtatgtaatgtgggagaatgtgatagaaaccaatataagttttctttagaattcacgaaatttcaaatattaggctagtatagcgtccaacatgatagcgaccggtctacttaagacttgtacccgtggaattaaacaagagtgtgatccataattaagtaaatcatatataactttacaagttagactactattagtgaattaaattctagaaaaataccataaaattatggtagcgctaatccactccctgcgctcggaattgtaatccgcacgccgcagttagcccctactgcgccaccccctccccccgaattttccgtttttccgttacccctgaatttagttttctgtttggctcccacgctccttttttccgttcccctttgctatctgttccacttatttccctgtttttctggctccctgcacaaattaatccttaaaagaattactcaatgtttttttttcccgttgtccccgctcccgtggacacagtaaaattattacccctttttccccacggtcccaggctcatcccccgttctctagatagacagattaagatgtagtaaaatattacatttactgcgcttcacttgtctagataagctgttgtaaataaattataactactcccattcactcatattattcgatggattacgtttgtagtaacaaaattacttgcataactctccctccccttttattagtagatagatttcgttacagtaaacaaattacaccttctattagtagatagatttcgttacagtaaacaaattacaccttctattagtagatagatttcgttacagtaaaacttaagcccgtcacagatgacacctatcagtgacgggccgtagtttaggtccgattgagataatattccatatctcaaacgggcctgaagttagggcccgtcacagatgaccatcatccgtgacgggcaccaactttagacccaattgagataacattccatatctcaaacgggccttaagttggggcccgtcacagatgaccatcatccgtgacgtacaccaacttgaggcccgtcatagatgactcatcaatgacggactatatattaatccccggttgacatgacttaatctctattgggcattaactaaagcccgtcaccgatgagcatttttccattttacatatgaaatgtttatatttgtatgttgaactatagcaaaataattaacttgcagtatagtaattcaatttatgagtcaaatcaattttacgcgtagtaaatgatatcaaatggaaaagtcatcaacaacaaagttgtataactcatcaacatctataacttttattttggtcatttttctatataacattttttgaacagtttgaatttgaatttgaaaatatgacaacttcaaacaatattttcaaatactaaatgatttcaactgaaaaattatcaacaacaaagttgaataactcatcaagatctaaaacttttattttggtcatacaataaataaatatatcaaaatcggtgacaaatggaaggtaaataatttaaaaattttgttttcttatccattgcaaatctacgaataattcagaactataaaacatgaggctaaagtcttggatattctcaattactcattcaataggttacagattaataatttgcagtcaatgaagagagatagccaatataggcagcaagactaacattcaatttcagatactcagtgactcaccagacagtatctcggtagcctgctctgctagcttatctgctggtggctgatgcttgtcgcgacgccgcctgacgcctgctgatctgcaggctcgcagcagtcctcccgttgctggtgtacggtgttgacgctgaggaggtcgcggtggccggctggccggcggttgccgtcgacgtcgaggagcccatcctggcgccgctcggtttggtaagatccaaaaaatgctgagagtgaacggttaatttctagaatagctgcttctattgatagtaaactagcaatcgtgcacgtgtagtacacgttatgatcaatataaattaaattgagcatattataagtacaagaatctgtttatttacgtgtattgtgtaaatatgacctaggtctagaatatatatgtaagtcctggtaattcataatctataacgattaagaaaatatgtacaactcaaaatacttttgatatattgtttcccattgccaagtcgataaggcagtgacaacagacaatgattgaggaacaatgttgagctggtagcgtggtttgttaatctcgctaattaaactaatacttgatactaacattgtataattcaccgcaccgagtaatagccagcatatgtctctcttggagccttatctactgaacaggcagaaatcagatttagtaaatctcctaactcatcagttaatggatgcaacaatggaggtaaatctctaaattgattcgtatgtgggtgattcagtaaaaaaaaaagagattcaggaaagggtcgacggcgtcgaggaagcccgcgtggtcggcggcgcggccgtgctcgcggtacacgaccatgcgccgccgcggcagcgacgccacgtcgccgaactcgtggaggccgccccacatggcgaccatctcggcgatgtccgagtcgttgcggttcacaaacgcaaccgacagcttaaatagcggctgcaacgcgagagtgacctgggagatggcgccgagggagaccttggccgcgtcaaggtcagggtcgccggtgcggcgtggggagggaagggcgcgcgggcgggcggaagtagcggcgtggggatggctgaggggcggaggttagatgcgccttttttttggcgttcttttttttcgttgttttttcgtgcgcgaagtggtctgcccacgatgaggtttctttgggcgatcacaggtgggtcccacgtgatagtggatctgaaggattgcaggattgagaatgaactcgtaatagatagatgaggcattgagtaggtgggaaacgtgggatgaatcaaattggaaccagttggtgcgactggaaggacgcgcgcaagcattttgtggccagtagagtgcctgcaatattagccagtggctatatatggcagggacattttcctgtttgtactcctagccaacgagggcatatgtggttctagttaatcccgtgcatgccgctgccccttgcatatataagcagggtgccatcccttccctcccaaacaaaagactgaataatttgaaaatatatattaattttctgagaagtgtgtggttagtactaacataataattgtaatggagacaatgcgtaaattcttcccagcaatcgccgtcctcctacttcttgttgttgccactggtatgtgtgttctccttgatcatcatatattatttattgtttgacgataggttttttttatatattaaaatgacttagctaagtttgttataacatgcactttcattatattacacttgttaaactgctatcttttttaagtttatgaaaaaaaaaccagtttttacatttctgtcttattatttgatccgaaaagtctaaaccaactataacgagtaatactatgcttgagttggtagcaaagggaacatgaacattcattatattattacacgtgtaactactatattttttaggtttatgcaaaaaaaaaaccatcttcttacatttatgttttatacttcgatccgaaaagtctaaaccgattatttttgcgaccgtaaggactaatattatgtgtgagttgttggcagaggcgttggcgccagcgcaatcatcagtcaggccgtgcgagacgaagagcctccgattcgaggggttttgcatggtggaagataattgcgcaaacgtgtgtcggacggaggggttcgtcgacggcaggtgcagcaccttcgtgcgaaactgtatctgcatcaagccatgctaaggttgtccatcattatctcatgtggtcacttggcaactaattaattgaccatgcaaacaagggtctgcatggagctattaatttctttctttttttactttctttcttttctttttttttttgcaagcagatgtacgattctgcatgcatggcaaattcagctagaataaaacaccagctcgcttaatgcatggcgttttcttgctagctcgactaattaattgtacaacagagtcaagcatgcatatgtgtttctctctgttttttacttacatgtatgttgttttccattgtaaggagaagtcataaccattaattattgtcggatatgtggttgtgtaatattgggtgtgtatttgtattagtattttgttgtgaatgtttggtaattggtcaattaatatgattgattaattttgatataatgttgtgactctttttccatgcattgtacttcatgaaaacacattcatgtctcactcctacaatgtatcaatgatctcctcagtgctgtatattgtgttctcagagtggttttgatggcgtctgtttccatgatgtcttccatggtgtcctagagactgcttgagcacacaggaaaagcaaaatcccgtaaacacacacaccatgtcgagtatgtgaaacctgctttaggtgtgaaaatcttccattcggcgtcggtagcactagacaataatatcaccaacatagcgtcttcatgaagcactcaaccacactcatattctcatcaatacgactctcattttgagagttacactcactactgagagccttacgtagagtaggcatggtcgatgttcccgaagtccataggacctgatgttgaggtacgtttataggatttcacatgttaatactgtacatagtgcttcagattctaattaatacactagaaaaagcattttcaccgatgttgggtatttattttcgtaggcggaccgcggacatggccctcggaaccacatagccgcctacaaaaatgtaaaccggggtaaagctcgttgtccgcctgcaaaaattcattttcgcaagcggacgccttaagcggtccgcctgcaaaaatactcttcatttttacaggtccgcctgcaaaaataccctttatttttacaggcggactagtccgcctgtgaaaatagactcggaatataaataccacctacgtaggggcaatttttttctatcatcttctccctcaccactcctctcccacgtccctcggtccctccccttccccctaccctcccctcacctcccgtcccctcttctccccagccgccggccggaggcagcggcagctacttgcggcgggcggcgcggcccctccctccctccctcccagatctggccagagggggccggcggaggcacgggtgggtggcggcagcgcgggcagagggggcctgtggaggcccgggcggaaggggccagctatggcacctacgagcaacgacgacaactacagtcggccgcgtcactgcccctcccctcgacccttccccacccagatccgatggaggggatgggtgtcggcggcggcgcaaggcggatgggtcggcgatggcttgggcggagggcgtcggccacgacgacgaagactaccagacaacgacggccctaccgcatgatgatgacgaatagtgccagccgcgtcactggccctcccctcccagatctgaccgaaggagggagggaggtggtggcggccaccccatgcaatagaggagttcgctgacgacgacgacgtgttttttttagtttacaagttcattgatgttaacttgttgtgaatttgaatctaatgcttttgtgttgcaagtatacaatgtctgtgattggattttatttcttggatgagatttgtgagaatttgtgatttgtgatttgaaaccctagggaggggtggggctggcgggaatttttttttggcgccgagggtatttttgaaggcagggttagtgtagcacttgaggctcctgggaagattggaacggctgcctgcaaaaatgaggtctgcctgcaaaaactggggatttttaccgtcatttggatacaggcggaaggttttgccgcctgcgaaaatgtgttttgaccacctggaaaaacttttttttctagtagtgataacaacgcaaatggctggattcctttcaagaaccttgaatcatttagcccagcccacataccacgtagatcttttatttcagagaataagttcacactaggtccttcatgttgacatcgaatttgaattgtgtccttgaaccgtacacaagacataacacgttcctcaacttccccatgctcatatgctaagcactcaggtccttcatgttgacatcgaatattgatctacctgagctcccaaggcattataggggctcacatgtcaatgaaccgccatccttcttctctcccctctcttccccatctgtcactgggcaacaagagagaagctgggcaggggcgtcaccgacctcgagtagccgcctcgactgctccctcccgagtggcacgggcgatggcccttctagtcccgcagctagtctaattttgtcgaccactgggcctcttgccgccattggcctcgacgcacaggcttttggagcagcacagttgaggtgggcgtcccaaggccacataacgaagacatcagcttgcctcgcctccaactcacagcctcgcgcagtccttttgtccgctctaccctcattctaccactcaaccgctcctcactgatagttggcaagctcatctcaaactacagtatagggacgcagtatagggacatgggggtacagctgtacccccaaaatttttgcaaaaagaacactacatattatggtgtattacatatgtgtaattgggttaaaagggttatatttgcacttagattggcattccagttcagttaatctcaatccttcctactctgtaggctatatatacatacttgtcgatggctagctgagatgactactggccaacaaaaaattcataggatattttatgaatatttttgtttgtggagcgttcaaataatcaaaatcgatgaaaatattagtttgttgaaccttcaaaactctatcgacttgcccaagggctatttaaattttttcccacaaacattgcaattgattattctatacaaataaattaagaaatatcgggaacataaaaaaatacttaaataattgcttggttacattcttaagaaacaactttttctacatgttcgtgacaaagacatcatatcctatttccaaaaaaattctgatcaattataacttaattttgtttaattttagtaatttactatacactaaaatcactttacttttaactatgtccatgttagttcttttttacataggcctccatcatttatgttgagcgatattttcttttaacatcgtacccccatcactgaaatcctgcgtccgccactgcctcccaagcagcaagaaccatctctttttctccccttgtctgtctgatctgccatctctattccattcatccaaatatgttcgcattgagattaaccgaccttttgtggtgattcacctttgagtttattcttgatctggtgtcacatggtttcatgagtttagggtaattatgtctttcattcccatgtttgtacgaatttaccctttttgttgatattactgtatttaatttttttttcttacaacatctgcggtggactaatcacaccatggctgatgtggatgctcttggtcgatgtgcaggtagttgatggcgtagacagcctggttggctcttgctcgggccaggcgctgcagtacgtgtccgcgatggccgacgacagcctggttggcctcgacagctttcatgtcatggcgtgggccatcacaggctatgtgttccacagcacgttcacgatcgatcagctggctttgtagcacccgcctacgctgccacgacgagcacgtcgacgaccatggattagggcactgaaattcttcttggcttcacggaggtttcacgttgtgggattcggggtggggtgagggggggggggtgggtttggttgcttggcctcccttattcccgccacccgtcgcttcaggtgccgcttagtggcctgctcaaagatgggaaagagaggagatagaggagcggtttaaatattagataaatttattttttaagtttaaaataataagtctcaattaatcctagtcttagagatattgaagacaacatcacacttcagagaatgttaagctggctgtgaaagacttcgatcataagctttcctaatctagcgactttcggattatattcttattcctggttgtgtgagaaaaagagccctactttcatcttagacaaaaggcttagcgcccttacaaattgtactataggctggctcttagtgcaaaggtgcggtttttttttaattcttttcttggagctgcagatgtatagaagaattgaatgccagctattgcttggtcctatccttagtctctaggctgtcttatatacgtaagggcaaatgacttctcgttttgcatgtcaatacttaaggggttgtttgccacaaatatgtcatgccacacaaagtgaggctagcaatttgttagccataaatgtggctaagtttggcaagaatttgagtctatgacgtgtaggtccaatgactagtaatgtgaggcatcacacaattataacagccaaccaaacactatactaaaaaattgttgcatgcctaaggtttggcatggcaacctttaggagccaaccaaacagccccatctccattagtgcaactgaatatagcctcaacagcatgcacaaaccagctttgcttcaatttaagcagcccaacaacctttatcgactctccgactgaagtgattcttgctcagcggcacatcgaccaagatgattttcaagggaaagaacaaatttttctaacccatgttgatctagggaaataaatttttctaacaataaaaaggaaccttgtccctttttattgtgtttgtgatgggttgtttcttgtagccagctttgttttgccgccttccttaaatacacttcacaataatttggaatccatctagctctcgtctctgttatgaaaacaaaatataggaaatagctcaaccgatattatatagcacgtactacagcagatgggcggactagcatctccactccacgatcatgtagaagaaatcagtccaaatggacattttcagccagtaattgagatatgtttttcatgatccccatcaatttcagtccgtctcaccctgtaaacactgctatgaccaggagctatacatagaatttactttttgccatcctcttaaaatagtagtgctcaaaatgccactctttaaaaatttaattccaaatgtcacctgattagcccacatgtcagccttacacatcacccgggcccacatcacttttgtttgaatgagaaaagaggctgacatgtgggccgagtggcatttgagaatgaaattttgggggagtggcatttgagcactgtcattttgggaggatggcagtgaaagaacctgtcgtaggctctccggaccttccattataattgagagatgaagtgaataattcaagtcatcaaacaagcataatgaaatatccgacgcctcgagagaggaatattggagatattgctaggcctttagcctgccagtcaacttcagcctgagacgtgcccgtcaaaccactcgaaggcggcgaccagatgtgttacacattcaggagacttgacaaaaatggctaaagttctacaacatctcaaatattcctaactcatactcatgtgaatctagttcccaggatgtgcactagattcacactttcatctcaagcatgattatacatagcaaacacaaataagatgaaagcgattataaactacatctactttagttacattggccgaccggccaaataaataatagaacagcggaaacttgtctacccaatccacaagcacaccgactaggggtttacccattatgttcaagtcctagaagaagcagtcgataacccgcatcactcaaagactaagtctaaatcctgcaagcaaaagttaattcaacagcaagagtcagtacattattagaaataatgtactggcaagcaccaagacaagcctaacaccctacttgcaaggtatataatcaaggaaggcatagtatggttctttttagcataaagcaagttttatttgcataaaacacattcaaaacggatttgctttcaaataaaatttcagcaagctagtacttagcatatgggcatcaaagtaggcattaatcatgtataaatattcacctcattgccatccatggcagcaaggagatcattttcaaatctcatcagaatttgaaggtaaatttcagcatttaggagaataaacacaagtctatactcaatacatatccacacgccgctcatgaccgcgagcacggctaatcgattagttttaactctgtagagtttgtacactttacccacatgatgcgaaataataatcatgcaagagcatggcacgcgatacataagtacccgatttattacccgcaacaaagcttttccaaaattcatgatttagccttacaccagcacgatacgtgttcctccatcctagtcatactggaaatatgacctagaaccgttaagtggcgggcccacgccttgaacttaacgccgtggtggcggacacaacgggaacccacccacgtggcacaataccgttgtattggacagacttagtcacctaaactaccacgtcggggtaaataggaagttcctctgagttatccgaactcatacacaccggcctaccagaatgtaaggctaaaccataaataatttactaagcttggactatcccatactagcacatgtggttgtactgtatacgaaatgaactgacattgagtgaagtccttaggtcggtttgggcgcactctccccctatcggtacacaactaatcaccatatgtacaccacttgaggcccaaacctaaaatctatgctttccaccattttatttatcaaaatcacaagtattaaagttctgtccagattaattaaaaatcaattttcatgtttgaaatgagcccataatgacaaggaagaccattctaagcatggctatgctttatagtaacctagtgtcaccaaaactcatatataaagtggtatagccatattgttcctaaggttaggaatgaggaatatggatatatgtggagttaaggtgataatgcaaataataggagtttatctaacaagtttaacaaaattttaatttattagtgtacaatcgacatgcaagatttgcaaacattttcaataacctccaaaagataggttcaaagtgatcaaagagagggaggtgggacttgccttgcaactggaaaatgtcagcacctaaatcacttcttcaccgattaagcaatcatctatacaaagtacacgttatgcaattaaacaccgaaatatgcgaaaaatccaaaatgctctaaaatggatgatttgtgcacagtgaataggtactggtctaaaattaatttaggtgaaagaatttctattttatctcattttatttgggagttatgaattttagaagtttcgtcggtatagtgtaggatttacttagttactattgtgaaatgctgttgtaaggtgattcttattaagtttatgtttgctggggtgaagatatttgttttctaagactaacacatttggtttcataatttttagagttaatatgaattatttatgtattttacaagttttaacgtgttctaggcatatattccctatgtgtacatggctttcgagatttaggtccagaacttgctctaacttgctagtgttgtataaaatgagtattttagttaactaatctaatcttagtttataaaattttagtgttcaaattactttacttcacattttataagctaggggatgttctatgttagaaacttaacatatcaatctggagattattatataagttaaggatactaagttttggtggaaggggatggatctatgccttcactggttcaacaagttttatttggatttatttggagctaccaagcatatatatactttttcatatgtattgtttaaccattactatgtgtttagtacctattctaccaaattaaggttcagagccatggtctgtaagagggtgctataattcactctattaggttgaagtatattacttgctggttctatagaaaatttggttcacttcatttagactatagatgaattttctacaaatgttacaatttaaggtatgctccatgttgcttattccttacttaaatacttaggggttttcattatactgtaagtatgtctttttattttataacattgaagtgcacaaccctatgattctactgaatttgggtttactcaaaaaggatctaagatgaattttatataaacttctaaag

SEQ ID NO: 33985 - DNA, 1674 bp, Oryza sativa
ctcgagctcaccggcgacaaacgatggctcgtttgggggtgcaaccaaaatacaaaatgaagatcatgttattgcgattccattcctctacttttctcggtcagtggacatcggagtaacgccggcggcgagtccgaaaggaggatgttttcgggtggtgatgcatgtgcttctacaatcatgtattggttaattgggtgcatgcatgtatgttctataggctgaagggtgctcaccgagatggtagacatggctggggtagctaggtttatgacggtggctcgtgtaacggctcggcggcggcaagaacctccgggtgaacggcgatggctcaatcagctccaagaactatcatgcatgtgtgtccatgaggttagagaggccccatagatgctactgatgcatggaattaggttggtactcaccggagggggtggattcggcaacggcgacggtgactggaggtggagaagatggtggacgatctccacactcgtagcaccatccttcgagattcttgaggggaaatggagaggaggtcgaggcgaagacgctggcgcgacagcttggcccggcttggtccagataagcgggaacggcgatgatgtcgctgcggcggtgcacagagcgcgctctagagcgaccatgacatggccgcgttcccgctgctgtagaagatgaaatggaatgggatcaaaaccaaagttgttcgtcatggtgagatgagaatggaacgagtatgagttagagatgaagagggctcgacaacggttggcgatgtccctcttcttggcggccggcgacgaaagagaggtggagagggagagctggagcttcctccctcggttggatcggcactgggatggtgggtgaagaatggcgacgcagctgggtggaggtgaagcctcggttcggcgctgccacgtcgaggccacgcgtcgtacacagtcggcgccaatctctctctctcggctgtctttggtccggctggaagatttgcacagggtgaggacgagccagagtggctgccaagtgggtccaggtcgtggcaaactaagctagggtgagagggttgggcagaaacgtgggtgaacaaaaggtttgaatgattttaaggattatttctctctcccactttagtatttcaattatttaatttgtgggtagaataatttagtgtggatttttctcaaggtagatgaagatacctagattccattttctttggttgcactcaaaaattatggatagattactcacagaaattagaggaatatgggttctttggaaactagttcgaatttttaggagacctaaacagagaagataaattctggaaaaattatttttattcatgataaattacctagtatttgaataaattattttacttatacacttttatgcaatgaaatgcacttttagacaaagtatggttttagccgattaagaactacagttaatctagtttttattagtttgactaatttatttgaggtaccaaatttagttattaaattataccgaaatcccagtgagttgtatgtgttgagtagagcctacatgaattttcccatgattttatcttgcatgaattattttagataattcgcaggacttatgtcttatatgtgtttaccttatcctaaatgcatgaaaatgtttataaaagtt

SEQ ID NO: 33986 - DNA, 551 bp, Oryza sativa
  unsure (1)..(551): unsure at all n locations
nnnnnnnnnnnnnnnnnnnnnnnnnnnnnnnnnnnnnnnnnnnnnnnnnnnnnnnnnnnnnnnnnccatctcataatataaggcacaacatatttcatgaaaatttttaattttatttaggctaatataaattaaatttcatttgaagaaaataaaattgttgaattggcatttgaatttattttaactaaatgttaaagataagtggtagacaccatgacggagcgtggggctcctcaccgggagaccgcgcaggcccccctttgccgtttcggccgggggcgctaagttaggttcttcgccctcgatctgaggaacgtcaacgggagaggaagtgcacaagacacgggcgacgtagacaggttcgggccgctgagaaggtgaacgccgcgtcccggatgacaccagggcaggccacgcgttcgccgttggcgacgatggccgtcatgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33987 - DNA, 815 bp, Oryza sativa
atgtcatgtgggtaaagtgtacccctctgcagaggttaacaaactgttcgaacagccgtgcccacggtcatgggcggatgtgaggtgattcctagcgtagttttgtttgactactgctcgtgaaattgctgttgtgaaaatgggttcgatgtttgaaaaatcagcagctgacgggatcagctaggcccgggtggccgtttggaaagttgttggcccgggtggccgtttgaaaagttgttggctcgggtggccgtttaaaaagctgttggtcgggtgccaaccttgtttcaagatctaaagactgacacattgcacatactccgaccggacgagacgcactgtctcatccgtgtcgtttgagaagcactcacttagttgcttttagaaaagagttcaaataaaatcaattgctaaaacaacagcctttccttgaagcctgcattaaacacttatttcccctggcttgctgagtactcccatactcacccttgctctatataaataactcctccccagttgctgaagaagatgaagcggatcctgctgatgaggagttcttccaggagcaagccggctacgatgagttttagggtttcggcctagttcccaagtcgcgcctgtgttgattggtccaagtcctggcttccgttttccttttgtaatgcagttgtgagctcgggatctgtccgcagcccaacatgactgtactcctactctataataaagagacttctgttgctgtgatattctgtcttcctgtgataccagcacttgtttcctgggactggtttcgattaacaaggttaatttggagt

SEQ ID NO: 33988 - DNA, 528 bp, Oryza sativa
  unsure (1)..(528): unsure at all n locations
cgattaacaggttaatttggagtgtcacgggctagttccagtcggggctagctcggggcgtgacaagagatggtatcatagcacaggcttggccctagggcgaaacccgacgcttaggacgaccctaaggatactaagttcaaaactacttgcgaaaagctaaggtctcttttgttttctttattttcaatagtttgtttctaaaatggttactgatctttctccctctttcaaaattgtagatggcagtgaacgccagcttcagttcccacggttttagtgagggtcaccacgtcgctcagcttcgtgacctcgcccgtttccttggcttctcgtgtcctgagtacacggggtactccgtggaccgtgttccccctcactgtgagctctctgtgtacctttacccccgtggaggtatacacggagctggccttcgcccccaccacttcactgtggccaggcccactctnnnnnnnnnnnnnnnnnnnnnnnnnnnnnnnnnnnnnnnnnnnnnnnnnnnnnnnnnnn

SEQ ID NO: 33989 - DNA, 2407 bp, Oryza sativa
aaatactttagcctctgcaggactcccccacacacggaggtgagctagcgagggtactcttcctgtccatagctcatacggtgttttgggcaccgatttgcttggaactctgttgagaatatgaatggcggtttttaacgcctccatccataaacccagtggtagtgtggagtagctcatcatgctacgcaccatatccataagggtacggttatgcctttcagctaccccattctgttgaggttcgctcggtgttgaatactgggctactattccattctctagcaagaaccttgcaaaaggtctagggacttgcccataaggcgtatgttgaccatagtactccccccccacggtcagatcttactactttaatctttatatcatgttgtttttcaacttcagccttgaatatcttaaatttatccaatgcttctgatcgctctttaattggataaatataaccataacggcagtaatcatctgtgaatgttatgaacgaatcatagccatccacacttttcacaggaaatggaccacaaatatctgtgtgaatgatctctaaaattctcgcgcttcattttgcaccctttttgatgctatttacaaattttactttaatgcattctatgcattgttctaagtctgagaactccaatggaggaagaatttcattcttaactagtctctcaattctccccctcgaaatatggcctaaatgacagtgccataatttcgatgagacatcaggagtgctctttcttttcttgttttcttttgtcaacgagaacacaacattcacattctgagaaagagataacaaataaagctcgtcttgcaacacaacaagaccaatacatgcattataataccatagttcacatttgccacttccaaagcggcaatcatatccatcaaaatccaatttcgatacacttattaaatttctttgaaaagaaggaacataaaaaacatctcgaagtaaaagtgtgaagccattcgtgagctctaggcaaagatctccagcagcttcaactttttcttcaactccattggcgactccaatggagctttcgcttctttgcgtagtcctcatcgaacagaatgcctttaaacaattacatgcatgaatagttgctccagaatcaatcctccatgtggatctagaataaacaacataatgagattcatttacaaatgtaacaatgttcttacctttccttgccatgatcattttcaggaagtcgggacaatctttgttgtaatgtcctatcttcttgcagtgaagacaatgatccttttcaacagtgaactgttgttgctaaggcagatgctaagacttttttgcttttgaggagggagatttgtggttcttttccttgttatctttaacatagttaattgagccaccatttgactctttgattctttcctcctcttacacacaattagcgatgagcttttcaaagttccatttctctggacttatgttgtagttgacaataaaattgtcaaaatgctttggcaatgaggccataaccagatggaccagaaagtcatctgttatgcccaaatccattggcttcaatttggaagccatgttgctcatcctaagaatgtggtctctgacagcttgatcagctgtgtcgcataagtctttgaagagctagtaaactgactctttattctttcaaggtactctgagacagcgtcacactctgggattgaacccaatatcgatggctcaaccgtgttctttaccacagccaaacatttcttgttggctaaggaccatttcgcatgctcaatgtcatgcgacattatggtgggattattgtccctttgtctcttttgccagtcagcatctgactcattttcacctctgacaagtgcagcaggttctgtaggacatggggtagtcaacactcagtccacctctcccaagatgaaagcaaggtcgagttttcttttccattctccgtagttatcttctttcagggtcggaatatctttaatacaacccatcaaggagtagccacttgaaataatcatgtacggtgagaacaaaattaacactaaaatattgtgcattaagcctacatcaccgttgggcagaattagacataacacatagaaccataactataatattgcaattaacaacgttggttagaaaattacaacatcatagcacataattaattttccaaaaattaaattctcccgttggttcgaaatttaattttagaaacactaattttcatcaatttcaactatttgcagcggaagatctatataaaattcatatgaacagtagcaattctgttatttacactctgtaaaaaaataccactctggttcgaattttaaacagagggaaaacataaaaaaaattcaaattctattg

SEQ ID NO: 33990 - DNA, 2031 bp, Oryza sativa
ctcaaggggagggagatccatccaacagctacttccataaatcctttgtcttctgtcttagcaacttagacactaccatatcttagctaaggtaagtacctgaattagctaaggattggaaaaatcatatatctggcagtgcgttcatattgatcactctatctttatttttttttttgtggaatgttgttctttgattaccctgctttagaattgaaggagatgatgtttgctgataatataatttctttttaaaaatggctattgaagaacaaaaaaaaatgcatacttatactacttaatttcttctatgctctttgaagaatgtctattttacattgccaatttagcacgtgtatttctttatataagattagtcttgatctgcaggtcatggtggtgaaggagagggtactcttttaattgaggtaaatacagcgaagattttgctcaggccattcatgccctttagtgttgatttttctgagctcctatgaatatacataacatctcttgacttgctgactggaacaacgtaaattgcaattggaatgaagggatggcccactctattgccttactgacaagagagatagtcctcctttgctaccagaatttgtttttccttggatggggttgctgccagaattgttttttttattgccttggatggactcattgcagccctaagctggattctgcatatagtccttcataagttggacaaagtgctgcattgggtgttgtaaaccgtataaaattctcatattttctttctgtttcccccctacacctcgctgattgctttcgtgttttgtcgtgtttataaaatgttgtttttgtacatgatggacacaaagtcttagccatttccgtgcattattcttaaccacttttatattagtcatgtttacgaactgatgctatctgtcaagagccttatgatctagggtaggcggccctcgactacggagttcgtaatctccggccgtggtcttccgatgcggaggttattcccctcactgccgatcgggcttgagagcgagaggtaggagagcaggtaattgatcttgcctccctaatcttttcggtttacagggaatatatggccatcggccctaaccaacggaggaaacaaactcctcgattcaaggaactaatcaaagatagcaaataatatcttaacaactaaaaatagctttccaacttcagccacttgcgctgatcgcttcatcctcggttgcatgcgccgtgcccgcgatcaccgcgcgttctgcgtccatgcgtgcgcccgcacgttctgctgcccggcgcacatctctggctcggtgtctcctggtgtaggtcttcccccacatgacatctcccccctcctcgagactcagctcgtcctcgagctgaagggcagggtacttggcacggagaacttcgatgtcctcccaagttgccgaagccggagactcgcccttccactgaacaagggcctggcgcacgcctcgcgccaaacgaaaccgaacagcacgttccggctcaggggcgatggcgccgtgatggagaggaggcagcgccggtggtgcacccggtggcggcccgtggaacttcttgagcaggccaatgtggaacacgtcatggagacgagcgccggccggtagctccaggcggacggccacgtcgttgatgagctcggtgatgcggtatggcccatagaagcggggcttcagcttgcccgtgccggactgagggagcgacgtggtgggccgctggcgcaggcggaggagcgcccagtcgcccacctggtatgcaacgtggcggtggtgcttgtcatagtgcagcttctggaccgcctgagcttgctcgagccggtagcggatgtcaaagaggaactcagcccgctcctccatgcttttggcgacggcggcgacccgcgtgtcccccgcttcgtaggagcggatggagggtggatccctgccatagacgacccggaacggggtgtcccgaagcgaggactggtacgccgtgttgaagatgaac

SEQ ID NO: 33991 - DNA, 2416 bp, Oryza sativa
ctccgcccatgggagccagcgcagccattgccgtggacggtcccctgtcaagcaacgcaagtacataataatcacccggttagcagcctcggactgcccatccgactgtgggtggaatgccgtcgtcatgtgcagcttggtgcccatcagccgcatgagttcgcgccaaaacgtcgaggtgaagatggggtcgcggtccgacaccatggactgcggaacgccatgtagatgaacgatctcggcgaagaaggcttgagcgacggactcggcggagtacgggtgcgccagtgggatgaagtggcagtatttgctgaacctgtccaccaccgtcaggatgacggacttgccgcgcactcgtggtagcgcctcgatgaaatctagagcgatgtcggtccaaacgccctggggcaccggcaggggcagcaggaggccggccgggctcaagtgctcggacttgtagcgttggcacactgcgcaggagcgtacccagtcctggacgagctgcttcatgttggggatgtggaactcgcgccggaggcggtgcatggtgcgcttgacaccctcgtgcccgtcctcatgtgtagcctcgatgatctcccgagctaagggcgatgccgggggaatgtataaccagctgttgtactgcagcaggtcgtcgacgagcgcccaggggcccgtgcgcgtgccggcgctgacctcgtcgcggagggcagtgagcgccgggtcctggcgctgcgcgtcatgcagcttgctgatgaagtcaaagcgaggcgcagacagtgccaagatggcgccctcctccgtgtcgcgccttgacagggcgtccgcaacagtgtttgcagcgcccggcttgtattccacggcgaagtcgaatcccagcaacttgcccacccaatgatgctgaggaatggtggcgaggcgctggtccagcaggtacttgagggagtagtggtcggtcttgacgacgaagcgccggccccagaggtacggccgccagtgacgtacggcgtgcaccaggccgatcagctccctttcgtaggcagcgagggcacgatgacgcagcacgacggggcggctgaagaacgccacggggtgcccgtcctggaccagcacagcgccgaacccgtgggtggacgcgtcgccctcgacggtgaacggcttggcgaagtccggcatggcgaggacgggcgccgaagtcaccgctgccttaagggcgtcgaaggcagcggcggtgtcctccgtccaggagaacccgtctttcttggtgagggccgtcagcggggcagcgatggtgccgtagttgtggacgaacttccggtagtaaccggcgaggccgaggaagctgcgcaccgcccgtgccgaacggggaaccagccactcgtggatagcctgaaccttggccggatccatggcgacgcccgcctcggatatgacgtggccgaggtaggacaccgagggggagccgaaggtgcacttgctgcgcttgacgaagagccggtgctgacggagcacggataggacggtacgcaggtgccgcaggtggtcggtccaagtctcactgtaaatcaaaatgtcatcaaagaagacaagcacgaagcgtcgcagaaacggtcggagcacgtcgttcatcagcgcctggaacgttgccggggcgttgcacagcccgaacggcatgacgaggaactcgtagaggccgtcgtgtgtacggaaggcggtcttgtggacgtcctcgggcctcatccgcacttggtgataccccgatcgcagatcgagcttggtgaagaagcgggcgccgtggagctcgtcgacgacgggaatcgggaacgcgtccttgacggtgagggcgttgagggcgcggtaatcgacgcagaaacgccacgagccgtcggccttcttgacgagcaggaccggcgaggagaagggcgagtcgctgcggcggacgacgccctgctcgatcatcgcggcgcactggcgttccagctcgtccttgtgcgccgctgggtagcggtacggacggaccgccacgggagcggagctaggcttgaggacgatggcgtggtcgcggccacgtggaggtgggaggcccgtcggttcgccgaagacgtcctcataggcgaccaggagctcatccaggagcgtcccactggccgcggctagggtacgcaggtgcgttgttgaggtcgaggccacgcccttccaggcgaagcgttgcccgtctcgctggaacgccatcgaccgggaggtgaagtcccacacgatgggacccaacgtgccgagccaccgagtgccaagcaccacgtcgaaacctgcgaggggcatcacaaaaaagatcggtgtggaatgtggagccgttgatggtgaaccccgcgtccggatgacacaaggcaggccacgcgttcgcccgtggcgacgatgg

SEQ ID NO: 33992 - DNA, 7936 bp, Oryza sativa
gggtacgcaggtgcgttgttgaggtcgaggccacgcccttccaggcgaagcgttgcccgtctcgctggaacgccatcgaccgggaggtgaagtcccacacgatgggacccaacgtgccgagccaccgagtgccaagcaccacgtcgaaacctgcgaggggcatcacaaagagatcggtgtggaatgtggagccgttgatggtgaacgccgcgtcccggatgacaccagggcaggccacgcgttcgccgttggcgacgatggccgtcatgcgcgggctggactggatcgggaggccggcgcgccttgccgcctcctcaccgatgaagctgtgcgtcgagcctccatccagcaaggcgaggagggaggcatcgccgacggtcacctggagctggatcgtgtccgcgatgggcacgccggcgacggcatgcagggagaacacgggcgcctccgtatccccggcggcggccgccgcgtcaccctcgattgcgacgtcgtcgatctccaccccgtcgacgaagaagaggcgacggcagaacctgttgtggccacgggtgaatttctcgttgcaattgaagcacagaccttggcggcagcgttcggccatctcttccggcgtcaggcgccgtgggttggccgcgtcgcgaccctgtggggcggccgctggtggggcaggcagcgccaactgctgcgcgggcgcgggtaacgcgagccgtggcgcaggcgcaggtagcagcccacgcggcggagcacgtagtggaggtggcgccggccgatcacgctccatcaactccacctggcgtgccaggctcatggcggcggcgagcgtctccggatggtggatgcggacggcgtggctgagaggcggcagaagaccgccggtgaagagctggacgcgctgggactcgtcgagccgacccgcgcgcggcaggagggcctggaagcggttggagtattcctccactgttcccgtgcgtcggcactcggaaagttcgaagagcggggccgaacgcaggggtggcccgaaacgcaggttcacgagttccttgaagcgcccccacgtcggggttccctcatcctcgagcagctgggtgtaccaagtctgcgtgacgtcgtccaggtggtaggacgccatgccgacgcgctcttcggccatggtacggtggtgacggaagtacgcctcgaatttgttgaggaagagcagcggatccgtggtgccgtcgtagcggggaaaatcccacttcttgggccggggaggcaggtcgaggtcgcgcaacccatcagggtggcgagtctcggtgcttgcggccgtcgaggccttgtccttcatggtcgccatatcggccttcagggaggtgagttcggcggacatgttcttgatctccttcaagaggtcggcgatggtgggctcggccatgtcggcggctgggttggctgcggaggcgggtgatgggactggggatggcggcgctggtggtgggctagtggcggcgtctggcgtggaagatgaaggtgcggcggctgctggggctgaggatcgagtggatcgtgataccaggttgtcaagagccttatgatctagggtaggcggccctcgactacggagttcgtaatctccggccgtggtcttccgatgcggaggttattcccctcactgccgatcgggcttgagagcgagaggtaggagagcaggtaattgatcttgcctccctaatcttttcggtttacagggaatatatggccatcggccctaaccaacggaggaaacaaactcctcgattcaaggaactaatcaaagatagcaaataatatcttaacaactaaaaatagctttccaacttcagccacttgcgctgatcgcttcatcctcggttgcatgcgccgtgcccgcgatcaccgcgcgttctgcgtccatgcgtgcgcccgcacgttctgctgcccggcgcacatctctggctcggtgtctcctggtgtaggtcttcccccacatgacactatcttaatttattattagaccatgttctgttagcactattaccacccaaattccatgtttctacatagttagctggaggatttgccttcaaaaattcaactgtttcttgctgcgacactgtattgttagcacaatatgtgaaactcagtcatcaatcctgttcgtgtcaaatgtgttgttttcaaattctgtgaattctagagctctgtatttagaccccagccaatgtgaattctagatctctgttcgaaaagtaggcgaaatctgaaatccaatttctcctgtagtttagtacatgctgtgcacattagcaaactgttatctacagtttcccaaagaattcacctacagtaagcacacatatgcgtttcaatttattttccttcagctgaaaataactgaaatgttatatgtgtttatgttctccttccaatgctctgcctgcacctgcaccatgcttccctttcaatcttttgtacaacagtgtgcttactgtttgtttgttaaaatgctcaccatgtatttgttgagatgctctataaatatttgctccaaacagccaccgcttcaccacctgcaatggacatcactattaggggctccccacaaatatcatcaacaagctcaggtaaattgtcttgctgctgatgtcaacaaagagaggttgtatttctgcctgttgcagcttttatcttacgataacatgacacattcctatacttttttgcatgtttgaacaaccattgcaatattactaatttgagcgcagatctattaaatagtgcagcatgcagttccttttcctttttttttttgtttcaattcaagtgatctgttctctgaaatctgaagtttcagagaaacttccaaggtgttggttttccatctctggggacatcaatatatttatcaattatacacgaatttcgagtcaggatggagaaaaacaattagtagcattcaccaaaagaggcacaagtattcattcaatgagtaaccactttttatagtgaattgtacctaccggatacatcaccaactggttagcctaatatatttgattatttgagatggttttctcacataatttgtagcacaaatgaacaccatcaaggcatcaactggacattatgttgatgtgtggctggcatcaagtaaattggttgtcagttatattgtgtttggcattttgaaaaaggttgataattggtgttatcagttatattcttcacatttacattatttcttcaatgttttatttctgtaagttcctttttagtgtccttggtttttctctagaattaaatcgacactgttcttttgtccattatgtattctggaggcttttaggtgggaaatagctagatactaagcaaaagcacaataaaggtattttcactaaggaattagaacatgcatttttattttaccctgttaagtatatttgttgtatatgcgcttaggcctttttatggtgactcccatcacgtatcttgctgataatagatactaagaatacatttattataatattgtaggcaatatggcagctttttcctctattctattttaacctgaaactcagggccggccctgacgggggtcgagcagtgcggctgcactgggcccccccaaacccaggggcccctcccaagatgccgaagagtaggcctactctgcttccgcgtatgatgatcgatccgtccagccctaacgattagcgacgtgctgatgccgacgttcctaatgccctagcgatccgcgagattagcagatcaattttcttctcgtccatggcaggcgacggcaaagcaggcgtccacacgtggacagccggcagcctcctctacagttccgctagcttcaaccgttgcagcaattctgcagttctacacgcctactacctgtctgccgatggcgtctgcaggtgaggtgaattccctgctggattaatccagatgtgggaactgaaaatatcatgcaaaaaaatctattaagcctacaaccagtagtctgtaggtggactggacaggcctgcatgaagtgctgtctcatcctgctagctgctgcaagcacacgctggctggccgaagaattgtaattagtaagtgttgtttgaattaatctaatatttttgtagtttgtatatttttgatatgctattttttctaattaatagatcgttcttgatatcatgttgtcgaaaaagtgtatgatttatgcactgagttgaaattgctagatgatattgaaattgatatcaacaccaatactttccctttacatatatccagagaaattttcatatatagatatctattgattataagatattatattaatggcccctactttttgtttcgccctaggccatcgaaacctcaggaccggccctgctgaaactcaaaactcatccgtatgaatccaagctctcctctgatgcttttctaacttacattacttttcagcctaacttgcaattattactataattcttaactaagagatcaaggcatcgagttctttgcttcatgtagatcaaagatgtttgatgatttgtatttttttccaagggatgatggcttgtattagtattggactgatgcagactagctaaatgtgttttgatccgcaaccttaaagtttaatgtgttgtgataatgaaacaagtaaaggtacatgtagcttggcagttggtgaccactgaccagccgtcgtgaggaactcccaagtatttaagctgttaatgatcaggaaaggcaatgttgacagtctacttagttctgttggttatttgtgagtaacaattaatagtgcaatgcatatgagtaaatcatgtgtacatgtattcctttgcaacctatatttgcttccatatcataggcatattatgataagcgcttgaggcataaattatcatttgtaaacaatagttgtgtgcgtgctttagcataggcaagttacggtggttgtgttttgcttgcatacttgaaatttatgaactaaaataactcaaacaaatttttattgattatctattttcttcaatttaattcttcaatatatgtcaacgtgccttggacgtgcacgctcactagttgttgtccaatgttgctgattaagagactgcatgaattgtaggaagtcgagtcattactacggaatccggacaccttctatgtgttggtttccaaaaaaactgacagatataaccccttcccgactttcacatgagggtaagattgaaaaccggcattgatatatctttatagatatcggtttattaaaatagccaacacatataatacatgtgccgattttcttttaaaaaaaactagctcctataactataaggatatatgggtgccgattttctataatctggcatctttgtaggaagctaagccgatggttttcctcctcgcattccacgcatctctcacccccccccccccgcccgcatccatttctctctcgttctcccctcctattccactgcccctctccctcatttccttcgctgcctgtgccaacctccccatcacttctgctgcccattgccctctcctccgacacccctcctccgccccacctcctctccccctcacctccaccgcagcaagcacgggggccagccggatctgctgccgcacactctaggatggccggatcagctgtcacacgcacggagaccaccggatcaacaacgaccgggtgaccgcaactctctcaaccaccaggcgctcgggagcagacggatccaccaccgcaaccattggggcagcctgctagatgataacagagattccctcaactacctcaaactgtcacgagcacgcggtgcacgtttgacgatgacggttgcttcctgaagtccctttctgtgttctctctgtgtgttcttaagtgttgttggatgttgacaggtggatattaattttgcaattcaatggtcatctacgactgtgtgcttgaaatgttagatcgatcttaggggtgatggggagctactcgattcatggctcgaccggcttcttttatattcgtgaaacctcaaaggttttgattcctaaagtggcacctttgattcctcctcattagctccctacggggtgccggttgggaaatccgacaccctatataagaggttttctgaaccaacaccaatcatatttttctatagaagtgagttcatcatttccaccagatgtaatatatttgattccatggcatggcagaaggccctcctgggctcctgttgatggtcgttaagtaccgattttgaccgtcaactaccaaaataaataatatttcttacacgtatattagtaataaataatgttgttccacttgtattagagaaatattatgcatgtagagattatacactaaagtgaagggaaaatgagccggcatgcaacaaaagcacaccaccgacgaatcacatgcgagcacacgaattgatcggcccacaagtcagctcgaaccgactaaaaatgaggccaatgaatcctcaaatgccttaggggcccacatggtagtccctggtgatggtcggtggcgagaaatggggcctaggggtcagccgaacccttggttcggccaaaccaagcatggcccctctcatcgccaccttacacatggacgctcctaatggactccaaatgacgactaccagcgcattgactttagtaaccaccatataactgtcactacaagtctataaatagatgatgccttctcacttcacaacacaaacctcaaggagcaattctcttattccatatattgtattctctctagtagtagtggagttttgcttactcttcagtcctatagtcttctcggaaattctgatatatgtttagtactttactcttcttgtaagactgtaaatgcaataagggaagtatcttctttattatattgtattcatagttcatatactactttattagttatgtgtgctatgaatagtttatacatcatttatatgcttcacatgattaggctagtcgatatatgctatagtaacggtccaataatcttaatgggttgcactagttctaaatcgtccatccgaaggtgaaagtctgaggggaattagtgacattatgtattaacataaacatggtgtttaggttagttaaatgtcgttccatgcaggtatgcttcccgaaaagtgaggtaggcgaaaggtaccctgtccatcttttgtattcctcgatgttcggatatgacgtaggagttcgtaaaatgccataaaaacgttggtagactagcagggagtggtctcttggtagtatacctaggtgcctaaaacaatatcctagtcttgtaagcatgtatgtgttaagtatatactaaacatttgtagtatataagtgcaaatgaaccttagctctttatagtttttctccacttccgagtgtatctttattagagatgaatctcctgtgtgtcacactacccatatatcatattatcaattaacccctctttagactatggtaaagtaattaaagctcgattaaggatataaaaactctatctttacatcatcactttccctgcagaaatataaatatgatattcttggaatactcctaggcgaaatacgacagcgatatccgtgcgcttgcagatttatctgtgatcataagaaataccaatatctcctaaccgtgactccttgatgttaaatattttctctccaacttttctttgatcgtcccttcagtaaggaatgttggagcacaatgcaaattcagagggacacacagctctggaactgaggtccatgcttcatgctgctaaccctacttttcactactagaaaacacattttcggtgtcgtaggggttccattttcgcaggcgggtatgttattcggagacaaaaccccgccggcgaagacgatacccggggtggagggggctgtcc

SEQ ID NO: 33993 - DNA, 2398 bp, Oryza sativa
  unsure (1)..(2398): unsure at all n locations
ttaaggatataaaaactctatctttacatcatcactttccctgcagaaatataaatatgatattcttggaatactcctaggcgaaatacgacagcgatatccgtgcgcttgcagatttatctgtgatcataagaaataccaatatctcctaaccgtgactccttgatgttaaatattttctctccaacttttctttgatcgtcccttcagtaaggaatgttggagcacaatgcaaattcagagggacacacagctctggaactgaggccatgcttcatgctgctaaccctacttttcactactagaaaacacattttcggtgtcgtaggggttccattttcgcaggcgggtatgttattcggagacaaaaccccgccggcgaagacgatacccggggtggagggggctgtccgcctgcgaagatcgatctttgcaggcagaccatataagcgtcgcctgcaaagatcgatcttcgcaggcagcaggcgacgtgcgcctgccaagattgatcttcgccggcatcgcttatatggcccgcctgcaaagatggccctatatagtcttcttcctccccgagccctgttcattctcccgaagtttctctctcctaaagtgtcttaaatataggggggaggttttgaacttcaaaccttcggggatttttctacagtgcttagatctactcatttccaccctaggtatgcatttttttaagcttttagacctcaatttgtgatgtatttatgcatgcaaaattgtgaaggaaaagctccatgttttttaatttactttcttttgatatgttgatgctagatgtatgtgtatgcctcttgttgtagtggtttaatgtggtaacataaattctctttttttttattttgctatcacatccacctcctagttctagatctagatcttgtcatatatagagagagtataaaatttttaatgtctatttatttggtgcaatcaaaaaataattatattagtttgtaatatgccgatgatatgattttgttagattttcctaatatactaatttggcaggtctgtgtaaaaaaaattgaaataaactttgtttttttattaatttacaattaacctttatttagttttgaatagcgataagttttttcaataaaccctacaaatttggtattagttgtacaaatattttatgttcatttttttagatatatggaaagtcgggaatggatgtatcattggccgaggtttttatctccatatagaaatgaagtgtctaaatttattggtattgcgaaggcacacgctgagaagaacaatatgaggaagataattgtccatgagctgactataagaatgaaatagcctgggacttcgatgatgcttttaatgtgaaggagcacttagtaactcgtggatttatggacaagtacgaaatatggacacgtcatggcgaagaacaagtggaggggcctaaaaatgagaaggttccgacacaagttgaagacatggtgcatgacgatggttctgttgaggacaaaatcgatctagaggaaatgttacgtcatgcataacccgaggtgctaatggagtcggctagaagcttaaataactttgnnnnnnnnnnnnnnnnnnnnnnnnnnnnnnnnnnnnnnnncaaagcttttcgataacctcgcattggcagtacctgctccatgaacttaaatcctcatgcactctaggcgtccatgtttctagcagtgagaggagttctggcgctcccgggaaagagaagtctcacacacatattaaatttatggttcaagttaagttctctctcacacacactcatggcagtcctaccaatggcgacaccgatgtagggcacgcctcttggccctacctcaacggctgtcccatcgtagcgcacctgcctcactcaggggtgaaccatctatgcagggatactgcctccgctcggctatctaatccgctaggtctatacccattcgagaagtacggttgtacgggggtcgtttcatgcttaacttcatggctcggtccttaattgaccggggacggtactagccttttccagataccacccaaatcctcggtccgccccagtcgaaaacagttgtttaattttatttctcctttcacaaatcatgtcatcaacatcatggcaatgtggcgctcatgtctccacgtgccgcatctcaattaccttcccaaaagtaattgcccaagcatatagcatttgataaatatgagtatgcatgattctagtatagcatttctaagcaattgtcataattgactagggactcatacgtaatcaggggtacaaggattttaagggtttttaagcaataaataaggcaccgtattatcacaagtaggacgttcatcatttgcatgcaattttatt

SEQ ID NO: 33994 - DNA, 1647 bp, Oryza sativa
  unsure (1)..(1647): unsure at all n locations
nnnnnnnnnnnnnnnnnnnnnnnnnnnnnnnnnnnnnnnnnnnnnnnnnattgaattttaccctcttgtgcttaccaaaaacacagtgctcacagaacttcatgttaccctgagtgcagccatctagcaggttcctcttcatcaattctgccataccaagttcactcatatgtccaagacgcatgtgccacaggttagtcttactaggttcatctttagaaacagcagcagcggtaacagaaccatgtaatgtacttcctctaaggacatataagtttgcagaattcatatcaccaatcatgtaaacaagagaacctttcgatacctttacaactccacctgaaccggagtatttgtatccttctgcatcaagtgtgctgagggagatgagatttctcgccatccctggtatgtgtctcacatctttcagcgtgcgtgtcatgccatcatgagtcttgatctaaacggagccaatgcctacaatctcacgtgggttatcatctcccatgcacacaacatctccattctgcacagacttgtaagaactaaaccaatctctgttaatgcagatatgaaaagaacatgcagtatcaagtatccattcatcatgactagcaacacaaccagcaaaaacaacaagacaatctcctgaattagagttttcagcactggtaacaacagaggccttaccatctgatttcctattgtccttattctgcagcttccaacattcttcaatgaagtgatttttctttttgcaatacttacaaaactttttacctctggatttagaacggcctctactctgactcttgtcacgatcattgctatcgttgtaggttctctgctcagatctgcctttgaccagcaatgcttcgcccttagaggacgatgcatcagactgaaccatacctttcatcttctccctgttttggagcgcctcataaacttccgctagggttacttcatcacggcttaaaagtatggtgtcacaaaaatttgtatatgaactaggcaatgagcataacagtaaaagacctaaatcttcatcatcaaactgtacctccatcgacattaggtcggcaacgatctccttgaagaccgatatgtggttcaacacagaaccactctcctgaaacttgtgcgagaacaacttcatctgatatgcatcttactggttagatctttagacatgcagatcgattctagtttgagccaaagttctgcagcagtcttttcctgcaacacttcttgcaaaatatcattagatagatgaagttggattagcgacagagccttacgatctttccgcttctcctcagcggtctagccagtcgttttcttcttcccgaaggtttccagcgccccatcaagatcctaagttgcatcagaacagcccgcatcttgacttgccacagcgagaatcttgtcttgtagtcaagcagcgatagatcatacttcatcgacgccatcgcgaaaccctaatctgagaacaagctctgataccacttgttaggaaacgataagcgaacaaacgataaagaacaatagatcaatcatagaagacacgagatttgacgtgaaacacccctccataacaggagagaaaaaaccacgggcgccagccaacaaaaatatctttactat

SEQ ID NO: 33995 - DNA, 709 bp, Oryza sativa
cattggaagtatttttaacaattcaaagatcatttcagtgattaatttaattgggaaagtaattaaaattcaccttttccttttcgggccgaattaggaaaagtcctctcattctcggcccagtctcctctcagcctgcagcccttttcctctctttcccgaagtctgctttgtgtccctctttcaatcgggccaagaagtagaagcccagccaaaagtctagtttgcatccctgctacagtggcatcttcaatctccagccggctggagacagagcccgagccagccgcacagtacctgtatagccgcggttttcccctccaaatccggccttttatctcgtgtatttccaaaattagttgaggggaaatactcctcttatcctcctctatctttacccccaaaaatcggagctaatcgttgagtatcttgcccgaatcgaactcgttttcgagtttatctccaaaacggagtttttgatttcccggatcgatttcttgcgggaggagtccgatctcttcaatccaaggaccccctagtcctcctctttcgtttgccccctctcccgagctctctcgtcaaccgtagagccgccgccacgacgtcttagccgccgccgtcgccggccgacgaacagccgcctcgcgccgtcgttttggccgtcgccgccgcctcctctcgccgccgtcgggtgcgcgtggaagagggg

SEQ ID NO: 33996 - DNA, 579 bp, Oryza sativa
  unsure (1)..(579): unsure at all n locations
nnnnnnnnnnnnnnnnnnnnnnnnnnnnnnnnnnnnnnnnnnnnnnnnnnnnnnnnnnnnnttaggcagctctgtgccgtcgcccgtgaccagccgaacggagcccggccgggggacgccgatcactcgatacggaccctcccacattggtgagagcttgctcagtccagcacgcatttggacgcggcgtaggacgaggtcgtcgacgcagagtgatcgggcccggacgtggcgctgatggtagcaccgcaggctctgctggtagcgcgcggctcggagggccgcgcgccgccttcgctcttccaaatagtcgaggtcgtctcggcgaagctgatcttgatcagcctcgcaatacatgctgacccgaggggacctcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33997 - DNA, 2575 bp, Oryza sativa
  unsure (1)..(2575): unsure at all n locations
nnnnnnnnnnnnnnnnnnnnnnnnnnnnnnnnnnnnnnnnnnnnnnnnnnnnnnnnnctctgcagaggttaacaaactgttcgaacagccgtgcccacggtcatgggcggatgtgaggtgattcctagcgtagttttgtttgactactgctcgtgaaattgctgttgtgaaaatgggttcgatgtttgaaaaatcagcagctgacgggatcagctaggcccgggtgcccgtttggaaagttgttggcccgggtggccgtttgaaaagttgttggctcgggtggccgtttaaaaagctgttggtcgggtgccaaccttgtttcaagatctaaagactgacacattgcacatactccgaccggacgagacgcactgtctcatccgtgtcgtttgagaagcactcacttagttgcttttagaaaagagttcaaataaaatcaattgctaaaacaatagcctttccttgaagcctgcattaaacacttatttcccctggcttgctgagtactcccgtattcacccttgctctatataaataactcccccccagttgctgaagaagatgaagcggatcctgctgatgaggagttcttccaggagcaagctggctacgatgagttttagggtttcggcctagttcccaagtcgcgcctgtgttgattggtccaagtcctggcttccgttttccttttgtaatgcagttgtgagctcgggatctgtccgcagcccaacatgactgtactcctactctataataaagagacttctgttgctgtgatattctgtcttcctgtgataccagcactgtttcctgggactggtatcgattaacaggttaatttggagcgtcactgtaacatacccgaaattttaggacttaaaatttcttgtcaaaatagttagaggttaacttctccaattttgagagagagccaaaaatttccattttaatttaggtgaagatcaacttaaaccattgcatgattaaaatttgagaacaaaataaaatcttttcattcccaacattagactagaaatgtcaccaagcatacatgtacataatgcatgcctaggctcgagttctttgtgcatttggagttttggtcttgcattccataatagatcccatgagcataatctaaaagaattacttcactaaacaaacctatagttaatctgttaatcttgggtgataacatgtggacttaatattaaactcaaatatcatcttcttagtctaaaagaaatttaatgtaatccctataataatattagatgcaattatgaagtgggaatacatatacaaacaaaggtcatcctaattctctaaaatattttgtgcaagataaaatcatggaaaaatttatgtggacagtgattagcacaaacttatcctctgtaattttggtaacatgttaacactcaagttgaaatctcaaattaatcggtcgaagcagacaactaaaagaaatcaaattaaatttaatcggctaaaaccatatttcatccaaaagtacatttaactgcacataagtgaacatgggaaataatttattcaaatattagattagttatcatgaataaatgtaatttttctagatttttcctcctctgtttaagcctcctaaaaattcaatctagctttctaatagcccatctttgtttaatttctgtgagcagtccacccattatttttgagtgcaaccaaagaaaatggaatctaggtgtaatcatctaccaccagtaaaatctacactaattcttctggtctacacattaagttatgtagttacaaagttagaggagaaaataattccgtaaattaatctaaaaatcaagtttcccagtcttctacccatatctctctccctggcctagtttccatcgagttggccccacttggcagtgccttaggctaggttcagccctgtccaacactttttccttctacacctctctcttgcctagtgggaccccattgtcagcctcacatccctctccacacgggcccacgactcaaccccgcgcgccacgcgtgtgagcacgcgttgagcgcggaagagggcgagctcctcctccccatctccgccggcgaccgtacttaacccgaccggccgaccaactcactctctctcgcccctgtctcgtttcgcggaagaaccgaggtaccccgcctcggattcgccgggaacgggggtgccaactccggcgccggtgagagaagtcctcgacgccgtcgcaatccggtgagctccatttccgttcaataagcgttctgtatttccctctcaatgccgtctctaacgccaccaagaacgcctcttttggtgcagccaatctccgggaacgcgaccgcatcaactcggaacaccgtcgcgctctggacgccgctgcttcgcctttgctcgtcgcccagctttcacggttcgtgacaagctgagccacttcgccacgagcttcatcaacctctgtagatcaagaatcccgaaggaatcgacgcgaggtggaccacggtgggagatcctctttttttttttcaactctggccgccgacgccattcctttctttctccttc

SEQ ID NO: 33998 - DNA, 3738 bp, Oryza sativa
  unsure (1)..(3738): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcggattcgccgggaacgggggtgccaactccggcgccggtgagagaagtcctcgacgccgtcgcaatccggtgagctccatttccgttcaataagcgttctgtatttccctctcaatgccgtctctaacgccaccaagaacgcctcttttggtgcagccaatctccgggaacgcgaccgcatcaactcggaacaccgtcgcgctctggacgccgctgcttcgcctttgctcgtcgcccagcttccacggttcgtgacaagctgagccacttcgccacgagcttcatcaacctctgtagatcaagaatcccgaaggaatcgacgcgaggtggaccacggtgggagatcctcttctttttcttccaactctggccgccgacgccattcctttctttctccttctctggtgagcttcggcgcaatctttttcgcctagagctaccttgtgctgatctaaaccgaagcatgcaccctctatatgcagtagaagcccgggagtacaccgtcgacgacgaccgtagcagttgcgccgtcgccgaaccagtacaccgtcgccaagacttcgccgagccgcgtttgattcttggtgagcctcctagtagtccctagagtccttatcgtacgcatgcacgattaaatcgagcctcaaaacccacatgcatgtgcaagccgagctgagccaccgcctctaacaccctaacagccgctatagagcaccaaatcttgccagaaagccaccaataggttcgcacggttgttctctacactttttgttttgggagcttaagctgaatcgccgttgttcgccactggtgatgctgtgaagctcgcggctgtgctgctgctctgctctgtccagagcaagggcatggcttttgaaatttaaagactcccagggatgtattaacaactggaacagtcacttacaagtaggaccagtaataatctgtaaataaactaaaactcaagcatcgttttgcatacaaacctaaaactaggggactgcaggatctatttcccgagaaaccaggggtttttgcgcaaaatgttagtaactgacatatgggcctaggactgcgggttgattcctagaaaactcaagggcctttgtgcatattggtccctcacagccatgtagacccatcctttaaaatctgaagaaaaattaggaaaatgcccaaacaaatatatgtttaacagaaaaatgcacaaagttgtaaaatctatataaaatcaaatatagctcattttgaagtgattccagttgctgtagattcttgaagttatgaactttattccaggaatataaaacttgacactcactgtacaaataatgtctctaagatttatctaagataagtcatgcataaaacatgtacaaacttataaaatacatagaaaattcatttcaactcattttgaaacaaactcaaaaactgcagattcatcatcagacacactctgattaggttaaataaaagtaatgacttactttgcatcaaatggctctaaaactattatctctataatgattagttttagataagctaaactttagaaattcatgtagaacccaatttagcttcaatttgaataaacttaagttatgtaggatcactaaaacatgtatttccaagttatgaaataagattatatacttgctgtgtagtaaaagtctctaaatattcatataaggatttactaacatagagcagccattaatttgtaaaacttgtagaaaatttatttttagtccaaatgaaatgaacaaagtttctatagaaccagcaaatagttatcttcaacatagtaaaataaaatttgtcaccttttgtagagaacattgatcaaaaccttaacttagtgaaataagaatttaaacacatagggttgtttaagtaatacataaacatgtataagtatatatatacactttaggtctaattaaacctaaataaaaacttgattgaccagtgaagccatagttccattcccatccactaaaattagaagaacttagctcatataacaatttctaggttaatataatatattgctagtttagattagagcatctctagtttataaaatatgaaccatagtagtaaagaccataaacatgtgaactaaaaatgttttagttaagcgaattattccttttattcaacttaaacaggaagtagcatgttctgaacctataactcaaaagtcatgaacatataaaacactatatgcctaaaacacgttgtaacttgtaaaatctataagaaaatcattataattccaaaaattgtaaaaccaaatgtgttagtcttagaaaacacatctccacacccctgtgaagtctaatctaataaaaatcactttacaaaagtatttcataacactacctaagactatactattgtaaaccgataaaacttctaaaattcataactcctaaatggaataaaataaaataggaattatttcacctaaattcattttagatcatttccaacccactgtgcataaatcatgcattttagagcattttggattttcagctctttcggtgtttaattgcatatcgtgtcctttatctagataattgcataatcggtgaagaagtggattaggtgctaacaattctctgatcaaggcaagttttctcctcccatcctttgaacacattgaatcccatgatttgaggaatgaaaatatttgtttgcaaagttgcatgtgaacttagactatatcggtatttgaaattgggttaaggtagttatgacctatttgctgcatattccaaccttgaataattgatcctcttgctgtttgaacccctagaaatgattagagtacattcattgtactcaaatgggtttatatatgctctatgtgcaactacttgcttagccatgcttagaaatatgcaaatgctcattccatctataattaaaatgtgaattttgatacatgaacccttgctggaataaaatgaatatgatgggtatttgcgaactaaaatgtgtaaaatgtgattttatacttgggcggcaagtggtgtgcatatggtgttagttgcataccgataggggaagtgtttgcccaagcccataaggaccgaacttgtgtcacccatttaaagttatccgtacatccacatgtgctagtatgggatggcctaagctgattaatctatttaggactagccttgcattctggtaggccggtgtgtatgagttagtcgataattctgaggaattagtcgatgattcagaggaacttcctatttgccccgacgtggtagtttatgtgactaagtctgtccaatacaacggtattgtgccacgtggtgggttcccatcgtgtccgccaccacggcgttaagtttaaggcgtgggcccgccacttaacggttctaggtatattccaagtatgcctaagatggaggaacacgtattgtactggtgcaaggctaggctctaagtaatgtaaaggctttgttatgacctctagatcacattcaacatgaaga

SEQ ID NO: 33999 - DNA, 1376 bp, Oryza sativa
tgtgcaactacttgcttagccatgcttagaaatatgcaaatgctcattccatctataattaaaatgtgaattttgatacatgaacccttgctggaataaaatgaatatgatgggtatttgcgaactaaaatgtgtaaaatgtgattttatacttgggcggcaagtggtgtgcatatggtgttagttgcataccgataggggaagtgtttgcccaagcccataaggaccgaacttgtgtcacccatttaaagttatccgtacatccacatgtgctagtatgggatggcctaagctgattaatctatttaggactagccttgcattctggtaggccggtgtgtatgagttagtcgataattctgaggaattagtcgatgattcagaggaacttcctatttgccccgacgtggtagtttatgtgactaagtctgtccaatacaacggtattgtgccacgtggtgggttcccatcgtgtccgccaccacggcgttaagtttaaggcgtgggcccgccacttaacggttctaggtatattccaagtatgcctaggatggaggaacacgtatcgtactggtgcaaggctaggctctaagtagtgtaaaggcttcgttatgacctctagatcacattcaacatgaagagtgtggtggagtcttgcaaactcaaaacaaactagagagttcatatcatgtgggtaaacctgtacaaactctgcagagttctttaaactaatcgattagccgtgctcacggtcatgagcgctttggtgatgtgtcatgagtatagactatgttttaaaaatgtgatcatgtgacattggtttgaaattgataaatgtgttgagttgtgtatgtggtgatacattatgacttattgttaagtatggcaataagagattgtttatgatggaattatgaagaagttaataatgaaacttaaaacttgtctttgttaattgaagcatcaactcctttacaaaagaattgcaaaacaaaacttgctttatgctgaaattgaactacatattgccttcctttgaatatatgccttacatgtagtatagtaggattgacttgtgcttgccagtacattaacttgtttaatgtactgactcttgctgttgatataaccttttgtttgcaggtttagtcttagtctttgagtgatgcgggttccgattgcttcttctaggatgagaacttaatggggtatacccctagtcggtgtgcttgtgtttgggtagtcaagcttccgctgttctctaataagtctatttggccggtcggcctatgtaattattaagttgttgtaagtcttaagtttctttcatcttagttgtgtttgctatgtgtaatcatgcttaagatgaaagtgtg

SEQ ID NO: 34000 - DNA, 6879 bp, Oryza sativa
  unsure (1)..(6879): unsure at all n locations
nnnnnnnnnnnnnnnnnnnnnnnnnnnnnnnnnnnnnnnnnnnnnnnnnnnnnnnnnnnnnncgccttcgagtggtttgacgggcacatctcaggctgaagttgactggcaggctaagggcccagcaatgtctccaatattcctctctcgaggtgtcggatgtttcattatgcttgtttgatgacttgaattattcacttcatctctcaaatataatggaaggtccggagagcctacgacagtcacgggctagttccagtcggggctagctcggggcgtgacacctaccatcccgccgccacccttctgccactgctaccttcaacagaggccgcctcccgccgcctgccacctccgcacgccgctactaccggtgggtcgccgtcaggtcggttgagaggaagaaggggagatgaatgaggaggaagagaaacagagaagaagagatgagaacgagaggaaaagaaagagagaagaagagataagaacgagagagaggtgggtggtgggccccaccggctcgactggttttttttaaaaaccgacacctataataaatttttattataggtgtcggtttgaaaaatcaacaactatattataggtgttggttttttttatagaactgacacctataatcactgaaatgcgctggtttttgtattttcggaccgtggagttgagaaaaggtctaaagataccggttttaacactttccggtacctatagtggtgacacctatttgatgttttacgtagtgaaaacacgtgttggcagacatattgataaggagctggggagggaaaaagaccttgctgcataagtgcagagtgcagactttgctgccgccctgccggaggacgagccacagcggtggcttccatcacccgccgcggcctgcatcgacccttcatctcgaccaggcagacatggaagagagcaggaagaaagactaggaagaggaacaaccaaacatcagcgctacaagtgcgctctactccagatcgatggagcagtggaaacgtcgatttccccctcggcctgcttctctggcccatgtcacgtgtgacgtgttgttgtttagcatttgattgggccaggaccaggggtccaatacaatttcctaggggtgtcccacgttgtatacatacacaggctatacttggagcgtgggttataagctctcgagcggacattccctcatcggcttcttgtctattgcatattatctaaatagtcataaaaaatatgaaaaaatttatgaagatagattaatatgtgatatatcactacacaaacatacaaattaaaatatgacttctacaatccataacaaaaataacaaattaaattgtgaatagtatacacatactcacaatcatatatttgttatttttgctatggattatagaagtcatattttaactttcatgttttttatgactatttggatagcatgcaatagacgaggggacgtcccctcgagagtttaaaacagtttccgctatacttgccttgatcctgttggttcgatggccagaaattaaagtctcttttggccttccctttttagccaaatttagtatccaacaccagagtgcttctccaataccatctaccaagagacaccacttaataagtattcaactagttttaaagtaacagacaagatggtgttaggaattaatataccacatgcatgttgagaaccacttccattccaccttcgatcggacttatttcgcaaaactataaaaaacttgtaatgatcccgtactatcaagaatatatatacttaaatgtacaacggcagatccagaaattagttcgttggtgtcataacgtgcctattggtatcatagtatactaattgtacttaatcatagtgttataatatatagacaagcagtttaaccataggttttaccgaatatcatcggtgacgtctgacaccggtgtttacactgtagatccacccctgaatgcacacacatctcatataaaatttctaattaatcaaatccattttaaaaaaactggaataaagtttgcatgaaattttccataccgtcagtatagagcagctcacgttaatcattaattgatacggtacatctatctatactaatataaaaaggagttgcccccgtccaatcctacaggccaaatcacccacatcaatctctaccgtccatctgcatatcttgtgatccgtaccgtccatctgaatatcctctagaaacgtacagtctacgcgggcgaagaccacgcgcgatgactacgcgccggtgcgagtgtgacacgcgctcctcttttctcatcctcctcctcgcgtgtgctgccgccgccgcctcgcaccaccactgtccccaccggcgcatctcgctcctcctcctccaccaccacgtgccgctcctcctccaccaccacgacgtgccgctcctcctcagtactcctccttgcatgtgctgttgctaccgcctcgtgcgaccgttgccctcgccggagccgagttcttccccttccgctgccgccgtcggagccaaggtcgtccccttccgccgccgccgtcggagccgaggtcatccccttccaccgccaagctgaggtcttccccatcagctgttgtcgccgcactccacatcaatatgagtgtacacgtagggtcttgacccatcacgcacgcgcaatccccaccgccgcggcaaatcctcctcactgacgcgctctccccaccacaacgcatcgatacatccgcacaaaccctaccgcgacgcaatcctcgccaagacccctcctccgatgacaacgctgctgtgccgctgctttgcctacatgccgaggttgttcctgcaaaagtcctcggctgtccacgaccgtacctattctgtcacgcctccagtgttctcggtgacaacggcagtaagcggaggcgttcggctctacttgctggatggcaggggaggggagatggtgtccgtgcgtactgtcctccatgtggtgctcaacttcgccttccttccgcggacctccctccgacgtggtgcgcgtgcttgccgcatcgtcgtcccccatcacaagagggtggcgatcaacctcaccgccctccttggacctctcgccagcatggtgcgtggactcgctcgccaaccaccccagctctccctaagccgtggaattgcagtctctccaccacgcctgacgattccacggcctccctttgtcgcgcgaagggaagtctgtgagggacttcccagtcatcgagggacctccttgtctagcatttggaaacatcggttcgttcaatctctcctctccagttcaccccttttcttggttcaatttgaacaatcaaccaatgaagtaaactattttctgtatgtacgtgaagaatctatcggtgtattgtgccctgtaggtgttcgatgaattgctgttgaggaagggataatcagttcacacccattaatttggttgttcacttgctttcagatgacataaaactatcgacattgtggcctacttgcatgtcccatttttcaggtatttagaattcaccacaaatggaatgtattcaaggggacatcacgaatacgagcgatatgctcttcttccatggatagatcttaaattatcccgctgaagttggagatggatatgttcttgacatggaaggcagcaaaataggcctatcattttcaagatcaagggcagctactgttaggactctctaggatcacctaggtttagatctagtcgggtggttctatttgggttgatgtttgaacaacaatggatgagggagagggtttagagagaccgaccggttgaggtgttggaggatgaagatgtgccgaacatcgtcgttgtcgtcgcgggcttgatgtggacggcggcgacggtggtcgtgacggtgacggcggtcgtggcagtggcggttgcacgcgatcccggcgaggtcgtggcgctgcagtggcgtttcccgtcactggttgcgcccccttgatcggattagggtttgtggggtggagtggcggtagcgacgaaccttgtgttgtgagccgccccggcctccaccccttttatatggcgcagtgtgacgggggccaaccagccattgggctgggcgcccccaatcagggcgagggtcaaggcccccttgtgccgttgggctcaaggggagggagatccatctaacattctcccccttgatcttactatttcttttagcctttttctattccatcacagatttacacatagagcatgcttcatcgtcacagtgaatcaccgatggattcgacagccactatacacatatctattcagaaatagatactttaacttttcggccctatagtccaggattcataaggcttcccttaaacccatgccggctacatgttccttgaacacgttgggcggtaggcctttcatgagcaaatccgcgagcatcatttctgttctaatgtgctcgagactgattgtttgatctcggactttgtccttcacaacatagtaatttatgtcaatgtgtttggcagcaccacttgactgattgttgtgacattacattaccacgggttcgttatcacagtataactttagtggtttctcaatactgttaaccacctttaaatccggtatgaacttctttagcaagttcacctgccccgtggcctcatagcatgctataaactcggcatacatagtagaccctgcagtgatagcctgttttgagcttttccatgaaagagctcctcctgccagggtaaacacgtatcccgatattgactttgtattatcttttgcaaagtcagaatctgaatacccactatctggagcgattctgacagcatgaggccttttgttccttgcaaataatgcaagactttctttaccaatttctaatgctctgggcctggattactctgaaatctgccaagtaacccggtaacaaatgccaagtcagggcgtgtgcacaacagcgcgtactgtaggcttcccacagctgacgcatacggctttttttttcatttcgttgagctcatactgatttgtgggactttgccatgccccatacctttcccctttaactatacgagcaggtgaagcactgcatctgtacatgttgaatttcttcaacacattttctatatatgccttttgagaaagtcccaatgcatactttgttctatcttggtgaatctctatgcccaaaacatatgaagcctcaccgaggtctttcatgtcaaagtttgaggacaagaatttctttgtttcctgcagtagactgacattaatactagccagtagaatgtcatccacatacaaaattaggaaaataaatctcccattcttaaactttgaataaatacagttgtcctcaatattctcttaaaacccaaatttctttattgttccatcaaacttcaagtaccactatctcaaagcttgctttaattcataaatggatctctttagacggtatcccatattttcgtttcctttcatgacaaaacctttcagttgcacaatgcatgctttttcctccaaatctccattttgaaatgctgtttttacatccatctgatgtaattccaagtcataatgtgccaccagtgccattattatcctgaaggaaactttacaagagactagagaaaatgtctcattgtaatcaatcccttctcgttgcgtgaagccttttgccacaagtcgcgccttaaacttttctatattccctctggagtcatatttggttttaaagacccatttacagcctactgttttggctccttttgggaatttcttctaaatcccagaaatcgtttagtttcattgatttcatttcatctttcatggtttccaaccattcagatgagcgtgcgcttctcatggcctcttcatatgaggtgggatcatcctccatatgcgactcttctatattataaacttgatagtcatcatggatagccgatcttctgactctttcagacctctaggggcctccacatttggcacgttctgtacctgaggctcttgttgagtctcctgtactggcacattatctgtctaaggctgttgcagctcctcctctggtgtggcaataatttatgttgaatcctgtagaacaggttcctcactttcattcattgttgccacaggaggggtaacaacaggtgctggtaccgcaacgtcatgcattgtaggcacaacatcaacaggtagagagaagaaaggctcctgagtcgacagagcgggtacagacccccgccactcctcaagatcaatttctcgaaataccgagctccccctaatcatttcgtcttccaggaagacggcgtgtctcgtttctacaaactttgtataactgtttggacagtagaaacgataaccatttgatctttcaggatagccaataaaatggcagctgattgtcttggggtctgttatcgaaaggacaacggcataagtcgaaagacgtggtcactcaacagtagttggaaaaaaagtaaagtgtataaaattgagaatttttcttcggatcccccattacatgaccctatgggactatttatagccctcattactggttcttactactagggttgtggttatataggggaatttacatagttgcccttatgaaagggacatttatatgggtacatagtgtaatcgagattcatgggcccctgatgggccgtcgggcgatcatcggcccaatagcccttaggcttgatgggctggaaagcttcttcggtccttgcgggggcgaacttgttacggggaagtcgtctcccttcggcatatactcttcgccctgcatccttcgcccaagagccttctggcttggcaaggtacccgtgtggttcg

SEQ ID NO: 34001 - DNA, 613 bp, Oryza sativa
agaccgtgcaaacaatgtggtatggtatgtggcgccccctttcgaccgatgctcatgccgaaatttacattgttcctgcaaataaagtttattgtctatgtgacaggtattgttttcccgctcttcgcctcctgcggacgcgcgggcaggtgaagcttgcccctaggaagcgaagggttcttgcttcctccgattccgatgacgtgaacgacgtcgaagagtgtgatggcgaggaggaaggggagtaagaagaggaggcgaagcccatggctgaaaagcccgcggacgaggcggtcgaaaaccgcgtcgacacccctagctacactcctactccaagtccgggacataacgagactggggtggaatcgaacagctccccccttcaccgaaaggatttggagggggcgaaggcgctagttgccttctcggcaggcaaggcggtgttaatgaccaaatttggtaatatcatcatcggaagtgaagatgagatcgaagcgcaatcagagataaggattgctgtgggaacagagtaagaatcggctggagtccagatcggctacgaccagaatcggctaaatccgaatcagactgggttaggtgatgcagccgattc

SEQ ID NO: 34002 - DNA, 1340 bp, Oryza sativa
  unsure (1)..(1340): unsure at all n locations
nnnnnnnnnnnnnnnnnnnnnnnnnnnnnnnnnnnnnnnnnnnnnnnnnnnnnnnnnnnnnnntgagcacccttcagcctatagaacatacatgcatgcacccaattaaccaatacatgattgtagaagcacatgcatcaccacccgaaaacatcctcctttcggactcgccgccggcgttactccgatgtccactgaccgagaaaagtagaggaatggaatcgcaataacatgatcttcattttgtattttggttgcacccccaaacgagccatcgtttgtcgccggtgagctcgagatcgagctcagccatggctgttctgcctctgtgcgtgagaaaagaagtcagggaccttgtttcgagaatttaaacaactataaggtttaatgtgcaacttttcaactcactgacatatgaggctaggtctgcgtgttgattcttagaaacctcagggatctttttgtatattgatctttcactgacagtggaccccttggaaacaaaaatctgaaattataaaaggaaagtacctaaaacttgcaaaatccatataaaattaaatatagctcattttaagatgatacaaatttctgtcaactcaccaaattgtgaactttagtgttatggaataaaaacttgcactcacagtacaaatttagcctctaaaatttatccaagttaaatcacacataaagcatgcacaaatttataaaatgcatacaaaattcatttcaactcatcttggagcaaactcagtttctacagatccaccaacttatgttctactataaagcaaaatgaaatagtatacatactatacatcgaatgcctctaaaactattacctttaaaatgactagttttacataagctgaactttagaagtttatataaaattcatcttagatcctttttgagtaaacccaaattcagtagaatcatagggttgtgcacttcaatgttataaaataaaaagacatacttacagtataatgaaaacccctaagtatttaagtaaggaataagcaacatggagcataccttaaattgtaacatttgtagaaaattcatctatagtctaaatgaagtgaaccaaattttctatagaaccagcaagtaatatacttcaacctaatagagtgaattatagcaccctcttacagaccatggctctgaaccttaatttggtagaataggtactaaacacatagtaatggttaaacaatacatatgaaaaagtatatatatgcttggtagctccaaataaatccaaataaaacttgttgaaccagtgaaggcatagatccatccccttccaccaaaacttagtatccttaact

SEQ ID NO: 34003 - DNA, 1101 bp, Oryza sativa
ccggaaaccacgcgggcgcgcgcgcgagcaacggcgcgcggggccggcttttcgagcggggagctcgctcgagaggagggggcgctcggtgcggctctcgcacgcgcgagcagcgagcgggggggggggaaacgccccggggtggggagggagcgagagagagagagagagagagggagacccccgggagagagagggccggggaagagatgggccgagcggaattcggcccatcgaacccggggaggcaaactagacttttgcagagggattcgatttggaaggaattggattcggaaaagaactcgatgatagatcggggattgagatcttgagatggcacggacactagacaacaatcaaagaaacaaatttcgcaattagggtttttcggagataattttcccgctaggcgccacgacggaacgggcgctacataccaacccccctaacaagaatctcgaccccgagattcagcacctaagggaacagctccggaaactcggcgcggagaagatcttctcgttcccaggttgcctcatcttcagaatgattgctccattggactttgtagaacttgatggtcttccttcgagtctgatgttctgcctcttcaagaaccttgatcggtctttccttgtaggtcagattcttttccagctcgatattacccaggggaacttgctcttctggaactcgaagacatttctttaactgggatacgtggaacacgttgtgcacatctgcgagaccttcaggtagctcaagctgataagccacttcgccacgtctggccgttatgaggtaggggccgatgtagcggggtgctaacttgccggacatcccaaaccttctcataccacggaggggtgatacccgcaggtacacatgatctcctttttcgaactcaaggtcacgcctccgattgtcagcgtaattcttctaacggttctgtgctgtcttcaaacgttctcgtatcagcttaacttgttcttctgctgacttgagtatgtcaggaccgaataccagtgcttcgcccacctcattccagcacaagggggtgcggcactttcttccgaacattgcatcattcggcgacat

SEQ ID NO: 34004 - DNA, 479 bp, Oryza sativa
cataacgaagacatcagcttgcctcgcctccaactcacagtctcgcgcagtccttttgtccgctctaccctcattctaccactcaaccgctcctcactgatagttggcaagctcatcttaaactacagtatagggacgcagtatagggacatgggggtacagctgtacccccaaaatttttgcaaaaagaacactacatattatggtgtattacatatgtgtaattgggttaaaagggttatatttgcacttagattggcattccagttcagttaatctcaatccttcctactctgtaggctatatatacatacttgtcgatggctagctgagatgactactggccaacaaaaaattcataggatattttatgaatatttttgtttgtggagcgttcaaataatcaaaatcgatgaaaatattagtttgttgaaccttcaaaactctatcgacttgcccaagggctatttaaatttttt

SEQ ID NO: 34005 - DNA, 582 bp, Oryza sativa
attccatggcatggcagaaggccctcctgggctcctgttgatggtcgttaagtaccgattttgaccgtcaactaccaaaataaataatatttcttacacgtatattagtaataaataatgttgttccacttgtattagagaaatattatgcatgtagagattatacactaaagtgaagggaaaatgagccggcatgcaacaaaagcacaccaccgacgaatcacatgcgagcacacgaattgatcggcccacaagtcagctcgaaccgactaaaaatgaggccaatgaatcctcaaatgccttaggggcccacatggtagtccctggtgatggtcggtggcgagaaatggggcctaggggtcagccgaacccttggttcggccaaaccaagcatggcccctctcatcgccaccttacacatggacgctcctaatggactccaaatgacgactaccagcgcattgactttagtaaccaccatataactgtcactacaagtctataaatagatgatgccttctcacttcacaacacaaacctcaaggagcaattctcttattccatatattgtattctctctag

SEQ ID NO: 34006 - DNA, 435 bp, Oryza sativa
  unsure (1)..(435): unsure at all n locations
nnnnnnnnnnnnnnnnnnnnnnnnnnnnnnnnnnnnnnnnnnnnnnnnnnnnnnnnnnnnnnnnnnncatctcatacacacaacaaacagaactgacgtagaaatttcctctttacttgattgcagattaaatcagtctatacaagaagggggcccgaaaggcctcggaagaagaaggaaaagttattaagattggcgggagcctgggggctcactccgacgcgcccgggttgccggcctcatcgtcgctgtcatccgcaccgtcgtcaccgccctcctcgtcggagtcgagcgcgaacgcgagccgaggggccgtaccctcgaagctgtggacgatgtggtcggcgggggtcccgacctgcgcacgcgcgccgtcctgggttccggaagggaccttttcagcgctgcccacgggagaagtcagggtccttggct

SEQ ID NO: 34007 - DNA, 614 bp, Oryza sativa
  unsure (1)..(614): unsure at all n locations
agctcggtacccgttctgtacctgaggctcttgttgagtctcctgtactggcacattatctgtctaaggctgttgcagctcctcctctggtgtggcaataatttatgttgaatcctgtagaacaggttcctcactttcattcattgttgccacaggaggggtaacaacaggtgctggtaccgcaacgtcatgcattgtaggcacaacatcaacaggtagagagaagaaaggctcctgagtcgacagagcgggtacagacccccgccactcctcaagatcaatttctcgaaataccgagctccccctaatcatttcgtcttccaggaagacggcgtgtctcgtttctacaaactttgtataactgtttggacagtagaaacgataaccatttgatctttcaggatagccaataaaatggcagctgattgtcttggggtctgttatcgaaaggacaacggcataagtcgaaagacgtggtcactcaacagtagttggaaaaaaagtaaagtgtataaaattgagaatttttcttcggatcccccattacatnnnnnnnnnnnnnnnnnnnnnnnnnnnnnnnnnnnnnnnnnnnnnnnnnnnnnnnnnnnnnnnnn

SEQ ID NO: 34008 - DNA, 571 bp, Oryza sativa
  unsure (1)..(571): unsure at all n locations
nnnnnnnnnnnnnnnnnnnnnnnnnnnnnnnnnnnnnnnnnnnnnnnnnnnnnnnaacacaacaagaccaatacatgcattataataccatagttcacatttgccacttccaaagcggcaatcatatccatcaaaatccaatttcgatacacttattaaatttctttgaaaagaaggaacataaaaaacatctcgaagtaaaagtgtgaagccattcgtgagctctaggcaaagatctccagcagcttcaactttttcttcaactccattggcgactccaatggagctttcgcttctttgcgtagtcctcatcgaacagaatgcctttaaacaattacatgcatgaatagttgctccagaatcaatcctccatgtggatctagaataaacaacataatgagattcatttacaaatgtaacaatgttcttacctttccttgccatgatcattttcaggaagtcgggacaatcttttgtggaatgtactatcttcttgcagtgaagacaatgatcctttttaacagtgaactgttggtgctaggcagatgctaagacttttttgcttttgagg

SEQ ID NO: 34009 - DNA, 821 bp, Oryza sativa
  unsure (1)..(821): unsure at all n locations
aacgcggggacgcgaattagacttttctgtgtggtttcctatgctaggcccgattgaaggagggaccacaaatggactttggaggagggataaggccagccgaaaggaagggagaatgggcggaggagtgaagctgaacttttcctatttcggcccgaaaaggagaaggggattttaaatacttttccaactaaattaatcacggaaatgatctttgaattgttaaaaatacttccaatgctcaaataattccaagaaaaatcttgaaaatacttggacactcaaagtacttaacaaaattataattagaccatttaatgattaatttaatatgtgggtaattactgaaatgctctttgtatgattaaaattaggaattgagctccgaaaaatccgagaaaattccagagagtataattaaccatggagaatttaataaaaattaaatccatccatgctttatatttaggaaattttatttcccacatttaacttcacttgtaaattaatgaacatttaatataaattctaataataatttattaaataatttatgaatcctgaaacaaaaatcaggatgtgacacctcgccctcagatgaaccgtccggcacctccgccacagcagcgtgcccctagtggcaacactgcgccaaacagtgttacctccttcaagtcaccacagggaccgtcagcagttcagtgtttccggtgcaaccagatgggtcaatatgctagacagtgccctcagaatcctaccaacnnnnnnnnnnnnnnnnnnnnnnnnnnnnnnnnnnnnnnnnnnnnnnnnnnnnnnnnnnn

SEQ ID NO: 34010 - DNA, 688 bp, Oryza sativa
  unsure (1)..(688): unsure at all n locations
nnnnnnnnnnnnnnnnnnnnnnnnnnnnnnnnnnnnnnnnnnnnnnnnnnnnnnnnatcaaccccgggggcgatctgggccgtcggtcccgtggaccggcggtggaccacccgcgtggtcccggtccacagtgaaccgttccccccttgagtcgctgccgagtgggcccgctcgccggcgcccctttcctccctctcccgagccgctgaccggtgggccccgcatgtcggcgccgcgcctcctccccctcccgtgctgacgccagccctgggatttattgcacaataaatgatttaaggactttttgttatagtaataaacacagtgaatcttctaaaattcatatctaattcatccgagctccgtttaagcccattcaggtctcagtaaatcaagaaaaatgtgtagaatccattaaaaatggttttgttctctgtttcagtagtcttatagcctgtttgcaatgtttgccttgtatgtcgctagattccggttcttccgacgctccggtgtagttcgaaatagtcgccgaggttcctctagcagcagagcaaggcaagtcatgcttgtcacttgaacatgttgatcctatattgcaaatgctctattgttttccttcaaatattgcattgttttataatgttactatggggtgtttacctattgtcatagccatgctattgttgta

SEQ ID NO: 34011 - DNA, 5094 bp, Oryza sativa
ctgttggattagtgccaccgctttggtgttggttaattaaaataaatcacatggtgggctgtgggtgcatggttttgctggtcgcaccatggcagttaaggaccggttcgcgagatgccctggaagaacttatcgtacttaccacaagccagcgtgggcaacggctgggcttgtagtgtagctttcctctagccgacgcatccaggcaagggtgggcatgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaacggtcctgtcacggcctctttccggtatgtcgtggtggcatgtcggcgcacggaaacgtgtcgtggggctgtgtcttgtgggtacagttgtacacctctgatcagagtaaaactattcgagtagccgtgcccgcggttatgggcggtcaaccagattcaccgggattagtctcaccctagtgtaatcttttgaatttggataggttaggtggatggttgggcctgtcgcaacgtgggatagcgttggacagtggttagttaataataattaattattacaactgtttaaatctttcaacttctgtgtataaatgctcgctttatgcaaatgaaccactctagctctcctttgataattccctgcatcatacccctattccgatatgacttgctgagtacagtgggtagtactcagtcttgctctattttttttcccaaccccagagttcgggtatgtgtcagatggaggtttctccgaggagtaggcttcgtccgtgccatcgagggtgcctgtggagtggtgttcccgctgcagttctagtcaaggcttagctcctgttgtcttcctttttccgctgcatttatgtaagacttttatgatgtttgtaagacgtggatctgaatgtcaacattgtcgtttgtgtaccccggccggtcctggacggggattttaatgcacattctgcttggaattctattcgggaatttctgggcgtgacatcataccaggtggttcagatgaggagcagcaatatgttagcgtgcaggtggagcacgtggatgatcaggaaactgaaattgttagtaatgatgttaatgatactgttcagcactcacctcctgttttgcagccacaagatcaacctattgcacatcgcagaacaaaaaggagttgtggagctccaattcgccttattgaggaatgtgatatggtttattatgcttttagttgtgttgaacaagtggagaatactcttgagccagccacatacactgaagctgttgtttctggagaccgtgagaactggatctcagctatgcaggaggagatgcagtctcttgagaagaatggcacatggaagcttgtgcacttgccaaaacagaagaaacctgttcattgtaaatggatcttcaagagaaaggagggtttatctcctagcgagcctccgaggtttaaggcaaggttagtagcaaaaggtttcagtcaaattgctggtgttgattataatgatgtgttctctccagttgtaaagcatagttcaattcgcacattcttcagtattgttgctatggatgatcttgagcttaagcagttagatgtgaagacaacatttttacatggagagcttgaggacgagatatacatggaccagccagaagggttcatagtacctggtaaggaggattatgtttgcaagttgaaaagatctttgtatggtttgaaacagtctcctcgtcaatggtataaaaggtttgattcatttatgttgtcacatggctttaagtggtctgaatttgatagctgtgtgtatattaaatttgttaatggatcacctatatacttgctattatatgttgatgatatgctgattgctgccaagagcaaggaacaaatcactacattgaagaaacagttgagtagtgagtttgatatgaaggatcttggtgctgctaagaaaattctaggtatggaaatcactagagacataaattttggtttgttatttcttagtcagcaaagctacattaagaaggttcttgagcattttaacatgcatgatgcaaagcctattagtactcctattgcagctcattttaaattatcagctttacaatgtgctagtactgatgaggatgtaggatacatgtctagagttccatattctagtgctgttggttctttgatgtatgccatgatttgctcccgtcccgatttatctcatgctatgagtttagttagtagatacatggctaatcctggtaaagaacactggaaagctgttcagtggtttttcaggtacctcagaggcacaactgatgcttgctcgaagtttggcaggactgataaggggcttgttggatatgtggattctgattttgctgcaaatttggataagagaaggtcattcacaggttatgtgtttaccattggtagttgtgctatgagttggaaggcaacattatagcctgttgttgcccagtctaccactgaagcagaatacatggctattgttgaagcatgtgaagaatcagtttggttgaaaggattgtttgctgagttttgtggagttgattcttgcattaacttgttttgtgacagtcaaagtgctatatgccttactaaagatcagatgttttatgaggacaaagtacattgatatcaagtaccattatgttcgcgatgtagtcgcgcaaggtaagccaaaggtatgtaagataagtactcatgataatcctgctgatatgatgataaaatctgttcatgttgctaagtttgagctttgctcaagcttagatggtatagtggtttaggccaagaggctatttggcgccgaaagtgtttttttgtctttgttgtgttcagggtgaaggattgtttcatactacaagaaggaatttgtctcaaggtggagtttgttgagttgtgatccaaattcatttgcacttaataaaggccagcttctgccgtagtggagcggaggcccgtcgccgggaggcttgggccggagcatagcagggacgcttggggtgcgggggcggagccaccgcgaaacggatcatcatcccttttagggttccaccatatatatacctcttgtaagccgccgtgcggcgttgtaatctcactccagatatagtgaagatattttgctggctggtgcccgtggttttttctctcctgttttaggagggtgttccacgttaaatctcgtgtcttctgtgattgatctattattttttatcgtttgttcgctcatcgtttcctaacaaaactgattcatccttgcggcatgcagcgacgatccaacgacgattggtcgccatttcgatcgatcgatcggctggtgatgtatatgaaaggcgttcgttaattataattaagttgggcgcctagcttagcattgggtcctgcacatgcagcggcgacggaatcccctgcagtcgtcgccgcccatgcagatgtggtcgcagttggcttgtatcatgcacatcccgctgaacttgctgctttccgtctcgcattccctcgcctgcgctggcgccatctctgatcgatatgatcatcacaaaaaatatatatatattccatacattaattaacaccactgaattaatttcccaatattgatggttgatctctttgtccgctatcgaaaataactgcctgaatatcacaccgtccggtgttggtcgttaaaaaaggaaataactgcttgaatactaactagatcccacgcacatagtacagatgataaaaaagagagtaaactttactttggactatgttttattaccgaagttttgctagcttttataccacctttaactaaggaaaaatattggataaaggatgatacaaagtgaaatgtacattggtaataaaagatagcccaaagacaattctactcagaataaatcattatgtatatattaattgtctcctattgtacctgtgttgataacaagcaggaggaggacagcaatggccgggaagaacttgcgtgatgactccattgtttgttgttttttttctttttgtgttgaactgttgattcttgtctctagtttttctgttactgatgattgttgtctggaggcagaagtgtcatgcttatatatgcagatcactgcaggctgcgtcatgcgagcgataatgaccataggaatttttccaactctaataaaatagaactggctaatattagtcgatggctactattgctttgcattgtaatgagtaatgctagagactgtcgctcccaaaatatcgcagccattgttaattagttaacatataaaataaacaaatagatactcaaagcaatcggattggttaattggaattatttttaggataatgcatttcttgtattccagtaaattcaaagcttatcgaaatttaaatatatttttgaagtgaaataaatcatggtgcacatataatttggcaaggatcatttcagagctttccctaattcatgcataacaaattagtatatgaaaccaaagaaactggtaaccctgaaaattactgtattaagttctatataaaattcaagactcaccagatatatatcaacttttagttataatgtatgctacttaaaaaaactccatctcataatataaggcacaacatatttcatgaaaatttttaattttatttaggctaatataaattaaatttcatttgaagaaaataaaattgttgaattggcatttgaatttattttaactaaatgttaaagataagtggtagacaccatgacggagcgtggggctcctcaccgggagaccgcgcaggcccccctttgccgtttcggccgggggcgctaagttaggttcttcgccctcgatctgaggaacgtcaacgggagaggaagtgcacaagacacgggcgacgtagacaggttcgggccgctgagaagcgtaacaccctactcctgtgttctggtggatctgtgcgtgaaggaatacagagacccggagagcgagagtgagttcaggctctaga

SEQ ID NO: 34012 - DNA, 419 bp, Oryza sativa
  unsure (1)..(419): unsure at all n locations
nnnnnnnnnnnnnnnnnnnnnnnnnnnnnnnnnnnnaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgtgacacggaaggggctagatcggtgcttgtggatagacttggggtgggacgtagcctgccgaatactggaggattgagnnnnnnnnnnnnnnnnnnnnnnnnnnnnnnnnnnnnnnnnnnnnnnnnnnnnnnnnnnnnn

SEQ ID NO: 34013 - DNA, 496 bp, Oryza sativa
tttgcttcatatgtcgtctcgggcaatgtgttctcctgagaaagcatgtccttcagtattcccaaaaagttctgtaaaactcttgtttgatcatccattactagccttcaacttcattaggtctaatgctgctgataatttggtgtgttttggcttgcatcctaagtataggaggagtctccgagtcactacccaacctgctgaacttcatggaatctctctcgttcatagctgggtcatcaacgtcacgtaacatatcttgcagcatatcagggtccacatcgaccatttcaccgcccaatggagatgggacaaacatgtcatgctcttcttcatctccttcttcatgaatgtctgtaccacttccgtctgcagctgcaccatcagtacccagatcttgctctccatgcatcacccaacatgtgtatctctccatgaatccccggcgtatcaagtgagcgtgcacttacttttcatcttcccccaaaatctcatt

SEQ ID NO: 34014 - DNA, 512 bp, Oryza sativa
accagaaagagaataggactcggctcgtcatacaaaacgaaatcgtggcgcaaagaggtcggcggatacaatgaaccgcagacagggagagtgaactgggaatgattcacaaccaaaggaggaaaaagaaagaattattaattacttttccaattaaattaatcactgaatgatctttcatttattaaaaatgcttccaatgctcaaataattctgggaaaaatctagaaaatacttggacattaaaaatatttaatacaattttatctatatcaacttaatgttcaaaattttcatagattttattcacacacttgctttaatcattaaataatttctaaaaattcctttttcacaacgatttataatttagcgatttttatggtgtgacaatctcacatagagagttaggagttccaatggacaaagatgaagtagaagacgagagcattccagactgggctcaatatggtggatttgatgaaaatacaaaaggaaggtggacagggctg

SEQ ID NO: 34015 - DNA, 472 bp, Oryza sativa
  unsure (1)..(472): unsure at all n locations
agctcggtacccaaatttattcaaaacttctagtaggtgtaacctcttgtatgtcttgaagagcattttaggtattttctaaaagtatccacccctaatggtatattgtagaaaaaattgacaaagtcagtggcgtattataagaaagacaaaatcgatgacaaatcatcgaactaaactgatctcagtgatataaatggatttctatgttttatcgctcatctcttgatctaactgtagttttcttgtatgtagggctagaatatctacataagggttgtaacctgccaataattcatggggatgtaaagacaaataacattctcttgggtggaaatttaaaagcaaaaatagcagattttgggctttcaaaaacctaccatagtgactcccagactcacatatcagccattgcagnnnnnnnnnnnnnnnnnnnnnnnnnnnnnnnnnnnnnnnnnnnnnnnnnnnnnnn

SEQ ID NO: 34016 - DNA, 870 bp, Oryza sativa
cctgactagcagataagggagctcttccttcctcaccagagcaatagtggcagggacatagagtatgctctaggccttattccaaatggaggtggtccatctcctcctgtcatcggctataatgcccccgagacttcaactcttcttcaagggctcatcagagaaccagccgatgctagtaaaaagagaagaaccagattatcggctgttgatacatcggctcctgctccaaagaaggccaaattaaagaagcctaaaccaaccgatgatctgcctgccctagatccatccatttaacaagctctggatgaagaagaaatcggcgaggatgttgatcaagccacagatgaaataagcaatactgaaataactccatcgacttcacctaagctaactcctccgaccccctctgctccagcttacttctctaggttaaatatctttccttgattctctttttataactattcgtcctcacccgatttctcactaatcttttccttgcaaaaaaagagaattgctgtgaagaagaaatcggcatcaacaactctaaaaccggctccaccaataagatatctttaatgctttcactagttgatctcaggagaatttgtctaacacttgtctcttttacagcctcctcttcttcgttcttgtcctgtacaacaatcatcgagtgaccaaactccatcgcccgtagagagccatcatattgaagaagaagaacaaccaactgcttctgctatcacagtaagtttccttttgacacaagaatttagatcggccatgtctatttagctctaactccctttaaataattattgcaggtcttagccaatcttttctcttttgacataagggactatcttg

SEQ ID NO: 34017 - DNA, 659 bp, Oryza sativa
  unsure (1)..(659): unsure at all n locations
ctgatttttaagacatgaatgcatatgtgatgtacaagcttttttataggtgtaatctacatctgtgctttgctagtccctatgatacaaagtgatatctagtatgattcttagagatcaccgcattaactactttttgttgttaaagggacaatactattttgattatttatgttattgctccccctgccgatctcggtacccacacaagagacgagtgttttacaactcccttaattgctatttgaagttgctcgtagaattcctttctaactgtttgtctgtgaatatattaaaagggaaaattggtatgggagaaaatttgaattggaagacacgcgtaagagttgcacttgaagctgcacaaggtattctataatagcaaggcaaaaaaaacaaagcaaaagtgttatggctcatcttttcttctaactatagtttccttatttgtaggcctggattatctccataagggttgcaacttgccaataattcatggggatatgaagacgaacaacattctgttgggtcaaaattttaaagcaaaaatagcagattttggaactcatatttcagccgttgcagctggatctatgggttatattgactctgagtatgaatctnnnnnnnnnnnnnnnnnnnnnnnnnnnnnnnnnnnn

SEQ ID NO: 34018 - DNA, 678 bp, Oryza sativa
  unsure (1)..(678): unsure at all n locations
catctttccaaccgcgagctctcaaacctctgcgatcaaactgttgaactacgaaactaattttgatttttgacaaaatttgagcaaattttgtcaaaataaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgcncgccgccctgtccgcgcctgacgggccgccggcgtgccgtgccgtgccgtgccgcgggccgtgccgtgccggcccgctacagtagccgtgccgtgccgtgccggcccgcgggctcggccaccggcccaagcacggcacggctactcgtgccgtgccggcacggcccgttactgtagcaggccgtgccgggccgtgcctgctacaggttcgcccgtgctccgggccgcccgtttggcccggcccattttgccacctctatgcatgggtcactatcgctgaaccattgcatgcgctggtcggtatcaccgtcaccaccttcttttgcttctaatcccgccat

SEQ ID NO: 34019 - DNA, 120 bp, Oryza sativa
tgaaacatacacctagcactttgcacccatagaacacaatgatcaaacgcctgagaaaaatcctgaggaggcaacatttgtagacactcccaagagtaagagacaaaggttgcaaaatcc

SEQ ID NO: 34020 - DNA, 533 bp, Oryza sativa
aaaaatttaaaaaatagattaattaatatattttaaggcaacttttctataatgttttatgccaaaaatacatcgtttagcagtttgggaaacttgagtgtggaaaacgagggactaaagttgggaacttgcaccaaagaacacgagggactaatgtgtatgaaatctcactgtgcctgtgattaagttatatgacagtgacaatattgactttgtctgtggtgaacttagtggtaactgaatttgtcacctcagctaaaaattgatcaagcccatgcgaagacaattcagaccgcatcttgatagcaacctcagtactgtcttctaaacaaccgtagtacacatgcccgaagcctccatgcccaattaaatgtttgaagttatcagtaaacttctctagctcttgatacgtgaatcggcgattttcaggttcttgtaaatggtcccaatgatttgtgatatgtccaggagcacccctgagttctggtaccatggcaagatcagttgaagaagctagtgcaaaaaaaaaaagt

SEQ ID NO: 34021 - DNA, 524 bp, Oryza sativa
ctgcgtggattttttgagcgctcgtaccttttcgcatgctaacatctttacatctcacctatgataattcgttcatcttttttcgtaagcgaacctcttatggctccgactgtaaaattcgaccaagcgggactaaatcatgggggcctttggctatttttgtaagcagtaaccagagggtatttttttactccatatagaaataaaagcctggtattggtaataaccatttttctagtagtggaagctgttgctcactgttgctgtctaggcccgccgatgctgctgaatcagtgtggcactctggctgggtagtggagggaaagtatgcagctttctagctgtggttgacaatgatggtgccatgacgcctgggagtgggagggagcggacgaggagagtccaagggactggatttaaccatagctggttgggctggccgtttttttagtgtctcctgaattgtatagccgtctttggtaaaagaactgcgtgtgaaaatacggttattttctttggtaaaa

SEQ ID NO: 34022 - DNA, 650 bp, Oryza sativa
tggtgccttaagttgattggcttttgatttcttggagtttttgttaaagcattaattctccggactttggcagacttgactctttctttctacttcctccgttcccaatgtaagaattcctagcattattcaaattcatagagatactaatgaatctagacacatataaaaaagatatacatcaatcaaaaaacatatacatcaatcaacacataaatctaggtaagacaaaaggtcttacaatatgaaacggagggagtactgcatatggcaaatggtgttactctatgtcacaaagtcgagcaatgcatgtgagacaataattttttttaggtttttacacaggagggatgagattgttcgcgtggtcctaggataggaacgatgttaccaggacaagtaacgtggtatatgtcacaaagccaagtccaaccgaatcgcgacccagttatgcacccaatgtctctttgacactacttagcaagaatccgccctagactgctaccgcctactcgagaccgttgtcgtgcagatctcctctatcttctgcttggatctatgaaaggagaagtatagagtggagagagataagaaaaaggtgagaaaaatcatgggacttatgttgcccccggtttcatggttgacgaatc

SEQ ID NO: 34023 - DNA, 660 bp, Oryza sativa
tactttcctttcttccgtacaggtggcttgcaaaaaggaatcgacgatggcccatgtacactaccttcctacaatgttttagatacgtactttcagtttcatccatgtagtgggtgtgttaacaacagaattttgtatcagatccggaaaagaaggaacaagatcgaagcggatttgatgaatgatcaagttgtatttgaagtcggaccgcgcatcggctgggcattgtatcggctggagacagaatagaagtttggcttagccaatatggcaagtggccgatacgatatgacttgggctcgtttcgggtctagattggaataaccgtcattgtcaattagagatagagctcgattaaggcaattgtatatattaattaggatatttaagtcgattgttagagatttggcaacagaccgccatgtggtcttgtttgtatcttatctttaggaaagtttgagtcgtgttcataatggactatgtttgtactcggggtacaaatatgaaccccagagcattgtaataagggaaataatccaatacaacttcggcgcatcgtcatccgtttttgttcttcttttcgtcgagttctctcgacaagaggtaactcgtctcaatggcttgtgctatcggggctactatgtcgttttggatgttata

SEQ ID NO: 34024 - DNA, 835 bp, Oryza sativa
tccccatgagcttcctccaattcatggctttccttcaattgcaagaccacggcggacatcattggcctttgagcagcaatatctgctatgcacatatggcagcatctagaaccttccacatggagttgacgttataagaacctccaagacgtgcatcggcaactgagctgatgttaccagtgaccatcttctgcttcacacgttcaacaatgtgaccatttccaggtattatggtaggttcaccactagttacctctagtaaaacaacaccaaagctttaaacgtcactgctctcagtgagtctaccggtgatgtagtacctaaaaatggcccacattatgttaaacacaatgattgcaccaagtgattaaggataaaattgaatagaatcattaaaatatatgaatacacagcacaaaattagcattaattgtgtagaaagaagctcatactcagggtcaatgtagcccatagatcccgctgcaatggctgatatgtgagtctgggagtcactatggtaggtttttgaaagcccaaaatctgctatttttgcttttaaatttccacccaagagaatgttatttgtctttacatccccatgaattattggcaggttacaacccttatgtagatattctagccctacatacaagaaaactacagttagatcaagagatgagcgataaaacatagaaatccatttatatcactgagatcagtttagttcgatgatttgtcatcgattttgtctttcctataatacgccactgactttgtcaattttttctacaatataccattaggggtggatacttttagaaaatacctaaaatgc

SEQ ID NO: 34025 - DNA, 263 bp, Oryza sativa
cctcgaacttagcctcttcctcaggagaaagaggtggttcacttcatttgccacgtgaaacatagaagcactgcatcgctgtcaaccacaatagtgcacgggctttccatctcttatagtagaaccatcaaaagcatgtggtttcagtgcagcagcaaagccaactaccgaaaatgacctatcaggtttttggattgttggaaatatggtcaagaatcggcatattttaatccaaaatgttaaagcaataatcatggcataag

SEQ ID NO: 34026 - DNA, 496 bp, Oryza sativa
tcttcgggatttgggaacgaaagagttccgtcactattcttcttcacccttgcccttgcccagttccttgcccgctagaccgggatatcagcaagcactggttgggtgttagattccgctgtagcttcatcctccttgccccattctgcctgtttccccgcgtagcctccggtgccaagccggtgcaggtgaaggttccttgcctgcagatcacggtaggtctggcttttttcctgagactctttcgttgatttggcggcatggaactcatcccacacgggtttggtgatgaatgggtatttcacaaatggttctggctgggcagggttgaggacgtactccgtgactagcgttgtcttgaaatttttccaacaattccccatcttgcggatagcctgccgcttcagtcctaccttggcctctgtaaggtatcggaagctttccttgaacttcctccatgcctcttctttttcttcttgagggaccagatcgatgt

SEQ ID NO: 34027 - DNA, 536 bp, Oryza sativa
cccgagccgatcgggcggtggcggcagaagtggccgccgggcttggcttggctccaaagccggccggccggccatggctagcggcggcggcacgcggtcgacggcgacggcgaccggcggcacgggaggcggcggtggcggtcgaaagcgacggcgcgcgatttgaagcggcggcttggcactaagagggagaggaaggggaatagaggaaatgaatgcctcaccgcgagtggccggcgctaagggagagaatggctaacggcgacggcgagccacgggaagacggccgcgacgggcggacgagcttcgggatgccctagggaaggaagagagagagattagagggagggagatgaaccccggcggcccgcatccatgggccaaggcggcggtaggggtagggctcacttgagcgcgaggggatgcggttcccgcgacaatctcgaccgaggagcgtcgcacgaggtggagttcggcctcgcgaacccgacggcagcgacggcgcggtgcgtcggcgaccctagcagcggctagcg

SEQ ID NO: 34028 - DNA, 476 bp, Oryza sativa
  unsure (1)..(476): unsure at all n locations
ggcgaattcgagctcggtacccgttgtttggccctagcgtcgtcatcgtttccgtgtgtgtcgccggatcgtcatcgtcgaccccccctctccggtcgctttggttcggtgagacttctatccgtgtcccctcgggttaggtttcaatcccttggtcgtgtcaccgccgctgttgctctaaccctagcgcagccggtgctgtgtcgctagctggtgccctagcgtcgccgctgcgctagctgccttgttgccgccgcgtcgctgtttagacgttgtacgtcgccgtcgtgctgctgctgtatgtgtgccaccgcaaccgctgttgtgccgttgccgtgtgtcaatccaagccatccgatcttgggcgactcggtccagattaatctcagccgtccaaaatcgatataaatctgttctttcttttcaatggcatattatnnnnnnnnnnnnnnnnnnnnnnnnnnnnnnnnnnnnnn

SEQ ID NO: 34029 - DNA, 520 bp, Oryza sativa
tgcttcaactgtggagagtatgggcatttcgctaataaatgtcctcatccaaacaagacacccattcgtaccggagctaatgcaacggctattcacggtactgctacccctgctgctggacgaggtctattcaggactccgcagactaacaggaccgctaccggatttggacgcgggcaagtgaaccatgttcgagctgaagaggcccaggaagaccaaggcgtactgatgggtatgttttcactcaactccactccagttaaagttctcttcgattcaggagcatcgcattcatttatatctttgaaagcaagtcaacaacacaatttaaccagagttaaattaagacaaccaatgttagtacattcacctgggggtgagatagcagtggatacagcttgcattgacgtacccatccgccttagggatgtggtatttccctccaatcttatggtgctaataccccaaactcttgatgtcattttgggtatggattggttagcaaagcatagaggagtaa

SEQ ID NO: 34030 - DNA, 553 bp, Oryza sativa
  unsure (1)..(553): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctagaagaacttatcgtacttaccacaagccagcgtgggcaacggctgggcttgtagtgtagctttcctctagctgacgcatccaggcaagggtgggcgtgatggagcggggcgggccctgcgacggcctctgtcgcttctcgatttacctaggcacgagaggggactgcccgctgccttgcgaggagtgggggtgaaacctgaggtgtggtgtgcttggttagaggggggttatgcgaagggtcctgtcccggcctctttccggtatgtcgtggtggcatgtcggcgcacggaaacgtnnnnnnnnnnnnnnnnnnnnnnnnnnnnnnnnnnnnnnnnnnnnnnnnnnnnnnn

SEQ ID NO: 34031 - DNA, 929 bp, Oryza sativa
  unsure (1)..(929): unsure at all n locations
tgggccgcctcggcttcgcccggcccaagccgagccgccctcccacccgtgccacgcaagtgcgcgcgcgcacgcgcccgttccgcgcgctgacaacgccccgcgtgggtcccacccccgggtcgtcgtcgtcctcccgcccggcctctttcctttctctctcccgtgcaaaccctagtgccaatcctccccaaaattgacgcgattcaaaacgggggtttccgaaattgattagggggttttaatccccattgattccttatcaattccccctaatttcccccttgattcgtgccctctaacgcccgaaacggccgcgccattcccggccgccttccatggccgccggccacaaactccaccgccgttccccgctcatcccgtggacggctccctctcctcccctataaaatgcaaccccccctccgtgcgttctctcgttttagcctcttcctgagctcccccgtggccgcaccacctctccccgcctcctccttctctttcctcggcgccggccaccctccagctgcctgtgccgcctcgcccgtgcggcggctgacatcgccaccaccttcctcggcctcgcaggtgtcccctctcgccggcctgcactccgtttcgcacggggaccatcggagacgcgtcctcgctggtgtagagtggcgttgccgccactgtaccacctccagccgcctgtgccgctttgccggagcgtcggctttcgtcgtcgctgcctctctcggcacagcagcgccatcctcttccccggccaagccacggtgtcgctcgaatttcgccggaacaccgncgncgncgcgccggnctntnctttctcctcatcgatgtctccttcggccggccgttccaccccgcttgtgcaccggccaacgttaccaccaccttcggcatcgcagcggcaaggtcgccct

SEQ ID NO: 34032 - DNA, 6802 bp, Oryza sativa
ccgatgatcaaagatgttaaggttgaagttgcagcaatgacagccgatgattggaggtatgatgtgcatcaatatttgtatagtccgtctcaatcggcttctaggaaattaagatacaaggcattaaagtatacattgttggatgatgagctttattatcggacgattgatagagtgttacttaagtgtttgagtgtcgatcaggctaaagttgcaatcggcgaagttcatgaaggaatttgtggcactcatcaatcggctcataagatgaagtggttacttcggcgtgcagggtatttttggccgacaatgctggaggattgtttcagatattataagggaggtcaagattgtcagaagtttggggcaattcagcgagcgccggcgtcggctatgaatcctattattaagccatggccattcagaggttggggaattgatatgatcggtatgataaacccaccatcaagtaaaggacataagtttatattggtggcaactgattatttcaccaagtgggtagaggcgattcctttgaagaaagttgattctggggatgcgattcaattcgttcaagaacatataatctaccgatttggtattcctcttacaactgatcagggtttaatgttcgtgtctgacgagtttgttcagtttgccgatagcatgggtatcaaattattgaattcttcaccttattatgcacaagctaatgggcaagccgaggcatctaataaaagtttgatcaaattgattaagcggaaaatttctgattacccttggcaatggcatactcggttggctgaagcgttgtggtcttataggatggcttgtcatggatcgatccaagtccctccttacaaacttgtttatgggcatgaggtgttttgccgtgggaagttagaatcggctctcaaagaatggaattacaaaatgatttaacagccgatgagtattacaaccttatggctgatgagagggaggatctggttctgtcacgtaatgataaattcatcccgaaataaaaatcattctctaaaaggaataatagaattaattaaaattcgaaaagaaattggcaaacactaaaatacgtacaagaaaaattcgaaagtggtccggagaatttttgttaaattctccttggtcaaaaaggagccctcaaattttacttgaattttcagagcaccgaaaatatttattaagcaacaacacaattatcaaagtttattaaaaagaaaaagctaaaaataatccccctccttcctttgggccaagcctccctctctctctcggcccgcggccaaagtccttccctcctccctctctttttccttccctctctctctcttgggccgccctccctccttcccctcggcccagctccctcctcctccctcttcctcccgggctgcctctccctcctcttctcctgggccgcctcggcttcgcccggcccaagccgagccgcgcctcccacccgtgccactcagtgcgcgcgcgcacgcgcccgttgccacgcgctgaccacgccccgcgtgggtcccacccccgggtcgtcgtcgtccacccgcccggcctccttcctttctctctcccgtgcaaaccctagtgccaatcctccccaaaattgacgcgattcaaaccggggtttccgaaatgaattagggggttttaatccccattgattccttatcaattccccctaatttcccccttgattcgtgccctctaacgcccgaaacggccgcgccattcccggccgccttccatggccgccggccacaaactccaccgccgttccccgctcatcccgtggacggctccctctcctcccctataaaatgcaaccccccctccgtgcgttctctcgttttagcctcttcctgagctcccccgtggccgcaccacctctccccgcctcctccttctctttcctcggcgccggccaccctccagctgcctgtgccgcctcgcccgtgcggcggctgacatcgccaccaccttcctcggcctcgcaggtgtcccctctcgccggcctgcactccgtttcgcacggggaccatcggagacgcgtcctcgctggtgtagagtggcgttgccgccactgtaccacctccagccgcctgtgccgctttgccggagcgtcggctttcgtcgtcgctgcctctctcggcacagcagcgccatcctcttccccggccaagccacggtgtcgctcgaatttcgccggaacaccgccgccgccgcgccggcctctccttcctcctcatcgatgtctccttcggccgcccgttccaccccgcttgtgcaccggccaacgttaccaccacctccggcatcgcagcggcaaggtcgccctcggcctcgcctcccctccacccgaacaccgccggtgtccgtcgtcgtcttcattgttcctcctcgccggctcgtcgtctcgcggcgctgcctccatcgtcggcatcgcagcggcgtgttccacgccgtcctcgtctccgtgcagctgccgccggctgccctcgttgcctcctcgccggccccggtcgttgtcctcatcgtcgtggcgttcgtccctccgtcaagccgttcgcgttcgtcgtccgcatccgtcaagcgagccgctgcagccccgtcgtcgtcttcatcctcggctccgcatcatcaagcctcgtgccggccgtgtctcgccttcgttcaaggatcgccgccgaagtcgtttgtcacgcccagaaattcccgaatagaattccaagcagaatgtgcattaaaatccccgtccaggaccggccggggtacacaaacgacaatgttgacattcagatccacgtcttacaaacatcataaaagtcttacataaatgcagcggaaaaacgaaagacaacaggagttaagccttgacttgaactgcagcgggaacaccactccacaggcatcctcgacgaagcctactcctcagagaaaccaccatctgacatatactcgtactctggggttggggaaaatagagcaagactgagtactacccactgtactcagcaagtcataccggaataggggtatgatgcagggaattatcaaaggagagatagagtggttcatttgcataaagcgagcatttatatgcagaagttgaaagaattaaacagttgtaataattaatcaatattaatcatccgctgtccaacgctataccacgttgcaagaggcctaaccatccacctatactatccaatttcattacactaaattagggtgaaactaatcacggtgaatctggttgaccgctcataaccacgggcacggctattcgaatagttttactctgattagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtaaatcgagaagcgacagaggccgtcgcagggcccgccccgctccatcacgcccacccttgcctggatgcgtcagctagaggaaagctacactacaagcccagccgttgcccacgctggcttgtggtaagtacgataagttcttctagggtttcccgcgaaccggtccttcattgccatttgtgcgactagcaaaaccatgcacccacagcccaccatgtgattcatttcaattaaccaacaccaaagcggtggcactaatccaacactaccattagaaccaacagcctaaacattaataggattttccccattgtgtactagttgaactaagcatggctaagcaattcctagtccaaagtctattcatgttataacccaagctaacaaaggaacatggtacaacaatagcatggctatgaccataggtaaacatcccatagtaacattgtaaaacaatgcaatatttgacgaaaaacaatagagcatttgcaatataggatcaacatgttcaagtgacaagcatgacttgccttgctctgctgctggaggaacctcagcgactatttcgaaatacaccggagcgtcagaagaaccggaatctaagcgacatacaaagcaaacaatacaaacaggctataagactattgaaatagagaacaaaaccatttttaatggattctacaaatttttcttgatttactgagacttgaatgggcttaaacggagcacggatgaattagttatgaattttagaagattcactgcgtttattactataacaaaaatccttaaatcatttattgcgcaataaatcccagtgctgacgtcatcaaaaggggggtggcgccgacaggcggggcccgcatgtcagtggctcaaggggagataggggcgccggcaagtggggcccccgggtcagcggccgaaggctgccggtccaccgtggaccgggaccacgcgggtggtccaccgccggtccacggaaccgacggcccagatcgccccggggctgatcggacgggcggtggcgacccggctcagctcggctcaaggccggccgaccggccgcggcgatggcgacggcgcggtgcggcggcgagtctagcggcggctagcggctgccggagtagcgggagcggcggcggcgggtggttgcacggcgcgggagcgatggggagcacgagggagttcggtgaaatggggaaaaagagagagggggcgacggcggagcttaaataggggaggggaatcctggacgtggccggtgggggcgggattccgccggccaacgcggggagtgggggaggagagagaggcgggattcgaaaatcgaatcccggccatctcaggcgcgggcgcgggcgggagagaaggggagtgggcgctgtaggtgcggcgcatgcgcgggcgtggccgacgtggcccggaggaggcggatgcgtgggcgcggcggcggttgcagtctcagcgcgctgctcgaggtgggagacgggtccgataggtgggccccacctgtcggtgacccgggtgagaggatgcggtcagccggcccgccccggctaactgggccttggcgtttcggccggcccagcgggaggggaggaaggaaggaaaatggcccaacggccctttcaaaaaaaaaaaaaagggaaaaaaaaggaaaaaaaaaaaaatttttcctaaggattacatattgcttatgctcaattttaattggttaaaattatttaaagagctcttggaaattccactaaaaatcttgttagcgaatttcgacatgtagaactcaaaaaaaattcacatgccaattccgattattaatttgcattaatttattaaggtttacttttgctttacataggtattttcttgagaccatttataacttcaatttaggcttgggaaggaacttcggggtgtgacatcgttccctcgccgtttgcttccgtcgttcccaagccgtctccgttcccacgcctcgtcgcgtggtggtaaggatccctctccctcactgccccgtcctcgtcctttcggtgtcgcccgtgcctgttgtgcggttgtcgaccctggtacccatgtaccggtgtcggtagtcgttcgtgtgtgcgtgtggcgactgtgtttgtgtgcgcgctcggtagccgcgtggtttccacgtgtgcaggccgtgtggtgtctagtggagtccgtttattggccactcgcctcggttgacacacgggatccgcttccgtcgacccgtggaccatttctgtgtactcggtctactgtggtcccttaggttgacatgtggggtccacatgtcaacggcgcagccttcctgtcttttccaggctagcgcttatacatgttttataattgcaaaacctaatcacaataatccgtaaatctccatgtaacagcattaaacttcggatgatcatatcttggtcatacgaaccccgaatcgacccgttcaagtctcctaatgtttgttataacctaaagaaccatgtgctttctttttatgtattggtattgcttctttataggcttgtagctttgcttgtgtgcttcgcgtagcttctgtcgttccggaggttcccaaagcgtggttcgcggtcgtcgccgaaggttcggaaggctgttctctctgagcaagaaaagtcacataatccttgaacatatttgtcacatcctgatttttgtttcaggatttataaaattatttaataaattattatcagaatttatattaaatgttcattaatttacaagtgaagttaaatgtgggaaataaaattttctaaatataaagcatggatggatttaatttttattaaattctccatggttaattatactctctggaatattcttggatttttcggagctcaattcctaatttttaatcatacaaagagcagttcagcaattatttaaatattaaattaatcattaaatggtctgattataattttgttaagtattttgagtgtccaagtattttcaggatttttcttgaaattatttgagcattggaagtatttttaacaattcaaagatcatttcagtgattaatttaattgggaaagtaattaaaattcaccttttccttttcgggccgaattaggaaaagtcctctcattctcggcccagtctcctctcagcctgcagcccttttcctctctttcccgaagtctgctttgtgtccctctttcaatcgggccaagaagtagaagcccagccaaaagtctagtttgcatccctgctacagtggcatcttcaatctccagccgg

SEQ ID NO: 34033 - DNA, 9844 bp, Oryza sativa
  unsure (1)..(9844): unsure at all n locations
nnnnnnnnnnnnnnnnnnnnnnnnnnnnnnnnnnnnnnnnnnnnnnnnnnnnnnnnnnnnnctctttcaatcgggccaagaagtagaagcccagccaaaagtctagtttgcatccctgctacagtggcatcttcaatctccagccggctggagacagagcccgagccagccgcacagtacctgtatagccgcggttttcccctccaaatccggccttttatctcgtgtatttccaaaattagttgaggggaaatactcctcttatcctcctctatctttacccccaaaaatcggagctaatcgttgagtatcttgcccgaatcgaactcgttttcgagtttatctccaaaacggagtttttgatttcccggatcgatttcttgcgggaggagtccgatctcttcaatccaaggaccccctagtcctcctctttcgtttgccccctctcccgagctctctcgtcaaccgtagagccgccgccacgacgtcttagccgccgccgtcgccggccgacgaacagccgcctcgcgccgtcgttttggccgtcgccgccgcctcctctcgccgccgtcgggtgcgcgtggaagaggggaagctcggccgccccctccccaccgtcgccggtcaccggagagtcgccgccgccgacgaccgagtcgccgccgtcgcctcctctcgtcgccgaccgtcgtccgacgtcgttcgtcgcgttggtgagtatcgttgggttcgtctcgtcgtcctctgcgtgtaggtgtcctccaaatccgcagccggccgctctatctccggcgaggtcgccaccgtggttcggccgccatggatgatgtcagcatgacatcatcatcctttctttttcccttttttctaatagattaaatcttcggaaaatcataactaaataaccgtagatccgtttcaggtggttcaagttgctaaatttttctaaaatcaagatctacatgttaaaaatatccacatgtactgtttatgcttgtttttgtactgttttgttgatttttgtttaattgctttagtttccgacgttccggaggagagccttcccgttgaggaaggttccgaagcgtttgcggaagcccaaggcaagtcacacagatcccaaacaaccctttgagcatgttgaacccgtttaaagctattattttatttcaactatgcattatttttgaatgtcatcgggtggtgaacctttccccgttaattaatggccaaagatgatcttatttttcctatgggttataatttgattagcatgaaccttatatattggattggttcagctaaatgctatatgtaagtttgcttagccatgcttagaaacattagctaactaaaggggttaattataaactatattatattatatcattattatggttatatttaatggtcgctcacgatggttaatcgtgtgatgttaattaattgataattaaaatctggttaaggtgggttgtgagcatatggttttgatggttgtgctcatgacaattaaggaccggttcgcgagctactgtagtgaaacatttaccgtgccaaccacaagccagcgtgggcaacggctttaccttttgtatagcatgattcattacggagtgccagactgagaagcggcgagaagtccgcgggggtcgctggggagtccatgccttgtttataagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctgattagagtttaatctattcgaatagccgtacccgcggttatgggtgagttgagcaatgtttttcgtgattagtctcacacctttcacaataattatggatgttataactggtaataatttgcttagctcctggtttggagttagatctgtacagccgggtatggttgttcaggatggttgggcctgtgcagcatgggtgtgctgttcagtgttgattaaaattgatgattaattactctactgttttacttatcttaaatctttgctaaatgctgcttttgcaaatgagcctatattatgccatcctttggaatccttgtgcacttgcatatttgctgtgtggcttgttgagtatgtcatatgctcattcttgcaataatcatcaaacctcacctgaagataaaggatccagaaggagaagacgtttggcttatacccagttgagctgcctgtgggagtggagctgaagccatcgctagaccgttaattccgctgctgttttcttttctttgtaagtatgtaacgttattattaagatggatttgtatattaaattgtcagtttgtgtacctcggctgattcctggacgaggattttatgtacaaattagttcggaaattactagtgaatttccgagcgtgacaatattgaatcccagtttataaaattattttgatttaaattattgcattatcgcttcatttaaattcccgcgttatcactgttttatttagccatgcctacttacctttgttatgaccttattattattgttattgttattattaccttgttcaccttagaataaacaataccccaactagtgggtactctatttatggttccactagtatgaatttaggtagatgtttcgctgattaattaggcaacattaggtggttttataactttagactttgggaattctcatatcatttggacagtatggaatggttggcttatgttggaattggacacacacctccccctcttttcaaaacccccaaaatggttttaggctgggctcgaggtgcgtggttgggttttgttagtcgtacctcgggtactataaggattaagctcgggcctctgttgcaaagcactaccgtacttccacatgtctagtgggtaaggcttagtttgtggctcagtctggttataaacaaaagtacacggatggagttggacgaagtcgggggtcgatggacatctctaggacaaatgaaggctacacaagctgcggcccggtagtcgagatgtcatggcacagggctggtgtcctaatgctaggggctcaatcctgcctgcctgtcccggaggttccggccgtaggtggggttgggtcggtactcttgtttatggctaggatgggttgggaactatgtcacgtctttcgtccgtatgccgtggtggtatgtggcacgtgattacacgtgaggaagacgtgtcttgtgggtaaagatgtacacctctgatcagagtataatctattcgaatagccgcgccctcggttatgggcaagcctagcaatgtacccaagttagtgttttaattcttaaaacctgcttaacaactaaaatgtggaatggttggtgtcgcgaccgagaaaattgccttatcctgaacgctagtgtattaatccccgtcccaggaaaagccggggtacaccaaacaaacatgatacaaagggaacatctttaatacatcgataatatttacattattacaaaggcacttcaggcctgacaatcaaaaataaatagcagcggactagcaggcctacggctccatcttcacaggcgctcaactggggtataagccaggactccacctaagacttcttctccaaagcttttcttactgaagggggggaaagatagagcaagaatgagtacaaccacagtactcagcaagccacaccgggagatgcatgattaatgcaagggggtacaaggggtaataataagggttaagttttgcagaaaacggcatttaaaagacacttagttactcaaagctattttgtaaacacgatcctagagctacacaatattattaatcaaggccgtggacccacacgaacctgccttaacccaaggcctacgatgattcagaccgaactggcaacccgacctgggtcccagctcgtcccaagccaacccaggccaaccattccatattttagttgttaagcaaattttaagaattaaaccactaacttgggtacattgctaggcttgcccatatccgagggcacggctattcgaatagatgtactctgatcagaggtgtacatctttacccacaagacacatccttactccgcattccatggccttggaacccgtcgtaaacatgtgacataacccttcacctatcctagccgtgaacaaaagtaccgacccaaccctgcctacggccggtatcccgggataggcaggccaggattgagcccctagcaacaagatctagaccgggtgcgccacacacataggggtgagaccacccgcgtactagtccagtgccatggcatctcgactaacgggcaccgacccgtgtagtcttcatttgcctagacatctcgattaccgagccgcagctcgtgtagccttcatttgcctcagagatatccatcgtcgcaacgacttcatccatctctatccgtgtccttttgttcaggactagactgagcaccgagttaagccttatccattagacatgtggttagtacggtagtgctttgcaacagaggcccgagcttaatccttatattggccggggtgctacttcccacatctggcatgcacccaaaccccaccggaaaacaggttttaggggttttgaaagaggaagaggggtatgtccaattccaccataagccaaccattccacagtgtccaaatgatatgagaattcccaaagtctaaagttataaaaccacctaatgttgcctaattagtcggcgaagcatctacctaaattcatactagtggaaccgttaatagagtacccactagttggggttttgtttatcctagggtgaacaaggtaataataaacaatagcaatgataaggacataacagggattaataggaagtgctaaataaaacagtgataacgcgggaatttaaataaagcggtaatgcaataatttaaaccaaaataattttataaactaggattcaatatgctcaagggtgatgtgacttgccttgctcagagagaacggccttccgaaccttcggcgacgaccgcgaaccacgcttcgagaaccttcggaacgacagaagctacgcgaagcacacaagcaaagctacaagcctataaagaagcaataacaatacataaaaagaaagcacacggttctttatgttataacaaacattaagagacttgaacgggtcgattcggagcccgtatgaccaagacatggtcatccgaagtttaatgctgttatatatggagatttgcggattattataattaggttttgcaactataaaacatgtgtaagcgctagcctggaaaagacaggaaggctgcgccgttgacatgcggaccccacatgtcaacctaaaggatcgcggtagaccgagaacacagagacggtccacgggtcgacggaagcgaaccccgtgtgtcaaccgaggcgagtggccgacaaacggactccactagacaccacacggcctgcacacgtggaaaccacgcggctaccgagcgggcacactgacacggtcaccacacgcacaagcgaacgactaccgcacaacgggcatgggcgacaccgaaaggacgaggacggggcagcgagaggacggacccttagcaccctgcgacgaggcgagggaacgacaacgacgaacgggcgcggcggagacggctcggggacgacggaggcgaacgacgagggaacgacttcggcggcgatccttgaacgaaggcgagacacggccggcatgaggcttgacgacgcggaggcgaggacgaagatgacgacggggctgcagcggctcgcttgacgaaccacgggcgacgaacgcgatcggcttgacggagggacgaacgccacgacgaccgggaacgacgggaggacgacgaggacagccggtagcggttgcacggagacgaggatggcgtggaacacgccgctgcgatgccgacgacggaggcggcgccgcgagacgacgagccggcgaggatgaacggtgaagacgatgacagacaccggcggtgttcggccgaaggggaagcgatgccgaggacgacgtcgcggctgtgatgccgaaggtggagacggcgacgtcggccggcgcacgggcacggcggaagaggctgccgaaggcgacgttgtcgaggaggaaggagaggccggcgcggcggcagcggtgttccggcgaaaccgaggagcagccggaggagaggacgacgctgcgacgtcgacggaggagacggcgacgtcggtcggcgtaccggcgacgaacagcagccggccagagacgatgtagtggcggcgacgccactggacgctggcgggggcgcgtctccggcaatttcccaacgaatcggaggcagcgccggcgaagaggaggcggctgcgacgccggggaaggcgacggcacagccggacggcgcttgggcgaggagggagaggcggctggaggcggccggcgcgggggaaagagaagggcaatagcggggaggggtggtgagtccacgggagaacgcggaaggggactaaacggcggatggggattccattttataggagaggggagggagccgggcatgggagaggacggaacggcgacgggaaacacggccggcggcaatggttggtggccgggaaaggcgcggccgttcccgacgattgggggcgccattcaagggggaaaacgggggaaatcaaagaggatggaaaggggattaaaagcccccacttaatttgaaaataagggaattgattcgtgcggatttgagggaggaagaaactagggttcacgggagagagagagaagctgggcgggaggaagacgacgacctggcgcgtggggcccacgcgggcgcgcggtcaacgcgtggcaacggcgtgctcgcgcacgtgcacggcacgggaaggaggcgcggttcggcctagaggggggggcgcggcttgggccgggcggccggcccaggaggagaggagggagaggcagcccgggagggagagggaggaggagggagtgggccggtagggggaggggaagaggtgggccgggaggaggaggagaggcccgggagaagagggaaagagagggagagggagactttgggctgggcttggcccaaaggaggaaggaggattatttttaagttttctttttaataaactttgatcatagttgttgttgcttaataaatatttccggtgctctgaaaattcaagtaaaatttgagggctcattttagaccaaggagaatttaacgaaaattctctgggctacattcgaaattttcttgtatgtattttagtgtttgccaatttctttttgaattttaattaattctattattccttttagaaaatgatttttatttcgggatgaatttatcaggacgtgacagttggcctgggttggcttgggacgagctaggactcagggtcgggttgccagttcggtctgaatcatcgtaggccttgggttaaggcaggttcgtgagggttcacggccttgattaataacactgtgtagctctaggattgtctttataaaatggctttgggcaactaagtgacttttaaaagttgtttactacaaaacttaacccctatattattaccccttgtacccccttgcattaatcatgcatctgccagagtggcttgctgagtactgtggttgtactcattcttgctcaatcttcccccccttcagtaagagaagctttggagaagaagtcttaggtggagtcctggcttataccccagttgagcgcctgttaagatggagccgtaggcccgctagtccactgctgtttatttttgattgtcaggccttaagtgcctttgtaataatgtaaatattatcgatataataaagatgtgccttttgtatcatgtttgtgtggtgtaccccggcttttcctgggacggggattaatacactagcgttcgggaaaatgcaaattttctcggtcgcgacaggttcaatcacgattgcgagcccttgcaaaggttaccaaggataaggaacgtgttgctcggcattacaagaagaaagtggtacccaaagatttttcggaaggtgaacttgtatggaaattgattttgccgattgggactcgtgatagtaaattcggcaagtggtcgccgaattgggaaggaccgttccaaatttataaggttgtgtctgagggagcatatatgttgcaagggcttgatggtgaagtctatggacgagcgctcaatggcaagtacttgaagaaatattacccaagtttttgggttaatgcatgatcggctagtattgccgatgcaagacagccgatgtgtttacatcgccttgagatggccgttatggttatatcacccttagttgttcttttcatggtataatcggttgtggtttgccgatgtataatgctcgatattgttatatcgcccttagttgtttttataattttatcaatgcttttgacattgtaaaattaggtgggcacatatgtatcaaaatgcaaaatttttataatgtgagcgaatttcaaagtcatcggcacaaaggattgtcaagatagtaaagtactagagcatcttagccgattacaaagatttctaagtcctattacacaaaagatattgagacaagtaccactggatagccaaaatagccctttgcctaatttgttctacttcttcaatagcttgggcatcttgagcatcagttctagaaatgaccttcagggacttggttaggtcagcaacattcttgatagccgatttgagccttgctttttgctgttctacagattttgggagatcggctagctttttgtgctccatatctagttcagcattgcattcttcaagttgtgccaagagattgatcttgcgggcttcaagccgatcaatattggatttgatcggaccttcggatagctgatcgagtttgactttttcttcatgcacaagctgccgattgacctggattgcggcttcaatctccttgtgctcacggcattcggataatcttagcttggctttctccagtttaaattgatgctgctcaagataagcagctggagttaggacatcggccagttcttcgggaattagagcttgaacttcgtgcaattgtgccctaatcgatccacagtccaccactaagctatctagagaagaggcctctagccgacgcgagatgtcttaaagtgttttctttgcattatcagataagggagctagagctttgcttgaagtatctttttctgcctcatcaagataatctctgatatcaaaatagaagagatcggctagaacctataggtataagttcagaaagtttgagagctaagccaatatagccgatctaaattcttgcatcaaaggaaaacttactgggatagcaggagcagctggttgttcttcttccacaatatgatgactccctacagccgatggagttcggtcactcaatgattgttgtacaggggaagaaggaggaggaggaagctgtaaaaagacaagtgttagacaaaatcggctagaattgactagtaaaattgagagtgtcttactagtggagctggtttgagaattggtgctgccgatgttttctttatagcagttttcttcttctataatcacaaagcctatgagtagtcggctgaaaaataataattataaaaagggtttgcaaggaaagatgttttactctgaagaagtgagtgggggcagaaggagttggaggnnnnnnnnnnnnnnnnnnnnnnnnnnnnnnnnnnnnnnnnnnnnnnnnnnnnnnnnnnnnnn

SEQ ID NO: 34034 - DNA, 3984 bp, Oryza sativa
gtccttggagattgagcagccgatccatcattaaagatgatgagatttctcctcggcattggatcttatcggcaaagaataagccgattaggaggttgcccattccaaattgtctggcagaactcattggatgataaaactcgtaggaaacttggatgtttctcccttgatgaatgccgactggaaggatgcatggggtgattgcagataagaagatttttctgggcttttgatatctgtcattgttgatgtcttcaaatctgaagtcccatggattttccagaagtgttgagtctccatagagaaaccaaactcgagcatccttttggaacccctcataaaagttgcaaaaccagtctttgagcagctcagccgatagttttgctcctgcatcagttggtgtagaggcgtactctccatatgatgtgcatctccgatgagtgagttcttctccgtcatcgttgacagtcggctctaatcttgggaattcagtttctgttatagatggccgattgacgaacctcatgactaccaagtttagccaggattgcagcagccaccatggtccacccgctccgactactgagctgacaattagcttagccgatgcattattcagcatttggtacaagtagctgaggagtattttgcctaaaggaaattgtccttttgtctccaaagcttcggctatgaactaccaattggttgtaggaccgcagctagacccacaaaagagaaacttttctaaccacattaacaggaaagccacatgttctcggggggtaactggaccctagcccatatatgctgctacatagcctaaccagctgcctatgctcttggtcttgaagtcatattggttctttgtattcaaactcatagggttggccgatgaggtgacatccagacccgtgatcatgctgatatctatgagagttggggtcatcagcccttgattaaacaaaaatgcattgatggtgtttgaccagaagtaagaagcagctgccatcaagggttcatctttggccgagtttgctatagtgaggtcaagtgcttggccgattccaatttcatcccagtgaacccttttgcttgctgatacatgtttgaaccatgtggtccaacttttctcgggtggaactttctctagagacggccaagatttgaaggtattcttccagtgacctagatctggattggttaatctgaagggaatcctattggtttcaccaatgataaactcagtgggatcaggattgctaactgggccgagaaagtagtagttttcgtgtgataggcttggaatcgcaactaggttggagagatgctacaaatccaaaacaaccgagaaaaagagagcgatataagacaagaggaaatcgatctgctgctaagaaaggggatctagccaacgaggacttatctcagcgtactcggctgatggcgcatcagatgggttggtggaggacgacatcgctgcgggtggaaatctcgccgaagatgaagtcgcctggaaatcgctattgcgtcggagagatcgccggagagagagaggacaaagtatcgcttgagcggtgaaaacaaaagtcacggcgtgagatttcttgagggcaacggttagtatttaaagcgatagaataacggtcgaaaaacggcggaatgcgaaacttgctcggaatcggtacacggcaaatccggaacattatcaaatatcctggacttggggggcatgtgttagcgaccaaatttggtaatatcagcatcggaagtgaagatgagatcgaagcggaatctgagataaggaatgctgcgggaatagagtaagaatcagctggagtccaaatcggctatgaccagaatcggctgaatccgaatcatacattcgaatgcgagctttggacctgtactagagttaagcagatctcccaggcctcgtgttttctgtgaacaggcggcgaagggaggtccggttaaaaagatctccaaaaagaaaggactcgtcgatgtcgctcgtgttttcagcgacgacaagtcttctgacgggactcagacttcgcccgccgaccgtagcttgcacctttcgaccgctcccattcttccgctcgatgctggcggagaaggtggtagcactgccatcggggctttagcctccgccgatcggatcgtcacggctgcggcgagggttatcggtagccccctgcgtcagccggttgtttcgccgctggtctaggcgaaggggaaggaggctgccgtcgaaacatctacctcggagtactccctcgcggggccccacttcgcccctggcgatttcgagtcccgggcggagcttattcccttcgtcgagggagtaagcaatcttgtcttacctgctagcaccccgagtctattcaccgagttgaacgagttcgatgaagggtgttccgctatcaaaagcttggcggttcgggtacgcctcttcgctctcttttttatcttcctctccttttttacatgtcccataattaacattttcgctcttcttggatccagattctcgcggcccactgttcgacagagtgaattgtgcggggtcgtcttgacggatttaagaaccgtcttcgggccaaggatgagaaaataggccgcaagagtttggagatggaggcccttgccaataccctcatagaggcgaaggccgaaaacaagcgtctctagaccgaattggagaaaggaaaagaggctagggccgagatcgatcgcctcaaggccaaactggagaaggaaaaagcccattctgccgcgctgaccgattattacaaccttaccgagccgaagatggaagctcttcgtctggaggtcagcaaggccgaggcgagcgctgtggaggagtcacggtggttttcgcgggagatggcgaaagccaccgaatccgcaaggacggcgtgccaaacgctccgccttgcccttactgacatggcagcaagggtgcgaggagtccccgccgaagacgcctcagccttcaacttctccgagtagacccagcaggatgatggtgcggtttcggactatgccactgcgtacggcgattgctatgagcgcgtatcggcggccttcactatgggccttctgcagcagttcggctatgagcacgtcgccgagttccctaactacacgaagggggactgggagattagtgcacataacgtttcgcccgcgctccgttcgtggcgaaagcagttctggcagaaggacggccgatccaccgccaaggcgcgccttctagagcaactggcgaaggcagaggcagcagaccggtgcgaagaagaggacgcggcagccgaagggggtggaggcgatacctaggatcacccagaggtgtgaggccctccgccctttccttagattttcgtagttttccttcttctttttctatttgctgggaaagatgtaaattctttttgtagccgaaaaggccccttggatatttggaatgtatgactcaatcttagccacttcttatggtcgatgccttcggcgtatatgactacgtcactttcgcattatgtaatattcgctcttttttcgcccgttcttactatgcacttcgtcttttgccctttctgcattgtctaccagggtgttcgccaaaaattgtgcattcggcccccttctgggagttggcaaagaaaaaacgagaaatttgtggcgttgaagggtttgccgaaggtacgatgcccatttcagcctgtttatcgcgaaatggtaataaacggccatagctataaggtttctaaggttgccggctggctgcgagcgcaccccgggcgaaccttagaagactacgatcatgttcatacaagacgtttggaggatgtggttcgtttttggcgaaaccatcagaagactgatcggcaggaggcaatctcccagcgtcgttacagtctagtctgtgtttcgcccccttctcctcttagggtcgtgtatgatattagtagtgatgacgaa

SEQ ID NO: 34035 - DNA, 5152 bp, Oryza sativa
  unsure (1)..(5152): unsure at all n locations
ttcgcccgttctaactatgcacttcgtcttttgccctttctgcattgtctaccagggtgttcgccaaaaattgtgcattcggcccccttctgggagttggcaaagaaaaaacgagaaatttgtggcgttgaagggtttgccgaaggtatgatgcccatttcagcctgtttatcgcgaaatggtaatatacggccatagctataaggtttctaaggttgccggctggctgcgagcgcaccccgggcgaaccttagaagactacgatcatgttcatacaagacgtttggaggatgtggttcgtttttggcgaaaccatcagaagactgatcggcaggaggcaatctcccagcgtcgttacagtctagtctgtgtttcgcccccttctcctcttagggtcgtgtatgatattagtagtgatgacgaacctagttcgtctgatcatcccttagagagagagagagtgattgtggaggcgaggatgtaatttatttctaagctaggtgtaaagccattgctctttctttttacttgtaccatgttgatgtgtttgtattcttcgatgtgcttttctttaaaatcagtaaaggtgcgttttatttccttttcgctatttttgcattgtcacttcgcgtgctttcgttgggtcggaacatgtcagcccctttgcgtatattagcgaaataggttctgagtttttagctttcggcttcgttctcgatccgttttgttctacgttgtaggaagcacttgtgctttccttttgatcgagtgtaacggtgttcggttagttgttccccgaaacaagctgttgtgatttcaacgttcggcgagcgatgcttcggccgattcgtttcgcccccctggcctttttcgctgatcaggcgtttgccttgggggttttccacaaattatcaatcacacaaataaatgaaaaagaagcggaggacacagagattttatactggtttgggcctccgtggtggataaaagccctacatctagttattttttgtcttttttcattttcctcttttttttcttttttttcttttgccgaaaggcttacaaagtgccgaagggcttacataacgatatatacatttttacaagttggcgatttgggtgccacccgctctagacatagaaacgcttgagagaggcagcgttacaggaatggtcgaactcttcgccttccagtgtcgccagccaaaaggatcctgttctggacttgtgcttgatgaggtacggtccttcccacttcgattcaagcttgccagcagctatcgggttcgccttcttccttaggacaagatgaccaggcaacaactccgttggtcgaacttttttgttataagttgccgaagtgcctatggcatacttgcgcgtgtgttcgagtgcttcaactctcaccccctccaggagttcgagtggcacctcgcgcccctcttcgccccagagaacaacacccttggtgagttagcccccagctctgtcggggtcattgcctcttcgccataaaggagcatgaacggactgaacttggttggtcttgtgggggtcatccaaagggcccagagaacagataacatttcctctggccatttgcccttcgctgccccctcaagccttttctttagtgcttctaggatcttaccatttgtttgtttggccgccccatttgactgtgggtgcgtgaccgacgcgaacctgatttccaggttaagcccttcgcacatttctttgaatttgtcagagtcgaactgcttaccgttgtcagtgatgaactcttttggcacaccgaaatggcaaacaatgtttttccatacaaacttctgtactgctgccgaagtgatcgctccgaggggttcggcctcaatccatcgggagaagtattcgacggccacaattgcgaacttgtacccatttcgcgccaccgggaatggcccaatgatgtccaatccccatatggcgaagggccagattggtgcgataggctgcaactcatactggggcgcggtttgacttcggccatggcgctggcagctttcgcacttcttgactttcttaacacaaactttcaacacggtgggctagtacactccttgtcgaaacactttggaggcaactgttcttgcggcctggtgcgtgccgcagagcccctgttgtatcttcttcgccatttcctcgccttcggcaaaagagatgcagcgaagcaagggttgaagtaccccagagcgatatggctggcccgagaccatcttgtaccttgcggctctgagttgcaggtgctttgcttctgcttcatcttctggaagccagctagtctcaaggtattttacgaacggtgttcgccagtcgtatagatcttcgcccagttttgcctggtcgattgccatgacctccatgctctccatgggcacacttggttcgtattggacttccaaaaagatacctggtgagtgtgggcctccacaagcagcagatttcgccaaggcgtctgcttcctcgttatagcctctaggtaaatgttcaaccgttatgccggtgaagcacttttccatagaccgaacggcctccaaatacctcttcattccttcttctattgccccaaaggatttgtcgacatggcctgccaccagcttgtagtcggtccggattagcaagcgccgaattcctaatgcttttgcctttcttaggcccagaagaatggcttcgtattctgccgcgttgttggttgtgtcgaactgcagccttgcggcataccgaatcggcacaccacttggcgaagtgagtactaacgcaatgcaggtgtccattcggccacgaagtcagctagcacttgagacttgactgcagtgcgggcaacaagatgcaagtcgaaaggggatagctctgctgtccacttgctaagccagccagtaacttccttgcctcggagtattttgcccaaagggtactgcgatgacactatgactttgtgggcctgtaagtaatgtttaagtttgcgcgaagccatcaccaaggcgtaagcgagctttcccatttcaatgtatcttgtcttcgctccttgcaatgcttcggagacgaaatagactggtttctgtcctgactctgtttcttggacgagggcagcactgactgccactggcaaagctgctgggtatagtagcagttcacttcctggtgctaggttgatcagagctggcgggctttgcagatattgcttcagctcgtcgaacactgcttggcattcgggtgtccaattgaattttcccgcgccccggagggtcttgaagaagggcaaacctctttcggctgccattgagaggaatcgactgagtgccgcaattcggcctgcgagcttttgtatctcatgtacgctcgtcaggggcttcatttgttgaatggcatcgattttctcagaactcgcctcgatgcctctttcagaaacaaggaaacccaacaacttgcctgcgcgaacaccaaaaacacacttctcaggtttcagtttcatacccgccgcgcaagttgtcgaaggtctcctgtggtcgaaagccttgcggctttttacgacgatatcgtcgacataagcttccatgtttcgccccagctgcttatcaaggaccttgtacaccagcctagcgaagtttgcttcggcattcctcaggccgaaaggcatcctgaggtgacaaaatgtgccaaatagtgtaatgaaagctgtattggggatatcggccgggctcatgtggatctggtgatagccggaatatgcatccaggaaactcatgagtttgcaaccagctgtcgaatccacgagctggtcgattcgcgacaaggggaaatcgtccttcgggcatgccttgttcaggtctgtgaaatcgacacacatgcgccatttgccgtttgatttctgcaccagcactcgattcgccagccactcaggatagtcgatctcttggatgaccccagtcttgagaaatttttggactttggctttagctgtttcttggcgatcagcggacatcttgcgcagcttctgtttcgttggcttggcatccggcttgactgccaggtgtggacccccgtttttataacaggaatcaatcgtgtaaacagtaccatttccctggatcaagtagtttggtacacacgaattcatagctgaaatatcaagtgcacatacacgagtgtctgatacgaattattacatcacaggcccgcaggcatagtcttaaatcatcggaccgagaggtccggaatacatccaaaagcagaaatagataaggcagcggaattcaggcagcggcatgccattgccacaggcaacgaccgtactaagacctactggacgctatcgtcttcatctccctcctgataataggcatagggatcctccgaggcttcatctcctacttctgataaattttatattcgcaaggatgagtaccaaccgtactcagcaagccaccacagcaacaatgcatatgaaagggggagttcaaaggatgcccatagttcttttgcgcaaagcaagttttgtaattcttttcacaagcctaagacctagcattgacttgatcaaatttagtacaagagtttgtatttaacaacgacggttctgtccaccatccattgtgatcccaaggatagcttcccgccattgattcgtcatggttttctgaggacgtccaccttcccgcctctcaggaagtggctccaacagcataaaattcatcatgcaataacccctcccacacaagttaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacctgctccatgaacttaaatcctcatgcactctaggcgtccatgtttctagcagtgagaggagttctggcgctcccgggaaagagaagtctcacacacatattaaatttatggttcaagttaagttctctctcacacacactcatggtnnnnnnnnnnnnnnnnnnnnnnnnnnnnnnnnnnnnnnnn

SEQ ID NO: 34036 - DNA, 2043 bp, Oryza sativa
  unsure (1)..(2043): unsure at all n locations
nnnnnnnnnnnnnnnnnnnnnnnnnnnnnnnnnnnngggtgaaccatctatgcagggatactgcctccgctcggctatctaatccgctaggtctatacccattcgagaagtacggttgtacgggggtcgtttcatgcttaacttcatggctcggtccttaattgaccggggacggtactagccttttccagataccacccaaatcctccgtccgccccagtcgaaaacagttgtttaattttatttctcctttcacaaatcatgtcatcaacatcatggcaatgtggcgctcatgtctccacgtgccgcatctcaattaccttcccaaaggtaattgcccaagcatatagcatttgataaatatgagtatgcatgattctagaatagcatttctaagcaattgtcataattgactagggactcatacgtaatcaggggtacaaggattttaagggtaaacaataatcaaggcacggcataatcacaagtaggacgttcatcattgcatgcaattttatttgtaaacaaaacaatttcgcaattaggatcaacatgttcaaggaatagtgataacttgccttgctcaaagtcttgcgggtcttggccttcacttggatccgcaactccctcgggctctatagttgcgtgcaaaattgatttgaattcggttagaattcaaataaaaatccaaataaatccaaatgaaagtcgaacgcgagagttgattctttttttttattaacattactatctgcgaactacggcaaacccaatttcgatttaaactattttgcgggtataattatttcgttgtcaataatttagtctccccgagcattgtatataataggttagaaatttctaccacgagctaaatattggacgaaatcctagaaatgctatacaatttaatttagtctatgattaaatgattaaatataatatacggctaaaatccctagtaattaaatccgaatttctaccgttaattgattacttacagggattacccagaaataatccataattatttacgagaattcatacatttgtttaattattaattacatctaaattaataccgcgaattgatttcttatggagagtactaaaaattatctataatctataggaattcatccaattatattttcattaatcctatatttaaatgctagtattttaggtatttaattagtaagatttcatctaattatattttcattaatcctataattaaattctaatatttgcaaatattttaaatttcccgtggagaggggagaggggaggaagggtgagatggggtgggggagaatggagagagaggggggggtatttgtagagaggggagaagcggcggggcttggggcggcgcgcggctcggtgtgacggcgatggcgacgcgatgatgacgcgatgcggcagcggcgcggggcgcgaggcggcgacgcgatggcgagcggggcgcggggcgcggggtgtgagacggcgcgcggggcgcaaggcgacgggacggggcgacagcggcgacacgacaggcgcgcggcgtggcgacgggacggtcgcgcggcgatggaataggcgggcgacgcggcgcgggacggcgatgcgcggtgacggctatgcgtcggatggcgtggcaacgggacgcgcgcgcggcggccggtgatggcgacgagcgggcggcgcggcgcggggctcggcgcggcttggcacggggctcggcgtggcgacgacggcgacgcgacgggcgagcggtgcggcagcgggatggcgatggggacggcttggcagcggcggcgcgcggctcggagcgacgatgggacgcgcgcggcgacgggacgggtggtgacggggcggcagcggtggcgcgcggcacgaggagggatgcgatggtgacgccgagcggcgcgcggcgcggcaggcgacagcggcacggcggcgggcggcgacggcgatggctcggggcacgaggcgcgcatggcaggggaggggaagggcctagggaacacggtcgagcacgtggcggccgatgaacag

SEQ ID NO: 34037 - DNA, 9636 bp, Oryza sativa
  unsure (1)..(9636): unsure at all n locations
atgcggcagcggcgcggggcgcgagtcgacaacgcgatggcgaacggggcgcggggcgcggggtgtgagccggcgcgcggggcgcaaggcgacggtacgggtcgacagcggcgacacgacagacgcgcggcgtggcgacgggacggtcgcgcggcgatggaatgggcgggcgacgcggcgcgggacggcgatgcgcggtgacggctatgcgtcggatggcgtggcaacgggacgggcgcgcggcggccggtgatggcgacgagcgggcggctcggcacggggctcggcgtggcgacgacggcgacgcgacgggcgagcggtgcggcagcgggatggcgatggggacggcttggcagcggcggcgcgcggctcggagcgacgatgggacgcgcgcggcgacgggacgggtggtgacggggcggcagcggtggtgcgcggcacgaggagggatgcgatggtgacggccgagcggcgcgcggcgcggcaggcgacagcggcacggcggcgggtggcgacggcgatggctcggggcgcgaggcgcgcatggcaggggaggggaaggggctagggaacacggtcgagcacgtggcggccgatgaacagtgccctttttccattaaaccgattttagagtatttcccatataaatttgatttcacaattcctaattttacatatatgcattttacttaatattcgtgttatcttaactaatgaattcaccctagattaatattactcatattttatttttatataatttatttgagctttaattagggttaattcttattccatcgcaatgaaatataattgatccaaatatggtcgcgataatattttatttattactatccacacctaatctttatttttaatttatatttattttaccaatttgtttttaaggtttatttctaattaactattctttactcacgattaataatcctcgagatcaactccagataaaatagacgaataagatcggcatgatgcaattagtttaaaaagtttttgaaaatccatatttttagagtttttgttttgtcggtcgaattttcagggtgttacaaacctaccccccttaaataaatctcgtcccgagatttcttaccagtcttcgaataggtgcgggtattccgtcctcaaaaattcttcactttcccaggtggcttcctcctcagtgtgattgctccattgtaccttgtacatacgccacactttgctcctagtcctctttgcggcttcatccaatatccggatcgggtgttctggatatgtgagatcattgctaatgtgaacctcttccagcggagcttgctcttccggcactcgtaaacatttctttagctgagacacatggaagactgggtgcacatccgcgatattctctggtaactgtaactgatatgcaacttctcctcgcctggcgatgatctggaatggtcccacatatcttggtgccagttttcctttgaccttaaacctttttgttcccctcatcggagaaacctttagataaatgtaatctccctccttaaattccaggtttcttcttcgggtgtcggcgtaactcttttgtcgtgattgtgctatttttagacggtcgcggatcaagcgaaccttttcttcggcctcttgaataatgtcaggtccaaataccgcccgttctcccgtctcggaccacattagcggggtacgacatcgtcgaccaaacaacgcctcgttgggtgacatctttaggcttgcttgaaagctgttgttgtaggagaattcggcgtagggcaaacatctctcccaatccttgctaaaatccagagcacaagccctcagcatgtcttccaggacctggttggttctctccgtctggccatctgtctgtggatgataagctgtgctaaatgcgagataacttcctagggcttcatggactttctcccagaaatgtgaggtaaattgtgtgccccgatcagatataattttctttggtacaccatgaagacatactatcctggtcatgtataactcggctagcttagcactgctataatttgtcttaacgggaatgaatctcgccgtcnnnnnnnnnnnnnnnnnnnnnnnnnaaatggaatcatatcctgttgcggttttgggcaatccaacaataaagtccatacctatctcatcccatttccattcgggaatcctgagaggttgcaacaaacctgccggcctctggtgttcagccttcaccttctggcatacgtcacagagtgctacgtattcggccacatctctcttcatgttgggccaccagtatccttccttcagatcttggtacatcttcgtacttccggggtgcaatgaatatgccgattcgtgagcttcctttaaaattaatcccctcagtccaccctgttcgggtacgtaaattctctttttataccatagaacatctttttcgtcggttgaaaattcctttgcacgtcctgcagctaagcgttccttcacctctcggacttcctcgttgtccttctgggcttcttctatttgggttctcaaaagaggttgaatgtccagggtgtttatctgtccacggggtactatatgtaggttcagctgagctatttcctccctaagctcagggaccatcccttccattctcagatgattgcaatggatcttacgactcagagcgtcggccacaacgtttgctttgcctgggtgataatgaacctctaaatcatagtccttgattaactctaaccatcgcctttgcctcaagttgagatctgactgggtgaagatatactttagactcttgtggtcagtgtagatatcgcaatggtttccaatcagataatgtctccaaatctttagcgcatgaaccacagctgcgagttctaggtcatgggtagggtagttttcctcatgtggtcgcaattgtcgcgacgcataggccaccacttttccgtcctgcatcagtactcctcctagtccttgcctcgacgcatcacaatatataacaaagtctttcctgatgtcgggaagaactaaaataggtgccgaggtcagcttttctttaagctgttcaaagctttcctgacattgttctgaccatacaaacttcttttccttcttgagtagttgtgtcatcggtcgggctatcttagagaacccttcaatgaaccttcggtagtatctagccaagcctagaaaactccgaatctcagtcacagatttgggtgctttccattccgtgacagcctccactttagcaggatccactgctactccaccggccgagattacgtggcctagaaaagcgacttcttttaaccagaactcgcacttgctgaattttgcatataacttatgcttccgaagtttctggagaaccaatcgtaagtgttccgcatgttcttcctcatctttggagtagatcagaatgtcatcaatgaataccaccacaaacttatccaagtattccatgaatactttgttcataagattcatgaagtatgctggggcattggttagaccaaacgacattactgtgaattcatacaacccatagcgtgttgaaaacgcggttttggggatatcctcggtcctaatcttcagttggtggtatcctgatcgaaggtctatctttgaaaacaccttagctcccttaagttggtcgaagaggttactcaatccgtggtagtggatacttatttttgatagttacttcgttcagtgatcggtagtctacacacattctcatgctaccgtctttctttttaacaaacaacacttgggctccccaaggtgacgaactggggcgtacaaatcccttctcttgcaactccctgatttgctttttaagttcttctaactcattgaccggcatccgatatggtctcttggatatgggggcagttccgggtatcaggtcaataatgaactctatgtcacgatctggtggcattccaggtaaatcttctgggaacacatcaggaaatcgctgcactattggcattccctttaggggtagcatggtaaatatacctccggcacgttcggttagcctaggatcttgatccatggttgctctcatatccgatccccagggtgtggtcagggtaacttctctacgtctacagtcaattactcctctatgctttgctaaccaatccatacccaaaatgacatcaagagtttggggtattagcaccataagattggagggaaataccacatccctaaggcggatgggtacgtcaatgcaagctgtatccactgctatctcacccccaggtgaatgtactaacattggttgtcttaatttaactctggttaaattgtgttgttgacttgctttcaaagatataaatgaatgcgatgctcctgaatcgaagagaactttaactggagtggagttgagtgaaaacatacccatcagtacgccttggtcttcctgggcctcttcagctcgaacatggttcacttgcccgcgtccaaatccggtagcggtcctgttagtctgcggagtcctgaatagacctcgtccagcagcaggggtagcagtaccgtgaatagccgttgcattagctccggtacgaatgggtgtcttgtttggatgaggacatttattagcgaaatgcccatactctccacagttgaagcagctccctggccttactgatccagtggcggcctgattcggtgtaggagcgcggttctgaatggtaaccggcctgtggaaattgctggaggcggcaggtcgactggttgtcaccactgttggtctccatgctgagggggttgtccctttagaacgctggggggcggtctgaggcgggcggttcatggcaagcctccttttacgattgtgctccactaccttccggtcgttctccagcctgacgaccttattgattaagctctggaaactatcgtggtcttgtccaatcatgggcccgcgtaactcgtcattcaagccttcaatgaatttgtcgatcttttcctcttcgtcggcaagatctctagttgcgtagcgcgccagctgagtgaaacggttcaggtactcttgtactgtggtattcccttgccgtagtttcctgaactcgttcttcttcatccgcatcaccgcggcaggcacaaagttgtcacggaaggctgtggtaaattcctcccagtttggttctccagcatcttcttctcgggcttctttgtacgtgtcccaccaatctccggctggtccttccaattggtttgccgcaaagatcaccttatcggcctcacgtactcgaacaagagttagcttcttctcaatgatccttaaccaatcttcagcatccataggttcttcagctgtggcgaatgtgggtggcttggtcctcataaactctccaaagcttgaccctccgcggttgccttggttgctcgcgatagcttgcagaagttgagtttgggtggccataattccggccagagtgtttaagtcgggtgtctgagtttcgtcattgctggttgttgcccgacgtcggcttgccatctgtgtaggttgatggagtaagcatcctaattttctaactagctcctatggctttatcccattaagggagttgtgtcgatatgaactttgtttcgcaagcatggtggaataaactcatttacaacacaacaacaatagatatcataaataacatcacagagtttcacaaatggtacataaatcatgatgcaattgactgcatatatacgcagtccaaataaggttcatccaaacgatacatcaaaccaatcatcaaactactcgtcaatctaggtaagggaagggggtgtctcgcatactatccaaaaaccatctgatacgagatcgaagctgcaaggagtccgtcagtctagtcctccagccatccgcaggatcccggggcaggtagagggtggtcgctggctcgcgcaaaccggagtccccactgctcaggggtagtggcctctggatctggcttaggcctcttgcccgggggtcgtgtgctcttgcgagcagtgctgagggtgcgagggcctccgaggaagctgatgcggggaacaggggtctcatcctctgaaggatcagtgatgtctggctcgatctcaggctcggcgtcggtcccctctgtctcggagtctatctggatcggagtctccaaaccgaaacccagctgcggagaaggtgtagggatcagtggagtgtgcaccaactccggaacaggtggctgtgccgctgtagggtccactaggtagggcgctgactcggtagctagcatactagcctctcccagaagagcgtggaacgccggtgggtacggcggggtgaggaagaagtagcggtcacggcctactgctgtggaagtagaagcccctgtagtgctgatcttggctgcttgaagctgctcctccagctagctgacgtgctcctgactctctctcagctgctcctcaagagtatccatcatcccgcggcgatcgttgtactggtcggataactgctggaactgatcgccgtggacctggagctgtgcctttagtgagtctatctcactgccccaagcctggtgctcctcctccaactgaagctgctgtgctgtgaggtcggtcacctcagtctctaactcccccacacgtctctggtggtcgtcaatctccaacagagcctcctcgtagtagtcatctactgcctcagcccatcgtgacaaccgtgtcaccatcgggttgtagcagcagggcatgtcctgaactgtgcaaactgagttgccctcctcccggaacgggtgatgagcaaactcggtactcactaactcagctcggtggatagagctgagtcggaggaagaccttccgggcggcatcctgcatcgcggtctctggcaggtctcggtggtgacgtgtctggaagctgtagtccaactcgaaagggactcgggggtgaatctcgacccgagccctcccaaactgagccacactgtctcactcggtatgacgggaacccagggtatcgcagacgcctcaacatccgatgcagctcaatgacatacccctctgattgaggtaagctcaactcccaggtagcgggtgaatccgaatctgccatctaattttaagaaaaacccaaggtcagttgagagtaaaacttgttttgtaaagggaatagttaagagtaagatgaaaagtgtaccgagttttgtaaacatagagtttttatttttgaaattattgctaaatgggaatttctcccttggccaacttagaaaaggggtggggcgccttttggtcttttcctacagtcgtatggctctgataccagctctgtggacccccgtttttataacaggaatcaatcgtgtaaacagtaccatttccctggatcaagtagtttggtacacacgaattcatagctgaaatatcaagtgcacatacacgagtgtctgatacgaattattacatcacaggcccgcatgcatagtcttaaatcatcggaccgagaggtccggaatacatccaaaagcagaaatagataaggcagcggaattcaggcagcggcatgccattgccacaggcaacgaccgtactaagacctactggacgccatcgtcttcatctccctcctgataataggcatagggatcctccgaggcttcatctcccacttctgataaattttatattcgcaaggatgagtaccaaccgtactcagcaagccaccacagcaacaatgcatatgaaagggggagttcaaaggatggccatagttcttttgcgcaaagcaagttttgtaattcttttcacaagcctaagacctagcattgactgatcaaattttagtaccagagtttgtatttaaacaacgacggttctgtccaccatccattgtgatcccaaggatagcttcccgccattgattcgtcatggttttctgaggatgtccaccttcccgcctctcaggaagtggctccaacagcataaaattcatcatgcaataacccctcccacacaagttaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacctgctccatgaacttaaatcctcatgcactctaggcgtccatgtttctagcagtgagaggagttctggcgctcccgggaaagagaagtctcacacacatattaaatttatggttcaagttaagttctctctcacacacactcatggcagtcctaccaatggcgacaccgatgtagggcacgcctcttggccctacctcaacggctgtcccatcgtagcgcacctgcctcactcaggggtgaaccatctatgcagggatactgcctccgctcggctatctaatccgctaggtctatacccattcgagaagtacggttgtacgggggtcgtttcatgcttaacttcatggctcggtccttaattgaccggggacggtactagccttttccagataccacccaaatcctccgtccgccccagtcgaaaacagttgtttaattttatttctcctttcacaaatcatgtcatcaacatcatggcaatgtggcgctcatgtctccacatgccgcatctcaattaccttcccaaaagtaattgcccaagcatatagcatttgataaatatgagtatgcatgattctagtatagcatttctaagcaattgtcataattgactagggactcatacgtaatcaggggtacaaggattttaagggtttctaagcaatcctcttttcttttcttttctttcttttcttttctttctctcctccctcccggcttctttctcccttcctctcctttctttttcctctttcttttcttttctttcttttcttttctttctctcctccctcccggcttctttctcccttcctctcctttcactccctcggtttctctctttctctctcggctctttgcctccccgggcggtgacggcgttgggcgcgaggtgaaagggggcggggaggacggctcaccggcggcggcggtggtggtgacgatggcgacggcggcgcaaggcggcgacgcacggcgcggcggctccggggcgacggcgcggcggcttctaaggtggcggcgcggcggcacgataacggcggcgcggcggcgtggaggcggcggctcagtggagaggggagaggggaggaagggtgaaatggggtgggggataatggagagagagggggggtatttgtagagaggggagaagcggcggggcttgggcggcgcgcggctcggtgtgacgcgatggcgacgcgatgatgacgcgatgcggcagcggcgcaggacgcgaggcggcgacgcgatggcgagcggggcgcggggcgcggggtgcgagacggcgcgcggggcgcaaggcgacgggacggggcgacagcggcgacacgacaggcgcgcggcgtggcgacgggacggtcgcgcggcgatggaataggcgggcgacgcggcgcgggacggcgatgcgcggtgacggctatg

SEQ ID NO: 34038 - DNA, 13298 bp, Oryza sativa
  unsure (1)..(13298): unsure at all n locations
ttaattagggttaattcttattccatcgcaatgaaatataattgatccccatatggtcgcgataatattttatttattactatccacacctaatctttatttttaatttatatttattttaccaatttgtttttaaggtttatttctaattaattattctttactcacgattaataatcctcgagatcaactccagataaaatagacgaataagatcggcatgatgcaattagtttaaaaagttgttgaaaatccgtatttttagagtttttgttttgtcggtcgaattttcagggtgttacaccaggtgatgcatgatgagatctgtcgaaacacctcccacctgatcagggccacaggcgaagatatcactgtttttcttgagtactctaggatgttcgcagcctcttcttcgcccatgtcgccccccagcgatacgagctttgtggggtcgacgtcatcaatctgcatcttgattatcttgtcgtgaggggcaggctttggcgcgtgcttcacccggtcatgttgttcggcctcaacattatgcactgctctattgattacggccagatcgccttttgaagcggccgaaggctgaagccccttcaccacgatcactcccaccgggccgggtatcttgagattgagataattgtggtgggagatagcttcgaacttgttcaaggtcgcacggccgaagatggcattgtagttgtatgggatgtcgacaacgtcgaacaatactcccttatcgactcccccggcctctggcgaatgccgagtagatgctgctacgtcttccgctcctcataggtgcctcgaaagttaagtacaaagacatcgcgcaattgctcccatgagtaaatgctattggcaggcaaattaaaataccaagaacgagcgatgtcgtctagagcaagatgtattaccttggccttggtattttcatcaccatgagccgcttcgatcgcggacttgtaaatagagaggaattcctttgggtcagtttcgactaagtagcgtgggacgggggggaacttgaattggggtgggattggacgggtcttgattccccactcagcggtagcccctttttgccccctgccgtgttcacggcaccttgctgtgggtacggcgtggcgaaaggagaaatcacggcttgcgcatgaggttgggccatgacattcggctgcccggctccgattggtgatgcttgctgacctgccatggatgagttgaacgttggctgggaccatgccatggcgacttggtttggtgcttggtttgctccgaagcctagcgttggtgcttgcggccgaacggttggtgcttgagcagtattgatgaagtcaaactgcggtccttgactccaaggcgaagcccccagacctggctgattcaacggcaaccaactaggcgcaccttgacttgtattcccctccaggtgggccgaaggggctgtacctgaaatgctgtggggttggctgagttgctgaaggaaagcttggagctgcacctgcagagccggttgagggtgtacttgggcaacgaccggctgagcttgcagttgcgcgtgaggggctggatgcaccgctgcgatcgagggctgcccggcgaagtatactggcgcttgcgtgacttgtggcggaatgtcgcgcccagaagttcttttccgtagcaaaactcaattaataaatggttggaagaaattatttgtttaaaggcaagagagaaaccctaaattaataaatgcaaataataatcggaatcggcatgtggaatttttcttgggttctacatgtcaaaatacgctaacaggatttttagtggaattttcagagcattggaaataattttaaccaattaaaaatgagcttgtgcaatatataaatcactggaaaatcctttcttctttttctttttcctccttttttctctcttcttgggccgtcggcccagtccgttcgcctcccgcgcgctcgccctcctctcagctgggccggcccactccctccctcctctctccgggtcaccgacaggtggggcccacctgtcggccccttcttcctcctccagccgacggcaccgccgccgccgaaaccgccaccgacgccgccggtttccccgtttcccgcgcccactccgccggtaccgcacgcccacgtcgccgcccaccttccccgtacctcccgccagctcgcgcgcccgcaaacggcgggggatttgaaatttcccccactctctctctcctcctccacttcccccacgtcgccggccaaatcggccacctttccggcctcgtccgcccctcccgagcccatataaacaatccctccactcccctccactttttcctctttccaccgctccctcccgtgccctctatcgcttccgcgccgctatacccgccgccgccgccttttccactcctccggccgccgctcgccgccgctggagccgctgccaagccaatccgccgccgttgttagcttcgccgccgccaaagctaccccggccgccgcatccccatccaatcccgccgtcggggcccgcttctccccgcgcgccggtgagtaccaccatagccgccgccgtcggccatggctctcgctcgtcgtggacaccttctctccatctaacctctctcacttcctctcttagggtgtcccggagcccgtccgcccgtcnnnnnnnnnnnnnnnnnnnnnnnnnnnnnnnnnnnnnnnnnnnnnnntatcctcccgcgccggccgaaccccggtgagaactccctccccttctcttcctctcacgcgcgccgccgctccccgcatgcgcgtcgccgcgaagcgccgtcgcccgcatcgccggccgccgccgtcggtggccgcttgccgccgccgccctcgccataaccggccggccggcttgaagccgagccggaccgaccgggcgcctcgccgcttcccccccttgtgacgctgcccagtgggcccacctgccagccgccccctctccctctcttagtgccgctgaccagtggggcccgcatgtcggcgccgccccacctcttgctgacgtcagccctggggcaatattgcgcaataaattgattaaggcttttcttttatagtaataaacacagataatcttctaaaaatcataactaattcatccgagctccgattaagtccattcaagtctcagtaaattcataaaaatgtatagaatccattaaaaatggttttgcttcctgtttcagtagtcttatagcatgttttgcttgtgtgctttgtttgtcgcgtagaattcggccgtttcgtcgattcgcggattctcgaagacgttgccgtggtctcatcagtgcgagagcaaggcaagtcatgcaatacaattgatcatattgtacccattttacaaatatcccgcatttctattaaatattgcattgttttacaatatcatgtgggataggtcctattactcagccatatattgtttaccttatgccattgataacgtgggtattcaaatgactagatgttggtttaggagatgcttagccatgcttagttcaactagtgcacaaagggggatcacattaaagcatagacttgattattggcatagctttgatttagtgccaccgtaatggtgttggttaattaaaatacacgtcatggtgggctgtgggtgcatggtcttgctagtcgcacccatggcatttaaggaccggttcgcgggatgccctggggggatcttatcgtacttaccacaagccagcgtgggcaacggctgggcttgtagtgtagcttttttctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatgcgaagggtcctgtcacggcctcttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtcccatcttaataaatcgactcaatacactgtagttcaggtgggttggttgggcctgttcaacgtggtgtagcgttgatcagtggagattcaatattactttaattactcaacagttttactgttttgctcaataaaatgttttacaaccgcctttatgcaaatagccacaaaccctccttgtatccccttgcacgtctgcatcgttggtgtggcttgctgagtacggtggttgtactcagtcttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgtgacacggaaggggctagatcggtgcttgtggatagacttggggtgggacgtagcctgccgaatactggaggattgaggccgaagcgaccttggaccgcctcgctgactcgtacgcctgctgttgttcttgcatctgacgaagcatgtcttggagtcatgtcatgttatgtcgcatggcttccatgtcggctttggtttgtgtttcggggtcagggttcacttgtacagcggcgagcgcagtcgaggccgctgccggctgcgacggagtggcttggggcaccagcagttggcttgtcgaaaggatctccgccctggtctagagtgcccttgccgtcgcggctgccttcgccatgtcaactatgttcggcacctacgcagaggcggcaggagccgaaggcggtactgatggcgcaggtgtggaggcagacagcgctcctccatcttcggcgatgggcgccgaaggctctctgctccctcttcggcggacatctcccccccggcttcgctttcctttcgccttgtaaccttctccttcacgaccctcttcggtggcattcgctctcagtggtttcgcttggaggtccccacggtcggcgccagctgttgtcgaaaggacaacggcatacgtcgaaagacgtggccactcaacagtagttggaaaagaagtaaagtgtataaaattgagaatttttcttcggatcccccattacatgaccctatgggaacatttatagccctcattactggttcttactactagggttttggttatacatgggaaattacatggttgcccttatgaaagggacatttatatgggtacatagtgtaatcgagattcatgggcccctgatgggccgtcgggcgatcatcggcccaatagcccctaggcttgatgggctggaaagacttcttcggtccttgcgggggcgaacttgctacggcgaagtcgtctcccttcggcatatactcttcgccctgcatccttcgcccaagaggccttatggcttggcaaggtacccatgtgattccccgcctcttgccgtcgttattccatagtcttcgccatggggggtcttcgccctgactaaccttgatgtctcgggcttgaatccccactgttcgcatggcttcggcaggtttggtcgaagggcctcatgccctatgggactatttatagccctcattgccataccgccaacaagcccctcacgggcaagggtgagattggagcttcggccgagaccgtgcaaaccatgtggtatggtatgtggcgccccctttcgaccgatgctcatgccgaaacctacattgttcctgcaaataaagtttattgtctatgtgacaggtattgttttgccgctcttcgcctcctgcggacgcgcgggcaggtgaagcttgcccctaggaagcggagggttcttgcttcctccgattccgatgacgtggacgacgtcgaagagtgtgatggcgaggaggaaggggaggaagaagaggaggcggaggccatggctgaaaaggccgcggacgaggcggtcgaaaaccgcgtcgacacccctagctacactcctactccaagtccgggacataacgagactggggtggaatcgaacagctccccccttcagaccgaggaaggatttggagggggcgaaggcgctagttgccttctcggcaggcaaggcggtgttaatgaccaaatttggtaatatcatcatcggaagtgaagatgagatcgaagcgcaatcagagataaggattgctgtgggaacagagtaagaatcggctgagtccagatcggctacgaccagaatcggctaaatccgaatcagactgggttaggtgatgcagccgattccgataatacgacttggtgtacaacatcgggttgagttgatatgcttcaagatgattgccgcacgtggatagagtcctgagaaggcaattgtatctattaattaggatattttatgtaatttccttagagatatgcttgggcaaaagtctgccgcaaagacttatggtatcttagagtttgttagagataatagtcgtgtccgttatggacatatcttgtaattctcgggtataaatagacccgagccctatgtaaaacacacacacacgttcaatacaatttcggcgcatcgccacctttttgctttagttttatttcgacgagttcttgcttttgggttgagctgcatcggttttgatcttcaacaagaggtaaaacttgttatgatggattgtgttctcgggattagtgcttccatctttacgacactctaatcttatttatgtaattcgtcaagttatcatatatcttacataatcttcgacaatatcgtcatctaacctacaatcggctaacatttgtcgacagaaggcagccgattaggttaaatagcgacgttgacctagattatataagatatctaccactttatgaaacatccggtggcttgattgtctagatattgttcttcctttcatacttaatgttgcgtcagttaagttcgatctattaagtcgtgcttagaatttcaatctctagcctgccttctggttgccgattagggtagtatcagagttttagccgatcttatctgatttaaccatatttgatctatatgcttcagtgacatgttaaatctgccctttatgtcaagatcttattgcattcaagtatattaacttttgtttggtatattatgcttgttttgatatctttatatagagtagtatcgaagtattagccgatacatgctagatcaatctgatcggctatgctataaacatatataatcctgttatttatatatatttcgatctaagtgatttatactatctcggcatggtgaccgatatatcccaatcacttgatttaagtatatattaatataagaactatatatcgttaatatctacagccgattggatagatttagttccttattgtctatttataaccgccgatcgattcacatatgacatcggctcaaagataaatgatatgtcatcggcacctagccgatcggctatcatttatagatttaaccacgaattctttgtctctatttcttgttgattacaggatcgaatcaactggcacgctcatacattcgaaggcgagctttggacttgcactggagttaagcagatctcccaggcctcgtgttttctatcaacacacttttggcacgcccggtgggaccatcaccacctcatggccgagaaaccaccaccacaaccatccccagctagcccaggctctgtcaaggaaaagatgcagaagttaggattgactgacgtcaatgaaggaaacgtcgtgccgatcgatccagaagaattcacacctgagcagaagaaagagtttgaagcaatgttgcagcaagcacgggatcagttcttgaactcattcatgcagacccgcaaggggacacttgttcagaagtacaaaataaaagtggttgctgatgatcctgggaccagttcttctaagaatggagacaggaaacaagcgccagacggctcggctcaaccgagtgacaaaggtgctaccgacggttctctaggaaatcagggtgacaattctcaaggagtccatgaagtgcaaggtaacggggtgcatggagttcaaggtgatggtgctcaggggttgcagggaggaaatcttaatcagaatagtgaggcggcacaagattttttcaataatttccaagaccgggttgactacgctgtgcatcatgctttgatcaatcagtatggggtgttagtcaataccttatcaaacatgatgaagtcaatagccgatagttcaatagctgagcatcaggctgcaggctcggtttatttgcaaggaggtgtctttccaaattgctgaccgatgttcagccatctattcaggcgattcccttcgttgcaccaacagctcagccaacggcaccggcatcaactcccctacctgctccgtcagcaatggcgccaggctagccggtgaaccctcggttgttaatgagagagcagccacagcatagtgggtaggttgcgaatcggctgacccaggatcaggttgctgccacgtttctgccacctcaacctgtttttgatccaatacaacatcagccgattcaacagacccccccaatccaacaggtcatgcaactagttcagcaaacaccaccaaggcagcagcctctgcagccgattcagcagatgccgttaagacagcaaatcgttcagccgattcagcaccaaggttcaataagcgcatcggcacaatttttaaatcaaattgtcacagaacacttggttcaccatgtacagccggatggcacagtaatgcctcaagttgttcttgaacacttagtacgccgaaccttcataattaccaagggggcaacttgaattatcaatatcagcctccttccccgcaagcccaatatcagccagggggactgactcaacctcagtttgcacctcaatacggttagttcgagcccttgcaacaacagtcacagggagcagctcagcaatgaccatgggccgatgtgattgctgatgtaatgagggaacagtttgggcttaaaccaaaagagactggaagcttgtatcggcaaccttaccctgactggtttgagaggattcctcttcccaatcggttcaaagttttagatttctccaagttttcggaacaagatggtgtgtcaacttatgagcacattagtcgattcttagctcagtgtggtgaagcatcggttgtagatgctctgaaggttagattgttccggttatctttgtctggatcggcttttacttggttttcttctttgctgtatgggtcgttcaatagttgggccgatttggagaagcaattccacagctatttctatagtggggttcatgagatgaaattatctgacttgaccgcaattaagcagcgtcatgatgaacctgtgcatgagtatattcagagattcagggagatgaggaacaaatgcttcagcttgagtttaactgatgcccagttagccgatctggcctttcagggtatgattgctccgatcagggagaaattctcgtctgaagactttgatagcttgtcacatctgatacataaggtaaccttggatgagcataggtctgcggaagttaggaaaaactataagaaggttaatcatgtttgtccgtacatgtatgggtcggatgatgatgaggatgattctgaaatagctgcagccgaatgggtgaggagtaaaaaggtcataccatgccaatgggtaaaaagttctggaaaagaggagaagtatgattttgtactaaagctgacaagatctttgatctgctactccgagagaagcaaattcaacttcctgctggtcatacaatcccatcagccgaggaattaggcaagaagaggtattgcaaatggcataattctggatcccattctactaatgatggcaaggtttttagacagcagattcaggtggtcattgagggaggcaagattaggtttgatgatttcaaaaagccgatgaaggtcgatggtaaccctttttctgttaatatggtacatacagctggccaaacagccgatagggtccgtgcaaagggttttcaggtgaatttggctaagattattaacaaatatcagatgaagtatgacaagcagcaggagaagcatcatgaagaatacgattatggttttgatcctcattggggttgtgagttctttagattctgctggaatgagggtatgagactgccatctattgaaaactgccctgggtgcagtgacatcatcgagagctcaagccgatcatataataggggcaatcggctaaggcagacaagagtttctgttcaccaaagattgggtccagtgaatcaagatcatggccatcaggacaatgtaatcagaaagaatcaatggtgtccttctggtattttcacgaagaatcaaaagagaagggttcaaagattgaggaacaaggagcgccttcaggaggtcgaacaagaaattaatcatcggctgaagaaagaaaagccgagacaggagtggcgtgttaagaatcaggttcctgtagccgatgatgttgcagccgatgaggcaaagaggttggcaaaagggaagagtgttgtgacggcaccggttaacatggtctttaccctgccagctgaattcgggatcgatcaagccgatgtcgacgaggtggaagaggaatcagctaagttggttctatcaccagaacaggcagtgttcgagaaacctaaggggacggagaatcggcatcttaaaccattgtatataaacggctatgtcaatgggaagctgatgtctaaaatgatggttgatgttggggccgcggtgaatttgatgccttttgctatgttcaggaagttgggtagaaatgccgagggtctcatcaagacaaatatggtgctcaaagattttggtggcaatccatcggaaaccaaaggtattctaaatgtggagctgacagtcggcagtaagactattcctaccacgttttttgtcaccgatgggaagggttcttacagcttgttgcttagaagggattggattcacgccaattgttgcattccttcaactatgcatcaatgtttgattcaatggcaaggcgacaagatagagatcgtgccagccgacaggtcagttaatgttgccagtgctgatttagctctttgggagatggatggccttgattgtttgtccggaaaagtttgggatggagattttctaaaagtgtccgattctgatatacagccaattgaagatggagaacccaagctattattttgagggcgtcgtagagggttcatgtctacactaaggacaccgtagatgatctcgatgacaagcaaggtcaaggtttcatgttggctgatgatttggaagaaatagatataggtccaggcgatcggccaaggccgacatttattagtaagaacttaactccagaatttagaactaagttgatagagctcttgaaggagtttagagatagcttcgcttgggagtattataagatgcctggactcagccaatcaattgtagaacatcggctacctatcaaaccaggggttaagccgcaccagcagcctccgagaagatgcaaagccgatatgcttcaacctgtcaaggctgagattaagcgtttatatgatgctggttttattcgtccttgccgatatgctgagtgggtttctagcatagttcctgttatcaagaagaacggcaagttgagggcatgcattgattttagagatctgaacaaagctacaccgaaggacgaatatccgatgctagtggccaatcagttggttgatgctgcgtcagggaacaaaattttaagttttatggctgaagaagatatccataaaacaacttttagatgtcctggtgcaatcggcttatttgagtgggttgttatgactttcggcttgaagagtgctagagctacatataaaagggccatgaattatatttatcatgatctgattggctggctggttgaggtctatattgatgatgtggttgttaaatctaaggaaataaaagaccacatagccgatttaagaaaagttttcgagaggaccaggaaatatggcttgaagatgaatctgacaaagtgtgcctttgttgtatcggctggccagttcttgggatttcttgtccatgagaggggaattgagataacttagagaagtatcaatgcgatcaaaaagattaagcccccggaaaacaagaccgaattgcaggagatgatcggcaagattaattttgttcgaaggtttatttctaatttgtccggaaagttagaaccttttacaccattgttgagattgaaggccgatcagcagtttacttgggggggcagaacaacaaaaagctttagataatatcaaagaatatcttagctctcctcctgttttgattcctccacagaaaggggtgccttttagattgtatctgtcggccggtgagaagtcaatcggctcagtcttgattctggagttggatggaaaagaacgagttgtattttatctcagttgtcggctcttggatgctgaaactaggtattcccctgtggagaagttatgcttgtgtttgtatttttcatgcacaagattgaggcattatctactatccaatgagtgtactgttatatgcaaggccgatgttgtcaaatacatgctatcggctccaatattgaaaggaagggttggaaagtggatattttccttaaccgagtttgatcttcggtatgagtcgccgaaggcgattaagggacaagctatagccgattttattgtgtgaacatcgtgatgattcaatcggctcggttgaaatagtgccatggactttattctttgatggatcggtgtgtactcatggtagtggtatcggcctagttataatttccctaggggggcatgtttcgagtttgcttatactattaaaccttatgcgactaataatcaagttgagtgtgaggcagtgctcaaagggttgcaattactcaaggaagttgaatccgatgctattcaaatcatgggggatcctatagagtccccctgcaggca

SEQ ID NO: 34039 - DNA, 467 bp, Oryza sativa
  unsure (1)..(467): unsure at all n locations
nnnnnnnnnnnnnnnnnnnnnnnnnnnnnnnnnnnnnnnnnnnnnnnnnnnnnnnctgggtgtgccaaaagcgtgttgacgtaaaacacgaggcctaggagatctgtttaactccagtgcaggtccaaaactcgccttcgggtatgctagtgtgccagttcatttgatcctgcaatcaacaagaaacaaagacaaagaaaccgcggttaaacctataaacgatagccgatcggctgagcgctgatgacatatcttttatctttgagccgatgtcatatatgtatcgatcggcagtcatgaataaataagaaggaactaaatctactcgaacgactgtagatattaacaatatatactccttatatcgatatatacttaaatcaagtgattgggatagatcgatcgccatgccgagacagtataaatcacttagatcgaaatatatattaataatgggactatatatg

SEQ ID NO: 34040 - DNA, 1475 bp, Oryza sativa
tcatctccctcagcacgcttgatgcagaagggttccaaatactccggttcaggtggaggttgtaaaggtatcgaaaggttttcttgtttacagtgattggtgatatgaattctgcaaacttatatgtctttagaggaagtccattacatggttctgttaccgctgctgctgtttctaaagatgaacctagtaagactaacctgtggcacatgcgtcttggacatatgagtgaacttggtatggcagtattgatgaagaggaacctgctagatggctgcactcagggtaacatgaagttctgtgagcactgtgtttttggtaagcacaaaagggtaaaattcaatacctcagttcatcgcaccaaaggtatacttgattatgtacatgctgatttatgggggccctctcgtaagccctctcttggtggtgctcgttatatgcttaccattattgatgattactctagaaaagtgtggccttatttcctgaaacattaagatgatacatttgctgcttttaaagagtggaaagtcatgatagaaaggcaaactgaaaaggaggtaaaagtacttcgcactgacaatggtggtaaattctgttcggatgcttttgatgattattgtaggaaggaaggcatcgttaggcatcacaccatcccgtacactccacagcagaatggtgtggctgagcgcatgaacagaaccatcatctccaaggctcgttgtatgctgtccaacacgcgcatgaacaaacgttttttggcagaggctgctaacaccgcctactacttaatcaacaagtcgccttctatctaacttaataagaaaactcccattgaggtatggattggtatgcctgctgattattcacaatttgagagtttttggagcactgcttatgctcatgttgataatggaaaattagagcctaaagctattaggtgtctgtttcttggttatggttcaggagtaaaaggatataagttatggaatcctgaaacctaataagaccttcatgagcaggagtgttgttttcaatgaatctgttatgtttaatgacagcttgcccacagatgtcatatgtcacaccccgaagttctcctcccaagcctaaaatttaatttataaatgaccctaagaaaatgccggtgcaaatcatgagaaaaccctaaggaagtaatacaaataataatcgaatctgacatgtggaatttttcttgagttctacatgtcgaaattcattaacaggatttttagtggaattttcagagccctagaaataattttgaccaattaaaattgagcacaagcaatatttaaatccctgaaaattcctttcttcctttttcttttttttctttttccttttcccttagtgggccgccggcccacttcccctcctctctcctcgcgccttgctgggccggccgcaggccatgccccagctcagcccgcgccccctcctctctcccgggg

SEQ ID NO: 34041 - DNA, 385 bp, Oryza sativa
tccgcctccaatacgggagccgggctccggagctagagcagaagctcaacgccgcccagggagtccttgacgccgccgctgtttgggaacggcgggcggcggaaaacgaggcggcgtcccggcagcgcgaaaaggcccttgaggctcgcgccacggcgccggatgagcgcgcccgcgccttggacgcgaaggagagagacctggcggaccgcgaggccgccgtcgccacccgggaggcaacactggcggcgcacgaagccgcctgcgccgaagaggagtccgcactccgcctccgagagaacgtgctcaccgagcgggggcgagctcttgaggaggcgaggccgcggcgcagcggctggcgaacagcctgttcctccgcgaggca

SEQ ID NO: 34042 - DNA, 1337 bp, Oryza sativa
  unsure (1)..(1337): unsure at all n locations
atgtttcagttcgccaggttgtctcttgcctgctcatggattcagcaggcagttcaaaaggttgacctatttgggaatctccggatctatgcttattttcaactccccgaagcatttcgtcgcttgctacgcccttcctcgtctctgggtacctaggtatccaccgcaagcctttcctcttttgaacctcgccattaacgttaaggctatgccatcctaaggtgctactaaatggaaggatcttatcaacgtccatgaatgcgaaatcatagatcgaactgccgaattggcaaaattcggtgctatcatagtatccgctaagttcacgggctggagataagcggactcgaaccgctgacatccgccacagggtaaaccaccgcctctcaggcctccccgacgggttctaccatagaggccaacgatagacaataactcccccccgaacacagcttacaactttcatcgtactgtgctctccaaagagcaactcttctcaaaatctcaaaacaaaaggtgctgagttggaatcccattctaaggattcttgtggttccggggaatccagctacaggagaaccaggaacggggagctctcccctttttccgcccgactctttgatcttaaacttaagaatgctggttttaagaacgagtgattgcccttctccgacccttactgcccaaccggagagcggacggctaatgtgttccacttattgaacagggtctatggtcggtccgtgacccctggacgccgaaggcgtccttggggtgatctcgtagttcctacggggtggagataatggggtcggtccatggattttccttccttttgccacatttcgctcaaagggttgaagggagatagtgcatcaagctattcgcaagggccaacttgatcctcttccccagggatcccagatgagggaagcctaggagagccgccgactccaactatcgtccatgtacgatccatactagatctgaccaactgcccatcctacctcctctacctttttgacagcccatctttttgtctcagtagagtctttcagtggcatgtttcagtcctcttccccattacttagaaaaagtgagccaccggttcaggtacaagatactccattaccgcctggacaattagacagccaacccgtaatcgcaacgacccaattgcaagagcggannnnnnnnnnnnnnnnnnnnnncccccgagccaagtggagtatgcatgaaagagtcagatgcttcttctattcttttccctggcgcagctgggccatcctggacttgaaccagagacctcgcccgtgaagttgcatgagctacttgca

SEQ ID NO: 34043 - DNA, 1645 bp, Oryza sativa
  unsure (1)..(1645): unsure at all n locations
ccatgtacgatccatactagatctgaccaactgcccatcctacctcctctacctttttgacagcccatctttttgtctcagtagagtctttcagtggcatgtttcagtcctcttccccattacttagaaaaagtgagccaccggttcaggtacaagatactaccattaccgcctggacaattagacagccaacccgtaatcgcaacgacccaattgcaagagcggannnnnnnnnnnnnnnnnnnnnncccccgagccaagtggagtatgcatgaaagagtcagatgcttcttctattcttttccctggcgcagctgggccatcctggacttgaaccagagacctcgcccgtgaagtaaatcatcgcccctacgatccaaccaattgggagagaatcaatagactccttttcgggagcgattcatccttcccgaacgcagcatacaactctccgttgtactgcgctcttcaagtgtgcttcttccccttctcccccttaccatggcaagtccttgggaaataactccgatgggcagaaaaaggaaggcgttaagagaccctcctggcccaaccctagacactctaagatcctttttcaaacctgctctgctcccatttcgagtcaagagatagataaatagccacatcccattgcactgatcgagggcgctcgtagtgacttagggagtcgaagaccaagaagtggcttatttataccaagcattcctcttatggctagatccaacctcctggtccctgcggaaaggaaaaagaatttcacgttcttcctttcaggaagggaggattagggaagtcctattgattgctgctttctccagaccgccgggaaaagcatgaaaaaaaggctcgaatggtacgatccctccgtcaccccagaatgaaagggtgatctcgtagttcttggtctgtgaagatgcgttgttaggtgctccattttcccattgaggacgaacctcaacctgtgctcgagagatagctctccatacactgataagggatgtatggattctcgagaagagaggagccgtagtgccccccccggaccgcccggatcccacgagtgaatagaaagttagatctacatgggatctcacctgaatcgccccatctatcctcctgaggagaagtttgtttggtttcaaactccgattcaaacaggaggagtacgccatgctaatgtgccttggatgatccacatcttcgggtcaggcgctgatgagcacattgaactatccatgtggctgagagccctcacagcccaggcacaacgacgcaattatcaggggcgcgctctaccactgagctaatagcccgtcgcgcgggcctccctttgggaggcctgctacgccaaaagcgagaaaaactccatccctttccttttgacatccccatgccgccacaccacacgggggggggcatggggacgtcaaaaaggggatcctatcactatcaactaatttgttccgacctaggataataagctcatgagcttggtcttacttcaccctaaacgaaagaagacttccatatccaagtttagctcagacgtagctgccttctttttgggcgtgaagcagtgtcaaaccaaaatacccaataagcataagcattagctctccctgaa

SEQ ID NO: 34044 - DNA, 1566 bp, Oryza sativa
  unsure (1)..(1566): unsure at all n locations
nnnnnnnnnnnnnnnnnnnnnnnnnnnnnnnnnnnnnnnnnnnnnnnnnnnnnnnnnnnnnnnntagtcttttttttagcttaactcaattcatgcatggttgcggaaaattcgcttggttggaaaacaaaatagttagaattgcgtatgaatatacaatctagagttgtagaagagagaataggctatattacggaattgccaaacaaagtatataggcattagggaggggcggagtcaggctagatctatatcctttatgtctataagttcagtcatcttttgtatgggtttccactttaaggaattttttttgaatccgattcaatagaaaatgagaaaatacacaaacaaaatagaagaaacaaattgatatgggatattatatattcccaagttagattcattatctaatccgatatatggaatcggattccatatccaattcgatgcagcatattgttatcaattggatatcttgatttaattcctattggatctggattaggtcgatttccataggggttcttcctctatttcaccttttattatgaattagatgataggggaaaaaatagaaactcaaggatatcgaagaggaaagaaagaaggatggaatgaaagatcagttggttggaaagaaagagaaatagaataatgagtacacaaacctctaatgattagaaactaaaaaggagatctcgaagcagttcggagaattcagattatcgtttcaatttgtactttttagttacttctgtccaatagagcttagaaatatgaatttcttggttgattgtatccttaaccatttcttttttttgacacgaggaactcatcatgaatccactaattgctgctgcttccgttattgctgctggattggccgtaggtcttgcttctattgggcctggagttggtcaaggtactgctgcaggacaagctgtagaaggtattgcgagacagccagaagcagaaggtaaaatacgcggtactttattgcttagtctagcttttatggaagctttaacaatttatggactagttgtggcactggcgcttttatttgcgaacccttttgtttaatcctaaaaaagaaaacgagtcctttagattagatactttcttctttttttagtaaattggtatttgcttctgcaattccaattatatcaatactttactcctaatttattactcctagagttttctatttatggggacagacaataccccaccccaggaatagctgatttgaggatgatcaatttagaggatatgttcgccgtcttgcttcccgccctttgtttagggcagtggaaagtatttttccttttattttaggaattttgggaacatttcaacaaaggaggtctttcacaggtcaaacgagatctaagacttaatctaaaagaaattactaaattgaatctatttctattaaaaaaaattgcattaaaaaaaccgatcaaaaagggcgagcgaagtaagtgatcgaaaaactttgttctttgttcgtcctatctataagaggagagcatatgaaaaatgtaacccattctttcg

SEQ ID NO: 34045 - DNA, 6141 bp, Oryza sativa
  unsure (1)..(6141): unsure at all n locations
ggcaaaagggggtactctttctacaactatattagtattagtaccaaatgctttaaacaggaaatagctaatgtagaatttatctgatatagaacactcatatcgataaaatggtttgaactatttactagaaggggcaccctgcccttttttatccaatgccgaatcgacgacctatgtataaaaaaggagaaagtttttggatttgaagaaaaaagtaggaattctatccattttcattttccatttttctatttagtttttcttaatgaaattgaaaattttaactaaagggcaaatacaaataaaaaaacaactttgctgcccacgatagatttttatctaggcggaagagtcctcttaatatttatctagtcttatatgggtttcggtatattgaaatataaacagaaaagagagggtagaggataggctcattacattaaaaaaaatatggaagtagccatagcaaaaaaagaaaaaagggagcgtgagagccaaatgaatcgaaagattcatgtttggttcgggaagagatcataaaagttgtaaacttaatagcaaggtaatctactttcattaaaagatttattagataatcgaaaacagaggatcttgagtactattcgaaattcggaagaattgcgtagaggaaccattgagcagctcgaaaaagctcgaattcgattacagaaagtcgaactagaagcggatgagtatcgaatgaatggatactctgagatagaacgagaaaaagcaaatttgattaatgccacttctattagtttggaacaattagaaaagtctaaaaacgaaaccctttattttgaaaaacaaagggcgatgaatcaggtccgacaacgggttttccaacaagccgtacaaggagctctaggaactctgaatagttgtttgaataccgagttacatttccgtacgattcgtgctaatattagcattctcggggccatggaatggaagagttaaattaattaggccttgaacttctactttcctttagaatttaggcattatttttccccttgcttccgaaaaaaaaatagtaaagaaacactaatggcaacccttcgagtcgacgaaattcataaaattctccgcgaacgtattgaacaatataatagaaaagtagggattgagaatatcggtcgcgtagttcaagtgggggatgggattgctcgtattataggtcttggtgaaataatgtcaggcgaattagtcgaatttgcagaagggactaggggtattgctctgaatttggaatccaaaaatgttgggattgtattaatgggcgatgggttgatgatacaagagggcagttttgtaaaagcaacaggaagaattgctcagatacccgtgagcgaggcttacttgggtcgtgttataaatgctctggctaaacctattgatgggagaggcgaaattgtagcttcggaatctcgcttaattgaatctcctgctccgggtataatttccaggcgttctgtatatgaaccccttcaaacggggcttattgctatcgattcgatgattcctattgggcgcggtcagcgagagttaattattggggacagacaaaccggcaaaacagcagtagctacagatacaattctcaatcaaaaagggcaagatgtaatatgtgtttatgtagctatcggtcaaagagcatcctccgtagctcaagtagtaactactttccatgaagagggggccatggaatacactattgtagtagctgaaatggcggattcccctgctacattacaatacctcgctccttatacgggagcagccctggctgagtattttatgtaccgcgaacggcatactttaataatttatgatgatctctccaaacaggcacaagcttatcgccaaatgtcccttctattaagaagaccccccggccgcgaagcttacccaggggatgttttttatttgcattcacgccttttagaaagagccgctaaattaaattctcttttaggggaaggaagtatgactgctttaccaatagttgagactcaatctggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagtaggatccgcggctcaaattaaagccatgaaacaagtagctggcaaatcaaaattggaattagctcaattcgcggagttacaagcctttgcacaattcgcctctgctctcgataaaacaagtcagaatcaattggcaaggggccgacgattacgagaattgcttaaacaatcccaagcaaatcctcttccagtggaagagcagatagctactatttatatcggaacaagaggatatcttgattccttagaaattggacaggtaaagaaatttctggatgagttacgtaaacacctaaaagatactaaacctcaattccaagaaattatatcttctagcaagacattcaccgaggaagcggaaatccttttgaaggaagctattcaggaacaactcgaacggttttcccttcaggaacaaacataaattttgcacgtctactcttgttagtagaagtagtagaggagaaatcgttgagaaagatttttcatttgaatcatgcaaaaaagttttcttagtttttagtatagttatttaaagaatagatagaaataagattgcgtccaataggatttgaacctataccaaaggtttagaagacctctgtcctatccattagacaatggacgcttttttcatattttcttctttcttttcattttttatcggaccaagagaaaaaactgttagaccaaaactcttttaggaaagaaaaacaaatgcatatacaaatgtatgatgcatatatcataaagaaggaatatggagcgggtagtggggaattaacccgcaaccccacggttatgagccttgtcagctaccaaactgttctatcctgttaaactaaagagaggggaactagtggataaaaggggggttgaatacgcccctctaccatatctatacaaatagaatagtccatttatacagaatggtaaagagggctcttctacgatcatcaattccagaaatccatacaaatacgaaagggtattttatccttaccaactggatcttgttgcacccggtaacaaacatgcataaaccatttctcgaagtatgtgtccggatagcccaaagtctcgatagttagctctaggtcttccggtcaaaaaacaacgtcgatgaaggcgtgtcggtgcactattacgtggcagggattgcaatttttctcgcattttcgttttttcactcaaactcaaagggtaaactttgcttcttatctttttttttgaagatcgacgaatcaaatgatatttctgttctaatttctgccgcttcctctctctctgaatcaaacttttttttgccataatgtgccgttcctactatctaccaagtatacggttctaatcctagatggaaaaataaatagaaaaagaaatctaagaaggcggatcctccccctccatcaagagtaatgaactaggtgctgatacagtacaacaaaattaactaaattaaccaaacttgcctgatgttgaggcaatcaagaaagcggcataagtgaatatataacccacggaaaagtgagctaatcccaccaatcttgcttgcacaatggaaagagccacgggcttatctctccagcgaattaaattagccaaaggtgtccgttcatgagcccatgctaaagtctcaattaattcctgccaatatccacgccaggaaattaagaacataaatccagtcgcccaaacaagatgtccaaataagaacatccacgcccataccgataaactattcatcccaaaaggattatatccattgataagttgtgaagagttcaaccataggtaatctcttaaccatcccatcaaataagtggaggattcattaaattgtgaaacgttgccctgccataatgtgatgtgtttccaatgccaataaaaagtaacccatccaatggtatttaacatccagaaaactgccaaataaaacgcgtcccaagcagaaatatcacaagtaccgccgcgaccagggccgtcgcaaggaaaactatatccaaaatcttttttatccggcattaatttggaaccgcgtgcatctaaagcaccctttactaaaatcaatgtagttgtatgcaaacctaaagcaatagcatgatgaaccaagaaatctccaggtcctattgttaagaaaagcgaattactattctcgttaacagcattcaaccatccgggtaaccatagggttcgacccgcattgaaagcgggaccgctcgttgaagataagagtatatcgaacccatatgtcgtcttaccatgagccgattgtatccattgagcaaatataggttcgatcaagatttgcttttctggagtaccaaaagcaagcatgacgtcattatgaacataaaggcccaaggtatggaatcctaggaagagactagcccaacttaaatgagatatgatagcttctttatggtctacattcttgccaatacattatcctcattctgttccggattgtaatctctaatgaaaaaaatagctccatgagcaaaagcccctgtcatgatgaaccctgcaatgtattggtgatgagtatataaagctgcttgagtagtaaagtcttgtgctatgaatgcataagaaggtaaagagtacatatgttgagctactaaggaagtaataacccctaaagaagctagagcaagacctaattgaaaatgaatcgaattattgattgtgtcgtaaaggcccttatgcccacgccctaatcgaccccccggaggagtatgtgcttctaaaagatctttgatactgtgcccaattccgaagttagttcgatacatatgaccggcaatgagaaaaataaatgcaatagctaaatgatgatgagcaatatcggtcagccacaaactttgtgtttgtggatggaatcccccaagaagagttagaatagcagttcccgctccttgagtggtaccaaataaatgattactcgaatcggggttttgggcataaagattccactgacccgtcagaaggggtcccaacccctgtggatagggtaatacatctaagaaattattccatcgaacgtactctcccctggatgctggaatagcgacatgaactaaatgtcctgtccaagccaaagaacttaccccgaaaagtcctgacaaatgatgattgagacgagattccgcgtttttgaaccacgaaaggcttggtttccatttgggttgtagatgtaaccaaccccctattaaggatagggtagaaagaaataatagaaaaagagctcctgtataaagatcttcattggtccgtaatccaattgtataccaccactgataaaccccagaataggcgatattcactggaccggcggcgcctcctcgagtaaaggcttccacagcgggttgaccaaaatgaggatcccaaatcgcatgagcaataggtcttacgtgtaaaggatcctgtatccatgattcaaaatttccttgccaagcgacatgaaacagatttccggacgtccatagaaagattattgctaattgcccaaagtgagaagcaaaaatgttctgataaagacgttcctcagtaatatcatcatgactttcgaaatcatgtgcggtagcaataccaaaccaaatacgacgagtagtggggtcctgagctaagccttggctaaacctgggaaatcttaattccataatgcctttcaaatcctcctagccactatcctactgcaataattctcgctaagaagaatgcccatgtgtggcaattccacccagaaggtaatgggttactcctacagcacgtccttgtataatgctcaaggctctaggctgagtagcaggagcaacttttaatttgttatgagcccaaacgatagattcaatcagttcttgccaataaccacggccgctgaataaaaacattaaactgaaggcccagacaaaatgagcacctaagaaaaaaagaccatatgcggataatgaagaaccataag

SEQ ID NO: 34046 - DNA, 698 bp, Oryza sativa
  unsure (1)..(698): unsure at all n locations
attcgcaataaaatatgggcacaatgaagaaggtcttatcaatgaaatttccatttatacgggatctaggcataattcccaacccattctatcattctatataaattcttttcattccttcacaaaataacataaaaaaaaacaaaatccattcaattcttataaatcgatccctatgctccaaatggataagagaggtatttctgctcagcccaaattctctctttttccttctgtttgaacaagaagagatagaaaatatttgactaagattggatttcattccactttcctatttcttttctcaacaacaacttctctcatcaactatttcgcattttcaaagtcattaatcgtcccataccctattttctatttgattgtatggggtaggataccttatgcaaacagaattctagggttccttttttatcgaataagaagaattcttccattctctttttctttggtttggggaaaacccaaactaaaacttttcgagggagcggaattcctagtaaaaaaatcctggacccgtccacttagatgaaaaggaatttttctatctaatagaacaatggaactctcgcgcggttgtggttgtacctgtactgcaggaataggaaaactcgctattcactcagttnnnnnnnnnnnnnnnnnnnnnnnnnnnnnnnnnnnnnnnnnnnnnnnnnnnn

SEQ ID NO: 34047 - DNA, 755 bp, Oryza sativa
  unsure (1)..(755): unsure at all n locations
nnnnnnnnnnnnnnnnnnnnnnnnnnnnnnnnnnnnnnccctttttccgcccgactctttgatcttaaacttaagaatgctggttttaagaacgagtgattgcccttctccgacccttactgcccaaccggagagcggacggctaatgtgttccacttattgaacagggtctatggtcggtccgtgacccctggacgccgaaggcgtccttggggtgatctcgtagttcctacggggtggagataatggggtcggtccatggattttccttccttttgccacatttcgctcaaagggttgaagggagatagtgcatcaagctattcgcaagggccaacttgatcctcttccccagggatcccagatgagggaagcctaggagagccgccgactccaactatcgtccatgtacgatccatactagatctgaccaactgcccatcctacctcctctacctttttgacagcccatctttttgtctcagtagagtctttcagtggcatgtttcagtcctcttccccattacttagaaaaagtgagccaccggttcaggtacaagatactaccattaccgcctggacaattagacagccaacccgtaatcgcaacgacccaattgcaagagcggannnnnnnnnnnnnnnnnnnnnncccccgagccaagtggagtatgcatgaaagagtcagatgcttcttctattcttttccctggcgcagctgggccatcctggacttgaaccagagacctcgcccg

SEQ ID NO: 34048 - DNA, 688 bp, Oryza sativa
  unsure (1)..(688): unsure at all n locations
nnnnnnnnnnnnnnnnnnnnnnnnnnnnnnnnnnnnnnnnnnnttcatcattccagtacaactgttgcagtagaatgacaacagattcgtgtatagggaactagattagcttagctacctatctaatttattgtagaaattccgggatctgtgattggacatggaaaatagaaatactttttcttgggtaaaggaacagatgactcgatcgatttctgtatcgatcatgatatacgtaataactcggacatctatttcaaatgcatatcccatttttgcgcagcaaggttatgaaaacccacgagaagcaactggacgaattgtatgtgccaattgccatttagcgaataagcctgtggatattgaagttccccaagcagtgcttcccgatactgtatttgaagcagttcttcgaattccttatgatatgcaactgaaacaagttcttgctaatgggaaaaagggagggttgaatgtgggtgctgttcttattttgcccgagggattcgaattagcgccgcccgaccgtatttctcctgagttgaaagaaaagataggaaatctctcttttcagagttatcgtcccaataaaaaaaatattcttgtgataggccctgttcccggtaagaaatatagtgaaatcgtctttcccattctttcccccgaccctgctatgaagaaagacgtt

SEQ ID NO: 34049 - DNA, 9334 bp, Oryza sativa
attgccgcgacaacggcctacttcttcacattcaccgagcaatgcatgcagttattgatagacagaaaaatcatggtatgcatttccgtgtattagctaaagcattgcgtatgtctgggggagatcatatccacgctggtacagtagtaggtaagttagaaggggaacgcgaaatgactttaggttttgttgattattgcgcgatgattttattgaaaaagatcgtgctcgcggtatctttttcactcaggactgggtatccatgccaggtgttataccggtggcttcagggggtattcatgtttggcatatgccagctctgaccgaaatctttggagatgattctgtattgcaatttggtggaggaactttaggacatccttggggtaatgcacctggtgcagcagctaatcgggtggctttagaagcctgtgtacaagctcgtaacgaagggcgcgatcttgctcgtgaaggtaatgaaattatccgatcagcttgcaaatggagtcctgaactagccgcagcttgtgaaatatggaaagcgatcaaattcgagttcgagccggtagataaactagatagctagactaagtggataaaattagatagaaaaaaggtctaaataaaaaagaagagaaatagaaagatcaaaaatcagttacgaaaatgcagtaattcttcttttttcttctaattgattgcaattaaactcggctcaatctgaaaaaagattgagccgagtttaaatagattttgatacgatcatgagacttgacaaatcgggattcctctattctatatatttagaagatataaaggtataatacaataaataaatacaaatagagtattatcatatgataatggaatcaaatacgcagtatttacagaaaaagttttcatttattgggaaagaatcaatgacatacaatgcattacagacgtatgatcattaccctttaaccgggttattctattccacttctagatagagaaaaaaactaaaggagaatgaatgaaaaaagacagagtttggaagttagacccctttctaagactctctttcaaaaaagaggacattttgaaacttttaacaggcacaatcgtgagtcaacaagtgactcgaaatgctcgtaagaaaagagaattgattttcaaaatggtagaactagatgacgaagttttctataaccttgatgaagaggtagttttagtttacgactccgatcaagagcgagaagtctttcatttcagattggactgctatagaatctggacccatcgtagagacgttcaaaaggctcctgatgataagaatcatactttcgcggaactccatggggctatgggcttcaacgcggtagacgttttgttccgaatttttctggagcaaacctccgacccaacgatacaatgaattttttctattcacaaagaaaaaagattcggaatcgcaatgctactatacgcacccggaggaatattcggaattatattcttatataatccatttttgcgcggggtcttactaacaggacttcgctgcacgagacgaggattcgtcgaaaagctaaggtcatccggtattttcataccctttgggggtggtatatggccttacaaagtctaaggggtagtatgagatctgtagtaggtaaaagaatttgtcccttgattgagtatgctattttccctcctttaccgcgcattattgtatatgcttctagaagagcacgtatgcagagaggaaattacagtttaataaaaaagcctaaaaaagtttcaactttacggcaatatcaatcaactaaaagtcctatgtatcaatccttacagcggatttgtggggtccgagagtggttgaataagtattgcatgtggaaggaagtagacgaaaaagattttggattcgaaataggcgcattcgactaagtcgtactttgaatccaatttcaagttcgattagaaggatagaaaggccgcgaggatcggaaaagaaaaatcaaatctttttaattgcttctccttttttgctattttcttattatttatataatccattcgattctttttttttagaatactttttttttagaatactaaagtattctaaaaaaaaagtattctataaaaaatctttttttgcaaactcaaaaatacaatagtcaatattcgttataatagatatacttaattatatcataagaatcttaagatattttttgaatagatcaaatcgaatagatagaaatagtaaatttgaatggagacacctattctatgatggattttaacttaccctctattttcgtgcctttagtaggcttagtatttccggcaattgcaatggcttctttatttctttatgtgcagaaaaataagattgtctagaaccgacgggaccgaattttctcaatgtatttccacacaggatcataatacggatcttttgtagtgtaagtaatataatatggtatgttatgtggctctttctacacacaaatgcaaacccgctatggatggggattatggatgcggatataggctacgagcataaatgcatgcatatgcggaaccgggtatagcgagtttttttaagtggatcaacaaatactttttgaatagaaagtcaatgtatctaaccaattattttacaggagtatctagttggcgaaggcgatttcagaatcaaaaaaagtaaagtcaaaatcatttagcttattctctcaatttcaatcgaccgctgttagtatatctaatatgaattggcgatcagaacacatatggatagaacttctaaaaggttctcgaaaaagaggtaattttttctgggcctgtattctttttctaggttcactaggattcttagcggttggggcttccagttatcttggtaagaatattatatctgtacttccatctcaacaaattcttttttttccacagggggtcgtgatgtctttctacggaatcgcaggcctattcattagcgcttacttgtggtgcactattttgtggaatgtaggcagtggttatgaccgattcgatagaaaagagggagtagtgtgcatttttcgttggggattccctggaataaaacgtcgcgtcttccttcgattccttatgcgggatatccaatcaattagaattcaggttaaagaaggtctttttcctcgtcgtatcctttatatggaaatccggggccagggggccattcccttgactcgtactgatgagaagttttttactccacgagaaattgaacaaaaagctgccgaattggcttatttcttgcgcataccaatggaagtattttgagtaccaattgaattttttgaaatgaattgaatgaagaagaattggaagaagaaaagttttctcaacacgagggaaaaggtcccttcgaaattgcattattgtaaggggattttgagtatttatctaaaggaaggaacaaatgaggataagagaaaattgcttctaatttgtccaagtgggatatatggcgtaatattcttccattttcatccgaaaggacttttttctatttctctattccactccatctagatctaagaaagaactcaatgcaatgaaattctactagtatagaaaaaagaggaatagatacaaggtctcaaaccttgttatagaatttttccttcaaagaaaaagaaatatcatatagagtcagcgaataaagcggattcattaacaactcaatttacagatcaaaaatgaaaaaaaagaaagcattgccttctttcctatatcttgtatttatcgtacttttgccttggggagtctctttctcttttaacaaatgtctggaactttggattaagaattggtggaataccaggcaatcccaaactctcttaactgctattcaagagaaaagagttctagaaagattcatggaattagaagacctttttatcttggacgaaatgataaaagagaaaccgaatacacatgtacaaaacccccctataggaatacgcaaggaaataatacaattggccaaaatagataatgagggtcatctccatatcattttgcatttctcgacaaatataatctgtttggctattctaagtggttctttttttctgggtaaagaggaacttgttattttgaattcttgggttcaggaattcttctataacttaaatgactcagtaaaagctttttttattcttttagttactgatttttttgttggatttcactccacccgcggttgggaactactaattcgttgggtctataacgatcttggatgggttcctaacgagctaattttcactatttttgtttgtagttttcctgtgattctagatacatgtttgaaattttgggtctttttttgtttaaaccgcctatctccttcgcttgtagtcatttatcattcaattagtgaagcataaactcatttgatctcctgatattaatcaaaattagcatcctttttcctttagaaagaaagcctttttccattttagcaaaattctttttttctatttctacctgctcaaggtattcatcattccagtacaactgttgcagtagaatgacaacagattcgtgtatagggaactagattagcttagctacctatctaatttattgtagaaattccgggatctgtgattggacatggaaaatagaaatactttttcttgggtaaaggaacagatgactcgatcgatttctgtatcgatcatgatatacgtaataactcggacatctatttcaaatgcatatcccatttttgcgcagcaaggttatgaaaacccacgagaagcaactggacgaattgtatgtgccaattgccatttagcgaataagcctgtggatattgaagttccccaagcagtgcttcccgatactgtatttgaagcagttcttcgaattccttatgatatgcaactgaaacaagttcttgctaatgggaaaaagggagggttgaatgtgggtgctgttcttattttgcccgagggattcgaattagcgccgcccgaccgtatttctcctgagttgaaagaaaagataggaaatctctcttttcagagttatcgtcccaataaaaaaaatattcttgtgataggccctgttcccggtaagaaatatagtgaaatcgtctttcccattctttcccccgaccctgctatgaagaaagacgttcatttcttaaaatatcccatatatgtggggggaaaccgagaaggggacagatctatcctgatggtagcaagagtaacaatacggtctataatgcaacgtcaacaggtgtagtaagaaaaatactgcgtaaagaaaaggggggatatgaaatatccatagtcgatgcatcggatggacgccaagtgattgatcttatacctcccggtccagaacttcttgtttcagagggggaatcgatcaagcttgatcaaccattaacaagtaatcctaatgtgggagggtttggtcagggggatgcagaaatagtgcttcaggatccattacgcgttcaaggccttttgttcttcttcgcatccgttattttggcacaagtttttttggttctcaaaaagaaacagtttgaaaaggttcaattgtacgaaatgaatttctaggtcccgggatttcttaccatcaagttggtaaaaagccgcgatttattggcgattgctagaattctctatgatccattttggaaatcttttttttgtttagactattttttgtttgcgagatgtcttgtctgcaattccttatttctatcatctcatgcaaaacgaggagaatgcaaggcaagggcgagaacaataaaaggaacaaatccttttaggagggattgctggtcttcttaatcctctattgggcacaagaaaaaggcttttttgcctttttcttgtgtcgattcttcttgtatcgaaatatgaatcttttttcttcctattcggcaaagattactatttcttctttatttgggtctgtctcttgaacctcttttgcttaggttcaggcgatgtagtggacaaaaagagggaaagaaaatatggcgtgggacaaattttttgtgaccaaatagaattgcttgacttgttcaattaagttcaatttagaacttacagaaattttgcaaaaaaaacggatactcttccattgaaggctgttttttatttttaggctagttgagtagttttaattaaggttttattagtttattactctaaattaaatcaatgatttacaagagacttcctccggggaataaaatattggatcctcgattgatcctttctttctcctcgcttcataaaagtgaattaatttcattggcgagggggttataaatcaactgatggattacttcactaacattattaacaaacaaaattaacaaacaaaacgaataaatagagggattctgaccatcagagcaaaggctttctctttgttatttttacaaatcaaaataggaaacccgtttgtaggttatggaatagattaaaaaagtcgggttataagagtaagaattccgcgggtcctttccgctctaatcagataaaagggggtaaggacccgctaagttcctattttttcatgtttacaacctggtccctccaattactatagagatgaacccaatccagaatatgaaccgtaaaagaaaacacctattaaaccaatcacagcaataccggttacagtacctatcagccaaagaggaattcttccagtagtatcggccatttcccctactttcctccacattttatcaagtggtcatgctagagacaaaaacagtcatggatagttataaggatggtatccttccaaatggggataagagaattcttactactctctttctttctctcaattgaagaagtaattggaaaataaaacagcaagtacaaaaatgagtaataaaccccagtatagactggtacgattcaattcaacattttgttcattcgggtttgattgtgtcatagttctatagttggaatttggtttatcgttggatgaactgcattgctgatattgatcccaagaaaaaaacagtaggtacagctagtccgtgaacagccagccatcgcactgtaaaaataggataggttcgatctatggtcattgagggcctcctaaaaggatctactaaattcatcgagttgttctaaagaatcaaaacggtcggttattaacggaattccttgtcggctttctgtgaaatactcgtttggccgaggacttccaaacacgtcataagctaaacccgtactgacaaataaccaacccgcaatgaatagggaaggtatagtaatgctatgaataacccagtatcgaatatggtaataatatcagcaaaagaacgttctcccgtgcttccagacatgctgagctccccaaatttttgtacattcaaaaaaggaattgattccgtaaaagatgggatcaaccagtaaatagaaaattactgatatttcatccttgtgagattgtcaattttgtaccaaaggtgtattttgagtataccaaattagtatagctatccttcctatggcacagcaatcctgtttcgcttggtctcgaaacagaattctttttttctcttctttgttccttgtctatagggtaagctatatggtattcaaggcatcaatagaaaacctcaattttgagggtcctacttaattttcaccggcttcggaatagtagaataattcggaatagggctcaagatcttgggaaaatctaagttaatgatcaacaggtttggataaagaatttaggaaagatattcttatactgacacaatacaaagagaagtagatgcgaaagctatcccttcgaatccaacctttccccttaaagaatttaattggttagcataatataatatctaataaatagaaaatcaaatagtagataatctgttatgaaagagagaaaacattctttgaagaatcaagattcgtaatcaacccttgccttgtttactaactttcttgaccaaactgcaagcgtggaactttgccagttcttaggtttccgaaatagtgtaatggaaaaagaagtgcttcgaatcgactttgattggggttcgaaaaaggaattaaaaaaaagtaaattcaggaaagatttcctttttttaggagaccctcgaggggtcgtggaatgcttttcttctcctcttattccatatggaatacaatcaattaaaataagaaggaataggggaatattcgactgttcgctccaaaaagaaggttaaatcatcctattgaaaaagaccaaaatagaaagaactttttcaaattcaattctttatttttcactggggttagctgatctagttcttaatatttttactttactcaattgacagattacacagcaaatctcttgattcggaattagggactcatgccccatctgatgaatccattttcttttacacttctgtatctcactctatcttgttttttagtattatctaaaataaccgatgaattatgaattttccataacttaggtaagtgctttaccaacatatgtagtgtagtaaaaaaaatggaatttaaccctttcatgcttactataactagttatttcggttttctattggctgctttaactctaaccctagctctatttattggcttgaacaagatacgtcttatttgaaatgaattgaatgaataaggcagaaaagaaaaaatctctcttttggattcctggtattctacgcactaattaccaattctttttttcttggtcattgagattcgtggataatttagactactatttagggataaatcgtacctcttttttttatcccctcgaacaaatcgaaatgattgaagtttttctatttggaatcgtcttaggcctaattcctattactttagcgggattattcgtgactgcgtatttgcaatacagacgtggggatcagttggatctttgattgagtaatatttcttttttgattgccctcctctctggtctggaggaggtcaaattggaattgcaatttgttttgttaagttattttgccctgcttcgacataagatagatggaatcacgctctgtaggatttgaacctacgacatcgggttttggagacccgcgttctccgaactgaactaagagcgctttcaaaaatcaaatccttttctactcctaatgtgtctcacgtacgtatagtatccacaaattcaagttatacccgctttaatcgacctcctcactactgcctataaagaagaaagaagtaataggtagggatgacaggatttgaacctgtgacattttgtacccaaaacaaacgcg

SEQ ID NO: 34050 - DNA, 3383 bp, Oryza sativa
  unsure (1)..(3383): unsure at all n locations
atatatctaaatccaatctaatttcacctataaaagaaagattactattccttggtaatctataggaagggattgtctttttcgtttttagttcggaatttcgcctaaacaaaagaaatacaaatgatcttgggcaataatatctgatcatatacgtattccaataaggaaggaggattttcaatgcgggatataaaaacatatctctctgtagcacccgtgctaagtactctatggtttggggctttagcaggtttattgatagaaattaatcgtttatttccagatgctttgtcattcccctttttttcattctagttgttgctatgtgaggaatagagttcttcgtgacatgataaaaaattcccacttttcaatccctttttagtataggaaagaaaaagaaagaaaagatagattgggttggaccttagagtcatgaaaaatttggtaaatctcatttttgaaaaaagaaattcaattaaaagcagtatccaagctaagtcaggcctcagaaatcagagcatagaaagaggctgggttggctactaaaatgaaaggattttgcttcaaaatccttgctaatttgacaaggattgtattccttaattatttctctattttttattacttaattgaaaaatttccaaaaatttttattctaatggattttcttcttcctcttcggtttcaaaatagaggaataaaagaataagtagaagaattaagttaagtcaatccaaaaaggaaaggaggttcatggccaaggggaaagatgttagaatcagagttattttgcaatgtgtgagttgtgttcgaaaaggggccaatgaggagtcggcagggatttctagatatagtactcaaaagaatcgccacaatacacccggacaattagaattaagaaaattttgtcgttattgtcgtaagcatacgattcatgccgaaataaagaaataggagcatcttgtgttcgatctttccaaagatcaaaaagaataagaacttcctatttaatatatagagcatagatagaatacaaaatacaaatcaacttgtctgatttccattagatattatttcatatgtatcgagggtattcatctaatatatggaccaaagagagactatttcttctggatccaaaattaataaaataaacaaatcaatttttttttcaattttaaaataaggaataaatcatgtatacatctaaacaaccctttcataaatccaaacaaacttttcataaatccaagcaaacttttcgtaaatccaagcaaacttttcgtaaattcaaacaaccttttcgcaaacccaaacaaccttttcgtaggcgtcctcggattggcccgggggatcgaattgattatagaaacatgagtttaattaatcgatttattagtgaacaaggaaaaatattatcgagacgaataaatagattaaccttgaaacaacaacgattaattactcttgctataaaacaggctcgtattttatctttcttaccatttcgtaactatgagaatgagaaacaatttcaagcccagtcaatttcaataattacaggtcctagacccagaaaaaatagacatattcctccattaacacaaaagttcaattccaatcgaaacttaagaaactccaaccagactttaagaaacaacaatcggaacttaagttccgattgttgatgttttattcgaaagggccagactatatataaagaaagtaatccaatttagattcttgggtttgttataagaaagaacaatggggaagaaaaaatagtttttttatttattgcaacatgctcgttgattcctaccacttaatcttaatttattgtatcttcccggagttacctctccgggaattcttttttaattattcctgtatattacttttttatccctttaattgataatctttattttattggaaatcgtgtaaagattatttgaatttaatacagctacttgtgcaaggattttacgattaagaatcaattctttcttgtaaagattgtgtattaatttactataattatcgaatactttatgtatccgcgttgctgcgtttatccgactgatccacaaacgccgaaaatccctcttttgcctgactctatctcgatgagaggaaacaaacgctcttcttacctgttgagtaatcattcgattaagtcttaaatgagcccctctaaagtttgaggcaaatgaacgcatttttgcccgtcgtctccgagctatatatcctcgcggaactctggtcattgaatcaaattaaccttaatgaataactaatgatttctcttcttttagccatcctttttcccattaataacaaaacgaattattcccatatataaaatattagttccaatggcttttgctactataaccttcccaaccacaattttctcttctactcccttcagttatttcgcacgatactaaaaaatagtgggttccatcgtttctatggttcccttttaaacggcgaggccctctctatacaccggagccctttctttcatttcatcaaagggtattgtgaacttgtatagttcacattctttggctctacctatccattatagagtaaatagctcttttcacaataagagttatccatacagtgacggcatttaattatgaaagttggctaagtagctgaccctcttagtccgtttttttaagataaaggagcataagcctttatctttttattactatttcctccgcttaatgaatagccgtttgctaccaatgggggaattgcttcttatttccaatctagatgattggatttgcaccaaaggaaaccagaaattccatataccgtagaaatctaggatagagaagctctatcctattcattggtaccgatcatggatacttcaaaaattgtcttatttgtttgaacccatgatccgaacgagtcgcacatacaccctagcacatgttcctcgacgctgaggacatcccttaagcgcggccgattttctagcatttcgtattggctgtcttgcgtttctaataagttgtttaaccgttggcatgtcgtatgtatatagaaaaaatggattggtttagatcgatcttaacctgaatgattgatcattatgaagtatttccattaaattgcataaaacccgaatttagggttgaaataaatttacaagaaatatggccactaccaatccttaaacatttctggaaaccacactggatcagtatcgcagtgctcgtcaagcatttcatcccctacaatatcgacaagtccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34051 - DNA, 861 bp, Oryza sativa
  unsure (1)..(861): unsure at all n locations
nnnnnnnnnnnnnnnnnnnnnnnnnnnnnnnnnnnnnnnnnnnnnnnnnnnnnnnnnnnnnnnnnnnnnnnncgggcaatttggcgaagaaaaaactagtcggataaataacagaattaaaacaaatacaggttaaactaagtatattaggcataacaagcgtttcgttcttgtagagtagataattggattttgattgagttatttttctaagggaaaaaggaaaaggaggattcaaaatccttttttcttcggactttcccaaacacaaaatacctccttgtattcgcactctcaaatgagagtggaagaaattcgactttcatataatatcttaatagaattccatgtaatgatcaatgcattttttggattctatattattcgcatgtctagaatcctaccaagagaataccccccatttttatgtaattgaagtaggattgacgaataagaaataaacataatactgtttattagtgtcgcataaaacccgaaatggggcgtggccaagtggtaaggcagcgggttttggtcccgttactcggagnnnnnnnnnnnnngttcgaatccttccgtcccagattttttctgatgaaacgaaagatgaaatcgtattgtattctgcacgagacataaaggttattaaagagaatttttttctcttataaactcttaaattcgatgcagtcctaatgcgttcattttctgtctcaaaaaacataatccagtgtcaagtccagtcaaattgaaaatctttttttcatgaaaaaattttaaacttgacgtaaaacattgtataaaaaacgagacctattcctttatggtagagatagatttatgatagaaataaaatttttt

SEQ ID NO: 34052 - DNA, 3729 bp, Oryza sativa
tccgtcccagattttttctgatgaaacgaaagatgaaatcgtattgtattctgcacgagacataaagtttattaaagagaatttttttctcttataaactcttagattcgatgcagtcctaatgcgttcattttctgtctcagaaaacataatccagtgtcaagtccagtcaaattgaaaatctttttttcatgaaaaaattttaaacttgacgtagaacattgtataaaaaacgagacctattcctttatggtagagatagatttatgatagagataaattttttttatagtattttattagtaaaaaaggttccttcttctttttctttctttggttaagcaaaaacgatctcgatccgcgattttttaaatatccagaatgatccatcccggtaaagataagataagaactgctcgttagatagaatggattcaattttgatttggagttgcttcttttaggtaaaagaaaaaataagtaaaagcaaagaccttaattttactttacaggaaatgcgttttttttacttcatttttttctttcttttggtattcgagtcgaagaaatacgagaattctataactaccaaaaaactttcttttcattgcaatagtttaactagttaatagttaattagttttgttacggaaaaatggtatggaaaaatagattgctaatctaatatattaattaaattaattaaacgggaggttgatagtttatttgttggagaagagtcaattcttctcttatcatttcaggattggattgatcatctcgagtcctctgttgaggatggaaattccataataaataagtcttaagcaaacttgtttattcccttttttcgaactatatttcattcatatgatagaatatgggtttaaataaattggctctttgcggagtctttcccgataaatacttaatttcttttattcatatttctccatagatagcaaagcaagtttgaattagtatacaaaaaacgaaactaatgactattcatgattccatccatattggatcaattccctataacactttgcaatgaaattagaggaatgttatgttaaaacttcgtttaaaacgatgtggtagaaagcaacgtgcgacttgaaggacacgatcgattgtggattttgctatccaccattttccatagtaatgaaaatgctcttggctcgacatagtctgttctattcgtcccgaaccgaattttcgctgggttgtttgtaagtaagctaagtaaatagtacacgatggagctcgagaggacagaatttattttttatcaagggaaagaatctagggttagtgaaaactaataaattaggccaactttgtcattctacccttaatatagaaatcgaaataatatagaaatcaaaaggttaaaataagaagaaagtccaattttggaagatatgggaaaactcttttgattaaaagtctatcagaatcaatcgctcatattcgatttctatagaagagggaaatgctttatcgaaggaaataagaaaaaagggtatgttgctactcttttgaaagaaaaaagaataagaattcccgaagtaatgtttaaacccaaggatttcacaaatcaaagataaaggattcccgaacaagtaaacacgattttcaactgtctcaacaatagaattggaccggaataaggaataaaagtgaatttgttcgagatgaggcaaagaaaagagtttagagacgactcaaaaaatttcaaaggatttttttctttcaagtctgtcaatcaaaattagtcaacttgagtcatgagtataaatgaaatttgttttttctgtacggaaattaatgcaagtcatattctcgagccgtatgaggagaaaacctcctatacgtttctagggggggctttgtttatctacatctatcccaataagctgtctatcgaatcgttgcaattgatgttcgatctcgaagagaaggaagagatcttcgaaaagtaggtttttatgatccgataaagaatcaaacttgtttaaatgttccagctattctctatttccttgaaaaaggtgctcaacctacaagaaccgtttctgatattttaaggaaggcggaattctttaaagaaaaagaaagaactttgagttaattgaagaactaaatgaataaaaaactaggagaggctcactagtatcccttgttgtctaactatttagaaataatttgcctctttcttaatcctatttttgactggatttatgtcgtgccaatccaacataagcctttatttttttgagtttttctatctaatttttttcttaccattgtatttccattgacaaaggtccattgaacatctagaatttgtagatggataagtctctttatcctcactccctattaggttttttgcctacactttgctcaaatggtagggttgtccctcttgtttgtactctcatacaagatttatttatttatttaaataaaaatgctaaaaaaatgacaattttacgatcgtgattggtgccacttttaaccttagtgaaatttaaccagacccgttccttttggtatctgagtgttttcaatggtgataaaatctttcttttaatgtcttgctattttaagattttgacaggggtgtgcggtgtaattccattgatttttggatttcgatcgtatctaagatcctagtttatctgggttgctaactcaatggtagagtactcggcttttaagtgcgactatgatcttttacacatttggatgaagcaaaaaattcgtccagactcttggtagagtctataagaccgcgactgatcctcaagggtaatgaatggaaaaaatagcatgtcgtaataaaatcaatttcttattttggatttttggaatggaataaaaaaattctgattttctgggtctaatgaataaatggatagagcctggctccaattctggtaaaacaaaaagcaacgagcttaacttcttaattggaagaactccctgatctaattagacgttaaaaatagattagtgcctgatgtagggaaaagctggttttcctatgagtagacctttgattttttcttttttttttagaaatcctaattattcttgattttggattgaaaaggatgttatggattgaatgtgtaaaagaagcagtatattgataaagagactgtatcccaaagtcaaaagagcaattggcctgcaaaaataaaggatttgttctcttttgtaattagaacaaacataaacaaattggatagaaaaggagcggaaaaagatccgtggattagactccttttcttccccaggggtttgtattaaaaaatgcaacaccctgttctgaccatattgtactatgtatcaccatttgataaaccgagaaatatttctctctctctgattcaagtagaaatacaaatggaaaaattcgagggttattcagaaaaacttaaatttcctagacaatatttcgtctacccactactctttcaggagtacatttatgtgtttgcccatgattatggattaaatggttccgaacttgtcgaaattattggttctaataacaagaaatttagttcactacttgtgaaacggttaatgattcgaatgtatcagcagaatttttggattaatttggttaatcatcctaaccaagatcgattattggattacaacaattttttttattctgagttttattctcagattctatctgagggg

SEQ ID NO: 34053 - DNA, 7189 bp, Oryza sativa
  unsure (1)..(7189): unsure at all n locations
cccatgattatggattaaatggttccgaacttgtcgaaattattggttctaataacaagaaatttagttcactacttgtgaaacggttaatgattcgaatgtatcagcagaatttttggattaatttggttaatcatcctaaccaagatcgattattggattacaacaattttttttattctgagttttattctcagattctatctgaggggtttgcgatcgttgtagaaatcccattctcgctacgagaacagtcttgtccggaagaaaaagaaataccaaagtttcagaatttacgatctattcattcaatatttccttttttagaagacaaatttttgcacttacattatctagcacatatagaaataccctatcctatccatttggatatcttgcttcaactccttcaataccggatccaagatgttccatccttgcatttattgcgattctttctcaactactactcgaattggaatagttttattacttcaatgaaatccatttttattttgaaaaaagaaaataaaagactatttcggttcctatataactcttatgtatcagaatatgaatttttcttgttggttcttcgtaaacaatcttcttgcttgcgattaacttcttccggaacctttctggaacgaatcatcttttctaggaagatggaacattttgggttaatgtaccctgctttttttcggaaaaccatatggttcgttatggatccccttatgcattatgttcgatatcaaggaaaggcaattcttgcatcaaaaggaactcttcttttgaagaagaaatggaaatgttaccttgtccgtttgtggcaatattctttctctttttggactcaaccgcaaaggatccatctaaaccaattagaaaactcttgcttcgattttctggggtacttttcaagtgtaccaataaattctttgttagtaaggaatcaaatgctggagaattcatttctaatagatactcaaatgaaaaaattcgataccaaagtccctgttactcctctcattggatctttagcaaaagcccaattttgtactggatcgggggatcctataagtaaaccaatttggaccgatttatcggattgggatattcttgatcggtttggtcggatatgtagaaatctttttcattatcacagtggatcttcaaaaaagaagactttgtatcgactaaagtatatacttcgactttcatgcgctagaactttagctcgtaaacataaaagcacggtacgagcttttatgcaatggttgggttcggtatttttagaagaattttttacggaagaagagcaagttttttctttgatgttcgccaaaacaacttacttttctttccgtggatcgcacagtgagcgtatttggtatttggatattctccgtatcaatgatctggtgaatcctcttaattaatcattaaacaaaactaataaactagaaatgattgataaatgatcaaggtaaaactttcacagtttccattctgaaatgttctctgtactataataaatagtaagtgaatcaacttactactaaaaaaattagtagacttcctcttcggaatagaaatagcctatttctacatagggaaagtcgtgtgcaatgaaaaatgcaagcacgatttggggagaggttttttctctattgtaacaaggaataattatctactccatccgactagttccgggttcgagtcccgggcaacccatatggaaactagaaaggagcaatctgagttttgatttttcactcacttcatttacaaaattttttggtttggtaaattttgttgtatggatatacaactgtcggggctggcttggttgacattggtatatagtctatattatactgttaaataacaagccttctattatctttctagttaatacgtgtgcttgggagtccttgcaatttgaataaaccaagatcttaccatgactgcaattttagagagacgcgaaagtacaagcctgtggggtcgcttctgcaactggataactagcaccgaaaaccgtctttacatcggatggttcggtgttttgatgatccctaccttattgaccgcaacttctgtatttattatcgccttcatcgctgcccctccagtagatattgatggtattcgtgagcctgtttctggttctttactttacggaaacaatattatctctggtgccattattcctacttctgcggcgatcggattgcacttttacccaatttgggaagctgcatctgttgatgagtggttatacaatggtggtccttatgagctaattgttctacacttcttacttggtgtagcttgttatatgggtcgtgagtgggaactgagtttccgtctgggtatgcgtccttggattgctgttgcatattcagctcctgttgcagctgctactgctgttttcttgatttaccctattggtcaaggaagtttctctgatggtatgcctttaggaatatctggtactttcaactttatgattgtattccaggcagagcataacatccttatgcatccatttcacatgttaggtgtagctggtgtattcggcggttccctattcagtgctatgcatggttccttggtaacctctagtttgatcagggaaaccactgaaaacgaatctgctaatgagggttacagatttggtcaagaggaagaaacttataatattgtggccgctcatggttattttggccgattaatcttccaatatgctagttttaacaactctcgttctttacacttcttcttggctgcttggcctgtagtagggatttggttcactgctttaggtattagtactatggctttcaatctaaacggattcaatttcaaccaatctgtagttgatagccaaggtcgcgttattaatacttgggctgatatcatcaaccgtgctaatcttggtatggaagtaatgcacgaacgtaatgctcacaacttccctctagacctagctgctcttgaagttccatctcttaatggataaggcttttctgctaacatatagcaatttttgaagaaaggaaagctagaaatacccaatatcttgctgaagcaagatattgggtatttcttttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcccattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagacccggctctacccaaacttttttggttcaccccaacattacccacttgtccgactgttgctaagcagttttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctctcaaaaaaccccttcccaaactgtacaagcttcttccaaagcatacggctttctagatgtatatgacgatctctagacagatggatcttatatgaatcgtatgatgaagtaccacatgagtggatatataggaaaggaatccaaatctgccgaatcgctcatgttatgatcttctacatcctaggtctccgcgttccgtcatctggcttatgttcttcatgtagcattcagatcgaatgactctatgaaattacgtcgatacttctacatattatgggtaacgtaggagacatccctattttcccccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaattacgacctttaccacaacggtgccgtccatggatcaaattatttcgtggattggatttcacttgcctatctatggttcccttgcgtgtgctcgggataggtgttttgtataaatgtttcgccgtattattaagtattctcctttagtttttttctctatctagaagtggaatagaataacccggttgaagggtaatgatcatacgtctgtaatgcattgtatgtcctagaatagggcccattcttctaccctttccgggtagtcgatggctattcacagctactaccttaacaccaaagaagagttcgacccaatgctttatttctgtcttagtgaatcccgattcgacattaaaagtatattgattctttcccaataaacgaagacttttttctgtaaatactgcgtatttgattccatccataaatcgactttccctcctatgctctgagttccagtatcgataagaattcgagttcttattgttcttatgttatggtatgaatataccataccaattcgttatgtatggatgatggatgagattccatggatagagagccagttccaatagacttatggaacgttccggttcgcgtgcatccagcaggaattgaacccgcaaatttaccaattatgagttgggcgctttaaccattcagccatggatgcttaacagggatcatcgtacatcgtaaataaccaattttcatatagaaagacatatcatagaaaaatgaaatcgaaaatattcggagatggcaaatattcggagatgactatgaaaacacctctctggatcctcgaattgaaagagagattgagagggatccagaatcctaattctcgctatttggaatggatccaattctattgagtctgactcatagtgatcatttctctttagcaaagaatgaccttggttatcaaaggattgaacaaccgggatccgtttacttatgatacctagttgacattgataacaaggatctaatgaattatgagtttaatagatcctctttagcagaaagacgtatattccttgctcatcacttattcccaaacctcgtatggggctaatcgttttcatttaccatctcagggaaaatccttttcgttccgcttagccctatcgggtattttagtgataggttctataggaactggacgatcctatttggtcaaatacctaatgaaaaattcctattttcctttcattaaggtacgagggcttcttattccacaagaaaagaacgaaagcaccttttcattctttcatatactgggggtttttacttggaaaagacaatgttccatactaaaggattcgggtccataaccacgagttccagtgcactagatcttgtagcacttagcaacgaggccctatgaatagacatatagaatttttggtcgggaaattcgaatgaatcattgagtgaaaaaggagcaaagaatgacaaaagacgagactctactagtcttcactcttgtggtttcctcggtttctgttttcttattcgggatcttgcttttcatggttctcatctctgcaactcgcgattttcgcgagagaaccaaatccaagttggtgaagatcatgatttgggctggcatagtagtgattacctttgcaattgcggttcgaatctatccgatctttatctttttgctcaaagaacgaataaaaccccttgtcgaagccctttatgataagcttccctggatctgggaagtttctctttcacggtattgggatcgtttgatcgatttccttgatcgctacttatgggcgtgcgctcaaaggatacaaacagggattcgcaaacaaaaaggggaattcgtagtcactttttcctgtcgcgtaaaaaaaaggctttacgcgagagcaatagaggttgggatacatctatctcttctgagcaacctcttttggattcttaagaccacccttgcagtaggataccgtctgctttgggttctttattatattatctccttcgagggatttttaggatcgttcaggctatatttagtctattttggcttttactgtctccttttctnnnnnnnnnnnnnnnnnnnnnnnnnnnnnnnnnnnnnnnnnnnnnnnnnnnnnnnnnnnnnnnnnn

SEQ ID NO: 34054 - DNA, 6781 bp, Oryza sativa
aaaccccttgtcgaggccctttatgataagcttccctggatctgggaagtttctctttcacggtattgggatcgtttgatcgatttccttgatcgctacttatgggcgtgcgctcaaaggatacaaacagggattcgcaaacaaaaaggggaattcgtagtcactttttcctgtcgcgtaaaaaaaaggctttacgcgagagcaatagaggttgggatacatctatctcttctgagcaacctcttttggattcttaagaccacccttgcagtaggataccgtctgctttgggttctttattatattatctccttcgagggatttttaggatcgttcaggctatatttagtctattttggcttttactgtctccttttctcagggaagtggttaaggacctcagaagatagaggagagcgccaggcgcagatttccggaatacttctacggggaatgctcattgaatgcgcattctccgtattatgccttgaagaggactcgaacctccacgctctttagcacgagattttgagtctcgcgtgtctaccatttcaccatcaaggcatcttgaaagtgaatcatattccatgaatatgatatctatctaatgtgatatcttgaaagtgaatcgtattccatgaatatgatatctatctaatgtgatatatggaatatatgacaaaggtggagtcttggagtatttcgatcgatcggtcatataggcctgagtcagacatcaaatagcttcgatttgcattatccgtaggacaccttatatgtatcaaaatcaaaaagatgtacaatccaatttctcgattcaatagaagcccaaagaggtgcatatggtacccaaataaggataggatagatatgtcaaaagcaggtctgattacacctattcctaatcctaaatagaatgtaaggacgtggggatttctatgtaaacagagtatcctatttccataggctcgaatgaccccttctcataataagaatgtgcacggtctggtccggtatggaatgaacttataatctgatgatcgagtcgattccatgattataagttcattaccctagcgcccattcccattttgggcggaacagatctactaattcttttattccagttagtaagagggatcttgaactaagaaatagacctagcagctaaaagagggtatcctgagcaattgcaagaatggggttcattgatattcctggtatagtagatgctatcacacatacagtcatactcaattcgatggaattgtttgatcttaaaggggatcttctataatttcgcacataaggggttatttcttggtttcgtccagtcattaataacttgactatttttagataatagtagatagaaagaacgctcgtaaggagtcctattgaaaccaagaaatataggcctgcttgccatccacaccagaatagatagagttttccgaagaaacctgctagtggaggaaggcctcctagggataagagacatagggctaaagagagagccaaaaaaggatctttcgtgtataatcctgcataatctcgaatgttatcagttccggtacgtagaccaaataatacaatgcaagcaaaagttcctagattcatggagatatagaaaagcatataagttatcatgcttgcatatccatcatttgagtctccaacaattattccaataattacatatccgatttgccctatggacgaatatgcaagcatacgtttcatgcttgtttgagtaatagcaaggagattccccaatatcatgctaagaatagctaggatttccagaagaagatgccattcgtttgatgagaaataaaaaggaatatcgagaattcgcgtggctgaagctgaagcagcaactttcgaagtaacagaaagaaaagcaacgactggagtgggggagtcagagtcgaaaagaggattcctcgcttctttctctcatgcaaaaccgtgcatgagactttcatctcgcacggctcctaagtgataaaagaaagaagaacttgtcttctttcttttttgattaccttcctcgcgtatgtataagaccgaatccattctttttcgaaatcgatttcgaaaaagaactactaatccttaacttttcgaggaatccttcatcagtggttgtgaatgactgactttttcaatcctttcgaccttggttccgtaggagcaagtcagaaaggttgagaaatagaaccatctgatttgattcgttcccaatagccatgagatgatcatcttagggtgatccttttgtcaacggatgctcctattacactcgtagtctctgaaggatgagaacccactatgtagcatctacgtcgataattcaagcattgtatacgtcattagtccgattctttgtaggaactacccgtaataacgagcttgcaaaatggatctgtttatcataaagagattcgttgttcctgaccctgcttcaccttaattgttatttgaacaaaaagatcacaataaacttttggtaaaagttctgtcttggtcggagtggggatagcatttctcttctgcatatctatggagttttgcaaaacccaaacacctcagagatagatatagaggtaggaatttgtcgaacgaaccacactccttcgtagacgtcaggagtccattgatgaaaaggggctggggaaagcttgaacccaagtcctacagtgatggatataagcgcaattgaaattcctggggagttatacatttgtgtattgataagaccgttcacaatttcttgaagctcgatctcccccccagatgaaccatatagccaagagaaaccatgaaccagaatagaagagcttgccccacccatgagtaaatatttcatagtagcctcattagaccgtagatctctcttggtatatccagacaataggtaggaacataaactgaaacattctggagctacaaagatagttattaaatcgttagcaccacataaaaacattccccctagagtagctgttaatacgaataacagaaactctgttatagccatttctgtacattcaatgtactctacggatagaggaatacataaagttgaacataataaaataagaaattgaaagatttcgttgaaattgttcgtttggaaatttcccgaaaagctaattataggttcttctctccatcggaacaatagggccgttatgcttattactaaacttgttgaagagatgaaatagaaccaaggtctatctttttgatcagaggttaaatcgatcatcagaagaagaattaggccaaaaattaggatacattctgggaaaatgaaacttccctggaagagaagcaaatgaaacgctttcataaaaattctcgtagaatcgagaatgaagttttcattctgtacatgccagatcatgaattagtaactgcatccaatctccgaaaagtcccgattgtttcgatttttggaatgggatatttacggaatccccatgaataggatcaaaccttattccatgctatttccataagattcctctttcttattcttaagcaagcccccgagagggcttagttgatcatgatttctgttttctctttcttttcctttttgtttgtttcgagaaagatatcgtccgattctccttctattgattcttttccgatcgagatgtatggatccatgtgtctacatacctagattctgttcatggattaacgaaaatgtgcaagagctctatttgcctctgccattctatgagtcgcttcctttttgcgtatggcacccccaccccctttggcagcatctactaattcggaacttaatttgaaagccatatttcgacccggacgcttttgggatgcttctaataaccaacgaatggcaagtgctcttccttgtttagatcctatttcaatcggaactttccgcgtcgatccttttttattacgtcttgtttttactcctatattgggagttactctacgtattgcttgacgtaaaaccaatagtggatttgtttctgtcttttgttgaatctttttcacggctcgatagagaatttgataagccaatgatttttttccgtctttcataatacggttaaccaccatgttaactaatcgattacgaaaaattggatcggattttgcagttcttttttctgcagtacctcgacgtgacatgagcgtgaaagaggttcaagaatccgttttctttttataagggctaaaaacgaatcacttatttttttggctttttgaccccatattgtagggtggatctcgaaagataggaaagatctccctccaagccgtacatacaactttcatcgaatacggctttccacagaattctatagggatctatgagatcgagtatggaattcagtttactcacttaaaattgagtatccgtttccctccttttcccgctaggatcggaaatcctgtattttccatatccataccatcaagtccttaggtttccgaaatagtgtaatggaaaaagaagtgcttcgaatcattgctatttgactcggacctgttctgaaaaagtcgaggtatttcgaattgtttgttgacacggacaaagtaagggaaaacccctgaaagaatttccatattgaccttggacatataagagttccgaatcgaatctctttagaaagaagatcttttgtctcatggtagcctgctccagtccccttacgaaactttcgttattgggttagccatacacttcacatgtttctagcgattcacatggcatcatcaaatgatacaagtcttggataagaatctacaacgcactagaacgcccttgttgacgattctttactgcgacagcatctagggctcctcgaataatgcgatatctcacaccgggtaaatccttaacccttcctcctcttactaatactacagaatgttcttgtaaattatggccaataccaggtatataagcagtgatttcaaatccagaggttaatcgtactctggcaactttacgtaaggcagagttgggttttttggggttgatagtggaaaagtcgacagataagtcacccttcctgtccctctacagaaccgtacatgagattttcacctcatacggctcctcgttcaattctttcgaagggatccttttcctcgttcgagagtctccgcccttcttccactccgtcccgaagactaactaagaccaattgagtcacgttttcatgttctaattgaacactttccatttatgattaaaggagaagattgttcttttaccaaacatatgcggatcaaatcacgtcttataataagaagaaatctttctcggtatcaatccccttgcccctcattctttgagaatcagaaggatccttttcgagtttccatttcttcatttggaatctgggctcttctatcttcgacttattttttttttgctttattctttatttatttcatttcgatttttccctcttcctctatccctatcctctaggtacagcgtttgcatcaatagagaaccttttcctctgtatgaatctatattattccattccaatttcttcccgaaacttcccaagaaaaatcccgaattggatccaaaattgacgggttaatgtgagcttatccatgcggttaggcactcttcaaataggaatccattttctaactggctttcgtgctttggtgagtcgtccgagatcctttcgatgacctatgttgtgttgaagggatatctatatgatccgatcgattgcataagacccgcggtagcaatagaacggggaaagtatacagaaaagacagttcttttcaatttcgattatctatatattagttcgtttctatttctagatatctatttctatatattagtattagttagtagtactattctattagttagcgatcccggctctgtgagttctttcttccgtgatgaactgtcggcaccagtcctccattttttctctgtggaccgaggagaaagggggctcagcaggaagaggattgtaccatgagagaagcacagaggtcaaccctcttcaaatatggaacatggattctggcaatgcaacgtagttgggtcctcatatcgatccgaatgaatcagtctttctacagaggtcaatctttgcctattaggcaagaggatagcaagttcgaaattctgtctcggtaggacatggatttctattactatgaaattcataaatgaaaatgaagtagttaatgggagggctaccattatcctttttcttgtatgtgttcctaagagaaggaatttgtccatttcatgtttcgaggtctcaaaaaagggcgtggaaacagatagaaactcttgaatggaaattgaaaagaaatgtagccccagttccttcggaaatggtaagatctttggcgcaagaagaaggggcgacccatatcatcttgacttggttctgcttcccctctttttttaagaataccgagtcgggttcttctcctaccagtatcgaatagaacatgctgaacaagatcttcttcatggaaacctgctcgatttagatcgggaaaatcgtacagattttatgaaaccatgtgctatggctcgaatccatagtcaatcctattttcgataggaccggttgacaattgaatccaatttttcccattatttgactatccataatagtgtggaaagaaagcccggaggaagggtggccttgagtttctcgcccctttgccttaggattcgttaattcttttctcgaggggacggggaagggatataactcagcgg

SEQ ID NO: 34055 - DNA, 956 bp, Oryza sativa
ttccttattcttttattaataagaaagggctatgtatcatatttatacttaatgctccccaattctaccagaaatactctaagaatttgttaagagtaaattctttgaactgattcatccatagccttaggtcagaacccctttttgactctgtacccttgattctactatgattattcatcaatagtagaataattccttcatagaaataggagacataatttacatggatatagtaagtctcgcttgggctgctttaatggtagtctttacattttctctttcactagtagtatgggggaggagtggactctagggatactactaattgattgagtagtcgaattgttgtatcaactcttttctttaattgaccgttttgcattaatcattttgccgaactttattctttctctctttctttaattttgtttcactcctgtaagaaactcttgtaagaaagagtctttctattctttctatttctatttctatatagtagaatagaaatagaaagaatagaaaatagaaatagaaagagcggtgagagcaattcataatcgctactagaagcgacccatggttaaaaaagttctatacataagaactttagattttcttccgcggagctattcccaacatatcgcacattttccatttgttttatattcttttcttattcttagttcttaaaataaattttatgctcttttgaaacatttcgcgacatgtttaagcatgaaagattcgctggttttttccttttactttttttcttttactatagtctattctcatattatttttctctccctccatggattttttcattttgacttgattgaaattaagtggatgcagtgaaaaaagaaattgaattagactactatttcaatctagtaatctattctatgtagattcaagataatataatagaaagactctaaagtgtggta

SEQ ID NO: 34056 - DNA, 517 bp, Oryza sativa
aatagtactcaagatcctctgttttcgattatctaataaatcttttaatgaaagtagattaccttgctattaagtttacaacttttatgatctcttcccgaaccaaacatgaatctttcgattcatttggctctcacgctcccttttttctttttttgctatggctacttccatattttttttaatgtaatgagcctatcctctaccctctcttttctgtttatatttcaatataccgaaacccatataagactagataaatattaagaggactcttccgcctagataaaaatctatcgtgggcagcaaagttgtttttttatttgtatttgccctttagttaaaattttcaatttcattaagaaaaactaaatagaaaaatggaaaatgaaaatggatagaattcctacttttttcttcaaatccaaaaactttctccttttttatacataggtcgtcgattcggcattggataaaaaagggcagggtgccccttctagtaaatagttcaaaccat

SEQ ID NO: 34057 - DNA, 1000 bp, Oryza sativa
ggcgaaggcgatttcagaatcaaaaaaagtaaagtcaaaatcatttagcttattctctcaatttcaatcgaccgctgttagtatatctaatatgaattggcgatcagaacacatatggatagaacttctaaaaggttctcgaaaaagaggtaattttttctgggcctgtattctttttctaggttcactaggattcttagcggttggggcttccagttatcttggtaagaatattatatctgtacttccatctcaacaaattcttttttttccacagggggtcgtgatgtctttctacggaatcgcaggcctattcattagcgcttacttgtggtgcactattttgtggaatgtaggcagtggttatgaccgattcgatagaaaagagggagtagtgtgcatttttcgttggggattccctggaataaaacgtcgcgtcttccttcgattccttatgcgggatatccaatcaattagaattcaggttaaagaaggtctttttcctcgtcgtatcctttatatggaaatccggggccagggggccattcccttgactcgtactgatgagaagttttttactccacgagaaattgaacaaaaagctgccgaattggcttatttcttgcgcataccaatggaagtattttgagtgccaattgaattttttgaaatgaattgaatgaagaagaattggaagaagaaaagttttctcaacacgagggaaaaggtcccttcgaaattgcattattgtaaggggattttgagtatttatctaaaggaaggagcaaatgaggataagagaaaattgcttctaatttgtccaagtgggatatatggcgtaatattcttccattttcatccgaaaggacttttttctatttctctattccactccatctagatctaagaaagaactcaatgcaatgaaattctactagtatagaaaaaagaggaatagatacaaggtctcaaaccttgttatagaatttttccttcaaag

SEQ ID NO: 34058 - DNA, 942 bp, Oryza sativa
  unsure (1)..(942): unsure at all n locations
nnnnnnnnnnnnnnnnnnnnnnnnnnnnnnnnnnnnnnaggagacatccctattttcccccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaattacgacctttaccacaacggtgccgtccatggatcaaattatttcgtggattggatttcacttgcctatctatggttcccttgcgtgtgctcgggataggtgttttgtataaatgtttcgccgtattattaagtattctcctttagtttttttctcgtttcatgcttgtttgagtaatagcaaggagatggtaatacggttatccacagaatcagnnnnnnnnnnnnnnnnnnnnnnnnnnnnnnnnnnnnnnnnnnnnnnnnnnnnnnnnnnnnnnnnnn

SEQ ID NO: 34059 - DNA, 11568 bp, Oryza sativa
  unsure (1)..(11568): unsure at all n locations
tctnnnnnnnnnnnnnnnnnnnnnnnnnnnnnnnnnnnnnnnnnnnnnnnnnnnnnnnnnnnnnntctaggctgagtagcaggagcaacttttaatttgttatgagcccaaacgatagattcaatcagttcttgccaataaccacggccgctgaataaaaacattaaactgaaggcccagacaaaatgagcacctaagaaaaaaagaccatatgcggataatgaagaaccataagactgaattacttgggatgcctgtgcccacaagaaatctcggagccacccattaatcgtaatggaactctgtgcaaagtttccccctgtgatatgagttaccaccccttgatcacttatagtaccccaaacatccgactgcattttccaactgaaatggaaaatgactaccgaaatggaattgtacatccagaatagacctaagaaaacatgatcccaggcggatacttgacatgttccccctcgcccaggcccatcgcaagggaagcgaaaaccaagatttgctttatcgggtatcaaacgggaactgcgagcaaataaaacacctttcaaaagtattaatacagtcacatggattgtaaatgcgtgaatgtgatggactaaaaaatctgcggttcctaatggaataggtaacaaagcaactttgccgcctactgctactaactcgccacctccccacgttaagctggtacttgttgttgcaccaggagctgttacgctaggcgcgccagcatggagattttgtacccattgagcaaagatcggttgtaattgtatggcggtatccgaaaacatatcttggggacgacctaaagcactcatggtatcattatgaatgtataaaccaaaactgtgaaaacctagaaatatacatacccagttaaggtgggatatgattgcatcacggggtctaaggacacgatctaatagatcgttgtatcgagtcgttggatcatagtctcttaccataaaaatggctgcatgtgcagcagcaccaactattagaaatccgccaatccacatgtggtgtgtgaacaaggaaagttgtgtaccatagtcagtagctaggtatggataggggggcatagagtacatatgatgagctacaacatggttgtagagcctagcatagctaggttaagagataattgagcatgccatgacgttgttaggatttcatagagacctttatggccctgtcctgtaaatgggcctttatgagcctccaaaatatctttcaggccatgaccaataccccagttggtcctatacatatgacctgcgatcaggaaaagaatagcaatagctaaatgatggtgcgcaatatcgctcaaccatagaccgccggttattggatctagccctccgcgaaaactaagaaattttgcgtatttggaccaattcaaggtgaaaaaaggggttgctccttcggcaaaactaggataaagttgagccaaaaggtcgcgattcaagataaattcatgaggaaagtggtatctcgttaggatcaaccccagggtcaagaaattggttaatcggtaaagatacatggatttggtgccccgcccaagaaagagacccaagtcctaataaccctgctaagtgatgattcaacatggattctacgtcttggaaccaggctaatttgggagcggctttgtgataatggaaccacccagcaaaaagcattaacgatgcaaaaatcaatgcaccgattgcggtacaatagagttgtaattcactagttattccggatgctcgccaaatctgaaaaaacccggaggttatttggattcctcggaaacccccgcctacatcaccattcaatatttcttgccctacgattggccaaactacctgagcactgggtccaatgtgagtaggatcacttagccatgcttcataattggaaaaacgggcaccatggaagtacatgccactcaaccaaagaaagataatggagagttgaccgaaatgagcactaaagacttttcgagagatctcctccaaatcacctgtatgactatcgaaatcgtgagcatcagcatgtaggttccagatccaagtggtagtatcagggcccttagctattgttcttgagaaatggccgggtctggcccattcctcaaaagatgtttttacaggatccctatccacaacaatttttacttctggttccggcgaacgaatcatcattaagtcctcctctttccggacaagacatacaaagagacccgccaactttttagtgaacctttgaaagatagatattatgattagtccttttctttactatctacccgtccttctatttttttttagttattcactggagcaattatatattgaagtcaatctgaggcaagtgttcggatctattatgacataaggattgggtgcctaacggactttttttatcttggatttctccacgtaacaaaaaaacctttttttaatttaaaaagctagtctattttttttaagagtataagtccctatctatatctactttccttgagcataatatagatttttttattcgattccaaattccaagataactcattagaattattaataagatggtcctgatatattagcaatatttatattgcccctttttattcgctttattacttctattctagaccctatcgtttatccttatgaaatataatataaaatagaaggcagaggaaagagatataatgaaattcttgattcgatcttccgacctaatttatttgattaatggatcaacaaccaaacccccattttctgaaaaaggagagtggtcttattcaaattcaaagcgcttcgtaatcttcaaccagttctgtgcttcaatataatttcccggagtaagcgctatagcttgtttccaatactcagcagcttgatcaaaccaagcttctgcaatttctgaatcaccctgtagaatggcctgttctccccggtcggaataggtagttccttcccctagaaccgtacttgagagtttcctacctcatacggctcagaaattgctatcttaatttcccttgtcttaactgaattcgatttctcaaaaatcgatccaatttcttcttgggttacgcagaagaagttaattacctaagtttcaaaccctaaattttgatcaataatcagtttgatcttttctcccacctgcagaaaaatgaagcatagatagacctatatccttcgtccgaattttctgaaaggtaactatctcggtttcatatatgaaatttctatagaatccttgaaaaagactttttccccataagcaagaaaaaagaacttactatctttgggatctgatactacaccgctgcttaatcccttagtggatcggctctattacataagcggattcctaaattttgccccatatcatgggataagtaagcagttttttttagttgtatcgacccagtcggtcactaattgatctttacggtgctttctctatcaatttgagaactctatccatagagtagtataggccatactttctttcttcctattttgattctcgtgaagtgtcctttcttcctacagctgatagggcaaaatcgttgttttgacgatccctatgtagaaagcccccttttctagtaaatactagaaaatttgatcctttcttatttttctttctatagtggagatagtcgcacgtaatgacagatcacggccatattattaaaagcttgtggtaagaaggggtttcgttctagtgcccggaaataatattccaaagcctttgtatgctctccattgcttgtgtgtataaggcctatgttatagagtatataacttcgatcatagggatcaatttctagtcgcgtagcttcataataattttgcaaagcttccgcataatttccttcggattgagccaacatccgttacggtcgttcgttctattcaaaaaatctccgttccaaaaccgtacatgaggttttcacctcatacggctcctcccttctgtacatagtactaagcgaaaaaatctagagaataaaaatagaattagttccatctcattatggaccgaaaggggctggtatttttccaagaaatctctagccaaccttcccacaagaggtttttcttaacaccaatgaattctattaatgctagaggaaaacgatagctccaagaatttctttgttctcaacgcctcctatttagaggaattagccacttcaacgatctttgatggttataggggtatccaaagtacaaacttgatggttgtttgttatcccaaccattcttcccagccctgataccaatcaggaaagggttaatttctaacaaagtttttctcttgttgattcctatttctaggtgtagtgcttttatcccctatgctacctattagtactagtagagtaggattagcctgtaatacagaacctatcctgtaggtgtaacctttcgctcaatactaaaatctacaattgaagcatccgaggccgcgtcagtcgaggatacacgacagaaggagttgttagttcacctcaccttccctaagcgtgggtttcccttactaatttggttttctctccgcgaacccccactctttctcgtaaaaccggggtgtaggtagggctaaaaaaacaaaaaaaagagtcaaatcgcaccatctctataataagtaaatgcccttttttccccggaggttgtcggaattattcgcaataaaatattggctacaattgagaaggtcttatcaatgaaatttccatttatacgggatctaggcataattcccaacccattctatcattctatatagaattcttttcattccttcacaaaataacataaaaaaaaaacaaatccattcaattcttataaatcgatccctatgctccaaatggataagagaggtatttctgctcagcccaaattctctctttttccttctgtttgaacaagaagagatagaaaatatttgactaagattggatttcattccactttcctatttcttttctcaacaacaacttctctcatcaactatttcgcattttcaaagtcattaatcgtcccataccctattttctatttgattgtatggggtaggataccttatgcaaacagaattctagggttccttttttatcgaataagaagaattcttccattctctttttctttggtttggggaaaacccaaactaaaacttttcgagggagcggaattcctagtaaaaaaatcctggacccgtccacttagatgaaaaggaatttttctatctaatagaacaatggaactctcgcgcggttgtggttgtacctgtactgcaggaataggaaaactcgctattcactcagttttttttccataataagattatggaggagagatggccgagcggttcaaggcgtagcattggaactgctatgtagacttttgtttaccgagggttcgaatccctctctttccgtttttcttaattcagcaacgttaatgattacaatgtatcaaatcaaatgacaatttattccagcaataatacaatacctttatttaatagaaattctctataccaaattactatggtatgtaaaatacacatagaggaaagaacaaaaaacaaaaaggaatcctagggttaatccatttctgttaggtgaatgggaaaatacgaattaagagccttaggtcgatttagttcggggaaaggggaaggggaagaaaattctatgaacctttccgtttttccttaagttcaagtttgacgagagtaatattctacaactaacaactcatttattttgagaccgacccacttcctatccaggattttttttactagtcctttatattgcaatgtgtcaatcgtcaaatgctttggcaatttccccgggtcggatgaagcaatagaattttgaaccagacgttttgatctttggttatccttcgtagtaataatatctcggggtttgcaacgaaaacttggtatatcgactatacgaccattaactaaaatatgtctatggttaactaattgccgggcctcgggaatggttgaagccatacctaatcgaaaaaggatattatccaaacgcatttcaagtaattgtagtaaaacctgacctgttgaactttttgcttttccagcgatatgtacatatctaagtaattgtcgttctgtcagaccataatgaaaacgcaatttctgtttttcttgaagacgaatacgatattgttcttttttcccagaatggaatttctttttcagattacttccggatttaggtgtttttctagtgagtcctggtaaagctcccagacggcgtatttttttaaaacgaggtcctcgataacgggacatgaagactcctttttttattgaaatttcattttacacaattaatttcattgtatttacattacagaatacatcgaaattaaaactgaattaaagtaaaggataaacagagtaaaatctactaaaagtaccacaaaaaaatggaatttcatcaacatctgaatttttgtatatatattatttattttattgttttgtatctagcaaaattgtagggtagaacgacataatagatcctggcttctccatttaattcggagaaaaagaggtatttttgttcatggaacattgatagagaaaaaagccgactatcggatttgaaccgatgaccctcgcattacaaatgcgatgctctaacctctgagctaagtgggcttacataacagaaatagtgtaacaaatagaaatatgtatagtataggaaatccgtaaaatgtcagatcttaattattaatcttagctattaactagttcgaaattggaagttctacttagaaaaaaatactagaacttcataaaataaagttagatagatttttttgaactttcttttttctctaattcgcaaatctatttttctaatagaatctattccaatttctatattgaatttgattttagatatttttaatttgatatggctcggacgaataatctaatacatggaaaagaataaataatatatattatatacgaaaacataataaagagaacatgcgaatttcttgtattttcagtccatcattatagacattttttgagatattttgtttttttttgttatttgctaataatttaatgattaatatttcactaaggagaacatagaatcatagcaaatgaaattgctaattctgattagcaaaaaaaaagaatgaatatcaagcgttatagtatgattttgaatactctaaaaaaggaacgcggtaggtgggggagagaaaaaccttgggatatattgattcgcattgaattgcaaatacatcaacgatagaatcaattcaatgctgaattgcaataagcggagtctctcaactagagacgaaccgctagactacatagagtaatgaattcaacgattcaaaaaaaactaacagatggaggaaattgcacaaggaatcctggtctcaaagaaaaagaaaatggggatatggcgaaatcggtagacgctacggacttgattgtattgagccttggtatggaaacctgctaagtggcaacttccaaattcagagaaaccctggaattaaaaaaggggcaatcctgagccaaatccatgttttgagaaaacaagcggttctcgaactagaacccaaaggaaaaggataggtgcagagactcaatggaagctgttctaacgaatcgagttaattacgttgtgttgctagcggaactcccttctaaattagggaaagaagggctttcgaaatctaatacacacgtatagatactggcatagcaaacgattaatcacagaactcatatcataatataggttctttaattcttttttaaaatgaaaataggaatgattatgaaatagaaaattcataatttttttagaattgttgtgaatccattccaatcgaatattgagtaatcaaatccttcaattcatagttttcgaaatctttttaaaagcggattaatcggacgaggataaagagagagtcccattctacatgtcaatactgacaacaatgaaatttctagtaaaaggaaaatccgtcgactttctaagtcgtgagggttcaagtccctctatccccaaaccctcttttattccctaactctagtatttatcctgtttttttattaataggtttaagattcaatggaatacatttcttttttattatagtatcggcaaggaatgtcgattattaactcgatatttaaatattattaaataggctttctttgtacaatgcataggactgccccctccccatttccaaattttggatattgacatagatacaaatactctactaggatgatgcacaagaaaaggtcaggatagctcatttggtaacncagaggactgaaaatcctcgtgtcaccagttcaaatctggttcctggcacagaaaaaagggatcttccgaataggtattgatacaaatacctcgagatgggttgggatacatattcgttaataatatagatagagtatgattttttcatctaagtagataaatctctaaatagaggcacttctttttctgcatttttgcatttcttaattttctattccgctattccgacaaatatttttttattcttgcttatcttatcttactttactagttgttctaagtaatgcacgcggtacaaagttcgtggtagggaacttctttgagtcatcatatttttctgttcatacgaaggaaatgaatatgtgattttccaacgaaatgaagcccttttttgcttagtctatctgaaccttttgtataattggaattaattagaatgtaataggtattctgtttcatctaggaacagagcgtaaaaatattccttgacttgcataaaatctggagttgtgttgtataagtgagcatgaatttcttatcattcaatgagcatcttgtatttcatagaaattgggggttatatagtccttacgtaagggccagcctatccaactttcaggcattaggatacgtttaaggcgtggatgattatcataagagattcccaccatatcaaaagattcgcgttcttgaaaatcggaacttctccaaatccagaagacagatgggattctaggattatccttttgggcaaagacttttatgcatacttcttctgggttatctataccatactgtattctcgtaagatgatacacgctagctaaagatccaccgggtgcaacgtcataagcacattgggaacgtaaataattgtaaccatatacatataaaatgacagcaatggaatcccaatcctctgcttttatttgcaaagtctctattcctcgatgatcgaagcccaaagatctatgaaccacctcatgtttgactagccaattagataaccaaccctgctgcattatcttgatctctcctcctttgtataaatatttcgcagttcgaatgcaagtttgaaatattgccctgctctttctttttcggcacaaagagctcctcctaattcactaatttgtaggaagatactggacttttggatttgaaaaaagtttcagaagatatgtctaaagtagatggtgattgatagagcaattcttgctcataagttccagtattagtactgcgccgaacataaagcttgtggctggtagtaaaacatcgatttttcttttgagatagagttcgatcctcaactatttctcgcgatatcttcttacgaagttttgttagggcatctataacagcctctggtttaggtgggcaacccggcaagtagacgtccacaggaattaacttatcaactccccgaacagtactataggaatccgtactgaacattccaccagtaatagtacaagctcccatagcaatgacgtattttggttcaggcatttgctcatataatctcactaaagagggagccattttcattgttactgtaccggctgttaaaattaggtccgcttgcctaggacttgatcttggtaccaatccataacgatcaaagtcgaatcgtgagcctattaatgaagcaaattcaatgaaacaacaactggtaccatatagaaggggccataaactagagagtcttgaccaattcgaaagatcttttagtgtagttgaaataacggaattggaacttgtttggtcaagtaggggaaactcaatcaaactcataactgtcttaatggaatcttttccttcttttttttttttgtctgaatattcagttaagaccattccaaggctccttttcgccatgcataaactaaaccaacaactaggataagcacgaaaatgaaagcttcgataaaaacggatatacccaatacgtcgaaactcattgcccaagggtagagaaagaccgtttccacatcaaaaacaacaaaaactagcgcaaacatgtaatagcgtattcggaattgtaaccaagccccccccatgggttctatacccgattcataactagaaagcttctctggtccttcacgaaccggagctaaaagtgctgaaatccaaaatgctaaaataggaataaggcttgctattattagaaatgcccaaaaaatatcatattcgtgaagcagaaacataaatgtactcccattaatgtggaataggcggaactgaattagtcaattcaagtcagcattgtcaatttatacagaatttctctcttttcctcggtgaaacaaggatcggtttttctcaaaccaaagggcttagtttagcctttgtttcctctttgccacgtcttctttaaagattcatccaatggaatcccgaccccctttctttttgatttcctttctatttaggtatggtggagacataattcttatagaaacaaaactctctcgcttcactttgtctcattttctctagaatctctagaaaaaggaataaaaacgaaaatactacgaattagagcctaattaagataggatgactaatgtatgcagcctaatgaggagtaattctataaaaataaagaactctatttcagaacgtagattgatttagatttaggtaatctatagatatagataagcaaagtaatatacttcaaacaaagtaggaatttgcaagatggagaacatcttgcagttgatttgatagaaattcatttttcttttcctgtctctataattttcgatgaatgagcctctggtaatccttttatctctattttatggcgcaggcgcctgtccagtctataaacaagtactaatagggaaatgaaaactatactaaaggaaacgtaggatatctctcctaaaatctaaaaaaggacatattagggctatacggattcgaaccgtagaccttctcggtaaaacagatcaaacggattattatcgaaatgattcgaactgtttcaaagacccaacatgcatttttttgcattgggctcttttatcaactgatagaaagatcagttagtccaccatagtttttctttacggaaagataatgagatggctccctgcgctctgattgattatttgtattatgatctatctaagagcaataccaaagtgtttcaa

SEQ ID NO: 34060 - DNA, 1796 bp, Oryza sativa
  unsure (1)..(1796): unsure at all n locations
cctttgtggtgataaattgcctacttaactcagtggttagagtattgctttcatacggcgggagtcattggttcaaatccaatagtaggtaggtaggtagaaaaattactagatagcattggccctacttcgcttcgctatctaataattttttctacccctcttccctttttctttgtatcaactaaaccgttgggttgtcttcaattagatgggggaatccaattaacagcctcgactcgtatcctagctcgtctgagagctaccttcgcttcaaccaattctttcgtaccctcagctctactcacgttagcttcggctatttcaagtgcctgttgagcttcttccggatcaatgtcactacccagttccgcatcatttcctaaaatgatgatctcattattaactattctggcaaaaccgctccacagaaccgccgttaaccattgatcgttgaggaggcgtattctcaagggacccatatctacagctgtgttaatgggggcgtggtttggtaatacgccaatttggccactattagtagataaaatgatttctttcacttcacaatcccaaataattcgcttaggagtcagtacataaagatttaatttcatttcttcaatttgttctcctcttctaagtttatagctttcgtgctagcttcatcgatgttacccaccaaataaaaagcctgttcgggtaggccgtctaattctccggaaaggattagttgaaatcccctaatagtttctgcaagaccaacatactttnnnnnnnnnnnnnnnnnnnnnnnnnnnnnnnnnnnnnnnnnnnnnnnnnnnnnnncaatttttcgtgctcttgctacagttaaacgatcctcctccgataattcatccaacccaagaattgcgataatgtcctgaagttctttgtaacgttgtaaagtttgcttaactctttgcgcagtttcataatgttcgttgccaacgatccgaggttgtaacatagttgaggttgaatctaaaggatctactgcaggataaatccctttggaagctaatcctctggaaagtacggtagtagcatccaaatgtgcaaatgttgtagcaggagcagggtcggtcaaatcgtccgcaggtacataaaccgcttggatcgaagttatagatccctttttagtagaagtaattctttcttgcaaagaacccatttctgtactaagagtaggttgataacccactgcagagggcattctccctaataaggcagatacctccgatcctgcttgaacaaaacgaaagatattatcgatgaatagaagcacgtcttgcttattaacatctcggaaatattctgccatagttagggcagtcaaaccaactctcatacgagctcctggcggttcattcatttggccatagactagagctacctttgattcctcaagatttttttcattaattactccagattccttcatttccatataaagatcatttccttcacgagtccgttcccctactccgccaaatacggatacgcccccgtgagctttagcaatattgttgattaattccatgatgagtactgttttacctactccagctcccccaaatagtccgatttttcctccacgccgataaggagctaaaagatcgaccaccttaataccagtttcaaagatggataatttcgtatctaactcgataaaggcgggcgcggatctatgaatagggaatgttgcactagtatctacaggacccaaattgtcaacaggctccccaagaacgttgaaaattcgtccaagagta

SEQ ID NO: 34061 - DNA, 2252 bp, Oryza sativa
  unsure (1)..(2252): unsure at all n locations
nnnnnnnnnnnnnnnnnnnnnnnnnnnnnnnnnnnnnnnnnnnnnnnnnnnnnnncaatattgttgattaattccatgatgagtactgttttacctactccagctcccccaaatagtccgatttttcctccacgccgataaggagctaaaagatcgaccaccttaataccagtttcaaagatggataatttcgtatctaactcgataaaggcgggcgcggatctatgaatagggaatgttgcactagtatctacaggacccaaattgtcaacaggctccccaagaacgttgaaaattcgtccaagagtagctccaccgacaggaacactgagaggagctcccgtgtcaatcacttccattcctctcatcaacccatctgtagcactcatagctacagctctaactcgattatttcctaataattgttgtacctcacaagttacattaatttgcttaccgtcagtgtctcgactcttgactaccaaagcattataaatataaggtaacttgcccgggggaaaagtgacatccagcacgggtccaataatttgatcgatacgccctgtacttttttcttcaattgtagaaaccccgggacgagaagtagtaggattggttctcataattatcacataattttcaaaaaaaaggaatttatcgaaattttgatttttttcttggtgaataatgccaaatcaacaccaaaaaaatatccaaaaatccaaaagtcaaaaggaaatgaattagttaattcaataagagagaaaaggggaccagcacttgatttcgttgccaaacgaatcccattcaatcgtatactcatggaatgagcccgccggaaagttcaatcaatctttttttcatatacattttgccttttgtaaacgatttgtgcctactctactttcttatctaggacttcgatatacaaaatatatactactgtgaagcatagattgctgtcaacagagaattttcgtagtatttaggtatttccactcaaaataagaaaagggggtctattaagaacttaataaggattagaagttgatttggggttgcgctatatctattaaagagtatacaataaagatggatttggtgaatcaaatccatggtttaataacgaagcatgttaacttaccataacaacaactcaattcttatgaattcctatagtagaattcctatagcatagaatgtacacagggtgtacccattatatatgaatgaaacatattatatgaatgaaacatattcattaacttaagcatgccccccattttctttaatgagttgatattaattgaatatcttttttttaagatttttgcaaaggtttcatttacgcctaatccatatcgagtagaccctgtcgttgtgagaattcttaattcatgagttgtagggagggacgtatgtcaccacaaacagaaactaaagcaagtgttggatttaaagctggtgttaaggattataaattgacttactacaccccggagtacgaaaccaaggacactgatatcttggcagcattccgagtaactcctcagccgggggttccgcccgaagaagcaggggctgcagtagctgccgaatcttctactggtacatggacaactgtttggactgatggacttaccagtcttgatcgttacaaaggccgatgctatcacatcgagcccgttgttggggaggataatcaatatatcgcttatgtagcttatccattagacctatttgaagagggttctgttactaacatgtttacttccattgtgggtaacgtatttggtttcaaagccctacgcgctctacgtctggaggatctgcgaattccccctacttattcaaaactttccaaggtccgcctcatggtatccaagttgaaagggataagttgaacaaatacggtcgtcctttattgggatgtactattaaaccaaaattgggattatctgcaaaaaattatggtagatgcatgttatgagtgtctacgcggtggacttgattttaccaaagatgatgaaaacgtaaactcacaaccatttatgcgttggagggaccgttttgtcttttgtgccgaagctatttataaatcacaggccgaaaccggtgaaattaaggggcattacttgaatgcgactgcaggtacatgcgaagaaatgattaaaagagctgttttgcgagggaattaggggttcctattgtaatgcatgactacttaaccggggggttcaccgcaaatacta

SEQ ID NO: 34062 - DNA, 324 bp, Oryza sativa
gccatggaatacactattgtagtagctgaaatggcggattcccctgctacattacaatacctcgctccttatacgggagcagccctggctgagtattttatgtaccgcgaacggcatactttaataatttatgatgatctctccaaacaggcacaagcttatcgccaaatgtcccttctattaagaagaccccccggccgcgaagcttacccaggggatgttttttatttgcattcacgccttttagaaagagccgctaaattaaattctcttttaggggaaggaagtatgactgctttaccaatagttgagactcaatctgga

SEQ ID NO: 34063 - DNA, 772 bp, Oryza sativa
acccacccccatttcagctcttatacacgcagcaactatggttgctgcggggatttttcttatagctcgacttcttcctcttttcatatccctacctttgataatgagtttcatttctttaataggtacactaacacttttcttaggagccactttagctcttgctcagagagatattaaaagaagcttagcctattctacaatgtctcaattgggttatatgatgttagctctaggtataggttcttatcaagctgctttattccatttgatcactcatgcttattcgaaagctttattattcttgggatccggatctgttattcattcaatggaacctcttgttggatattcaccagataaaagtcagaatatggttcttatgggtggtttaagaaaatacattccaattacaagaacttgttttttatggggtaccctttctctttgtggtattccacctcttgcttgcttctggtccaaagatgaaatccttagtaatagttggttatattcacccttttttggaataatagcttcttttactgcaggattaactgcgttttatatgtttcggatatatttacttacttttgatgggtatttgcgtgttcattttcaaaattacagtagtactaaagaggattcgttgtattcaatatcgttatggggaaaaaggatatctaaaggagtcaatagagatttcgttttatcaacagcgaagagtggagtttcttttttttcacaaaatctatccaaaattcatgttaat

SEQ ID NO: 34064 - DNA, 827 bp, Oryza sativa
agacttcaagcagtttagctttaaccgtgttaatggtctcatattattggtctatagagaatcaaagttgatttgatttaccaataggtcgcgaaatgctatggttctttcatatgatttctgcatttattcagaagtaattcgtcgagatcgtgcacccttttcttatttattcgaaaaatactaaaaaatattctaaagtgcagccggatagatccaatctattcttgaaatagacaactcgcacacactccctttccaaaataaatcaatacaccaaccactacagttagatttattagatttgttgctaaaatatcggtattaagcccgaaactcccagcggatggccagtgagctaaaaaaacgaaagaatgggttacatttttcatatgctctcctcttatagataggacgaacaaagaacaaagtttttcgatcacttacttcgctcgccctttttgatcggtttttttaatgcaattttttttaatagaaatagattcaatttagtaatttcttttagattaagtcttagatctcgtttgacctgtgaaagacctcctttgttgaaatgttcccaaaattcctaaaataaaaggaaaaatactttccactgccctaaacaaagggcgggaagcaagacggcgaacatatcctctaaattgatcatcctcaaatcagctattcctggggtggggtattgtctgtccccataaatagaaaactctaggagtaataaattaggagtaaagtattgatataattggaattgcagaagcaaataccaatttactaaaaaaagaagaaagtatctaatctaaagg

SEQ ID NO: 34065 - DNA, 3460 bp, Oryza sativa
  unsure (1)..(3460): unsure at all n locations
cctatatactttgtttggcaattccgtaatatagcctattctctcttctacaactctagattgtatattcatacgcaattctaactattttgttttccaaccaagcgaattttccgcaaccatgcatgaattgagttaagctaaaaaaaagactattttgaaaactagtcaattcaatgatgaccctccatggattcacctatataggctgcggctaacgttgcaaaaataagagcttgaataccgcttgtaaataatccaagaaacatgaccggtataggaactactaaggggactaaagaaacaagaacaacaacgactaattcatccgccaatatattcccgaaaagtcgaaaactaagcgataatggttttgtgaaatcttctaatatgttaattggtaaaaggattggagttggtttaatatatttctcgaaataactcaatccttttttgctaagacccgcataaaaatatgccgctgacgtgagtaaagctaaagcaacagtagtatttatatcattcgtgggcgctgctaattctccatggggtaactgtataattttccaaggtaaaagagcacccgaccagttcgaaacaaaaataaaaaggaacatagttccaataaagggaacccagggaccgtattcttctccaatctgagttttgcttaagtctcgaataaactcaaggacatattcgaagaaattctgaccatcggttgggatggtttgtggattgcgaacagctatgataactgaacctagcaagatagtaattacgacccaagaagtgataagtacttgggcatgaatttggaaacctcctatttgccaatagaagtgttggcctacttctacgcccgatatatcgtataaccccttgagtgttttaatggaacacggtataatattcatattgtcccctgataaaaaatgaacttcaaaaaaagaattcttttgattcaaccatctttttctcaactcagcaacgtgaagtattaatcttatatttaggatatcaagaaatcacatcagatgataatatatatcaataccctctaatatatatcaatattccccgtcttttttctatgcaaaacaaaaaagaatagtaagtgattccataaatctacgcagttgcccaagaattaactattcttcttaatcaatgatttcttatatagagagaacggccctcacaaattgcaaatactaatttgttaagaatcaatcgaattgaagtcatagtgtcatcgttggctggaatcgatatattcgcgagatctgggtcacaatttgtatcggctaaagaaatagtaggaatccccaaaatggcacattcccgaagagctatatactctttttgctgatcgaggacgatcacaatgtcaggcaacctcgtcatatatttgatcccgccgagatatctttgcaaggtagataattttctcttcaagattgccacatctctttttgggagatggtggaatttttccatcttttcttctgctcttaagtctctaaattgagaaagtctagttttagtaatcgaccaattcgttaacataccactgaaccactttttattaacataatgacaacgagcccttattgcagctgatgctactaaatccgctgctctttttttggtaccaacaattaagaagctttttccctgacttgctgcatcaaaaactaaatcacaagcttctgataaaaaacgggtggttctagcgagatttgtaatatgagtacctttacgctttgccgagatgtaaggggccattttaggattccatttcttaataccatgaccaaaatgaactcccgcttctatcatctctttcaaattgatgttccaatatcttcttgtcattttttccacacttccttttgattttttcttttttttcatcctacctttccattacgaaatttctttcttttcgaagattaagaaagagccgaaatagcttgaaataaataataattgttccgatggaaccttctacatggtataagcataaccttaatgaattaactaaacttctttttaaattaaaataaaaatagaaaatctaacctcttagcgttctaaggtcaaaaatctagtttaaagtaaaaaatctgctttatgtatccttaaatcatataaatggggtaaatggtgattctgatgtctcatagaaattgtttgttacgtcagaatcagaagaaactaattctgtatggagaaacaaaatatctctcatttccgacgcaaatagtttttttttttgaatttcgaaataaaggttcttgttttgtgggtaacggtgcacaaatttttggaatccggtaccaacaggtataatcccccccagaactacgttttctttcaggcctttcaaccaatcaatacgacctcgtaaggcagcttttgctaaaactcgagcagtttcttgaaaacttgcttcagatatgaaactttgggtattcagggaaacccttgttattcccaataagattgcccgataatagatcgattcatccaaagcccgccctgctcgctctgctcgcaatagtccaattaattccccaggtgaaaaaacattagacattccatcttcggaaacccgcacttttgatgttacttggcgtataataatctctatatgtctattatggatctgtaccccttgggatcgataaaccttttggatcttattaaccaaagagatacgactttgggctatggttaactcagctccaatcaagaatccccaaggacccccaagaattcttggtatacgctcattccaatcctcaattctcctttcgagattcggcgatagtgaatcaattgaacgcgcttcgaagatttgttctacttttggaagaccttgcgttatgtcactagatctcgctttttcgtatataaacgtaactaacctatcccctttgtaaaggatttctccataatgaccatgaacagttgctcctgtagtggccaaataaggcttagctgctcttataacaaaggaatctatatttacaatgaaaatttgacctgatttttttatgtgcgatttaaatagacatacattttcgcaaataaattgtccaaggtgaatttttgctgatgtctcttcccaagaatcatgagggagaaagtgccaatttaactggaatggatccaacatgatgttactatcgaaatttgaagtcctttgattttcatttattaaagagtgtttaagtccttgaagtactttgaagttttgtttcaaattgtcaaggagcaaatgcttttttaacaggatctgattatacgttagtaaatagtaagatgaagaaaaattcgatatactaggtgcaatagtacctaagagtcccgaaaaatttcgaaagagnnnnnnnnnnnnnnnnnnnnnnnnnnnnnnnnnnnnnnnnnnnnnnnnnnnnnnnnnnnnnnnnnn

SEQ ID NO: 34066 - DNA, 978 bp, Oryza sativa
agacatacattttcgcaaataaattgtccaaggtgaatttttgctgatgtctcttcccaagaatcatgagggagaaagtgccaatttaactggaatggatccaacatgatgttactatcgaaatttgaagtcctttgattttcatttattaaagagtgtttaagtccttgaagtactttgaagttttgtttcaaattgtcaaggagcaaatgcttttttaacaggatctgattatacgttagtaaatagtaagatgaagaaaaattcgatatactaggtgcaatagtacctaagagtcccgaaaaatttcgaaagagcccccaaaattttggaataggaattctaggattcgattcttttaccccattgggattttttgaattcttaaaaaaaccaattcgagaacagttggatgccgacaaaaccatcaaagattggtattctttatttcgattcaacaaggtaccaatagcttcttgatgttggctaagtgattgaatcttcgccttggaataaaaggaattggtattggtgcgatctaacctattatggagaatcagtcctgcacttctgctatcatacctttttcgtgtatacgaaatagtggatttgattaacccaattcttaggaaatcgcgaatcagaccatttgctcttatctcaacaagggaagcacgagcctcctctttttcttcttgttcccaattcaatactaagcaagttcgaacgaattgactattcgtatgataaattctttgagttaacttgctattttcatgagaaataaaattgacaagtcgaagttggagattaccctcttcctgcaagagatcctgtgggaaaagtgttgctaaatttctcccttcgttcatttcatacgcgactgcaggtcgaaccaaaacaaaatacttttccttgctcttgagaatttttttccactgaacatagacccaattttcccttttttttgattccttc

SEQ ID NO: 34067 - DNA, 674 bp, Oryza sativa
  unsure (1)..(674): unsure at all n locations
agctcggtacccggtaaaccaccgcctctcaggcctccccgacggatagcaagttcgaaattctgtttcggtaggacatggatttctattactatgaaattcataaatgaaaatgaagtagttaatgggagggctaccattatcctttttcttgtatgtgttcctaagagaaggaatttgtccatttcatgtttcgaggtctcaaaaaagggcgtggaaacagatagaaactcttgaatggaaattgaaaagaaatgtagccccaaaaattccaattatttaatatgaataattaggaataattaggattaattaatgagtttacttttatgtgtcgaattcctcggtacaatattcttagaacaaacctctctgatatataaaaaaagggtttttggtatactgtgacctaaatattcttttcctatcaatgaacttttcgtaatagaatccgtataataaataaaaaaaggggattctattatgaaaagtagagtattcctgcaataagacttacaacttctacctatcctatccttatttgggtaccatatgcacctctttgggcttctattgaatcgagaaattggattgtacatctttttgattttgatacatatnnnnnnnnnnnnnnnnnnnnnnnnnnnnnnnnnnnnnnnnnnnnnnnnnnnnng

SEQ ID NO: 34068 - DNA, 1070 bp, Oryza sativa
  unsure (1)..(1070): unsure at all n locations
actacagcgccgggattcgaactcgccaccagggttccctaaacggggattcacgaaacaaacaaccagcaaacagcttttaaagggaaggggaatatttttacgctctgttcctagatgaaacagaatacctattacattctaattaattccaattatacaaaaggttcagatagactaagcaaaaaagggcttcatttcgttggaaaatcacatattcatttccttcgtatgaacagaaaaatatgatgactcaaagaagttccctacccagtcaagaattggggcttcacaattactagccaatatttctctcatgcctttcctcgttcatggttcgatattctggtgtcctaggcgtagaggaaccacaccaatccatcccgaatttggtggttaaactctactgcggtgacgatactgtaggggaggtcctgcggcaaaatagctcgatgccagaatgataaaaagcttaacacctcttatttgactttttcactattttgaaatacgaaaaagatccaaatccaaaatgcaaaggtcgtcttattcaaaacctcaatcatcacatcccctctctcccacttcacacctcggaacgcactgttcttatagagagaaaggggctttcccatcttcttaacccgaaatgaaatggctgaggagagggaggttccttttggggggtacccccgggaagagatccaatggagacggggtgggcctgtagctcagaggattagagcacgtggctaccaaccacggtgtcgggggttcgaatccctccttggcccacagccttcaaaaggggaagggcctttactttccccctgagggtagaaaaaccatgatcgggatagcggacgtaaagctattgaacttgggtatgctctttccttttgtcgaagtggaatcgtagaacagaatgtgatacgatgagataaaatgcaatagaaacaaggatagcgaacgggttgatcttcatatcgatctattatccnnnnnnnnnnnnnnnnnnnnnnnnnnnnnnnnnnnnnnnnnnnnnnnnnnnnnnnnnnnnnnnnnnnnnn

SEQ ID NO: 34069 - DNA, 710 bp, Oryza sativa
  unsure (1)..(710): unsure at all n locations
acaaaaaaatcagtaactaaaagaataaaaaaagcttttactgagtcatttaagttatagaagaattcctgaacccaagaattcaaaataacaagttcctctttacccagaaaaaaagaaccacttagaatagccaaacagattatatttgtcgagaaatgcaaaatgatatggagatgaccctcattatctattttggccaattgtattatttccttgcgtattcctataggggggttttgtacatgtgtattcggtttctcttttatcatttcgtccaagataaaaaggtcttctaattccatgaatctttctagaactcttttctcttgaatagcagttaagagagtttgggattgcctggtattccaccaattcttaatccaaagttccagacatttgttaaaagagaaagagactccccaaggcaaaagtccgataaatccaagatataggaaagaaggcaatgctttcttttttttcatttttgatctgtaaattgagttgttaatgaatccgctttattcgctgactctatatgatatttctttttctttgaaggaaaaattctataacaaggtttgagaccttgtatctattcctcttttttctatactagtagaatttcattgcattgagttctttcttagatctagatggagtgnnnnnnnnnnnnnnnnnnnnnnnnnnnnnnnnnnnnnnnnnnnnnn

SEQ ID NO: 34070 - DNA, 879 bp, Oryza sativa
  unsure (1)..(879): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccccatttcagctcttatacacgcagcaactatggttgctgcggggatttttcttatagctcgacttcttcctcttttcatatccctacctttgataatgagtttcatttctttaataggtacactaacacttttcttaggagccactttagctcttgctcagagagatattaaaagaagcttagcctattctacaatgtctcaattgggttatatgatgttagctctaggtataggttcttatcaagctgctttattccatttgatcactcatgcttattcgaaagctttattattcttgggatccggatctgttattcattcaatggaacctcttgttggatattcaccagataaaagtcagaatatggttcttatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34071 - DNA, 111 bp, Oryza sativa
tttcttcggactttcccaaacacaaaatacctctgtgtattcgcactctcaaatgagagtggaagaaattcgactttcatataatatcttaatagaattccatgtaatgat

SEQ ID NO: 34072 - DNA, 1539 bp, Oryza sativa
  unsure (1)..(1539): unsure at all n locations
aacgctgggtagccaagtgcggagaggataactgctgaatgcatataagtagtaagcccaccccaagatgagtgctctctcctccgacttccctagagcctccggtagcacagccgagacagcgacgggttctccacccatacggggatggagcgacagaagcatggaaataggataaggtagcggcgagacgagccgtttaaataggtgtcaagtggaagtgcagtgatgtatgcagctgaggcatcctaacgaacgaacgatttgaaccttgttcctacacgacctgatcaaatcgatcaggcacttgccatctatcttcattgttcaactctttgatgaaaagatgaaaaaaccaaaaaaaagctctgcccttccatctcttggatagatagagagggagggcagaggcctttggtgtcccttccagtcaagaattggggcttcacaattactagccaatatttctctcatgcctttcctcgttcatggttcgatattctggtgtcctaggcgtagaggaaccacaccaatccatcccgaatttggtggttaaactctactgcggtgacgatactgtaggggaggtcctgcggcaaaatagctcgatgccagaatgataaaaagcttaacacctcttatttgactttttcactattttgaaatacgaaaaagatccaaatccaaaatgcaaaggtcgtcttattcaaaacctcaatcatcacatcccctctctcccacttcacacctcggaacgcactgttcttatagagagaaaggggctttcccatcttcttaacccgaaatgaaatggctgaggagagggaggttccttttggggggtacccccgggaagagatccagtggagacggggtgggcctgtagctcagaggattagagcacgtggctacgaaccacggtgtcgggggttcgaatccctcctcgcccacagccttccaaaggggaagggcctttactttccccctgagggtaggaaaaccatgatcgggatagcggacgtaaagctattgaacttgggtatgctctttccttttgtcgaagtggaatcgtagaacagaatgtgatacgatgagataaaatgcaatagaaacaaggatagcgaacgggttacctactcctaagggtcaaagcaagccctttaattcaattctttattcttacattaaagaatgaatcaaatctccccaagtnnnnnnnnnnnnnnnnnnnnnnnnnnnnnnnnnnnnnnnnnnnnnnnnnnnnnnnctgaggaacaagggggattcgacctcctagagttcaactcccgctctcaacccatgaacaatatgagtccgaagcttctttcgtaactcccggaatttcttcgtagtggctagtttccatacctcatttcataggtaagcccagagtggctctatttcattctatttcacttcctagcacttcctatcatttaatatccatccctttggtcttattgacataagagatgtcatttatagtctatctctttctatatatggaaagtcaagaaa

SEQ ID NO: 34073 - DNA, 10604 bp, Oryza sativa
  unsure (1)..(10604): unsure at all n locations
tcttcttaccccaaaatgaaatggtgaagcagagggaggttccttttggggggtacccctgggaagagatccagtggagacggggtgggcctgtagctcagaggattagagcacgtggctacgaaccacggtgtcgggggttcgaatccctcctcgcccacagccttccaaaggggaagggcctttactttccccctgagggtaggaaaaccatgatcgggatagcggacgtaaagctattgaacttgggtatgctctttccttttgtcgaagtggaatcgtagaacagaatgtgatacgatgagataaaatgcaatagaaacaaggatagcgaacgggttacctactcctaagggtcaaagcaagccctttaattcaattctttattcttacattaaagaatgaatcaaatctccccaagttnnnnnnnnnnnnnnnnnnnnnnnnnnnnnnnnnnnnnnntctaccactgagctactgaggaacaagggggattcgacctcctagagttcaactcccgctctcaacccatgaacaatatgagtccgaagcttctttcgtaactcccggaatttcttcgtagtggctccgttccatgcctcatttcataggtaagcccagagtggctctatttcattctatttcacttcctagcacttcctatcatttaatatccatccctttggtcttattgacataagagatgtcatttatagtctatctctttctatatatggaaagtcaagaaattctcatcgaaacatcgagaaattgtgcatatagaaaactctaaagaaagaaaaaaaggagacccatgccatgattttcaaatcttttctacttagtagtctaagtttctcgatgaggataattaattcggtcgttgcggtcggactctattatgggtttctgaccacattctccatgggtccctcttagatcttctttctccaatcttggattagggaagaaggagatattcgcgactcctggtggtttcattatggggcagctcatgatcttcatatcgatctattatccacctctgcatctattctttcttagctaaacgggtggaagatccatccaatttggttatatcatggactcaaaaaacggatctgaatgtgactgaaatgcacgatcttcacaggtatcacttttcacgatacctaaaaggtggaatagcgattttcgaaccatttcctataagagaaaggtttccattactttgagaaatggattctatatcaaactatagctattgcattaaagaagaaaagaaactaatagaagtcgaagacgcggaatggtagtgaatagagagaaagattcttctggttttcttgttcctgaaaatattctatctatctcctagacgccgtagagaattgagaattttcatgtctttcaattctcgtactcgtaattggaaagttacggaaggagatccatcattttgcaatgaaaactacataaaaaactctggacaatttcgaaatcaggccaagcgtcttaatacatatgcaaaaaaattcattattggcccaccattgattagaagatttaacttgtatgaatcgctattggtttgatacgaataatggcagttgtttcagtatgttaaggatacagatgtatccacaattcatttagagttacttaatagcctatttcttataccatatctctatcccgtgaaattctcgagccgaaagatggatgcatatgctatgtttcattttgctaaatgatatcaattaaacggtgtatcaattccataaattggatatagcaataaataaatcagcaaaattcttttattttagatagaagaaacttttcttctatctaaaataaaagaatgtacccttctatccaaatccaatttgcatcgataaaataaatccaaattccagtagtagatgaataattgcaaatttttgtgtgtacgagattagaataacttcaaaataactgacataattttttatttttcctgatcagaaaaatacatgaaaaagaaaggaggtagaaaaatttttggatttatggttaaagaagaaaaagaagaaaactggggttctgttgaatttcaagtattcagtttcaccaataagatacggagacttgcttcacatttggaattacacaaaaaagatttttcatcggaaagaggtctccgaagacttttgggaaaacgtcaacgtttgctggcttatttggcaaagaaaaatagagtacgttataagaaattaatcagtcagttggatattagggagcggtaatttcatcgttcgaattttttttcttattttattagtagtcttatagtagtcttagattttgcattttgatgagcctcgttttgaggaattcatggaataatccattttcatggaataatgaattaaggaagaaaggatatgagtctaccgcttacaagaaaagatctcatgatagtcaatatgggccctcagcacccatcaatgcatggtgttcttcgactgatcgttactctcgatggtgaagatgttattgattgtgaacccatattaggctatttacacagaggaatggaaaaaatcgcggaaaaccgaactattatacaatacttaccttatgtaacacgttgggattatttagctactatgtttacagaagcaataacggtaaatgcaccagaattcttggagaatattcaaataccccaaagagccagctatattagggtaattatgttagaattgagccgtatagcttctcacttgttatggcttggaccttttatggcagatctcggtgcgcagactccttttttttatatttttagagagagagaattaatatatgatctatttgaagctgctacaggtatgcgaatgatgcataattactttcgcatcggaggagttgctgccgatctgccttatggatggatcgataaatgtttagatttctgtgattattttttacgaggagttattgaatatcaacaacttattacacagaatcccatttttttggaacgagttgagggagttggttttattagcggagaagaagctgtaaattggggcttatcgggccccatgttacgagcttctggaatacaatgggatcttcgtaaagttgatctttacgagtcttacaatcaattcgattggaaagtccaatggcaaaaagaaggggattcattagcacgctatttagtacgaatcggtgaaatgagggaatccatcaaaattattcaacaggctgtagaaaaaattcctgggggcccttatgagaatttagaagtccgacgctttaagaaagcaaagaattccgaatggaatgattttgaatatcgatttcttggtaaaaaaccttcacccaattttgaattgtcaaaacaagagctttatgcaagagtggaagccccaaaaggtgaattaggaatttatctggtaggagatgatagtcttttcccctggagatggaaaattcgtccacccggttttattaatttgcaaattcttcctcagctagtcaaaaaaatgaaattggctgatatcatgacgatattaggtagtatagatatcattatgggagaagttgatcgttgaaatgataatagacagggtacaggtagaagctatcaattctttttcgaacttggaattattaaaagaagtctatggactgatatggattctacccattttgaccctcttactgggaatcacaatagaagtactcgtaattgtgtggttagaaagagaaatatccgcatcgatacaacaacgtattggtcctgaatatgctggccccctgggactgcttcaagctatagcagatggaactaagctactttttaaagaggatatcttgccatcccgaggggatattcccttatttagcattggaccgtctatagcagtcatatcaattttattaagttttttagttattcctttgggatatcgctttgttttagcggatcttagtattggtgtttttttatggattgccatttcaagtattgctcctattggtcttcttatggcaggatatagctcaaataataaatattctttttcaggtggtctacgagctgccgctcaatctattagttatgaaatcccattaactttttgtgtactagcaatatctctacgtgcgattcgttaaaataggatctttttcctctgaaattcattgaatatttatcctccttttcttattctatattcaggttagtaagttaaactagatagctatatgagtgaaacaaaactgcttattaatttgtagtaaaaagaaaaaatctcatttcctatgtacaagaaaaaatggaagtaaacataagcggtgtaaattctttaccccaaggttgagattttttgattagtcatcatatcttgaagcgggcaataataagggattcccgatacagaaagttgtaatcataagggaatccatcaaaagttagtgagggattagaaacactaaagtacataaaggattagtaatgagggaatctaaagcattagatatttttcctcataaaaggaatcataataaggacttgaaattggtggaaatgagcaagtagtactttcttcggattccgatccagagtatgttcccattcacttgttaaggaaatggctatcaagaacgaattaaccctttattccttttttctttttaaatacccctcggggaaagaagaataggacaaaagatatggaatgcaatacaaaaaaaaagatctttatttattctttccgtcgtttatccatattcatacagaattcttcatgaactaatacccaactcttttcgtttattaattgttataacgagtgttttattccaagattaagttattgctgaacaaagaaaaagtaccattatattataaaggatgagatgaattccgaagcgttttttattattctagcagacagaattcctttggtctaatttaggacgttgaaatcgattttatcttagataattctaactacgcccaagaagataataacgaaatgaaacagtactttccttttttctgatcatagaggagccgtatgaaactaaggtttcatgtacggttttggaatagcggtgggaactgtgatgttatcgtcgactatgattatccaacagttcaagtacagttgatatagttgaagcacagtcaaaatatggtttttttggatggaatctttggcgtcagcctataggttttctggtttttctaatttcttctttggcggaatgtgaaagattaccctttgatttaccagaagcggaggaagaattagtagcaggttatcaaaccgaatattctggtatcaaatatggtttattttatcttgtttcttacctaaatttattagtttcctctttatttgtaacagttctctacttaggcgggtggaatttgtctattccctatatatccttttttggatttttccaaatgaataaaatggttggaattttagaaatgacaatgagtatctttattacattaactaaagcttatttatttctcttcatttctatcacaataagatggactttacccaggatgagaatggatcagttattaaatcttggatggaaatttcttttacctatttccctgggcaatctcttattaacaacttcttcccaacttgtttcactataaaataagataatacaataacagtaagaatattttcaacacaaaagtcctctcaaacaagagaaagaaacatacctttttcatagatatttcgaatatgttccctatggtaactgggttcatgagttatggtcaacaaacaatacgcgcagcaaggtacattggtcaaagtttcataattaccttatcccacacaaatcgtttacctataacgattcactacccctatgaaaaatcaattacatcggagcgtttccgggggcgaatccactttgaatttgataaatgtattgcttgtgaagtatgtgttcgcgtatgccctatagatctacctcttgtggattggagatttgaaaaggatattaaaaggaaacaattgcttaattatagtattgatttcggagtttgtatattttgtggtaattgtgttgagtactgtccgacaaactgtttatcaatgactgaagaatatgaactttctacttatgatcgtcatgaattgaattacaatcaaattgctttgagtcggttaccaatctccataatgggagattacacaattcaaacaattaggaattcaactcaaagtaaaatagacgaagaaaaatcttggaattcaagaacgattactgattactagaatttttttgttagaatccaaaagttctttactaactagaaagaaaaacgaatacctactgcttattgcaaattattcctgattttaaaccagagtagattttcgtgatgtgatttctaactatagaaagaacttatatacaatatacaaaaaaatttcctaatcccttttttcttccttgaatcttttagttttagtcagttcatgaaaaaatttatactattaatttcttcttatccataatggatttacctgggccaatacatgaaattcttgtgctatttgggggatttgttcttctactagggggtctaggggtggtattacttaccaacccaactttttctgctttttcgctaggattagttcttgtttgtatatccttattctatattttattgaattcctactttgtagctgtggcacaacttcttatttatgtgggagctataaatgtcttgatcatatttgccgtaatgttcgtaaatggctcagaatggtctaaagataagaatttttggactattggagatgggttcacttcactcgtttgtataactattcctttttcactaatgactactatcccagatacgtcatggtatggaattctttggactacaagatcaaaccaaatagtagaacagggtctcataaataacgttcaacaaattgggattcatttagcaaccgatttttatcttccatttgaactcatttccataattcttctagtttctttaataggtgcaattactatggctcggcaataagaaatacttagaatgagtcaaaattataagaatttcaaatctaaaataaatcactaaagaaccacaattttgatttagtaaaactcatctactgccaacaaataccttcttttctcttttgttgtgtaattgttctattctaattaattcaatcggttcaattcttgtccccatattgaaatgaatcgagattgataaggagttagttaatgatgtttgagcatgtactttttttgagtgtctatttattttcgattggtatctatggattgatcacaagccgaaacatggttagagctctaatatgccttgaacttatactgaattcaattaatctaaatctcgtaacattttctgatctatttgatagccgccaattaaaaggagacattttcgcaatttttgttatagcccttgcggctgctgaagcagctattggattatccattctttcttccatccatcgtaataggaaatcaactcgtatcaatcaatctaattttttgaataattagacatagaatcttctaaacaaagggacacatataataataatatgaaatagtaacatgaatactatttattatttgagaatatctattttttgagtaggttattccatagtattcttttttacttagttgaatttttgcaattcattgatattgcaatttgaatattgcaataatttatattgaaaagacgatagccaatttattggctaattcgaattcgtatatacaattcgtataattatgattgttgaaacccaaaattaaagtctcttggctctttacatgctttctcacaaacggattaagaaatatattgcattatttgggaaggtntggataaaccattggttcgtctgggggtcaccaaacacattggattgatatagtactaatttcattttgaccagatcganaatttttatgttgaaaaggaaatttaatagacccaatgtcacattccgtaaaaatttatgatacatgtatagatgcactcaatgtgtacgagcttgtccaacagatgtattagaaatgataccttgggatggatgtaaagccaagcaaattgcttccgcgccaagaaccgaagattgtgtgggttgtaagagatgcgaatccgcctgcccaacagattttttaagtgtccgcgtttatttaggacctgagacaacccgcagcatggctctatcttattgatacgttacaaaaaattccacttgaatcgtctgattcctctttaccgaagaagcctgtgctcaaaataatcgagcacgggcttttctggtcaaaacgtatcttgtctttatcactttatcatgagttcttttccttggttaacaatacttgttgttttgccgatatttgcgggttcattaattttctttttacctcataggggaaacaaaatcgttaggtggtatactatgtctatttgtttattagaattccttctaatgacttatgcattctgttatcatttccaattggaggatcccttaatccaattaaaagaggattctaaatggatagatgtcttcaatttccactggagattgggaatcgatggactttcattaggatctattttattgacaggatttatgactactttagctactttagcagcttggccggttacccggaattcccgattattctatttcctgatgctagcaatgtatagcggtcaaataggattattttcttcgcgagaccttttacttttttttatcatgtgggagttagaattaattcctgtttacttacttttatccatgtggggggggaagaggcgtctctattcagctacaaagtttattttgtatactgcaggtggttccatttttttcttaatcggagttctaggtatgggcttatacggttccaacgaaccaagattagatttggaaagattaattaatcaatcataccctgcaacattggaaatactattttattttggcttccttattgcttatgctgtcaaattgccgattatacccctacatacgtggttaccagatacccatggggaagcgcattacagtacatgtatgcttttagcgggaatcctattaaagatgggagcatacggattgattcggatcaatatggaattgttacctcatgctcattatctattttccccttggttagtaataataggagcgatgcaaataatctatgcagcttcaacttctcttggccaacgcaattcaaaaaaagaatagcctactcctccgtctctcacatgggtttcattattataggaattggttccataaccaacattggactcaatggagctattttacaaatattatcccatggatttattggggctacactttttttcttagcgggaacggcttgtgatagaatgcgccttgtttatctcgaagaactgggaggggtttctatcccaatgccaaaaatttttaccatgtttagtagcttttcaatggcttctcttgccttaccaggaatgagtggttttgttgcggaattagtagtattttttggactaattactagtccaaaatttctgttaatgccaaaaatgctaattacttttgtaatggcaattggaatgatattaactcctatttatttattatctatgttacgacagatgttctatggatacaagctatttcatgttccaaacgaaaattttgaggattccggcccgcgagaactctttcttttaatctgtatctttttaccagtaataggaatcggtatttatccagattttgttctctcgctatccgttgacagggtagaggctctgttatccaattattatcctaaataggattttttttcttctactagtccgctctatattccatagtggaaatactcaaaaattcagaaaaaagtaaaagagtctaattagatctatctcgaatttttgagaaccctttgagaaggcgttcaaggggttctcaaatcaaacacaaaaatggaagttttttccatttcattaaggttttatgttatgtaatcatttagatgggtaatgtaaatgaaccataactatgtaaacctattcctaatagattgataccaaaataacagatccaaattataagaaatcctatggaagctacaaatgctgacttcgtacccttccaatttggatttgttctactatgtaaataaattgcaaatatggtccaagtaataaatgcccaagtttctttaggatcccaattccagtaggatccccacgcctcattagcccatactgctccacaaagaatacctatggttaaaagggtaaaccctagactaatgacacgataactccaagaatccaaacgctcaattaattgatatttgtaataatttggaaataaaggaaaaaaggtgctttttaaagcacttctttttgcatagaaatattcaatctcattaaagaaaaatgttttgcttaaaacatttttcttctttttcgaaaaaaaatctaaattctttcgaaatctaatcat

SEQ ID NO: 34074 - DNA, 2472 bp, Oryza sativa
catgaaaggaagatcaatgactcatataaattacttaatggaaaatgtcccgaagaagctccaacgagaaactaagaatcctgttatacagaaaaaagtggctatcattcctttttctgacgaatcacgcaatcccccaagttcacgaactaataaggttattaaatgaatcgtaatcacaattgaaattgttgagaaagaaatatgagttagtatatgttctaaagttgcaaatagcataaggagaaggtcccattacaaaattggaaatttcgaattgaatccattttattttataatctattgtattctttttcgagactgccgccactcggactcgaaccgagatgcttgagcactgcttcctaagagcagcgtgtctaccaatttcaccatggcggctaagttgaaataacaggtttattaaaagaatattaagttattttctcgcgaatcgtcgagattggaagattccatagaatttaggacattagaatcttcattaaaatagacttcgtttggtagtatcgttgcgaattttttaacaaaaaaattcttgctttgcccaatagaaactttgaaagagttggaacaattttttctcagttgcaatatagaactaatttttttgttaatttaggataagataggtagaagttgtaagtcttattgcaggaatactctacttttcataatagaatcccctttttttatttattatacggattctattacgaaaagttcattgataggaaaagaatatttaggtcacagtataccaaaaaccctttttttatatatcagagaggtttgttctaagaatattgtaccgaggaattcgacacataaaagtaaactcattaattaatcctaattattcctaattattcatattaaataattggaatttttgggggataggtcaattcatattatcccaaaaccctattatttgtttgttgccgagaaaaaccctttggttttggatgctcgctgacgccagaaaatgatcttgattttgctaaagaataagattgtactatggaaaaataagtctttttcttccaaagatttttacgaatacgcttttttgacatcgaagtacgtttttttggaactgccattcaaaaaggaaattacttttttctagttgtatgtgaaagacatctattgccgcaaatcaatccatctttcttctttttcttagtatttatacttagatactaaaagatattgaaattctgaattcttttttacttcattttgtctaatgcggataagacaagagttttttaacatattatatattttttttagactttgttttaataatatagaatatatacaaaggttttctatttaaatcaatttatatttcaagtatactctccatatacagatataaggtatgggggcctatcccccatataagacgggaggataaaaggaagggaaaattcaatcaaatagttaattaaagtattccagaattgaattccaatcaatttgagttacgaaacaagggagctgcttcattttaatacaaaaaaatattaaagtaaaatgattcaatcttttttttgtattttaataaaagtccttctttaggtaataactaggtaacgaagttatttcattaactttttgactttaaccaacaaaacctattcttattttttgattgtttcaatgagaaaatttttgaaaaattaagaattctagtatttttttattccttcagaaatagataagaattagtttggtgaatcggaaacttttttcaattttatagaaaaattgaagtaaaattttcaagtaaaaattgcaatttcttttcttatggaacatacatatcaatatgcatgggtaatccctcttctcccacttccagttattatgtcaatggggtttggactttttcttgttccaacagcaacaaaaaatcttcgtcgcatatgggcttttcctagtgttttacttttaagtatagctatggtattctcagttcacctgtctattcaacaaataaatggaagttctatctatcaatatctatggtcttggaccgtcaataatgatttttccttagaatttggatacttaatcgacccgcttacttctattatgttaatactaattactactgtaggaatcctggttcttatttatagtgatgattatatgtctcacgatgagggatatttgagattttttgtttatataagttttttcaatacttccatgttgggattggttactagttccaatttgatacaaatttattttttttgggagcttgtgggaatgtgttcctatttattgataggcttttggtttacacggccaattgcagcgagtgcttgtcaaaaagcttttgtaactaatcgtgtaggggattttggtctgttattaggaattctaggttttttttggataacaggtagtttagagtttcgggatttgtttaaaata

SEQ ID NO: 34075 - DNA, 969 bp, Oryza sativa
  unsure (1)..(969): unsure at all n locations
tcnnnnnnnnnnnnnnnnnnnnnnnnnnnnnnnnnnnccgaaccgaattttcgctgggttgtttgtaagtaagctaagtaaatagtacacgatggagctcgagaggacagaatttattttttatcaagggaaagaatctagggttagtgaaaactaataaattaggccaactttgtcattctacccttaatatagaaatcgaaataatatagaaatcaaaaggttaaaataagaagaaagtccaattttggaagatatgggaaaactcttttgattaaaagtctatcagaatcaatcgctcatattcgatttctatagaagagggaaatgctttatcgaaggaaataagaaaaaagggtatgttgctactcttttgaaagaaaaaagaataagaattcccgaagtaatgtttaaacccaaggatttcacaggggatcctagataaaggattcccgaacaagtaaacacgattttcaactgtctcaacaatagaattggaccggaataaggaataaaagtgaatttgttcgagatgaggcaaagaaaagagtttagagacgactcaaaaaatttcaaaggatttttttctttcaagtctgtcaatcaaaattagtcaacttgagtcatgagtataaatgaaatttgttttttctgtacggaaattaatgcaagtcatattctcgagccgtatgaggagaaaacctcctatacgtttctagggggggctttgtttgagtaatagcaaggagattccccaatatcatgctaagaatagctaggatttccagaagaagatgccattcgtttgatgagaaataaaaaggaatatcgagaattcgcgtggctgaagctgaagcagcaactttcgaagtaacagaaagaaaagcaacgactggagtgggggagtcagagtcgaaaagaggattcctcgcttctttctctcatgcaaaaccgtgcggggatcctcta

SEQ ID NO: 34076 - DNA, 744 bp, Oryza sativa
  unsure (1)..(744): unsure at all n locations
nnnnnnnnnnnnnnnnnnnnnnnnnnnnnnnnnnnnnnnnnnnnnnnnnnnnnnnnnntattgtgaacttgtatagttcacattctttggcgaggaacatgtgctagggtgtatgtgcgactcgttcggatcatgggttcaaacaaataagacaatttttgaagtatccatgatcggtaccaatgaataggatagagcttctctatcctagatttctacggtatatggaatttctggtttcctttggtgcaaatccaatcatctagattggaaataagaagcaattcccccattggtagcaaacggctattcattaagcggaggaaatagtaataaaaagataaaggcttatgctcctttatcttaaaaaaacggactaagagggtcagctacttagccaactttcataattaaatgccgtcactgtatggataactcttattgtgaaaagagctatttactctataatggataggtagagccaaagaatgtgaactatacaagttcacaataccctttgatgaaatgaaagaaagggctccggtgtatagagagggcctcgccgtttaaaagggaaccatagaaacgatggaacacaagaaaaaggcaaaaaagcctttttcttgtgcccaatagaggattaagaagaccagcaatccctcctaaaaggatttgttccttttattggtctcgcccttgccttgcattcttctcgttttgcatgagatgatagaaataaggaat

SEQ ID NO: 34077 - DNA, 1392 bp, Oryza sativa
  unsure (1)..(1392): unsure at all n locations
nnnnnnnnnnnnnnnnnnnnnnnnnnnnnnnnnnnnnnnnnnnnnnnnnnnnnnnnnnnnnnnnnnctggctgttcacggactagctgtacctactgtttttttcttgggatcaatatcagcaatgcagttcatccaacgataaaccaaattccaactatagaactatgacacaatcaaacccgaatgaacaaaatgttgaattgaatcgtaccagtctatactggggtttattactcatttttgtacttgctgttttattttccaattacttcttcaattgagagaaagaaagagagtagtaagaattctcttatccccatttggaaggataccatccttataactatccatgactgtttttgtctctagcatgaccacttgataaaatgtggaggaaagtaggggaaatggccgatactactggaagaattcctctttggctgataggctcgaatgaccccttctcataataagaatgtgcacggtctggtccggtatggaatgaacttataatctgatgatcgagtcgattccatgattataagttcattaccctagcgcccattcccattttgggcggaacagatctactaattcttttattccagttagtaagagggatcttgaactaagaaatagacctagcagctaaaagagggtatcctgagcaattgcaagaatggggttcattgatattcctggtatagtagatgctatcacacatacagtcatactcaattcgatggaattgtttgatcttaaaggggatcttctataatttcgcacataaggggttatttcttggtttcgtccagtcattaataacttgactatttttagataatagtagatagaaagaacgctcgtaaggagtcctattgaaaccaagaaatataggctgcttgccatccacaccagaatagatagagttttccgaagaaacctgctagtggaggaaggcctcctagggataagagacatagggctaaagagagagccaaaaaaggatctttcgtgtataatcctgcataatctcgaatgttatcagttccggtacgtagaccaaataatacaatgcaagcaaaagttcctagattcatggagatatagaaaagcatataagttatcatgcttgcatatccatcatttgagtctccaacaattattccaataattacatatccgatttgccctatggacgaatatgcaagcatacgtttcatgcttctacgcacaataatatgttgaactacttcaacaagtctacgtgtaagcccaaaaaaaataaatttgtatcaaattggaactagtaaccaatcccaacatggaagtattgaaaaaacttatataaacaaaaaatctcaaatatccctcatcgtgagacgggtac

SEQ ID NO: 34078 - DNA, 290 bp, Oryza sativa
aaagtatgttggtcttgcagaaactattaggggatttcaactaatgctttccggagaattagacgggttctaccatagaggccaacgatagacaataactcccccccgaacacagcttacaactttcatcgtactgtgctctccaaagagcaactcttctcaaaatctcaaaacaaaaggtggctgagttggaatcccattctaaggattcttgggggtccggggaatccagctacaggagaaacaagaacgggaagctctcccctttttccgccgacttttgatcttaa

SEQ ID NO: 34079 - DNA, 340 bp, Oryza sativa
catgaagaacataagccagatgacggaacgcggagacctaggatgtagaagatcataacatgagcgattcggcagatttggattcctttcctatatatccactcatgtggtacttcatcatacgattcatataagatccatctgtctagagatcgtcatatacatctagaaagccgtatgctttggaagaagcttgtacagtttgggaaggggttttttgagagaaaagaagaatctacttcaaccgatatgcccttaggcacggccatacataacatagaaatcacacgtggaaggggtgggcaattagctagagcagcaggtgctgtagcgaaactga

SEQ ID NO: 34080 - DNA, 792 bp, Oryza sativa
  unsure (1)..(792): unsure at all n locations
nnnnnnnnnnnnnnnnnnnnnnnnnnnnnnnnnnnnnnnnnnnnnnnnnnnnnnnnnnnnnnnnnnnnnnnnntaagcccaccccaagatgagtgctctctcctccgacttccctagagcctccggtagcacagccgagacagcgacgggttctccacccatacggggatggagcgacagaagcatggaaataggataaggtagcggcgagacgagccgtttaaataggtgtcaagtggaagtgcagtgatgtatgcagctgaggcatcctaacgaacgaacgatttgaaccttgttcctacacgacctgatcaaatcgatcaggcacttgccatctatcttcattgttcaactctttgatgaaaagatgaaaaaaccaaaaaaaagctctgcccttccatctcttggatagatagagagggagggcagaggcctttggtgtcccttccagtcaagaattggggcttcacaattactagccaatatttctctcatgcctttcctcgttcatggttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34081 - DNA, 430 bp, Oryza sativa
  unsure (1)..(430): unsure at all n locations
tnnnnnnnnnnnnnnnnnnnnnnnnnnnnnnttaactaatcgattacgaaaaattggatcggattttgcagttcttttttctgcagtacctcgacgtgacatgagcgtgaaagaggttcaagaatccgttttctttttataagggctaaaaacgaatcacttatttttttggctttttgaccccatattgtagggtggatctcgaaagataggaaagatctccctccaagccgtacatacaactttcatcgaatacggctttccacagaattctatagggatctatgagatcgagtatggaattcagtttactcacttaaaattgagtatccgtttccctccttttcccgctaggatcggaaatcctgtattttccatatccataccatcaagtccttaggtttccgaaatagtgtaatggaaaaaaaag

SEQ ID NO: 34082 - DNA, 597 bp, Oryza sativa
  unsure (1)..(597): unsure at all n locations
tatagggcgaattcgagctcggtacccgtcaaaatgaaattagtactatatcaatcaaatgtattgtagacaccagacgaagcaatggtttatccaaacttcaacaaataatgcaatatatttcttaatccgtttgtgagaaagcatgaaaagagccaagagactttaattttgggcttcaacaatcataattatacgaattgtatatacgaattcgaattagccaataaattggctatcgtcttttcaatataaattattgcaatattcaaattgcaatatcaatgaattgcaaaaattcaactaagtaaaaaagaatactatggaataacctactcaaaaaatagatattctcaaataataaatagtattcatgttactatttcatattattattatatgtgtccctttgtttagaagattctatgtctaattattcaaaaaattagattgattgatacgagttgatttcctattacgatggatggaagaaagaatggataatccaatagctgcttcagcagccgcaagnnnnnnnnnnnnnnnnnnnnnnnnnnnnnnnnnnnnnnnnnnnnnnnnnnnnnnnnnnnnnnnnnn

SEQ ID NO: 34083 - DNA, 702 bp, Oryza sativa
  unsure (1)..(702): unsure at all n locations
nnnnnnnnnnnnnnnnnnnnnnnnnnnnnnntcaaattgccgattatacccctacatacgtggttaccagatacccatggtgaagcgcattacagtacatgtatgcttttagcgggaatcctattaaagatgggagcatacggattgattcagatcaatatggaattgttacctcatgctcattatctattttccccgggtcggatgaagcaatagaattttgaaccagacgttttgatctttggttatccttcgtagtaataatatctcggggtttgcaacgaaaacttggtatatcgactatacgaccattaactaaaatatgtctatggttaactaattgccgggcctcgggaatggttgaagccatacctaatcgaaaaaggatattatccaaacgcatttcaagtaattgtagtaaaacctgacctgttgaactttttgcttttccagcgatatgtacatatctaagtaattgtcgttctgtcagaccataatgaaaacgcaatttctgtttttcttgaagacgaatacgatattgttcttttttcccagaatggaatttctttttcagattacttccggatttaggtgtttttttagtgagtcaaaattggatcagtgatcgatttctaggtttcgtcgtaaacctaattggttacttccaattacgtaaatcaataggtcaaaccgcactcaaag

SEQ ID NO: 34084 - DNA, 669 bp, Oryza sativa
  unsure (1)..(669): unsure at all n locations
nnnnnnnnnnnnnnnnnnnnnnnnnnnnnnnnnnnnnnnnnnnnnnnnnnnnnnnnnnnnnnnnnnnntcttatagtttaggcgctttatctgtctttggttttatcgcttgttgttttgtctggttcaataatacagcttatccgagtgagttttatggacctactgggccagaagcttctcaagctcaagcatttacttttctagttagagatcagcgtcttggagctaatgtgggatctgcccaaggacccacaggtttaggtaaatatctaatgcgttccccaacgggagaggttatttttggaggggaaactatgcgtttttgggaccttcgtgctccatggttagaacctctaaggggccccaacggtttggacttgagtaggttgaaaaaagacatacaaccttggcaagaacgacgttcggcagaatatatgacccatgctcctttaggctctttaaattctgtgggacgtaaagctattgaacttgggtatgctctttccttttgtcgaagtggaatcgtagaacagaatgtgatacgatgagataaaatgcaatagaaacaaggatagcgaacgggttacctactcctaagggtcaaagcaagccctttaattcaattctttattcttacattaaagaatgaatcaaatctccccaagt

SEQ ID NO: 34085 - DNA, 694 bp, Oryza sativa
  unsure (1)..(694): unsure at all n locations
aggtagaaaaatttttggatttatggttaaagaagaaaaagaagaaaactggggttctgttgaatttcaagtattcagtttcaccaataagatacggagacttgcttcacatttggaattacacaaaaaagatttttcatcggaaagaggtctccgaagacttttgggaaaacgtcaacgtttgctggcttatttggcaaagaaaaatagagtacgttataagaaattaatcagtcagttggatattagggagcggtaatttcatcgttcgaattttttttcttattttattagtagtcttatagtagtcttagattttgcattttgatgagcctcgttttgaggaattcatggaataatccattttcatggaataatgaattaaggaagaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34086 - DNA, 1457 bp, Oryza sativa
tccaaatcgaaaggtttccgtgatatgacagaggcaagaaataacgattgcaaaaaatccttcctttttctttcaaaagttcaaaaaaattatattgccaattccattttaggtatattcttttttcttaatgttaataaaaaaaagaagaaaattcttcttttttctttctaattctaaaattggatattggctaaaagacaatcagatagattttctcttcagcaggcatttccatataggacttgttataataaaacaagcaggttatagaaaaaaactcttttttttattatttatcaacaaagcaaaaaggggtcttatcaaaccaacccaccccataaaattggaaagaaagataaagtaagtggacctgactccttgaatgaggcctctatccgctattctgatatataaattcgatgtagatgaaattgtataagtggatttttttgtatttccttagacttagaccacgcaaggcaagaatttctcgctatttactatttcatattcttgttactagatgttctataggaataagaagaaatcgcaacccctttccgctacacataaaaatggatttcgaaagtcaatttttcttttcaatatctttactttttttcagaatcctatttttgttcttatacccatgcaatagagagcgagtgggaaaagggaggttactttttttcatttttcccttaaaaaataggctttcttggaaataggaatcatggaataatcctgaattccaatgtttatttctatagtataagaaaaactaattgaatcaaattcatggatttaccacgacctcggctgtgaccccatagataaaaatgcaaaatttctatcttcgagaccattgaaaaaaggcattgaacgagaaaaaatcgtccacagataatctatcgtatgccttggaagtgatataaggtgctcggaaatggttgaagtaattgaataggaggatcactatgactatagcccttggtagagttactaaagaagaaaatgatttatttgatattatggacgactggttacgaagggaccgttttgtttttgtaggatggtctggcctattgctttttccttgtgcttatttcgctttaggaggttggtttacagggacaacttttgtaacttcttggtatacccatggattggcgagttcctatttggaaggttgcaatttcttaaccgcagcagtttccacccctgccaatagtttagcacactctttgttgctactatggggcccggaagcacaaggggattttactcgttggtgtcaattaggtggtctgtggacttttgttgctctccatggggcttttgcactaataggtttcatgttacgtcaatttgaacttgctcggtctgttcaattgcggccttataatgcaatttcattctctggcccaatcgctgtttttgtttccgtattcctg

SEQ ID NO: 34087 - DNA, 520 bp, Oryza sativa
tacaccaaaaatattcttttaaacgagggtattcgtgcgtggatggcagtcaggatcagcctcatgaaaatcttatattccctgaggaggttctaccacgtggaaacgctctttaatggaacttttgttttagctggtcgtgaccaagaaaccaccggttttgcttggtgggccgggaatgccagacttatcaatttgtcgggtaaactacttggagctcacgtagcccatgcaggattaatcgtattctgggccggagcaatgaacctatttgaagtggcccattcgtaccagaaaaacccatgtatgaacaagggttgattttacttccgcacttagctactctaggttggggagtagggcccgggggagaagttctagatacttttccgtactttgtatctggagtacttcatctaatttcctccgcagtcttaggcttcggtggcatttatcacgcgcttctgggaccggagactcttgaagaatcttttccattcttcggttatgtgtgcaaaga

SEQ ID NO: 34088 - DNA, 725 bp, Oryza sativa
  unsure (1)..(725): unsure at all n locations
nnnnnnnnnnnnnnnnnnnnnnnnnnnnnnnnnnntttcctgatcagaaaaatacatgaaaaagaaaggaggtagaaaaatttttggatttatggttaaagaagaaaaagaagaaaactggggttctgttgaatttcaagtattcagtttcaccaataagatacggagacttgcttcacatttggaattacacaaaaaagatttttcatcggaaagaggtctccgaagacttttgggaaaacgtcaacgtttgctggcttatttggcaaagaaaaatagagtacgttataagaaattaatcagtcagttggatatccctagagtagctgttaatacgaataacagaaactctgttatagccatttctgtacattcaatgtactctacggatagaggaatacataaagttgaacataataaaataagaaattgaaagatttcgttgaaattgttcgtttggaaattttccgaaaagctaattataggttcttctcttcatcggaacaatagggccggtatgcttattactaaacttgttgaagagatgaaatagaaccaaggtctatctttttgatcagaggttaaatcgatcatcagaagaagaattaggcccaaaattaggatacattctgggaaaatgaaacttccctggaagagaagcaaatgaaacgctttcataaaaattctcgtagaatcgagaatgaagttttcattctgtacatgcc

SEQ ID NO: 34089 - DNA, 603 bp, Oryza sativa
  unsure (1)..(603): unsure at all n locations
nnnnnnnnnnnnnnnnnnnnnnnnnnnnnnnnnnnnnnnnnnnnnnnnnnnnncaatttctatgaaatacaagatgctcattgaatgataagaaattcatgctcacttatacaacacaactccagattttatgcaagtcaaggaatatttttacgctctgttcctagatgaaacagaatacctattacattctaattaattccaattatacaaaaggttcagatagactaagcaaaaaagggcttcatttcgttggaaaatcacatattcatttccttcgtatgaacagaaaaatatgatgactcaaagaagttccctaccacgaactttgtaccgcgtgcattacttagaacaactagtaaagtaagataagataagcaagaataaaaaaatatttgtcggaatagcggaatagaaaattaagaaatgcaaaaatgcagaaaaagaagtgcctctatttagagatttatctacttagatgaaaaaatcatactctatctatattattaacgaatatgtatcccaacccatctcgaggtatttgtatcaatacctattcggaagatcccttttttctgtgccaggaaccagatttgaactggt

SEQ ID NO: 34090 - DNA, 4749 bp, Oryza sativa
  unsure (1)..(4749): unsure at all n locations
nnnnnnnnnnnnnnnnnnnnnnnnnnnnnnnnnnnnnnnnnnnnnnnnnnnnncgcggaagctggattattacgggccatatttggtcttgaggtatccacttcaaaagaaacttctctcaaactaccgataggtggaagaggacgcgttatcgatgtgaaatggatccagagggatcccctcgacataatggttcgtgtatatattttacaaaaacgcgaaatcaaagttggggataaagtagccggaagacacgggaataaggggatcatttccaaaattttgcctaggcaagatatgccctatttgcaagatggaacgcctgttgatatggttttcaatcccttaggagtaccctcccgaatgaatgtgggacaaatatttgaaagctcgctcggattagcaggggatctgctaaagaaacattatagaatagcaccctttgatgagagatatgagcaagaggcttcaagaaaacttgtgttttcagaattatatgaagccagtaaacaaacaaaaaatccgtgggtatttgaacccgagtacccgggaaaaagcagaatatttgatggaagaacaggagaccccttcgaacagcctgttctaatagggaagtcctatatcttaaaattaattcatcaagttgatgagaaaatccacggacgctctactgggccctattcacttgttacacaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaacgctacgatctggggaaaacgagtacctaatcacgaggatcctccagaatcttttcgagtgcttgttcgagaactacgatctttggctctagaactgaaccatttccttgtatctcagaagaacttccaggttaatagggaagaagtttgatcggaataaatataaattcttttcttatttctattttatgattgaccaatataaacatcaacaacttcaaattggactcgtttcccctcaacaaataaaggcttgggctaacaaaacactacctaatggggaagtcgttggcgaagtcacaaggccctccacttttcattataaaaccgataaaccagaaaaagatggattgttttgcgaaagaatctttggacccataaaaagcagaatttgtgcttgtggaaattctcgagcgagcggagctgaaaacgaagacgaaagattttgccaaaaatgcggagtagaatttgttgattctcggatacgaagatatcaaatgggatacatcaaactcgcatgtcccgtgactcatgtgtggtatttaaaaggtcttcctagttatatcgcgaatcttttagataaaccccttaagaaattggagggcctagtatatggcgatttctcttttgctaggcccagtgctaaaaaaccaactttcttacgattacgaggtttattcgaggatgaaatttcatcctgtaaccatagcatttccccctttttttctaccccaggctttacaacatttcgaaatcgggaaattgcgacaggagcaggtgctattagagaacaattagcagatttggatttgcgaattattttagagaattcctcggtcgaatggaaggaattagaagacgaggggtatagtggagatgaatgggaagatagaaaaagacgaataagaaaagtttttttgattagacgcatgcaattggcgaaacattttattcaaacaaatgtagaaccagaatggatggttttgtgcttattaccagttcttcctcccgaattaagacccattgtttataggtctggggataaagtagtgacttcggatattaatgaactttataagagagttatccgtcggaacaacaatcttgcctatctattaaaaagaagtgaattagcgccagcagatttagtaatgtgccaggaaaaattggtacaagaagccgtggatacacttcttgatagtgggtcccgcgggcaaccaacgagggatggtcacaataaagtatacaaatcactttcagatgtaattgaaggtaaagaggggaggtttcgcgaaactctgcttgggaaacgggtcgattactcggggcgttctgtcattgttgtgggtccttcactttcattacatcaatgtgttacctctagagatagcaataaagctttttcagctatttgtaattcgcgatttaatcacgaaacgtgctacttctaatgttaggattgctaaaaggaaaatttgggaaaaggaacccattgtatgggaaatacttcaagaagttatgaggggacatcctgtactgttgaatagagcacctaccctgcatagattaggcatacaggctttccaacccactttagtagaggggcgtactatttgtttacacccattagtgtgtaaaggtttcaatgcagactttgatggggatcaaatggctgttcatctacctttatccttggaagctcaggcggaagctcgtttacttatgttttctcatatgaatctcctatctcccgctattggggatcctatttgcgtaccaacccaagacatgcttatcggactttatgtattaacgattggaaaccgtcgaggtatttgtgcaaatagatataatagttgcggaaactatccaaaccaaaaagtaaattacaataataataatcctaagtatacgaaagataaagaatctcttttttctagttcctatgatgcactgggagcttatagacagaaacaaatctgtttagacagtcccttgtggctccgatggaaactagatcaacgcgtcattgggttaagagaagttccgattgaagttcaatatgaatctttggggacttatcgtgagatttatgcccactatctagtagtgggaaatagaaaaaaggaaatccgttctatatacattcgcaccactcttggtcatatttctttttatagagaaatagaggaagccatacaaggatttagtcaggcctattcatacactatctaaacaaggaagttagattcggggatgcccctttcgaggggcattccgatttcgctagtatcatcatttttgccgcacgaatccagattgagattgaggaaaggaagttaactaagttttcgaatcactgactcaggcccattgtcgaatcctactcagcaattgtcgaattatactcagccgaaaaagggggtacttatttatggcggaacgggccaatctggtctttcagaataaagagatagatggaactgctatgaaacgacttattagcagattaatagatcatttcggaatgggatatacatcccatatactggatcaaataaaaacgctgggcttccatcaagccactactacatcgatttcattaggaatcgaggatcttttaacaataccctctaagggatggttagtccaagatgcggaacaacagagttttcttttggaaaaacactattattatggggctgtacacgcggtagaaaaattacgccaatccgttgaaatctggtatgctacaagtgaatatttgaaacacgaaatgaattcgaattttcggataacagatccttctaatccagtctatctaatgtctttttcaggagctagaggaaatgcatcgcaggtacaccaattagtaggtatgcgaggattaatggcggatcctcaaggacaaatgattgatttacctattcaaagcaatttacgcgagggactttctttgacagaatatataatttcctgctacggagcccgcaaaggggttgtagatactgctgtacgaacggcggatgctggatatcttacacgtagacttgttgaagtagttcaacatattattgtgcgtagaagagattgtggtactatccaagctatttctgtgagtcctcaaaatgggatgacggaaaaactttttgtacaaacattaattggtcgtgtattagcaaacgatatatatatcggttcacggtgcattgccactcgaaatcaagatattggaattgggttagtcaatcgattcataaccacctttcgagcacagccatttcgagcacaaccaatatatattagaaccccctttacttgccggagcacatcttggatctgtcaattatgttatggtcggagttccactcatggcgatctggtcgaattgggggaagctgtaggtgttattgcgggtcaatctattggggagccagggactcaactaacattaagaacttttcatactggtggggtattcacagggggtactcccgaccttgtacgatccccttcaaatggaaaaatccaattcaatggggatttggttcaccccacacgtacccgtcatgggcagcctgcttttctatgttatatagacttgcatataactattcagagtcaggatattctacatagtgtgactattccttcaaaaagcttgattctagtgcaaaatgatcaatatgtagaatccgaacaagtaattgcggagattcgtgccggaacgtccgctttgcattttaaagaaaaggtacaaaaacatatttattccgaatcagatggggaaatgcactggagtaccgatgtttatcatgcgcccgaatatcaatatggtaatcttcgtcgattaccaaaaacaagccatnnnnnnnnnnnnnnnnnnnnnnnnnnnnnnnnnnnn

SEQ ID NO: 34091 - DNA, 1840 bp, Oryza sativa
cgtagaagagattgtggtactatccaagctatttctgtgagtcctcaaaatgggatgacggaaaaactttttgtacaaacattaattggtcgtgtattagcaaacgatatatatatcggttcacggtgcattgccactcgaaatcaagatattggaattgggttagtcaatcgattcataaccacctttcgagcacagccatttcgagcacaaccaatatatattagaaccccctttacttgccggagcacatcttggatctgtcaattatgttatggtcggagttccactcatggcgatctggtcgaattgggggaagctgtaggtgttattgcgggtcaatctattggggagccagggactcaactaacattaagaacttttcatactggtggggtattcacagggggtactgccgaccttgtacgatccccttcaaatggaaaaatccaattcaatggggatttggttcaccccacacgtacccgtcatgggcagcctgcttttctatgttatatagacttgcatataactattcagagtcaggatattctacatagtgtgactattccttcaaaaagcttgattctagtgcaaaatgatcaatatgtagaatccgaacaagtaattgcggagattcgtgccggaacgtccgctttgcattttaaagaaaaggtacaaaaacatatttattccgaatcagatggggaaatgcactggagtaccgatgtttatcatgcgcccgaatatcaatatggtaatcttcgtcgattaccaaaaacaagccatttatggatattgtcagtaagtatgtgcagatctagtatagcttctttttcgctccacaaggatcaagatcaaatgaatacttattccttttctgttgacggaaggtatatctttggcctctcgatggctgatgatgaggtaagacatagactgttggatacttttggtaaaaaagatagggaaattcttgattattcaacgccggatcgaatcatgtccaatggtcattggaattttgtctatccttctattcttcaaaataattttgatttgttagcgaaaaagcgaagaaataggttcgccattccattacagtatcatcaagaacaagagaaagaaccaatatcctgttttgggatttcgattgaaataccctttatgggtgttttacgtagaaatactatagttgcttattttgacgacccacgatacaaaaaagataaaaagggttcaggaattgttaaatttagatataggaccctagaggacgaatataggactcgagagaaagactcagagaacgaatacgggagcccagaaaacgaatataggacccgagaggaagaatgtaaaaccctagaagacgaatataggactcgagaggaggagtatgaaaccctagaagatgaatatgggatcccagagaacgaatatgaaaccctagaagatgaatatggaatcctagaggacgaatataggactcgagaggaggaatccgaggacgaatatgggagtccagagaacaaatataggccccgagaggataaatatggcactttagaggaagactcagaggacgaacatgggactttagaggaagactcagaggaagactcagaggacgaatatgggaacccggaggaagattccgtcttaaaaaagggggttttgattgagcatcgaggaacaaaagaatttagtctaaaataccaaaaagaagtagatcggttttttttcattctccaagaactgcatatcttgccgaaatcctcatccctaaaggtacttgacaatagtattattggagtggatacacaactcacaaaaaata

SEQ ID NO: 34092 - DNA, 634 bp, Oryza sativa
  unsure (1)..(634): unsure at all n locations
ggatctgttacaagatcaattcggactggctcttggtcgtttacaacatgcggttcaaaaaactatccgtagagtattcatacgtcaatcaaaaccgactccacaaactttggtaactccaacttcaacctcgattttattaataactacttacgagaccttctttggtacatatcccttatctcaagtttttgatcaaaccaatccattgacacaaacggttcatgggcgaaaagtgagttgtttgggtcctggaggattgacggggagaactgcaagttttcggagccgagatatccatccgagtcactatgggcgtatttgtccaattgacacgtccgaaggaatcaacgttggacttactggatctttagctattcatgcgagaattgatcattggtggggatccgtagagagtcctttttatgaaatatctgagaaagcaaagaaaaaaaaagagagacaggtggtttatttatcaccaaatagagatgagtattatatgatagcagcaggaaattctttgtccttgaatcggggtattcaggaagaacaggttgttccagctagataccgtcaagaattcctgactattgnnnnnnnnnnnnnnnnnnnnnnnnnnnnnnnnnnnnnn

SEQ ID NO: 34093 - DNA, 1422 bp, Oryza sativa
gatgggtatttgcgtgttcattttcaaaattacagtagtactaaagaggatgcgttgtattcaatatcgttatggggaaaaaggatatctaaaggagtcaatagagatttcgttttatcaacagcgaagagtggagtttcttttttttcacaaaatctatccaaaattcatgttaatacaggaaataggatagggtcctttagtacttcattggggactaaaaacacttttgtctatcctcatgaaccgggaaatactatgctatttcctcttcttatattactgctttgtactttgtttattggatctataggaatccattttgataatgaaataggggaattaaccatattatcaaagtggctaactccctcaatcaactttttccaagaaagttctaattcttccataaattcatatgaatttatcactaatgcaatttcttctgtaagtctagctatttttggtctattcatagcatatatgttttatggatctgcttactctttttttcagaatttggatttaataaattcctttgtaaaagggggtccgaaaaagtattttttccatcaactaaaaaaaaagatatatagttggtcatataatcgcggttatatagatattttctatactaggacctttaccttgggtataagaggattaaccgaactaacgcagtttttcgacaagggtgtcattgatggaattaccaatggagtaggtcttgctagtttttgtataggagaagaaattaaatatgtagggggaggtcgaatttcgtcttatttattcttttttttatgttatgtatctgtgttcttattcttttttctttcttaaggaattcccctatctcctgcctaagtagctttcctatttgccgattttttccattcctctgtgtaaatagcctaatatgggttcacaatcaataacatcttcaccatcgagagtaacgatcagtcgaagaacaccatgcattgatgggtgctgagggcccatattgactatcatgagatcttttcttgtaagcggtagactcatatcctttcttccttaattcattattccatgaaaatggattattccatgaattcctcaaaacgaggctcatcaaaatgcaaaatctaagactactataagactactaataaaataagaaaaaaaattcgaacgatgaaattaccgctccctaatatccaactgactgattaatttcttataacgtactctatttttctttgccaaataagccagcaaacgttgacgttttcccaaaagtcttcggagacctctttccgatgaaaaatcttttttgtgtaattccaaatgtgaagcaagtctccgtatcttattggtgaaactgaatacttgaaattcaacagaaccccagtttttttttttcttttttaaccataa

SEQ ID NO: 34094 - DNA, 652 bp, Oryza sativa
ggggggtattctcttggtaggattctagacatgcgaataatatagaatccaaaaaatgcattgatcattacatggaattctattaagatattatatgaaagtcgaatttcttccactctcatttgagagtgcgaatacaaggaggtattttgtgtttgggaaagtccgaagaaaaaaggattttgaatcctccttttcctttttcccttagaaaaataactcaatcaaaatccaattatctactctacaagaacgaaacgcttgttatgcctaatatacttagtttaacctgtatttgttttaattctgttatttatccgactagttttttcttcgccaaattgcccgaagcttatgccattttcaatccaatcgtggattttatgcctgtcatacctgtactcttttttctattagcctttgtttggcaagctgctgtaagttttcgatgaaatctttactactctgtctgccaaattgaatcatgtattcattctaaaaaaattcgaaaaatggataagagccgagaagtcttatattatgaaccttcgattctaaaattcaaattcttctacattgaatgtatagctgcagcaataaatttggatcagcctttctactccctgcatctacgttgagcaggtatctttag

SEQ ID NO: 34095 - DNA, 4706 bp, Oryza sativa
  unsure (1)..(4706): unsure at all n locations
tgggaccttcgtgctccatggttagaacctctaaggggccccaacggtttggacttgagtaggttgaaaaaagacatacaaccttggcaagaacgacgttcggcagaatatatgacccatgctcctttaggctctttaaattctgtgggtggcgtagctaccgagatcaatgcagttaattatgtttctcctagaagttggttagcgacttcccattttgttctaggattcttctttttgtgggccatttgtggcatgcaggaagagcccgggctgctgcagcaggatttgaaaagggaatcgatcgtgatttggagcctgttctttacatgacccctcttaactaagattttcttatttatacctgttctactgtttttttctgttctggctcggttattctatctagccgagccattcattcctttctatgaaagaaagataaggggacagaacaaaaaaaacaaataaagaaacaaacgtattcaatacgcaaaagaaaagagagaggaaagcaaaaggagagagagggattcgaaccctcgatagttcctagaactataccgggtttcaagaccggagctattaaccactcagccatctctccacagcctaatccttattttattcctacaaatagaacatagccatacgaaatgactcactaacctctagaaacatctcaaatacaaatcccttttcgatatatttctgtatactgtatccatgtatacaggatccgctatatccgcttgtgaaataaagcataaaaccccctcaaccccatatccaaataaaaaaagtggtgagtaataagttttaaagagaagaatcaatggattcatgattaaacccctcctacttcttgtattttattacaattttgattaagtgagggatcaaatataatatgtagtcaactttatttgatggtaacttggaggattagaaatatgactattgctttccaattagctgtttttgcattaattgtgacttcctcagtcttagtcattagtgtaccccttgtatttgcttctcctgatggttggtcaaacaataaaaacgttgtattttccggtacatcattatggattggactggtctttctggtagctattctaaattctctcatttcttaaatgtgtttagtatttagtagcccgatacaaaataaaaaagggccgtttattcggattgtgagacgcattaaaatgcaatttgcgccccgaattgattgacagacaattaaattaataaaaagaaaactcaaatagaaaatgaaacggtcgacccagacatagacggtcgacccaggcggatataccctataaaatataggacgtagcgagcgtagttcaatggtaaaacatctccttgccaaggagaagatacgggttcgattcccgccgctcgccagcttaatttagtaaggtactatgataaaaaatttagtctacttttattaaagtaataggtgttagtctagtaccgtacccctttactatcttaaccccctttgcaccccactcaaaaaaagagcactacagcggcggggaatcgaactcggcaacagggttccctaaaccggggattcaccgaaacaaacaaccagcaaacagcttttaaagggaagggagatagactgtgcctttctttcatttattttttcttttctgcaaggtagggagggggccttgagagttcctcttgtggtagcaagttacttcgcaacctgctcaatttgggcttatagggtcgggaactaatgaataaaaagggttggataccgcccaaccacccagccctctaccatgtctagacaaatagaatagttattttatacagactgctaagtgcggagacgggaatcgaacccgtgacctcaaggttatgagcctcgtgagctaccaaactgctctactccgctctggagcgctggaaaccggtggacgaaaaaggttgaatacaggcctctaccatgtctagacaaatagaatagttattttatacagaatgtnnnnnnnnnnnnnnnnnnnnnnnnnnnnnnnnnnnnnnnnnnnnaggggttatagtgacgttggttgattattattaacgtctctaattcaaaaccgaacatgaaattttgatttcattcggctcctttatgggtattctcaccacttaacatctaagtcagcttttttgtctgaatggaaccaaggctctctgctttctagatgatccctaaagagtaggagatagaaatttgcctaaatctatctaatctaattacttcgttccctaatttcatttaagagatcctgaggaaaagaattgggtttccaccgagctgaaacaatatgctgatggttctagtaaaccaaaactaccgttttttagctatttggcttccatttccttttttaacaaaagaagatttagttacgattggaaataaatttttttgtatcttcatccatagatcctttactcatatttaaaaaattggaatccttaatccaatgcaaaattatgttttgtgactttgtattcataatccaaatcttatttgttttttggatgcaatttcaattagtctttgggtacaaatcgcgaaaatgcatattcttcctcaatatgctattgagagaaaaaggagtaaatcctttctaagaactaaagttttcatcggaatataaaaaaccttaaggacgccttaagtatatcatttcaaattcagttattaatagaacgaatcacacttttaccactaaactatacccgctacatgtaaattctgataccaacgctaccctttgtcaagggtagccattcgagaaagatgctaattccctcttagttaatgaaacagagaaggttcctcacagttagcggttggtacttcgatcgcgggcctttcctttactttcttttttgttcagaattgaacaaagaatttggggaagaaaacatcttcccccacttatcatgaaatctgggccatagagaaagagtgagatgtttttttttatttatcatagacactttccctatggcttgagagaaacaataaataacttaaagaaaaaggcacataggagccgaaggatttacttgatgtaaagaagattctgaatgtctctgcttagtcgattctctccgtttaactttttcttctcttcttttccactcaattctagtttattagattcttgtttaaaagaatcaaagaagatgaatagaactaagaacacacaaaaaagaacatataggcccgagaccattaccaaaagttcttcccaataatcatattgggtatctgttcccttccttttcctattaggatggggcatgttggattttccatatccatataccatcgaaccttaagggttccagaaccctccttttttgctagttttcggaaacggaaaaccctgaaccaggagcagtataaattctactgcccgccttttacaagaaaattggtgataaaactccactacagtttgttcaaaatgcaccaatcagaatcccttgagaatattcaagtaccctatttctaagatatttctaagagaagaggtacctgctgaaaatcgcttcaacaaatccgcttaagaaaaattgcaaagttttgaactcgaaggtttttccaagggatgcctgttaaaaattgtttcaacctctcaccaaaacagacaagaagtatatcactgaaaattaatacccagccatatgggtatatgaagggcggaattcgtttataccccacccaattagaggaaataaaacataaatggagaaagttttcatgataagatcagccaatagaagaaaaaagtccctaatttttcagaccgttctgagcatgtgaaaagtcaatagcctaaagataaaaaaccctatactttgtgcaagtgataagagagaatatgaaagattttcctatttttcttgattttcttaagatttttttgaacctgaccatgaatagacttatatatctcgatatatacagatataatgtacattatggagtagacctataatgggaaatgaaagtggctaattttggaattgaatagaagcccttttaactcagtggtagagtaatgccatggtaaggcataagtcatcggttcaaatccgataaagggctttttttacttagtggtagagtaatgccgcggtaagacgtgagtcagtggttcaaatccgatacagtacttttctactaaattcattcactttctttctttttgaaaatttctctttttttattgaatttgataacttagtgcgagatgcatgcatttttagtttaaacactaagcgaagcaggggggtgtaaattccaaaaaagaaattggactctttttcctattagatcaatcaaatcactacccgtactgaactaatatagaatcccttttattaatctattcttattccatatcctttataaacgaatttccctaaaaagtaggggatgatccgtgaattaacctaaccatcaactaaaaaaaatcctacaaaagcataatggaaaagtaggaaggactccttgctttggatctagttatactcttcgagtatattgacaattccaaaaaactgctcatactatcattatagtataatgaggagcggttgtataccgccctatcgtctagtgatgcccctatcgtctagtggttcaggacatctctctttcaagg

SEQ ID NO: 34096 - DNA, 1718 bp, Oryza sativa
  unsure (1)..(1718): unsure at all n locations
ttggatctagttatactcttcgagtatattgacaattccaaaaaactgctcatactatcattatagtataatgaggagcggttgtataccgccctatcgtctagtgatgcccctatcgtctagtggttcaggacatctctctttcaaggaggcagcggggattcgacttcccctgggggtagggagtattatgaaaggaggttaatcatagattatcaaaaaccctagaataaattcttcctgggtcgatgcccgagcggttaatggggacggactgtaaattcgttgacaatatgtctacgctggttcaaatccagctcggcccaaaaatctagggcttcgtgaatatgagttaaatccattttttttcttccataaaaaagaatatttgatccatagaaataaaagaaataaaggataaaaagaaaaggggaaatatctttctaatctatatctctttcattcctctcttacaaacaaaagaccttttcttattggttattgaaaggtggattattatctatttttagcgataataaatcgcgacatactagttatgtcattctcactatacccccatacgatacgggggtatgtagtatatgattcgtctatttcttagagtaggacaggcgaatattcttattcttatggttccatttaagaataagtatgccatacgccccgcggggattgtagttcaattggtcagagcaccgccctgtcaaggcggaagctgcgggttcgagccccgtcagtcccgaactagggttcaatgaatggagaaattcatctttcctttttccatgaaaaaaggggggcaggaagcaagatcaaatacctatggggtacccctatttcactttttttagttcgcgtttctcagtaaagagaggagagtataggaatttttttatcactacttctggttgatagcgaaagacatacatatcatacgtggaagggatcctcctatgttatactattccactctcaaccatgaattgatttgatagatccgatattcataatattgaattgattcagtattatcagaatgcaagtcctccccttgaatttacaggatacccttttccctctccatgggattacatcccgagttattgcgaaaaaaaagaggttatggaagtcaatattctcgcatttattgctactgcattgttcattctagttcctactgcctttttacttattatttatgtaaaaacagtcagccaaaatgattaattggaagttcaattaatcattgaagaaatgaaaaagggattaaataaaataaaaatccaagtcttaaatgaaaggatccggttggaatcataaagtgtggtagaaaaaactacatatagttttttctaccacactttagagtctttctattatattatcttgaatctacatagaatagattactagattgaaatagtagtctaattcaatttcttttttcactgcatccacttaatttcaatcaagtcaaaatgaaaaaatccatggagggagagaaaaataatatgagaatagactatagtaaaagaaaaaaagtaaaaggaaaaaaccagcgaatctttcatgcttaaacatgtcgcgaaatgtttcaaaagagcataaaatttattttaagaactaagaataagaaaagaatataaaacaaatggaaaannnnnnnnnnnnnnnnnnnnnnnnnnnnnnnnnnnnnn

SEQ ID NO: 34097 - DNA, 3707 bp, Oryza sativa
caattcgactactcaatcaattagtagtatccctagagtccactcctcccccatactactagtgaaagagaaaatgtaaagactaccattaaagcagcccaagcgagacttactatatccatgtaaattatgtctcctatttctatgaaggaattattctactattgatgaataatcatagtagaatcaagggtacagagtcaaaaaggggttctgacctaaggctatggatgaatcagttcaaagaatttactcttaacaaattcttagagtatttctggtagaattggggagcattaagtataaatatgatacatagccctttcttattaataaaagaataaggaaacgctatctcatccctattggtatcggtttgggccactactgctaaaacaaaccccagtttgaggaaagaacggtgggttctcaaaatccagtatcgccgagccttgttattctcttgccccaacttatgcggggtgcaaatttgtcgatttggatcagtactataagcctaagtattttattgatcaggcggcacccagatttgaactggggataaaggatttgcagtcccctgccttaccgcttggccatgccgccaaaaaatacgatctaaaatcgagaaaagagcaagtattcatccacgtttcttactaaaactaactttcttttatcttaaatctaattctacttacttttttccaatctttttcaaaaaatctattcatgctttttttggatccagtttcgattattctcctcaaaggattctatcttaaaacacacattgctaacactagaaaacttcccttttctttctattgaaatgaaaaaggagaaaagtggatttctagtcacaagctacaaaattaagaacaaattggaaccattaactagaattctctttttattttgaatttcggtattctctcccgcctgccatttaatgtcataataaaagacaatggatttatgcctaatccgtatataggtaaactccaggtccgaacagcattattatctatggatcccccttatgtacatatctctgtggagaatcgttctttaatttttcattgcattaaatatcttgaataaaaaaaagaaaattgactttgctatgtggaggtccagaactagattggcatgtacttaaaaaagtacttactttattttaggattctacaacgaaatcttatatcttatattttatagaaattctactactacgaaacaaaaaagaaccttcaaattcttttttgaaattaaactaagcgtgctattctcaatcgaactaaagtcaaactttctagtgcttataaattattatattttggttttatcccattcatagaaaggagaaaaaatgagaaatctttgccgtccaatctaagaatatcataaactgtaagtggcagaatttttttcgaggttctaggaatgttttatcacttcattttcattccatttggacccctgggaaattcgaactttcgttgaaattgtctctattcatatgtatgaaatacatatatgaaatacgtatgtggagttcccgagaatttcatgtgatttagtaaacagaatatagattccataattgctagatcgatctgtagggattgatgaagagtgagctgataatggaatttttcttcgataaacaggaaacttaagattaagatgctccggaatggaaatgagggaatgtccacaatacccggatttagtcagatccaattcgagggattttgtaggttcattaatcaaggcttggcagaagaacttgagaagtttccaacaattaaagatccagatcacgaaatttcatttcaattatttgcgaaaggatatcaattgctagaaccttcgataaaagaaagggatgctgtgtatgaatcactcacctattcttccgaattatacgtatccgcgcgattaatttttggtttcgatgtgcaaaagcaaaccatttctattggaaacattcctataatgaattccttaggaacctttataataaatggaatataccgaattgtgatcaatcaaatattgctaagtcctggtatttactaccgctcggaattagaccataaaggaatttctatctacaccgggactataatatcagattggggaggaagatcggaattagcaattgataaaaaagaaaggatatgggctcgcgtgagtagaaaacaaaagatatctattctagttctatcatcagctatgggttcaaatctaaaagaaattctagataatgtttcctaccctgaaattttcttgtctttccctaatgctaaggagaagaagaggattgagtcaaaagaaaaagctattttggagttttatcaacaatttgcttgtgtaggtggggacctggtattttcggaatccttatgtgaggaattacaaaagaaattttttcaacaaaaatgtgaattaggaaggattggtcgacgaaatatgaatcgaagactgaatcttgatatacctcagaacagcaccttcttgttaccgcgagatgtattggccgctacggatcatttgattggaatgaaatttgaaacgggtatacttgacgatgacgatatgaatcacttgaaaaataaacgtattcgttcggttgcggatctgttacaagatcaattcggactggctcttggtcgtttacaacatgcggttcaaaaaactatccgtagagtattcatacgtcaatcaaaaccgactccacaaactttggtaactccaacttcaacctcgattttattaataactacttacgagaccttctttggtacatatcccttatctcaagtttttgatcaaaccaatccattgacacaaacggttcatgggcgaaaagtgagttgtttgggtcctggaggattgacggggagaactgcaagttttcggagccgagatatccatccgagtcactatgggcgtatttgtccaattgacacgtccgaaggaatcaacgttggacttactggatctttagctattcatgcgagaattgatcattggtggggatccgtagagagtcctttttatgaaatatctgagaaagcaaagaaaaaaaaagagagacaggtggtttatttatcaccaaatagagatgagtattatatgatagcagcaggaaattctttgtccttgaatcggggtattcaggaagaacaggttgttccagctagataccgtcaagaattcctgactattgcatgggaacagattcatgttagaagtatttttcctttccaatatttttctattgggggttctctcattccttttattgagcataatgatgcgaatcgagctttaatgagttctaatatgcagcgccaagcagttccgctttctcggtccgagaagtgcattgttggaactggattggaacgccaaacagctctagattcgagggtttctgttatagccgaacgcgagggaaagatcatttctactaatagtcacaagatccttttatcaagtagtgggaagactataagtattcctttagttacccatcggcgctctaacaaaaatacttgtatgcaccaaaaacctcgggttccgcggggtaaatccattaaaaaaggacaaattttagcggagggggctgctacggttggtggggaacttgctttaggaaaaaacgtattagtagcttatatgccatgggaaggtta

SEQ ID NO: 34098 - DNA, 612 bp, Oryza sativa
cgagctttaatgagttctaatatgcagcgccaagcagttccgctttctcggtccgagaagtgcattgttggaactggattggaacgccaaacagctctagattcgagggtttctgttatagccgaacgcgagggaaagatcatttctactaatagtcacaagatccttttatcaagtagtgggaagactataagtattcctttagttacccatcggcgctctaacaaaaatacttgtatgcaccaaaaacctcgggttccgcggggtaaatccattaaaaaaggacaaattttagcggagggggctgctacggttggtggggaacttgctttaggaaaaaacgtattagtagcttatatgccatgggaaggttacaattttgaagacgcagtattaattagcgaacgtttggtatatgaggatatttatacttcttttcacatccgaaaatatgaaattcagacggatacaacaagccaaggctccgctgaaaaaatcactaaagaaataccacatctagaagaacatttactccgcaatttggacagaaatggagttgtgaagttggggtcctgggtagaaacaggcgatattttagtaggtaaattaacg

SEQ ID NO: 34099 - DNA, 711 bp, Oryza sativa
tttatctttctttccaattttatggggtgggttggtttgataagacccctttttgctttgttgataaataataaaaaaaagagtttttttctataacctgcttgttttattataacaagtcctatatggaaatgcctgctgaagagaaaatctatctgattgtctttagccaatatccaattttagaattagaaagaaaaaagaagaattttcttcttttttttattaacattaagaaaaaagaatataactaaaatggaattggcaatataatttttttgaacttttgaaagaaaaaggaaggattttttgcaatcgttatttcttgcctctgtcatatcacggaaacctttcgatttggaacggggagagatggctgagtggactaaagcggcggattgctaatccgttgtacaatttttttgtaccgagggttcgaatccctctctttccgccccctcggatcgtttgggactttcgaattggaaggaattctgacccccggattttctcgtagataaatgtatgaaacaaatccaatttgtaagaaaaaattttggatttttactcgtcacgcccaggattacgtcctggatcattagataagaatccaaagataaagagggaaacaaagaatatcactactgtataaacaaaaagtttgagagtaagcattacataatctccaagatttttttttaaggaatagat

SEQ ID NO: 34100 - DNA, 574 bp, Oryza sativa
acacgtgcgccaatgcttttcaagggagcttattatgcaatgaacatagtggatcttcttgcaaaatcaatgtcttacttcatggattcgagagaataggagaacagtcgcctgacaaatagttggttcagtccgattcaggtaccaatccaggtgcctaaacaaatagaacctttattgatttgctagttgataggtaaatatccagcccactaaatgctaggcttaatgaggataagggcctccaaaaaaattcttttcgttctatgaactttaaggtgtatgaagtctcatagtcaactcttgtagcggaacgatagagactctatttcacttaggttgatttaatttaggccggaggcagacctaagtcaaggtaatcctcctttgaaacactttggtattgctcttagatagatcataatacaaataatcaatcagagcgcagggagccatctcattatctttccgtaaagaaaaactatggtggactaactgatctttctatcagttgataaaagagcccaatgcaaaaaaatgcatgttgggtctttgaaacagttcgaatcatttc

SEQ ID NO: 34101 - DNA, 542 bp, Oryza sativa
aatacgcttgccgatgccttcgagctgggcgcaggccccattcaaccacaagatgtatccagccgccgattcctcgggatcctcgcgggatactcggagctctctacagactcccaccgctgcccgctcccggtcggcgtcgtcgtcgctggtgccagttccacgaggggacgagccatcgccgcccgctcccggtcgccggcacccgtcgtcattgtcgaattcacacagggtggcgttgctctaggctacctcgtcggtgccgctcgccgctttcggctgctctgctcccggtcgcccgctgtcatcactggatccacacgcgctgccagccgctccatgttgcccgccgtcgcggggccaacaccagatccgcggcgccatgaccgcccgccgccgcccattgtggggccgggagagagaggagagtaaataattaggagaggagagggggagagagaggaaaagtttttataataaaaattgaagttttgagagggaaaagatagtggaggaagattaaaaaaaatgtgaaggggtgg

SEQ ID NO: 34102 - DNA, 31593 bp, Oryza sativa
tattaatcatagcacttaacgtgggccaatgaaatttattagaatttaatttggtctacccattaatctaacaggcgcaaccacctacgttgcacagcgcgccctcgcgtgcggtgagtccacatggcacgatagggtagcatacgcgagacgggttgcgatacatggaaattgtgttgcggcactcaacaggagcagcgacggcatgtggttttttttttttttttgactcctatgtggttttgttcgggttgatgcaagctcgtgccgtcgtgcggtgtgggcacaacaggacgcagcactaccggctgggcttggttcatgccggggagcaacaacagcgagtagctccagcagatggcgatgagacaacggctgtgcaggcggccgtaacaggcaattccaacagctccctggtaatggcggtggcgacaggtgccaggtggcttcgctcgacaattaccctataccctatttgaaaaacttaagactataagaattgatagttatcttgcgagaatctagagaagctggatttttcagcttgtaacttctagtttattttatggattttacaactacaaaaaatttttaaaatctatataacaatcagaactgtttaagggaaggaagttgaagattgtgcgggaagctgcggttgctaaaaccttcccaaacaggcccctagccagctgctgtgccggaatctctagtggtccggttcggcctcaggttggttccgtgaactggaccaacagatagaggagccatgttagacttctggttatctccaacttaagcttgagcctaggcatggataaagagatagactttggggtagatgtagcttgggttaggtcggttaaggcctaagaagaagttagactttgaacaaagtgcaaatatatttttattgaagattttgaattgaattttgtaaaatagctttgttaaatattgttatagtggtgttaattcgtaatgataattctaattatatttgtattcgaatttcatatttgaatttgatttattttaatttttggcactagcacaaacagaaaaatgaaaaactaattaaggcccccttggagccaatttgaaaaattttttggatctttcaaatttttggttacgtttttagggtaaaaaattttaggatgttacaaacttcttaaataaacacatttataagacacgtaacatttagcagtttagaaagcgtggtaaaaaaaacgagcagaattttctcccgatccatatggttaattttctcttctcttatctggcctttgtattctcagatctgtttgtatcgtacggttgttgtcatgttggggctctgaagacatacagccttattgcttggcttatgtatacgtgtatttgtacgacttattactccctgtgttttatatttctatgttataagttgattgaactttttctgagtaccaaatttacatataaatttagcaacatttacaatattaaataattagtttcattaaatataaccttaaatatatttgaaaaatatgtttgttttgtattcaaaatgttgctatattttcatataaacttgatcaaacactaaaaattttgacttggaaaaaaaataaaaatgacttatagtacgaaacagagggagtactaactaaaaaataatttatagttaaaacttttaatatatgttcttaacgattaaaaataaatgttgtaaaataaaatatggtaaaaaactacaaaatcaactctaaaatttttaaaatttaaattttggcctataaacataaaatatgcacaaaaaaaaatgagttactgtattagacttggagtctccttttagagtcatgtttgcattgagcacttcttttaaatagatcagcgctacggaggatcctaaagaggctgtagcgatttagacccagatgacacactatgacacgtttaaaaactgctcgtgcactttactcttttaaatatatataccacatgaaattcctacgttaccataatggccatttgatcccagtgtgaggctgctagcaatgcctagccgcgtaaaagaactagtccgtttgcttttgtgccccacatcccccccctcgacatgcaactattttttatatttataaattgttgtgaatttcgtaaaaaaataaattcagtaagaaaatgtataaattttacggtagcacaaatccgtgcactacagcgcacaatattagttcgagcgccgcacaacgccctttcctccgcactacgtctagttttcccgtatttttaccaccccacctttcctccgcatcccacctttttcggttcattttttaccaccccaccttccgtgtttcttttttctcttttctatctcatccatgcttcatcaataggcccggtaagatgttaaccatccagatttatctgtttttcgctccttctctgtagttattctgttttcgcgttttagtaaaatatttaccatctagtttttctttccgagttttccgtttttcaggatctccacacatttcaaaagtaacgaatttactctgtgaagtttttcatttactcccagcgtccgacatctggtcattcaaaagtaacaaatttactcgcatgaatgcctccacatcgtatgacgccatacctagatgatcctaaaaaaattactaccaacttacaacgctagtaattcttttaccaatattataaatatagtttagatttcatgttctgtgagtaaacaattactacattcctcttgatatagcccatgatctcgtagccaccgtatagtaatatgtttactgatgtgttcaatacacagtataagagtaaaaattgagatttcgtagtttgcgagtaaaataattactaccttcctctcgatatagccatgatctcgaagccaccatgtagtaatatgtttaccgatgtgttcaatacacagtataagagtaaaaacttattgtcgacggtgggtacccgtagaccggatatagagggcattggggtacgctggtacgagaatctacgtagtacgacatcaaggaaacaagagacaaagattatactggttcaggccccttaataggtaatagccctaatccagttgatatgggattatatggagagaaccacaaagtacaaagggaataacagaactcgatgataccgatgagatcgtagttgagttgattcgactagatcacccggcgacttggctcctgtaggctccgacttcgtagactatggtcgttgtgttggctatgagattcgatgccttaggtcctcccggggggtcccttttatatcgcaggtcaggtggtctccaagtaggactcggagacatcggaccctacacgatatagtgacgaccaagtcctatacgggtaggaatctttccattagtggacttcgagatgactttccttaacatatacggagaacgtccgtacacgcaccgatgtgtcgtattgccgtatagcgtacatccaagggtagagggtataccttatccgtaaccctgacagtagcccccgacttctgcttaaatgaactcgtgtaaccgatcgcgacttctgatgttggagttgttgtcgttctcgactagtcgatctcagtgtggggatcgtagagataaggagtgatcgacaacaccatgcgaagttcaacggttatgagtgaatttaaattgaagtccaagaaaccgcctcgcgcaacggacccaaaaatttccggcggccatctctctcctttccttggaattcgcaccgtcggtagtgcgcctatttaagggagttttgagaatccattttagagtccggctgttgcgaaaactttctagcctccaaactctcttcgtcttctccgtttccacgcaaaccctaattcgctcgcctcggcttcttctccgacgatctccaacggcgatgaacctcgacaagtccacctccagcagtgcgtccttgaagaaattgcaggaggagggctatgttggaagtgaagaaggaccaggccgtggaggcactccgaggtcgcgaggtgtggttcaactcgtaccttaggagttgttgcaccgccatggccgtcgtctgcagggaactccgagtacctcgcgggaatcccgaggagtcagcggccggctatatctcgtggctgaacggggcatgcgctcagctcgaaggtatcggcaagcgtacgacgaggccctgaagcaggagtgccgtcgatcgagccggtatgccggagggcacgtgctggcatgtatacgagatcattgtccgcagctgcacctcaagttcctccacgaggggttttcttgttctcggaggactcccgcggaggtagacaacctagcgaagttgatggtgccgctggcggagaaagtgttccagtcgatggattggcgttggccttactggtagtctttgtatattctagatgtggtgtgcacgagtgtcttctcacttcgcgacttcgatcagtcacttgagttgtacactctccctagcccccagccttgttgtcggagaattcttctcggaagataaggctcttagacctttgacttgccttagttgaataagcactgatcctagcacccagccatgaagttggaaaatccatttctgattacacggcttggttaatacgcacggcgagaactcttacacgaccagatcttacatggtctttcgtctctgaaggatccaacaaggccttatcagctctgggcgtccccagccgaagttcccttaggttcctcggaggccttgtcaagacggcgtaaagggtcatgaggataggtttcaatgctaggtgtcatctgggtaagggatcatcgggaagggacactttgattgaaatctgcatcttaaaacaggctttattgaagttgtaagatgtcttacaagtatggatactattgacttatacataaaatttacgcaattggtcaatgttccacgaatttgctaactcacgaccgtcgccgtctacaatcttgaatacgcctggccgcaagacttgtgtgatcgtgtacggtccttcccatttgggtgagagtttgttttgccctgcttggcgttgaactcgccggaggacgtagtcgccgatcgaaagtatgcgtgctcggatgcgcttctcgtgatagtggcggagggcctgttggtagctagctgccctgacgacaacccattctcaatgttcctcgagtaggttcacgtcattgtttcgttgttcctcctaatcctcgtcggagtatttctgtactcgtgtactctgatgtcgtaactcggtagggagcatggcttctgaaccgtacacgaggaagaaggttgtctccttgttggacgttgtcggtgtggtgcgcacggcccatagtaccgaggggagttcttcgacccactttttgtcatctgacatgagcttgtcgtagacacgggtcttgatcccttgtagtactatgccgtttgccctctcgacttgtccgttactctgagggtgagaaatcgaggcgaagcagatcttgactcccagtccgatgcagtaatcctagaaatcgacgctgatgaactgggagccgttatccgttatgacgcggtgaggcaatccatatatgcaaaatatccccttaatgaatttgatggcgttgtcggccttgatttcccccatgggtgttgcctcgatccatttggtgaatttgacgatcgccacgaacaggaatttgtagccgccctgtcctcatgggaatggaccgagtatgtcgagcccccagcacgagaacggcgaagtgagagggatggtttgcagtgcttgcgctggtagctttgtgtgtttgctatgaaattgacaagcttcacaccgttgtaccatgccgcaagtgcctttgagggcggttggctagaaaaatccatgtcgaaaggcttttccaaccaatgtacgaccggcggcatgtgacccacagaccccttcgtgtatgtcgaggaggaggtgtttgccgttgtcggacgagacgcatttgagaagtaccccgtttggcgccttcttgtatagatcgttgccgatcatacagtagatttttgcttgacgggttattttatcggcttctgcattgtcctcgggcaactcgtcgctgcttatgaatttaatgagtggggtccgccagtcgtccgtggtctcgatgtcggcaacggcgcgctctgcctctgtagcccttgagctaatgtcgggggtgactgggctatcttcgtcgtttgcctctttcactgatggctttatcaagatgtccagaaaggtggctctcgtctggacacacgccgtgctagatcgtccagctcgatgttgtccttgcgatatacgtgtcggacctcgatcccatcaaatcttttttggacaactcagggctagagcatttgtaatctttgtgcacctggtttgtgactagttcggaatcccctttcacgatcagtcgcttgactccaagtgtagctgcagctcttatcccagcgagtagcccttcgtactcagctgtgttgttggtcgccctaaagttaaggtgaattgcatgcttgaactgatttatcgaaggtgatgtcaagatgaagttgacgcacatactccacttcccgttggccttccgcaccatgactgggttggctagccactctggatggagtacctctctgatgaaaccagctttgagaagtttatcgagctcttctcgtatggcttgtttctgatctggtgcaaatctccgcagtttttgctttactggcttggcatcgggtcgcaccatgagtttgtgctcaatcacctccctggggacccccggcatgtcggagggctgccaagcgaatacgtccgcattgtcgcggaggaaggtgatgagcgcgagttcctatttctcgttcagtgatgccccaatcttgactgtcttgtcggggttggtaatggacagtggaatgattttgattgtaccgtctggtttcggcgtctttgtcgttatgatcactttcttgggtggctcggctgtggcgggtgggctgggtatgtgctcaaccatgtcgaggctccgcttgtcgcattggactgccagctttgtgttcccttaaatagtgattgttcccttcagcccgagcatcttgagtacctgatacgcgtagtaagatgcggccatcaacttcgcgagtgcagttcttccgatgatggcgttgtatgatgtgtcaaactcagcaacatcaaatgttatctgctctgttcggaagttgctcgcttggccgaaagtcacaggaagcgtgatcttgcccaatggcctggacgaagactgaggagtgattccatggaagggttgtcgtgcctggaaaaataccttttccagaacgctagtgtattgatccccgtcccaggaaaagccggggtacaccacacaaacatgatataaaagacacatctttattatatcgataatatttacattattacgaaggcacttcagggctgaaaaacaaaaataaacagcagcggactagcgggcctacggctccatcttcacaggtgctcaactggggtataagccaggactccacctaagacttcttctctaaagcttctcttactgaagggggaaaagattgagcaagaatgagtacaaccacactactcagcaagccacaccggctgatgcatgattaatgcaaggggggtacaaggggataataataggggttaagttttgcagtaaacagcatttaaaagacacttagttgctcaaagctattttgcaaggacgatcctagagctatataatattattattcaaggccgtgaacccacacgaacctgccttaacccaaggcctacgatgattcagaccgaactggcaaccagacccaggtcccagctcgtcccaagccaacccaggtcaaccattccacattttagttgttaagaaggttttaagaattaaaacactaacttaggtacattgctaggcttgcccataaccgaggacgcggctattcgaatacattatactctgatcagaggtgtacatctttacccacaagacacgtcttcctcacgtgtaaccacgtgcgacataccaccacagcatacggacggaagacgtgacatagttcccaacccatcctagccataaacaagagtaccgacccaaccccgcctacggccggaacccccgagacaggtaggtaggattgagcccctagcagcagaacaccggccctgtgccatgacatctcgactaccgagcaacagctcgtgtagccttcatttgtcctagagatgtccatcgagccccgacttcgtccatctccatccgtgtacctttgtttatgaccggactgagccacaaactaagccttaccaactagacatgtggaagtacggtagtgctttacaacagaggcccgaacttaatccttatagtacccgaggtacgactaacaaaacccaaccacgcacctcgagcccagcctaaaaccattttgggggttttgaatagagggggaggtgtgtgtccaattccaacataagccaaccattccatagcgtccaagtgatatgagaattcccaaagtctaaaggatgatgtgacttgccttgctaagagaaaacggccttccgaaccttcggcgatgaccacgaaccacgcttcaggaatctccggaatgacagaagctacgcgaagcacacaagcaaagctacaagcctaaaaagaagcaataacaatacataaaaagaaagcacatggttctttaggttataacaaacattaagagacttgaacatggtcatccgaagtttaatgctgttatatggagatttgcggattattataattaagttttgcaactataaaacatgtgtaagcgctagcctggaaaagacaggaaggctgcgctgttgacatgcggaccccacatgtcaacctaagggaccacggcagaccgggtacacagagacgggtcaacggaagcggaccccgtgtgtcaaccgagacgagtggccgacaaacggactccactagacaccatgcgggctgcacacaaacacagtcaccacacgcacacacgaacgactaccgacaccggtacaagggtaccggggtcgacaaccgcacgacgggtacggggcgacaccgaaaggacgaggacgggagcagcgagaagggggatccttagcaccacgcgacaaggcgtgggaacgatgacggcgaacgggtgcggagacgaacgggaacgacggagacgaacggcgaggggacgacctcggcagcgatccttggatgaaggcgagacgcggccgacacaaggcttgacgacgcggagccgaggacgaagacgatgacggggcagcagcagcacactagacaaaacgtgggcgacgaacgctatcggcttgacggagggacgaatgccacgacgaccgggaacgacgagaggacgacgacgaccgggggccgacgaggacgaacgatgacgaggaaacgacgaggagacgatgacgacagatagcggaggggtttggatggaggggaggcgatgccgaggacgacgtcgccggctcgccgctgcgatgccggaggtggtgttggcgcggccgacggcgcacgggtggaggaagggtcgaccggggaaattccggcgaggcggatggagaggccggcgcggcacggcggtgttccggtgaaattcgggcaacgctgtggcctggccggggaagaggacggcgttccggtgccgggagaggtggtggcgacgtcggccggtgcacaggagacgcgacagaggcggccggaggcggaacagtggcggcaacgccactgttgccggcggggatgcacttccggaggtctccacgggaaacggagggcaggccggggaaggggaggcgactgcgacgctgggggaggcgacggcatggccagccagcgtgctgacgctgcggtaggggcggctggaggctgttggcgccgggagagagagggagcagcgacgggaggggctacggacttgggagaggccaaaacggaacgaagggaggaggagggcttcgttttatagggcaaggagggagtgccgatcacgggagagggcggaaacggcaccggaggaggttgctggcggcatcaatggtggtcaaagaagggattaaatcccgacgattggggatgggattaaatggggaatgttaggggaaatagagaggaagggatgtggattccatttctctaaccaatttgaattaatccggcatgaatggagcggatttgggggaggaattggtgcaagggttaacgggagagaggagagagagagaagccggccgggaggtagaagacgaccaggtgggtggacccatcggtcaggagcggggcacgcacgtgcacctcgcgtgcagaggggcgcgagggagaggagggaggcggcctggggcggcaggtcggctgggccgggatagggcaggggtggcccaagagagagagagggaaggaaaaagagaaggagaagatggagactttgggctgggctcggcccaaaggaggaaggagggattatttttaattttctttttaataaactttcttaattgttgttgttccttaataaatatttccggtgctctgaaaattcaaataaaatttaacaaaaattctccggaccacatttgaatttttattgtacgtattttagtgtttgccaatttctttttgaattttaattaattctattattccttttagagaatgatttttattttgggatgaatttatcaggatgtgacaaggattgatcggtaggtgtcaactcgcttcgtggaatccccatcgcgtccaaggtgctggcgaagagaaggttgatggagctgcctccatcgacgaggattcacactaccttgatattccgaatagtaggttcaaccacaatcggatatcgtcctgggataacagcagccttggggtggtcctcgtctaagaactcgatcttctgttcagaccacttcatcttgggtgcaaccccctgcaatgtcgaacaaacctcacactccacttttttgtattctcgctttaaagagtacgctgtcgaacctccgaagatgtgcgagacatgaagataggaatctaggtacgccaagtccgagtcctgagtggtttcctcagtggccttctcgactacacgtactcgcttgcccttctccaaagccagttgcttttccagcgacttcttgaagatgaggcactcctctagagaatgtatgtccgacttgtgtatggggcaccatattctctttgtatcactgccttgtgggtctgggtgtttgggtgggcgctcgtattcagacgcgaggacttccgcttgagctttcctcttcccactcttgccgcttttcttcttgcttggtttgggtgtgtccttggctggcttcttatctcctcccgcctttggcttgtcgttcttgcgtctcagtgcgtcgtctgcatgggcgcatcgatcgacaacctcgaacaaccttcgagtagttgtgattcgccttgttgccaactcctgggtagtatagcaatctctgacaccggttttgaaagcatgaatcacagaaacattggtgatatcggggatcgtatttctgcactcattaaagcgccgaacatagtccctcaaagattcgcccggattctgtgttaacgcgtgtaaatcgtcttcgatcgcgtggcgcttgtaagttccttggaagttagcgatgaattgctgccacaaatctgcccatgaagagatcgagtagggtgggaggtgcatcagccacgaacgcgtagaacctttcaacgccattggcaaatagtttgctaacgcgttgtcgtctgccccggcagcatatagtaccgtggagtagacctggaggaattcttcagggtcagtactcccatcgtacttctctattgctccgggttggaatctctcgggccatcggacatcacgtagagaacggttgaaagctctacacctagcgctgggggcggtgggttgtcggtgatcgtgtgtcctccgtggatgtctatcgaatgacgaaaatgaagatgatgacgatgatgacgatggttcactcggctccggtgtgcgattctgagggcgacgttcaggttctcgagaattctgttgtcatccaccattgttgtcctggtgccgatccacattattgtcaccgtcatgttgacgccctcgaccagcatcgtctggtgtccgctgttcgcgatcgtcgcggttgcggcggttgtgacgattatggtggtgttggtcttcgttcgagcagcctcctcgctcttcgttctcgcgacgtcgtgaagaaacacgatatcgggaatgattctcgttgtctcgcgcgcgtcgtgcttctcggcggctattcagatggtcgcggagctcgccggtgccgcgaggtggaggggtagctcgtctaggcgacgtccgctgctccggtggttcgccgtcggcaccgccagctgtcggtcgttccagttgtgctctgtagcagcttcctcgaacgcttactgagattggctaccgattcccgtagtcgttctgtccatcgtgtgagatcatcgttaagcacggggtcatagggagcttctctcaatattgcgttgacggtgccgagtagttgggccggcgtgaccgtctggttctccgcctctgcgttagcgtgtgcaaacgtgctagtcctaccgatggcaaacacgtcgcgtggtgtactggaagatgacaagccatagttttcgagcaagtgtaggactgatggctcatggggatcaatgtcgattactccaacgaatcgatccgaggtcaacatcgctccttgttccttgtttgtatccttaagggaggttcctgactgctggactttaggaagcgtcgttttcatggcgcggagaaagaccttgcagcttgagaagtcgtgattcttcgtcttgtgaataggacaatagacatcacgagttggagaagtacgctggattccacgctccttgcaagcacgaatttcggcttgtgcgttgagaaaaacccagcatgcttgcaagttgtgcttcctggacttgtggataggacactagggctttgttacctcggaagttatccttgtcagctcgcagttcttgtcagaaggacaaggtttggccgcactaggaaccttcgacaagggatcgtctggggttatagccacggcgttctcgtttccggtcattgatggaccagccgagattggtaccgtggtgtaaaccgggaagacgatttcgccgacttgagtccacaccagcattgttgaagtagggactccttgaatggggccggtgttgacgccgttgtcgacgaagcttgatgtcatagtagtagaaccttgagcaccaaggccccctacctggcgcgccactgtcgacggtgggtacccgtagaccggatatagagggtattggggtacgctggtacgaggatctacgtagtacaacaccaaggaaacaagagacaaagattatactggttcaggccccttaataggtaatagccctaatccagttgatatgggattatatggagagaaccacaaagtacaaagggaataacagaactcgacgataccgacgagatcgtagtcgagttgattcgactagatcacccggtgacttggctcttgtaggctccggcttcgtagactgtgatcgttgtgttggctatgagattcgatgccttaggtcctcccggggggtcccttttatatcgcaggtcaggtggtctctaagtaggactcggagacatctgaccctgcatgatatagtgacgacccagtcctatacgggtaggaacctttccattggtggacttcgagatgactttacttaatgtatacagagaacgtccgtacacgcgccgatgtgcagtattgccgtatagcgtacatccaacggtagagggtataccttatccgtaaccctgacacttatactaagagtattgttgatctgtatcacaaaatagtcgtatgaatgaaaaaattacaggctcaatcacacacaagcgataaaatcactcacaggtgaatcaaactagaaaagaaaaaaatgattcagtcaaaaatccatcctgtggctttgctggatcttgctataaagatgaagaggatggtctgtgacttgggactggtagtggagagggcaaccatgtgacgagcagtagtcgacgatagaatcgtggaaggatgtagcggtgtggtctagagatgagctcgacgttgtgtagtagcagccatccatcatctagcaagcacgaaaaaaaaaagcaaaaacactctcgttcatgtcaatagagatgacgagcaaaagaaaaattgcaaacaacctccatcaccggcggactccaccctatcctctgcgaccagccacatggagcacgatgtgcaaatgtaggacccgtacaacccatcaattgagataagttaatattagagattgcacgttaatttgatttgcaaaaaaaaaaagcttcatgcgtgaagttgaaggagagcacgcagatccaaatcagagtgtcagttccttacttgcttattgtatcaatgtcgccaacgtgaagcagccgctggttattgctatttggcctaggtgaacacctccttactggttaaggtgctgtccagtgtccgacagcgaggcccgaagcagtgccgtcgcctcaaccaccgccggccactgccatcaaccgccacgatgtcgtcgtcctcctccagggtgtgttgccaatctgtgggctagggtggtgtatcgattcagataaaaaaaaggaaaaaaatgaagcaggggcgagagtggttggttgggaacgggaaaaatataatatataccgaaagcagagaagttgttttttatcgaagtaaatcatttactccgataatggtgggaacacgatgcgggacgtggggtgggatcgaaagcaagaaagttatttttattatcgaagtaaatcgtttactcgaataaaggtaagtggtagaggcccgcgataggagtaaatcatttacatcgacaacggtaggagtgggatgacggcacgtagggtggggtgggtctgtgctgatgcatgtttggcgctcggaatgctgcgctcctaatagtagttctgtagattttaactaatttagtgccaaaaatttccgaaatggtaggacgggtagtggtggaccttacggtcagtaagttgaacctaatcacttgcacggttgcaccacaaatcagttcatttgacaagccaacacagtgattagagtgtagaaaaagaagctcacctaacttgttcatataactcagctgcttccaaagtcgaaagccctatttgaaaacgaagcctgagctgcttccctagaccaaaagctacagatgcacgatggatacatatccgatagcgtgcttccttgccttgcctcgcctccgcccccttttatgccaccccgtgacatcaccgttggcattgcacgaaatccaaatgaatacaacgtaaacagcttctgcccgccgggcccccatggccccatcatcggccatccgagtcaaccgagtgagccacccaccataccagcagctcccactcgaggcggacatcacattatcgtctcgtcttcccaccagcacctgccgcgctctcccccctcgattcccatttgatcccacacctccaccaactagctgccacgctcgctttcccctgcgacatgcgtgatgtgtgggcgctccacttgttaaccatctcgcgcgcacgccaggctcggctcctcgatcgacgccatgtcgctgcgccggctctgcttcgtgctgcccatggacgccgacgaggtggtggtggtagctggcgctgctggtgaggagcagcctcgacgacgagggatggcagcgagcgggaggctggcgtcgtacgtccgccgcaaggtcggccgcgcgctgcggtgcgggctctgcggcgcctggtgccaccaccgctcgtcgggagtctgcagcttcgaggacatcgccggcgtggacgcggtcggcgcggggaagctcggcggaggcgcgggcgggagccccaggatcttcagctactcggagctctacatcgggaccagtgggttcagcgacacggagatcctgggcagcggagggttcgggcgggtgtaccgcgccgtgctgccgagcgacggcacgacggtggccgtcaagtgcgtcgccggccgcggcgaccggttcgagaagtccttcctggcggagctggcggcggtggcgcggctgcggcaccgcaacctcgtccgcctccgcgggtggtgcgtgcaggacgaggaggagctgctgctggtgtacgactacatgccgaaccgcagcctcgaccgcctcctcttcagaccggcggcggcggcggcgcccgccgcgtcggctccggcgctgagctgggaccggcgacgccgcatcgtctccggccttgccgctgccctgttctacctgcacgagcagctcgacacgcagatcatacaccgggacgtgaagaccagcaacgtcatgctggactccgagtacaacgcccggctcggcgacttcggcctcgcccggtggctcgagcacgccatgtccggcgaggacgcgccgccgccgcagctggaggtgtccccgtcgcctcattccgcgcggtcgtcgtcgtttgcttccgcgaattaccagttccggctgatggacaccagccggataggcggcaccatcgggtaccttccgccggagagcttccagcgccgggccatggcaaccgccaagtccgacgtgttcagcttcgggatcgtcctcctggaggtggccacagggcggcgagcggtcgacctcgcgtaccccgacgaccaaatcttcatgctggattgggtgcgtcggttgtccgatgaggggaagctgctcgacgccggcgaccgcaagctgccggacggcagctacccgctgttcgacatgggccgtctcatacacctcggtctcctctgctcgctgcacgatcctaggtctcgtcccagcatgaagtgggtggtggagaacctctccggcagctgctccggcgacctgccaccgcttccgtccttcctagctctcccaaagtacgtctctctcacttccccctccgattccggcacgacgacgaacgccacggacagcacggtcacctctgcgtcgaagctctacggcacggcggccgggacgaccatttacctcaccgcggagaacggccaccgctccagaggtggcttggctgacaacagcggcggcagcagccagcgatcgacgcggccgctggtggtgatccccagcgtcgacactccccgtgagatatcgtacaaggagatcgtcgcgatcaccaacaacttctccgagtcgcagatggtggcggagctcgacttcgggacagggtacgagggcttcttggacaacggctatggcggcaatggcgcccgccgcgaccgcgtccatgtcctcgtgaagcggttcggcatgaagacgtgcccggcgctgcgcgtccggttcgccaacgagctccgcaacctcgcgaagctgcagcaccggaacctcgtccagctgcgcggctggtgcacggagcacggcgagatgctcgtcgtctacgactactccccggggaacctcctgagccaccacctcctccggcgcgatggcgcaggcgccgccgccgtcctcccgtggcgccaccggtacagcatcgtcaaggccctcgcgtccgcagtcctgtacctgcacgaggagtgggacgagcaggtcatccaccgcaacatcacgtcggcggcggtgttcctggaccccgaccgtaacccgcggctcgggagcttcgcgctggccgagttcctgtcaaggaacgagagccacggcggcgcgggcgggcaccacgttgccctgcccgccaccagctctgctgcgcggggcatcttcggctacatgtcgccggagtacatggagaccggcgaggccaccaccatggccgacgtctacagcttcggcgtggtggtgctggaggtggtgaccggcgagatggcggtggacgtgaggtcgccggaggtccttcttgtcaggagagcgcagcggtggaaggagcagagccgccccgtcgaggccatcgtggacagacggctggacggccaggttgatcgcccggagctcgagcggttggtgaggctcggcatggcgtgcacccagtctgacccggcggcgcgaccgacgatgaggaagatagtgagcatcatggatggcaatgacgagatcttgaagaaattcgagcagaggaagcagcagagcaaggaagagtgggagaccacaaatgctgctgctctgtccttagtaagaagactccatgctcttgcgatacactgaacacaacgtcaatatgtatatattttctctaatagagaaataaattctgttattatagttggacacgatatttttatatatatttattaatttcgttcttcaaaaccgatctaacgcatctcagcttgtccatctgattcatattataggttgattcctttttttttctagtcaatttttttcaagcttaatcaaatttatagaaaaatataatactattttcaacacaaaacaaacatattatcaaactatattcaatgtttcatattataggttgttttctttttttctagtcaaattttttcaagttttattaaatttatagaaaaatataatactattttcaacacaaaacaaacatattatcaaactatattcaatgttagatttaatgaagctaattttatattttagatgttgttaattttttctataaacttggtcaaatttaacatagtttgactaggaaaaagttcaacctgacttataatatgaaatggagagaatactttgtactaatgaacttgtgtcttgtggtacacaatcaactacgtctcgtaaaaaaccaacttaggacgatatatgccgtttagtagtactacaaaatatcatattcttattttaggttgttttttatgggacggacataatatgtttatgtaagaataaaaggggctatgagctgttgcatgcaaaaatgcaattcatcattcgatttcctagggtcgttagatctctgtatccaaaggccgggagcctgagatcactgatccacctttgttggcccgtggaccaccgatccacctaacgggttaggccgtattaatgggtctttttttttgtctggtttgttaatttgtttcccttttggatgaaaatgcacccgtttgttttttgggtttcttttgtgtgctctatgtgtcggctaggctgacaattattttaaatctatcaggctgttcgagtttcattttttttgccctatttggatgtgtattttgggtttcccatgggtcatttttatacttctcaaccttgacaactgagagcatgacaacatcagacacaatctctcgagttcttctctctcttcattctagagtatatatcaaagtttccgagcacaaccataaaccacatttatagtgaagaataaacaactaatagcattcagttgactgcgtaggacaatttctatccgacaaaatagttacaatctattttatttcgagaacacaaggtcagtataaaacctatttcttttacaaatggtcacattcgaagatataaaaaaaaattcacttctttggagaactagtagatttaaattcagcaaaccaaaaaaacttcatctcccataagttgagctcaggaaaaaaacacatgtgcgactttgtggagaaaatatgccttatttatctgttgtgacaagcatgcgacgacagacaataaaaaaataacaatagctaaactttaatctaaatacaacccgagaaactcttaaaatataccaagctaattaaggaagtgggaggccgacctagggtgtctatggttgtgctccacctggttgtcgcgcattccacataggcctcaaagctagagtctcaaacaagttacaagctcactcatggaattccgaggtcactcgaggtggcacaatatcttgctactaactcttggaattccgaggtgagaccagatccgttggaaagaggtttcaatatctttacattaagtacccataagcccaaaacagagctcatatgcacatttagcggcaattttaagtcaatttctgtaggtggctgaattggactcggaacttatacgatttaatctcgatatcttctagttaacttatgatgtgagcaatggttatatctatagtagccatgatcacatcatgcatgttgttatattgctcgaaattatggtagcagaattatggacttacaagaatgttgaccttgccctcgaacgaagtgtgtaccctgccgctcctctttgtcggtgcgcactgacacgttgcagacggagacgatgatggtgagacctttggtcatccgctcctcctggtatctactcaactccacctcatttggcacaggtgtgcactgttgcgctaaagcccgcgagctcctccacgatgaaacggctgcacacgcagttgattataatggacgattcggtagatagatgttatatagcgtgtgggtgaataaccactcagattttgatgagtaacctatgctttcactgtcgccggtgacaagcacagtggcgctagctagtgagctagggcagtgctagaacaaaatggaggaggttccactcccattcatcgtgtatttgctgcattaggacacggttgtcatcttcagggtctcaaccttgtccacacgtacgtctccagcgagcaattgattgagagatctctgaacatagcattgtaaatagacaaaatttattacaggacaccatacgaagtgacttttgaggaagacactataaacatggtaattttccagcgaacaccataccattaaaataataattttcggttggagaggagagaaaaatcgtgtgaaatgtcaaaaatacctctgcacctacatgtcagctctcccatctctcttctctctctatcggcgaacgaggagttgttgggcgtctgctacttggtgttcgatgtaatccatcggcgccaaggggggttggctacttggccgtggattcgctgcacggtgggatggacggcacgacgagatggcggttctcagtgttcgctattgagtcagctatccggtgcagtaacaaggtcaagcaggtctggatagtggcaggggtgcgggatcttctatgcgaaggagaaggcggcgccatgaggtggtcgcacgtggtgtgccgtgtgcggtgttcgggtcagtgatttcgctgcagcgatatgggcgaacgggtccttgtggtcgaagtggcaggaccggcgacgagactcgacgctgaggcagggccggctggtggcgcagtggtttttctatggagcggattgctactcgatgagatggatgcacggcaatggcaatgacaacattctgaaccattgttggtgtttggtagtgatctgctatggtagtgaggccggggatgagcctcgaagatgaggtgttagagtcaaaggaagaatagcggtgaggagggtgacggtggtgattggtgcagcgcatggggaggggcgaggcatatctgcacggcgcacagtcgggtttgacttggtgcagaagatagcggcacgccgtgatgctggctcgagctcagctgagagagagctcaacgacctccctctatcctaccgcgcgcgctgcttcctgtcggtggcaatgacctctatggctctgacaaaggggagagagagaagggagatgtcttctcctaaaagtctttttgtacggtgttatacaactaaaaccgtgaagttaaaatattatctagcaattatagcaactcacctttagatgttttttggtgatctctctcacacaaatagctataggtacttcacgggtgctcattgtttgtgtgctaagagttaggaggggatttatacgttgttgtgcaacagtgcaagtagccaagtgtagtgtactgtgtacattcgtgttcgtttccgtatcatcggaaaaataaaaaaaacttctcatgtactgtaaactcgagctctcgttgctgggggaacgccgttgcttgcagctgtctacacaaagcccatgtgaccatgtctgtttgggtcctcaagaaatgttcatgggcctgatgaatctgtccgtgctcatctcagcccattatgacccgttctaagcaagccggctgggccgcataggcattacgattcgtaataagtccactttgagccccttcaaatataactccaacttaattcatatctctgaaccacaaccataatacggatgtcttaaccctcaactattaaaaatggtataatttgactcctgtgacaaattttgaagaacggtttcactgacatgacactttgacttgttcaacttgctaagtcactatgtggagcccacccatcagtgactcttatctttcctctcacttttctctccatcggatcgacgccgggccgacgacgcctatttgctgcacggctcgtgctggcccctggcacgccgccgtccaactccaccacctcctacaacatcaccatgacgctgtcgctgcgcaaccccaacctgtacccaggcatcagctacgagcccgtcgcggtggccttctccttcaatggcacccgcttcgtcgagtccgccaccatgccggcgttctaccgtaccataagccgaggaagacggctacgttccacgtcacggtgggcagcattgacaagcccttcagcaagctcaccgcagcgggggtggtggcatttggccggctagctgtggtctgcccgctggagctatagcttgtcgactcggaggtcgccgccatcgcgttctagaggaccaagtgcaccatcctccgggccaacaagtccgcggggtgctagcttgttactaaccgggactaaagattctatagcgggacgggactatgtacctagtagtaaaaattctttttagtcacggttcttataatagccttaatatttgtgttttgagccattcgatgaaagatcagttctccagtagtggagaaaaacaaaaagataaatagccatctatttatcatttttatttgtcgttttgtaggtcatgtttagagacttcatttttttgtccggtaggttaatatacttcatgttataattttctttaaaactttttatgatattttgtattatatattagagcagggggattgtttttctaaaaatacacattacattacaaacgattacaaacgtagatattgataatgcatgctaactcctttaaatacacatgtaccttctatccctatgaccaacatatcttaaatttgaaaatatcatcatctgctactaactgtcaagaagtgtgaaatctataacttaaatctggatatctgatctcaccacagagaatccaattaaacaattaaactttgcttcacggtcgggagataattctagtccttccttcgagacgggtaaacacccgattgattgcaagtgattcttcttgtgagcattccacggtggcgtttggatccagggattaaattttagtccctattacatcagatatttcgacactaactagaagtactaaacatatactaataataaaactaattgcataaatgagagttaattcgcgagaaaaaaattttaagcctaattaatccataattagcacatgtttattgtagcatcatataggttaatcatggattaattaggttcaatatattcatattgtgaattagtccaaggttatggaatagattttgttattagtataaatttaataattctaattaattaatgtcaaacgacctccgctgatcatctctccgtggaaagctgcatgcatgcagatcgtgttaacgacaaaggcagcggtaacgacactgccatgcacccttgcaggcttgcagcgtacagaaacgaggctatcgagtgtatctcgcactctcaccatcacgagctctctgcatcgcgtgcagagcatgcgttccatgcaagttcctttttccttctcttatcttatcggaaactatgtgcgccgttttttgcacactcctcctttctaatcattatacggacggacccattccaacatgtactgatcagggttttccaaaccgctaaatccggagttactgtactccggtggtaaccacgattaccgcggtaaccgtgaaaaaccgtacaaaatttattaaaaatttaaatcatttttttaatttatttgaatttaaagaggttatcacggtttttctattaccgtaccccgcagtaaggccggtaaccgcggtaaccgcgcggttaccgatggtaatgtaaacccgggtaccgatgtatacgtggtagcatgtccgttatcttgtaaattgcaaagtcaaaagaatcaaatgagcctctactatcactactggaaatcgattttccccggctagatgcttatatttttccacgtggacggatttttttccaccaccgatccggctgcaaaatgcaggaggggggttgagatggccgtccgcatgcgaagatcaatcttcctaaacgaataatataaggcgttgcctaggaagatgcaacttcgcaggcgacgcctatgaattttttctactaggaagatgcaccacgcgcatgcattttttttcgttttaatgcttttttccctatgattgtggtggacctatatatatatgcaccttgatggcatgttgtcctctcatccattgtgcttaaatatgatgcttttattagccaaaatatatgtgtattggtcactttaataatcacctagatcaagaggagagagagaaaaaaaaatctattgttcacactccccacatactagtagaaaaaatatatctacgctaaatttgtacaacaccatcccctagttatttatatttctctttcccatagcgagcaaactttatttgtttgtaaattttattattctgttaatttaatttttaatataattgtaaattaatctactgagtgcaacaattcggtctgtcagcttctgtacctcccgtgcattctttggcagttgcatcaattggattacttcgacttttttaggattttttcttctaggcccccttcggacactaggaatcccagcaactggcccgctcaaacaccgaaaacgcatttttcggggtttaacttgattccggccaccctcgggttgtcgatggtctcctatagattggcggcgtgatcgttcaccttctgactcttgacgacgatgtcatcgacataagaataaatgttttgcccgatctgcctcttgagaaccttgtaaaccaatcggacaaaggtttgctcctacgttccttaggccgaagggaattctaacatagcagacggtgccgaagggtgtaatgaatgcggtcttcgcccaattttcgagcatcatgaatatatggtggtaatcggagtatgcggctaggaaactcatgagttcacacccagctattgaatctatcggctggtcaatccgtggaagtaagaagtcgtcatttgggcaagccttgttcaagtcggtgaagttgacacacattcgccatttgtcatttgccttttttactagtgctggatttgccgagcactcggatggtcaatttccgtattactccaaccatgagtaacttgtagactttagttttagctgcttcttggcgatctatctactgacatcttgcgaacgttctatttttggggtcttgcatcgggcttgaccgccaaatgttgtaggatgatgtcgggcgaaacaccgcccactttgtcagggctcaagacgaagatatcgagattgttcatgattacacgcatgatgcttcgcttctcttctttgcctgcctcgtaaccaatggagatagttgtggtggacaactatgtcgaacttgttgagcgtggccctgctgaagatcgcattgtagtggtacgggatgtccaccatgttaaacatgatgagttacttgcgcttgttttcttcagggctgaaggacaccctaagttggacctgacccaatgcctacagagatatgccatcgaaaccttggagaggggcggtagcttgcgaaagtgctagcgtaggctggtccattttcatgtaagcgttgaagaagatgatgtccattgagcttcttccatccaccaatatatgacgcacctcgcatccagctactacggccgaaataacaaggggatcttgatgtgggaagtgtactccctccgcatcagctgggtcgaaggatattttggatgcctggtattccggttctccgctccccctggagcccatggttatgtacgttctgctggcacttcgacatgtggccctcggggttcccccatgtgatgacttgtttaacccttcgctgcccgtctagtgcgactctgaactgtagcggcttattagcatattcgctagtctagggattcgtctagggaacttgaggctggccttggtgatgaggacataactagctcggatataaccatgactaccttatgtattaatcaaccaaaggtgcatatgttctacattagatttacttgttatatatttgaacaaacgttgctacacaatgagttttgtgtgttttcgtttgcagaggtacttgcttggccgaaggaaaagagaccaagtataacgaatgcatggatgatcaaagaagttgattagggacaaaaccaagaccttctccaagtctacttctacctcaccatgtcacttttggtccatagaagacaagagatcaagttttacatgttttggattcggattcgggcctcctgacagcatcaacttcaaacggatctagccactgatctagaaggaatttcggggcccatgagtacttgttggaaagattatggagtctaattttagatggttttggttccacgtcaaatttcctatcgagctgccgggaatctgcaaaacaaaccacgtatgtcatctagtccgaatctgatttgagttttgggccttataattgtgtcgtgggcttagcctaagggggtgtgcaccctagggcaaccctaggacgtccctaatcatatttatttggtagccgtcatcgtttagactcgggttttgcttagattaatttgtcaagaacagtttcgtcgctagattagtttgtggaaccccaaattcgagtgcttaatcattcatatgcaattgtgttgcaatctatcttgttcttgcttgtgttctttgattcaaatgcagggattagccttctcggtgaggttaacctggtttcggcatggttgataaccagaggagacgtggtgctgcgattgcgggggctcagtaacgtgttcgttcagaaggcggatcgagttgtgtcgcgactccacccaaatcgactttttatcaatacctatcggaagatcgggacctaacatcctcatcaaatggtgtttgatatttcgacgctcttcagttgtgtgggacgatgacttgccgtggtacaaacagtatttgtccttcttgcatttctttcttggcggcaagccttgttctccccccttacttggcattgaagttttttttgaaggttctcgacttcttcgatagttgttataggcttgacttgtctgttcaaaatttttgccatgccattgggacctaagccggccttggttgacttccgcttgcttcttgttggaccgctttggcctgaactacagctttgtcatactgggcttatatttcgacctggcacttcgtatcctattcgcctcgcgtgtacctgtcaatgatatgaaaaaggtggccgatggtttggggtttctcccagtgattttccacgtccgttagcttggtcgaagccctgccgaacggcatttatgactgaaacttctgtgatgtcttggacttggcatcttgcttgcgaaaatcttcgcatatactcccttgtggattcgctaggtttttgtcgaattccgaacaggtcttgttgggtcttgggttcttcatacgtttttacggctgttaaataccaaatttatgccgtcaattaatacctgcataaatctaaaaatataaaacatccaacatagttgtagggtttatttctaacaaattccatgagtgttggtgtatatttggatgcaagtgataaactaccaaaattgagataaaggaggggaagaattacattcatatccaagccatggagttttgggcccacaaacccaacgaaataccagaaaatggacccaaccactatgccactggaccaaggacccacctgccagggcccaggagaaaacccagggccaggcaggggcggccgacccccaggcctgacccatctggccttcaattttcacatgccggtagttaccgactatccaaggcggttgtgaccgtttctaccggaagaaaccgccattgagggacacttggtagctcaagagagaagttgctcctttggatgcttagcatctccacactccgaaggcacctcttggcctataaatacccttctcctcactcattcgcaacacatcaagatgtgagctgaattataagaggctctttgtatacttttacgtatacttagaataagggagagagcgaggaataaagagttggaggagttccggaattgtcggtttctctatctctttcttttgtaccttagcaattactttgttttagttgagaatattttaattaagtaattgagattcatcttgtgtgatatacttcttagttagttcctatttagcttgctcgatcattgttcactattgttcattaagaaatagtgattacttcagtgtttagctaacgctagagtagtaattatttgcatagacatggtgtctaggtaattaattaccaatgtttgctgcgtatgctatagtattagagattggtgtagaggtggtgacagccctcgagatcaccgtagtcctccctatgcaggtacggagtagagcgcgttctggtagcacgagcaagccagtgcctgaaaaatagttataggattgaagttaagctttctaaacaaccatgtaccacattagaaaatcctctccaccctttggtctacatttatcttgtgtccttagatgaacctaaagaagaccaaatacacatgttccctgtggaaattcaataccttcgaatactacaaggtgaagtactacatcggtatatccgtacgcttgcggattttatctgtgaacgtaagaaataccaacagtacgtcccatgaaatttcattacgaagacatcccgcaactgctcccatgagtaaatgttgcttgggtgaatgttgaaataccacgatcgggcgaagctgtctaggacaagatgtgcgaccttcaccttggtgttctcgtccccgtggactgtttggatcgttgacttgtggaacggcaagatctcgcttggttctgatttgcccgaatatcttgttatagtttaatactcgaaatgtggtggaattgggtgatttcgcaacccccaactcaaaggcaacatcttttccaatgcttgttgtcggaacttgctgacattgtggcgaaagacttgggtaaaggtcgggtgaaggatgaagctattccttatgcttgcgcttgcggctggccttacaatgtagcttggaccagccaaagctccttgaaacatgggaggtggggtttgggcgggcggtcgaacaatcgtcgggtttaccgttggccaaaccaccaccccttgacttgctcctcctgcggtcagagccgcgcttggttgggtcgcttgctgcggtgattgtgtgtgtggctcacccgaacttagctgctggacctaagcttggaattgggcttggagggtcgaagcagcttcggccgtggattgggagggcgagatcagttgtgccaaaggctgtgttggtgcaaggcggacctgcacctgtgcaactgtgggtgatgccaaggcttgagtcgaaggtactaccataactttagtcgaaggggctgcctacggtgctttggtcggtaaaatggccgatacagcccaggcttgtatggccgcctcttgagtctgttgctgctgctgctgcatctgtcagagtatttcctatagccgtgtcatgtcttgcctcatggattcgtgcttcgtcctcggcactgtggacgctttgggctcaggttgctgacttccttcggctatggccaccaccgaagcttgggcctatgctgcctacgccgcttgggccgcatcgattcgggccccttcttcggcttcggccccagcttcaacttcggccttgtcctagtcttcatctttgtacctcctcgacactgctcttcccctcacggacttcctcttgggtgacatcagtttgaactgaggttccccatggtcggtgccagctgttgtcgatggacaaatgcgtctatcgaaggacagacttcacccaaaggttggaaagtaaagtggtaaaatgtcctgattttttaaaaattggatctccattacatgcccttggggtttatatatataacagcgagtttacgtgggtgcccttatgacaaggtcacttacaggggtaataacaatattttagctcagttacacggcccatgggcctagatatctcctccacgtagtgttgttgggccttcatgattgactggcctagtggctactgcatcggcttcagcttccacctcggggtgcttcgctgtctggcgatcctcttcgacgattgccacctgatcggcttcaacctccatgtcaaggtgcttcgctgtctggcgacccctttcgacggttgccggccgctggcctcctggctgtgcgcctgtgcggcactgtcttgatgcctcgacggctgatgtttcagcgggctcggtcgaccttcataggatgcctccaacaacttctatttttgaaaaatcgcagttttgtatcactaatatcgatcagaaactaaaggccctgcgacatgcgacatgcctgaacaggcccttctggaagaattcagctgcaaaagcaaaagcggagatgaagaactggttaagagcacataggaaaaaaattaaaggttagccgtgactgtgatcgtggcgttaattctagtacttcgtaggtaatatcctgaggtgcatgcgactctcactctcaaagcatccaattcctctcttctttttgagacagcatagcacattagcagatttgatgcaaagcctgagtactccccagagatgtcgatatctctctcgacctcttttactgtttatctgttttttccttcatccttgcagtaaaaacttgaaacctaccactgttgtcttggcagtgctgatcttgtttctgcaagtgattaatgtgctgtatatatcaagctctctcaccgcagaaagagaaacaaaggggcttgcaggacaccaggagggtgcaggacatggtacatacggcatgaaaagagctctgccagta

SEQ ID NO: 34103 - DNA, 5622 bp, Oryza sativa
cagtggatttgcgaagggggcggcgccgcgtccttcccccctccccctccgtcgctctccccaccaccacaccgccgcgtccttctcggcaacggcgccggggcggaaggtggccgaagcggggaggcggctctccctccctcctcgccgtcgcgcttcctccgtggcgctgatgagcaggggacctcgggggttgtggggggggggggtggcggaggacgactccgaggcgggcacggcggcggaggaccccgaagcgggcggcgacgaccccgaggttggcgcggcagcagacgcccccaaggacccagccacctcgagctccccctccaacgcggcagcgagctcatggtggtggcctcgccggtggccggagctctccctctcccctccgacgcccgtggcagcctctcccctctccccttcgacacccgcatcagcctctcccctatctcatccagcaccggcgcaaatcggggagacgggccacgaagcgcgaggccacagccgcacggccatgcccttctcccccgtccatttactgacgaagaatgcgtagccaagattggctacgcgaacctgggttggtcacgcagaaaacctagctagcagagaatctcctacgtggtaacagtaggtcgaatgccacataggaacactgtgaacgcccttaaaatccatacctttgtccattctcgtgcaacaaatatcgatcatgcacattcaattcaacagaacaaattttaggacaagaaatcaagtcatagatatatatacccgcgcaggaaaacttatagtacaaaatactgcaacctcctatggacaacaaatcattttgatatctctttgttattcagaaaatattgaagaacaagataagacttatttctccacccacaaactaaaaatagataaggtgaatctagtgggggatcataaccatgttcacgccattgcaattttattaagctcttgtactccctccattttttctaagggattttagcacgagactgtgctattttcattaaatatagcaggagaaaaatataacccctaagggcaaagaaaaaggagaactatacacaatgacgaggaggcctccttgtggtcaaagatcctccggttacgctcattccaaatttcctaaacgatgaggaggaatcaaggtacgcaggcccttctggggacgcccaccgaagcggccagtccctcccaccactcttggaccgtctgattctctccattttaaagcgcaagatttgttttattttattagaacggagacaatgaaatcctagtgtatcaccagaaatgatagagcctatagaatatcactcctcttcagaaagtaaggaattcgaactattgaaagaaacctccaataaaaccatacatcgataatatatgaggtcaaaaggaggctgggatgttatgacaaatacatccatggctctcgactacaaacgtggtacctttggtatttattactcccttcgggctgataatacttatcgttttagatacgggtcaggtcaaactttagaatctttgattatgaattagttttaaaatatttgtctttcaaatatggtgactacatgtatagattagtcttaaaaagtactttaacaaaatcatatatttgttaacacttttatatatatataataatggaaaataatggtcaaagttgtttatttagaccgtgccattgtccaaaacgacaggtattatcaacccggagggagtactatcacaaataaattcgtaagagcatggatatcgttgtagcatttcactcgggagtatttcaagagtattgttatttgtttctctgcaaggaaggcggcaatgtaaagaatgggccatcataatcataatcgtatgtagtatgatcaataatattgtagtctagctagggcaaatgacaatgataataaggtactgtgacacatcgaagaatcatttctataaataacaaaatagactaaggagaaagacaaaacataactatggtttcatatgtacttctatacttacaatgcttagattatactcaaacaaacacatgattatacaaggtttggagttggttctatgcacccagtggcgttatacaaggtttgcagttggttctatgcacctaggcgccgagagaccgctccttactagtctgctaatgtggttatggtattttatgaactcttaagtcatacccgaacatgaagtattacaaagtatggactaggctattaccgcacgttgcctacctctacggcccgtgaggcacgcacgcattcaacaacatttaatcaacccaagtaccatgcttgcattgctaaataatatgactagttccctggggacttctattctttggatggacaagtaagaactagtacaacccgttaagatcattggaccgatgtcgtgacatagatcgactagcctaaacatataaagcatatgatagaggtataaactactaatttacaaagcaatatatgaactatgaacaccaataactaaataagataatttcattactaggctcgaaatcttataaagatataaaagtactaaagatataccttaatctctgagaagactaggaaaccgaagaactactcttagtctaaactcaacttatctagatagtaatacaaatgagaaatacagagattgcttgttgagtgtgtgttgagagtgagagctttctcacattttatagctcccaaggatgattgcaaatgtcagtgaattaagtcggttcacccctaactgccatcaaggaccaaagtggagctggcacgtggaagacagagatgagacaggccagaactggtttggccgacccctggttctggtttgagccaatccagggccaccatctcttcaccgaccttctcccagagattgacatgtgggcccctagaatggcacatggtggattagccttacgtatgtcggtttagtctaaattgtagccttcaatccgtgtgcactctcgtgattggtcggatgtgtgtttctttgcacactgacttattttctccttcattttgtagaaaatccttgcatccatagtattttccgtggacaagtggaacaactatattatttaaaactaatatccgtgtaataaatgttcgttgtattttatttatttagataattgatggtctgagatcagtatttataatgaccgtcaacacactccacctaacaaaccagcaccatttggctgtcgatctctatggaaaaacactatttgagatccattgttaagctgtagattttgtataaggtccccggatttaaaaaaaaaatgtcagggattttcccttaaaatatgaaaaaacagggcaaatttcttgttgggtcccaggcaagaacccatagaccaatgggcaccatgttatatcttgcatgcatcctttttctcttttcactgtacaattaacagaagtgaataaatgatactgtatttaaataagaaccaataggtacagcttgggctagagttacttcattagtatgatctggaccaacttatctatacctaattttgcattgttgcaacacttccatacgggtttacataaggagtttgcattccaccttgacatcactgtcggagggtctttcatgcataaaaccccatctgaaggcaaggaaattcttggtcgtatgtcagaaaatacctccttcgttggacgatgctctgtacacctccctaaggcattagtgtcaggtcaggaggaaccctgtatagccaaactggaacccgaaccttccatataatcgggttcgactaagagtcctccctggagccatctccgaataccaaagaaattcaagctccgggttgcactcctgcattcagggatgatctttatgaagattatggaaacaccctgaattattccagcaaaaagaagcctcgtcccaagcataagacgttcgaggaggggatattggtatttcgttggtttcttctgaacccattgccattttaaagaaatgaagaccttcattgccctcataaaagcctaagccttgtccctctaatcctcagaacgttgttattgtttatcatcaagaaacaacctggttcttgcacgatgcatctcttgagaaggagaaccttcaggtcatgtacaagcttgagacatcgactctgaagggcgagagaaaacattccacaaatgagcattgaagtttttctttcaaaattctccaggattcatgctcgcatatggtatccccagagacctaccgcttctctgtgcgaggatcacaaccaccttacggtcctcatttttaatatatttagaagtgtggttgtggatgcttatatttatcataaatgctgcaaatctcatatttgtttgtggcactaatctagcatatcgatgtccacatggtcaagcttgtgaccataaacaaagcactatcgagagatagcccgaattactacggtaagtttcttttctaatgaaaataagaaccagtttttaggatagtatgcaccttccggtattcttggtcgctaactatttcaggttgatattaagaacgagggtcatgcaatgcctaagaacacggtaactatatcaactatacactttggtgatccttggtgttagaacacactttataagagactccaacattagacacttgagttttgatgtcttgcgacacaaaagtccaactgtggggtgttggtatttcttaacgacattacaagaaatataattcccagtaatggcgcagaaatactcctggtatattatggttacagagttcatctgcaagcgcacggatataccattgtagcatttcacccgagagtattccaacggtatcgtatttatttaatcccgggggaagattatagtagagagatcctgactaataatttatatgttacttgtaataatcatagtctaagcaggggttaagataaatctaagggtagagtgacacacaagcaggaagctactaattctcatactaaaatatctaagctaagtggaaagaaaaagagaaagagaatctattcctatagttctagtatacatagtatacatacatcctagttatctgacatactagctaataccctctatccgataccttcctggtacttcgagaagccacccctgactgccgagttccttacgacagcccatcatgaccatacaaccggggctaaatacggaggagtaccctccccaggaaattaacttaggactatatcacaagcggaggaatacccatactgagctgtcgccatcagcggcccacctctcatccgcagcatataaccccaaataatgatatcccgtaatctagacaccacgcctaaactacctgatactactctaatatcatcgtcatgacatagagtaattacataagcaaacactatacccataccaaagcatctcccagataaactagcagtataatcagtataacatgcacataatgtaaagttgacattcatatactcggaaagtattccaataccataaatgtataaagaagagtattccaataaaagtacaaagcttacaaaaagagaagataagagcaactagagccataccc
